United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 9

SEQ ID NO: 26444 - DNA, 557 bp, Artificial Sequence
  chemically treated genomic DNA (Homo sapiens) CpG-island No: 26444
ctaaccgacgcgtaactactactacacgactcgcgccgaactccccgaaaaacgaaaaaaatacgaataaaacgaaaaaaaaaaaacacgccgactacaacccgaacgaacgaaaaaacgcgcactcacctccacacaccgcgatcaaaaaaaaccaaaacaacaaaaacgcctacacgcaaaaccgcaaattcatactactccttaaaccgccgcgaccccgacgaaccgacgcgaaaaaaaaaaaatcgaacgcccgaaaaccaaaaaaaacgcgaaccgcgactaacgcgtacgaacgcaaaactcgaaaaactccccgaccgctaaatatacgcgctaaaccccgccgctcccgctaaccgcctccgctcttctacaacctcctctcccgccgcgaaacaacgccgcgaaactaacctcgacgactccgaaaacgacaacgacgaactctttcttaacgactaactactcgaccgcgactacaactacccgtaaccccgactaccaaaaaaaatactccccgctcactccaaaaactacattttataacttat

SEQ ID NO: 26445 - DNA, 981 bp, Artificial Sequence
  chemically treated genomic DNA (Homo sapiens) CpG-island No: 26445
tttttgttcgggtagtcgtcgtatttttttcgggtttttttcgattagttcgacggtagcgggcgaatgaggaagtcggtcgcggaggcggaaatcgggtcgggtgtaaggtttgtagcgggacggttcgattttgatttaggaggacgttttgatagttgttaaacggtgttcgttgttcgttattttcgtgttttagacgttagaaatttttacgggagcggttgtttcgggtttttaattcgtgaggttgcgttttaggggtcgcggttttcggaaggggttaaaaagtttgttcgagtcgggtttgggcgaggcgagggcggggcgcgtgttttagcggttgggggaggtcggttttagtgtttagttttgagatcgcgtcgggggatacggggggcgtcggggagcgtcgggtttcgaggtcgtttttgtatttttaggtttcgttgttgtcggcgtttttttcgagcgttcgcgtgggggtttcggtttttttgggaaggatgcggtgtcgggttttgagtcgtcggcgttcgttttcgttcgcgcgggtggcgggtcgtattgagtttaagaattattagtcggtttggcggtagcgcgtttcgttttcgttcgttcgtcgtcgtttgttcggggcgggatcgcggtggggttcgtttatttgaatttggatttgtttcgggaataggcgttgtttttttcgagaggattttttcgagcgttcgggcggcggtcgggtggggcgagcgtacgaggcgggagttgtagtaggttagttttgtttagtttttcgtgttttgtttaggaatcgcggtgatttgcgcgttttatcgtatttagttcggtttttcgtcgttttttcgtttcgttttcggagtcgcgggattatttttagtcgggagtcggtttcggggcggagtttggggtataatttcgttttttttttgttatatttattgtaggtcgcgtttggtt

SEQ ID NO: 26446 - DNA, 981 bp, Artificial Sequence
  chemically treated genomic DNA (Homo sapiens) CpG-island No: 26446
aaccaaacgcgacctacaataaatataacaaaaaaaaaacgaaattataccccaaactccgccccgaaaccgactcccgactaaaaataatcccgcgactccgaaaacgaaacgaaaaaacgacgaaaaaccgaactaaatacgataaaacgcgcaaatcaccgcgattcctaaacaaaacacgaaaaactaaacaaaactaacctactacaactcccgcctcgtacgctcgccccacccgaccgccgcccgaacgctcgaaaaaatcctctcgaaaaaaacaacgcctattcccgaaacaaatccaaattcaaataaacgaaccccaccgcgatcccgccccgaacaaacgacgacgaacgaacgaaaacgaaacgcgctaccgccaaaccgactaataattcttaaactcaatacgacccgccacccgcgcgaacgaaaacgaacgccgacgactcaaaacccgacaccgcatccttcccaaaaaaaccgaaacccccacgcgaacgctcgaaaaaaacgccgacaacaacgaaacctaaaaatacaaaaacgacctcgaaacccgacgctccccgacgccccccgtatcccccgacgcgatctcaaaactaaacactaaaaccgacctcccccaaccgctaaaacacgcgccccgccctcgcctcgcccaaacccgactcgaacaaactttttaaccccttccgaaaaccgcgacccctaaaacgcaacctcacgaattaaaaacccgaaacaaccgctcccgtaaaaatttctaacgtctaaaacacgaaaataacgaacaacgaacaccgtttaacaactatcaaaacgtcctcctaaatcaaaatcgaaccgtcccgctacaaaccttacacccgacccgatttccgcctccgcgaccgacttcctcattcgcccgctaccgtcgaactaatcgaaaaaaacccgaaaaaaatacgacgactacccgaacaaaaa

SEQ ID NO: 26447 - DNA, 981 bp, Artificial Sequence
  chemically treated genomic DNA (Homo sapiens) CpG-island No: 26447
ggttaggcgcggtttgtagtgggtgtagtaggaagggggcgggattgtgttttaggtttcgtttcggagtcggttttcggttgggaatggtttcgcggtttcgagggcggggcgggaaggcggcgaggagtcgagttgggtgcggtgaggcgcgtagattatcgcggtttttgggtagggtacggaaggttaagtaaggttgatttgttgtagttttcgtttcgtgcgttcgttttattcggtcgtcgttcgagcgttcgagaaagttttttcgggagaagtagcgtttgttttcggggtagatttaggtttaggtgagcgagttttatcgcggtttcgtttcgggtaggcggcggcgggcgggcgggggcgagacgcgttgtcgttaggtcgattggtggtttttgggtttagtgcggttcgttattcgcgcgggcgggggcgaacgtcggcggtttagggttcggtatcgtattttttttagggggatcgggatttttacgcgggcgttcggggagggcgtcggtagtagcgaggtttaggggtgtaggggcggtttcgggattcggcgtttttcggcgtttttcgtgtttttcggcgcggttttaggattgggtattggagtcgattttttttagtcgttggggtacgcgtttcgttttcgtttcgtttaggttcgattcgggtaaattttttaatttttttcgggagtcgcggtttttgggacgtagttttacgggttgggagttcggggtagtcgttttcgtggaagtttttggcgtttgaggtacggaggtaacgggtagcgggtatcgtttggtagttgttagggcgtttttttgagttagagtcggatcgtttcgttgtagattttgtattcggttcggttttcgttttcgcggtcgatttttttattcgttcgttgtcgtcggattggtcggggagggttcgggggaggtgcggcggttgttcggataaggg

SEQ ID NO: 26448 - DNA, 981 bp, Artificial Sequence
  chemically treated genomic DNA (Homo sapiens) CpG-island No: 26448
cccttatccgaacaaccgccgcacctcccccgaaccctccccgaccaatccgacgacaacgaacgaataaaaaaatcgaccgcgaaaacgaaaaccgaaccgaatacaaaatctacaacgaaacgatccgactctaactcaaaaaaacgccctaacaactaccaaacgatacccgctacccgttacctccgtacctcaaacgccaaaaacttccacgaaaacgactaccccgaactcccaacccgtaaaactacgtcccaaaaaccgcgactcccgaaaaaaattaaaaaatttacccgaatcgaacctaaacgaaacgaaaacgaaacgcgtaccccaacgactaaaaaaaatcgactccaatacccaatcctaaaaccgcgccgaaaaacacgaaaaacgccgaaaaacgccgaatcccgaaaccgcccctacacccctaaacctcgctactaccgacgccctccccgaacgcccgcgtaaaaatcccgatccccctaaaaaaaatacgataccgaaccctaaaccgccgacgttcgcccccgcccgcgcgaataacgaaccgcactaaacccaaaaaccaccaatcgacctaacgacaacgcgtctcgcccccgcccgcccgccgccgcctacccgaaacgaaaccgcgataaaactcgctcacctaaacctaaatctaccccgaaaacaaacgctacttctcccgaaaaaactttctcgaacgctcgaacgacgaccgaataaaacgaacgcacgaaacgaaaactacaacaaatcaaccttacttaaccttccgtaccctacccaaaaaccgcgataatctacgcgcctcaccgcacccaactcgactcctcgccgccttcccgccccgccctcgaaaccgcgaaaccattcccaaccgaaaaccgactccgaaacgaaacctaaaacacaatcccgcccccttcctactacacccactacaaaccgcgcctaacc

SEQ ID NO: 26449 - DNA, 1019 bp, Artificial Sequence
  chemically treated genomic DNA (Homo sapiens) CpG-island No: 26449
gggtggagggttttcggtgggtggcgcggcggcggtcgcggcggtgaagttatcgtggggagtggttcgtttgcggcgggtgcgggggtttcgcgggtatttagtggagtagcgggagttcggcgtcgtcgaggggcgggcgatggggcgtcggttcgttttggtaggggtgggtttcgtattggaggcggagttgttgttgggtggggcgcgttttcggcgcggacggaggcggcgggacgttcgtttttacgatcggtttataatgaggcgagcgggtagcgcggagtaggcggcggtcggtcgggtcgggttacgcggcggcgttgttcgggtaggttagggtagggtcgcggggcgttcgagcgaggatatcgcggtttcgttttcgttttttttttcgtttgtcggtcggcgttcgagttcggagtcgtagtcgtagtcggaaatcgggttcgcgcggcggtcgtcgtttcggttaagtcggggtttcgaagttagagtcggagtcgggcgggtcgcggggttatggttgggtcgcggggcgcgttgttggtttggtgtcgtcgttagtgcgagggttatcgcggcgtggagattcgcgatttgagtagtttttttcgggacggtttggttttttgcgttattttgtatcggtatcggttcgatttgttgtgagtgcggggtttcgggcgagcgggcggcgcggggcgggttggggtcgcgatcgtcgtttttttttagtaatacgaagttcgggcggtgataggcgtcgttttcggatacggagacgtcgattttttcgacggtttcggacgtcgggcgggtttttgagatttcggtttagggcgtttttttttcgttcggtcgttttgatttcgttcgtgggatttcgaattttttttcgaggttggttttttcgcggggatattggtttcgtttataaagcgttgattttcgtcgaggatcgttgaatttttaagtttttgatttttttgaaggggtgttgagtttttttt

SEQ ID NO: 26450 - DNA, 1019 bp, Artificial Sequence
  chemically treated genomic DNA (Homo sapiens) CpG-island No: 26450
aaaaaaaactcaacaccccttcaaaaaaatcaaaaacttaaaaattcaacgatcctcgacgaaaatcaacgctttataaacgaaaccaatatccccgcgaaaaaaccaacctcgaaaaaaaattcgaaatcccacgaacgaaatcaaaacgaccgaacgaaaaaaaaacgccctaaaccgaaatctcaaaaacccgcccgacgtccgaaaccgtcgaaaaaatcgacgtctccgtatccgaaaacgacgcctatcaccgcccgaacttcgtattactaaaaaaaaacgacgatcgcgaccccaacccgccccgcgccgcccgctcgcccgaaaccccgcactcacaacaaatcgaaccgataccgatacaaaataacgcaaaaaaccaaaccgtcccgaaaaaaactactcaaatcgcgaatctccacgccgcgataaccctcgcactaacgacgacaccaaaccaacaacgcgccccgcgacccaaccataaccccgcgacccgcccgactccgactctaacttcgaaaccccgacttaaccgaaacgacgaccgccgcgcgaacccgatttccgactacgactacgactccgaactcgaacgccgaccgacaaacgaaaaaaaaaacgaaaacgaaaccgcgatatcctcgctcgaacgccccgcgaccctaccctaacctacccgaacaacgccgccgcgtaacccgacccgaccgaccgccgcctactccgcgctacccgctcgcctcattataaaccgatcgtaaaaacgaacgtcccgccgcctccgtccgcgccgaaaacgcgccccacccaacaacaactccgcctccaatacgaaacccacccctaccaaaacgaaccgacgccccatcgcccgcccctcgacgacgccgaactcccgctactccactaaatacccgcgaaacccccgcacccgccgcaaacgaaccactccccacgataacttcaccgccgcgaccgccgccgcgccacccaccgaaaaccctccaccc

SEQ ID NO: 26451 - DNA, 1019 bp, Artificial Sequence
  chemically treated genomic DNA (Homo sapiens) CpG-island No: 26451
aaagagggtttaatatttttttaaagaggttaagggtttaggggtttagcgattttcggcggaaattagcgttttgtgggcggggttagtgttttcgcggagggattagtttcgggggagagttcgggattttacgggcggggttagggcggtcgggcgggggaggggcgttttgggtcggggttttagggattcgttcggcgttcggggtcgtcgggggggtcggcgttttcgtgttcgggggcggcgtttgttatcgttcgggtttcgtgttattgagggggggcggcggtcgcggttttagttcgtttcgcgtcgttcgttcgttcggggtttcgtatttatagtaggtcgggtcggtgtcggtgtaggatggcgtagaaggttaggtcgtttcggaaggagttgtttaggtcgcggatttttacgtcgcggtagttttcgtattggcggcggtattaggttagtagcgcgtttcgcggtttagttatgatttcgcggttcgttcggtttcggttttggtttcggggtttcggtttggtcgggacggcggtcgtcgcgcgggttcggttttcggttgcggttgcggtttcgagttcgggcgtcgatcggtaggcgaggggaggggcggaggcggggtcgcggtgttttcgttcgggcgtttcgcggttttgttttaatttgttcgagtagcgtcgtcgcgtggttcggttcggtcggtcgtcgtttatttcgcgttgttcgttcgttttattgtgggtcggtcgtgggagcgggcgtttcgtcgttttcgttcgcgtcggaggcgcgttttatttagtagtagtttcgtttttagtgcggagtttatttttattaagacgggtcggcgttttatcgttcgtttttcgacggcgtcgggttttcgttgttttattgggtgttcgcgaagttttcgtattcgtcgtaagcggattattttttacgatgattttatcgtcgcggtcgtcgtcgcgttatttatcgggagttttttattt

SEQ ID NO: 26452 - DNA, 1019 bp, Artificial Sequence
  chemically treated genomic DNA (Homo sapiens) CpG-island No: 26452
aaataaaaaactcccgataaataacgcgacgacgaccgcgacgataaaatcatcgtaaaaaataatccgcttacgacgaatacgaaaacttcgcgaacacccaataaaacaacgaaaacccgacgccgtcgaaaaacgaacgataaaacgccgacccgtcttaataaaaataaactccgcactaaaaacgaaactactactaaataaaacgcgcctccgacgcgaacgaaaacgacgaaacgcccgctcccacgaccgacccacaataaaacgaacgaacaacgcgaaataaacgacgaccgaccgaaccgaaccacgcgacgacgctactcgaacaaattaaaacaaaaccgcgaaacgcccgaacgaaaacaccgcgaccccgcctccgcccctcccctcgcctaccgatcgacgcccgaactcgaaaccgcaaccgcaaccgaaaaccgaacccgcgcgacgaccgccgtcccgaccaaaccgaaaccccgaaaccaaaaccgaaaccgaacgaaccgcgaaatcataactaaaccgcgaaacgcgctactaacctaataccgccgccaatacgaaaactaccgcgacgtaaaaatccgcgacctaaacaactccttccgaaacgacctaaccttctacgccatcctacaccgacaccgacccgacctactataaatacgaaaccccgaacgaacgaacgacgcgaaacgaactaaaaccgcgaccgccgccccccctcaataacacgaaacccgaacgataacaaacgccgcccccgaacacgaaaacgccgacccccccgacgaccccgaacgccgaacgaatccctaaaaccccgacccaaaacgcccctcccccgcccgaccgccctaaccccgcccgtaaaatcccgaactctcccccgaaactaatccctccgcgaaaacactaaccccgcccacaaaacgctaatttccgccgaaaatcgctaaacccctaaacccttaacctctttaaaaaaatattaaaccctcttt

SEQ ID NO: 26453 - DNA, 584 bp, Artificial Sequence
  chemically treated genomic DNA (Homo sapiens) CpG-island No: 26453
aatcggtttcggagggtcgtaggaatttatgaaatacgtcgtttatttgtaatggtttcggtcggtcgggatggtaatagatggtgcgtgtcggggatcgcgttagtagtagtatttttgagaaattaggaaaagaggaaatatgcgcgcgtagcgggcgtcgtcgtaaatacgatcggcgttgtcgtaaattgttttttcgttttttttgggttgggcggaagaatttacgagtcgtaaagcgaaggtttattcggaaattcgttattgcgtttcgttaggcgtttttattagttttcgaggcgtcgagacgcgagaggtgtgattggtattacgttaggcggtattcggggacgtttaaagagggcgtttattattgaaatttggcggtcgcgtaatcgaagttcgaggcggggagcgattggcgtttttttgtgttttataatgtttcgcggcgcgttttagtttttatgtattttatcgttattcgcgatttttcgtttgttttatttgtttgtttaatgtgaaatttagcgtaggggaggttcgtcggtgttttaggcggtttttattgttattttttt

SEQ ID NO: 26454 - DNA, 584 bp, Artificial Sequence
  chemically treated genomic DNA (Homo sapiens) CpG-island No: 26454
aaaaaaataacaataaaaaccgcctaaaacaccgacgaacctcccctacgctaaatttcacattaaacaaacaaataaaacaaacgaaaaatcgcgaataacgataaaatacataaaaactaaaacgcgccgcgaaacattataaaacacaaaaaaacgccaatcgctccccgcctcgaacttcgattacgcgaccgccaaatttcaataataaacgccctctttaaacgtccccgaataccgcctaacgtaataccaatcacacctctcgcgtctcgacgcctcgaaaactaataaaaacgcctaacgaaacgcaataacgaatttccgaataaaccttcgctttacgactcgtaaattcttccgcccaacccaaaaaaaacgaaaaaacaatttacgacaacgccgatcgtatttacgacgacgcccgctacgcgcgcatatttcctcttttcctaatttctcaaaaatactactactaacgcgatccccgacacgcaccatctattaccatcccgaccgaccgaaaccattacaaataaacgacgtatttcataaattcctacgaccctccgaaaccgatt

SEQ ID NO: 26455 - DNA, 584 bp, Artificial Sequence
  chemically treated genomic DNA (Homo sapiens) CpG-island No: 26455
ggaggagtaataataaggatcgtttaagatatcgacggattttttttgcgttgagttttatattaagtaggtaggtagaataggcggggagtcgcgggtgacggtgggatatatgggggttgaggcgcgtcgcgaagtattgtgggatatagaagggcgttagtcgtttttcgtttcgagtttcgattgcgcggtcgttaagttttagtgatgaacgttttttttgggcgttttcggatatcgtttgacgtagtgttaattatatttttcgcgtttcggcgtttcggaggttaatgaggacgtttggcgaaacgtagtaacggattttcgggtggattttcgttttacggttcgtgagttttttcgtttaatttagaggaagcgggagagtagtttacgatagcgtcggtcgtgtttacggcggcgttcgttgcgcgcgtatgttttttttttttttggttttttaagagtgttgttgttaacgcggttttcggtacgtattatttgttgttatttcggtcggtcgaggttattgtaggtgagcggcgtgttttataggtttttgcggtttttcggagtcggtt

SEQ ID NO: 26456 - DNA, 584 bp, Artificial Sequence
  chemically treated genomic DNA (Homo sapiens) CpG-island No: 26456
aaccgactccgaaaaaccgcaaaaacctataaaacacgccgctcacctacaataacctcgaccgaccgaaataacaacaaataatacgtaccgaaaaccgcgttaacaacaacactcttaaaaaaccaaaaaaaaaaaaaacatacgcgcgcaacgaacgccgccgtaaacacgaccgacgctatcgtaaactactctcccgcttcctctaaattaaacgaaaaaactcacgaaccgtaaaacgaaaatccacccgaaaatccgttactacgtttcgccaaacgtcctcattaacctccgaaacgccgaaacgcgaaaaatataattaacactacgtcaaacgatatccgaaaacgcccaaaaaaaacgttcatcactaaaacttaacgaccgcgcaatcgaaactcgaaacgaaaaacgactaacgcccttctatatcccacaatacttcgcgacgcgcctcaacccccatatatcccaccgtcacccgcgactccccgcctattctacctacctacttaatataaaactcaacgcaaaaaaaatccgtcgatatcttaaacgatccttattattactcctcc

SEQ ID NO: 26457 - DNA, 981 bp, Artificial Sequence
  chemically treated genomic DNA (Homo sapiens) CpG-island No: 26457
cgttgcgttttagggtacggtcggtttaggtcgtggtttattcgggattcgcggtttatcggtgcggttgacgcggtacgggaagcggtaggtgtttagtatttttttttcgttttgttcgtcgatgattcggtattggcgtagatacggcgtgagtttggtcgggtttagggcgcgagttagtcgatgtcggacgttttcgattcgtttttatagcgcgttttttttcgttttagatttcgagtcggtttcggtttttttttcggtttttttcgttttcgttcggttcggtatggtcgtgtttttagggtttgcgggtaagaggcgtacgggggtcgattagggttttttagggttagatgtgcggttaagtattttcggggcgtcgttcgtagattcgtcgtcgggggcgcgtttcgagtttttcgcgatttatttcgtacgttatagtcgtttcgggttttcgggttcgtattcgggcggcggtttcgtcggcgtaggggggcggtgttcgtggcgttttcggtttcgttttcgttttcgtagttttttgggttgttcgggtttttttatattgtcgttcgtttcgggtcgtgcgttcggttttcggttatttcgcgcgttcgtttgtacgttttttttttcggtcgttcggttgcgtttttttttgttttttgtttttcgtcggttttttagttcggttcggcggggttttggtcgttcgtttatatttgttcggtttttgggcggggcgggggcgggtaggcgcgtttatatttttcgcgcgtcgcgatatatttttttcgggttacgcgtatcgtttttttacgtttatagcgcgttcgttcgtgcggggttagtcgtttacgttcggcgtagttcgcgggtatttaagttgggtttgtttttttcgggtttttatatgtattgcgggcgcgggagtttttttggagcgtaggatagtttcgcgggggatagtaa

SEQ ID NO: 26458 - DNA, 981 bp, Artificial Sequence
  chemically treated genomic DNA (Homo sapiens) CpG-island No: 26458
ttactatcccccgcgaaactatcctacgctccaaaaaaactcccgcgcccgcaatacatataaaaacccgaaaaaaacaaacccaacttaaatacccgcgaactacgccgaacgtaaacgactaaccccgcacgaacgaacgcgctataaacgtaaaaaaacgatacgcgtaacccgaaaaaaatatatcgcgacgcgcgaaaaatataaacgcgcctacccgcccccgccccgcccaaaaaccgaacaaatataaacgaacgaccaaaaccccgccgaaccgaactaaaaaaccgacgaaaaacaaaaaacaaaaaaaaacgcaaccgaacgaccgaaaaaaaaaacgtacaaacgaacgcgcgaaataaccgaaaaccgaacgcacgacccgaaacgaacgacaatataaaaaaacccgaacaacccaaaaaactacgaaaacgaaaacgaaaccgaaaacgccacgaacaccgcccccctacgccgacgaaaccgccgcccgaatacgaacccgaaaacccgaaacgactataacgtacgaaataaatcgcgaaaaactcgaaacgcgcccccgacgacgaatctacgaacgacgccccgaaaatacttaaccgcacatctaaccctaaaaaaccctaatcgacccccgtacgcctcttacccgcaaaccctaaaaacacgaccataccgaaccgaacgaaaacgaaaaaaaccgaaaaaaaaaccgaaaccgactcgaaatctaaaacgaaaaaaaacgcgctataaaaacgaatcgaaaacgtccgacatcgactaactcgcgccctaaacccgaccaaactcacgccgtatctacgccaataccgaatcatcgacgaacaaaacgaaaaaaaaatactaaacacctaccgcttcccgtaccgcgtcaaccgcaccgataaaccgcgaatcccgaataaaccacgacctaaaccgaccgtaccctaaaacgcaacg

SEQ ID NO: 26459 - DNA, 981 bp, Artificial Sequence
  chemically treated genomic DNA (Homo sapiens) CpG-island No: 26459
ttgttgtttttcgcggggttgttttgcgttttagggaagttttcgcgttcgtagtgtatgtggggattcgagaagggtaagtttagtttgagtgttcgcgggttgcgtcgggcgtgagcggttagtttcgtacgggcgggcgcgttgtgggcgtggggaggcgatgcgcgtggttcggggaaggtgtgtcgcggcgcgcggggggtgtgagcgcgtttgttcgttttcgtttcgtttagaggtcgggtaggtgtgggcgggcggttaggatttcgtcgagtcgggttggagagtcggcgggaaataggaagtagggggaggcgtagtcggacggtcgggagggagggcgtgtagacggacgcgcggggtggtcgggggtcggacgtacgattcggggcgggcggtaatgtggggaggttcgggtagtttaggaggttgcggggacgggggcggagtcgggggcgttacgggtatcgtttttttgcgtcggcggagtcgtcgttcgagtgcggattcgggagttcgaggcgattgtagcgtgcggggtgagtcgcggggagttcggggcgcgttttcgacggcgggtttgcggacgacgtttcgggggtgtttggtcgtatatttagttttagggagttttggtcgattttcgtgcgttttttgttcgtagattttgaggatacggttatgtcgggtcgggcggaggcgggggaggtcgaggaggaggtcggggtcggttcggggtttgaggcggaggaggacgcgttgtgggagcgaatcgagggcgttcggtatcggttggttcgcgttttgaattcggttaagtttacgtcgtatttgcgttagtgtcgggttatcgacgagtaggacgaggaggaggtgttgagtatttatcgtttttcgtgtcgcgttaatcgtatcggtgagtcgcgggtttcgagtgggttacgatttgggtcggtcgtgttttggggcgtagcg

SEQ ID NO: 26460 - DNA, 981 bp, Artificial Sequence
  chemically treated genomic DNA (Homo sapiens) CpG-island No: 26460
cgctacgccccaaaacacgaccgacccaaatcgtaacccactcgaaacccgcgactcaccgatacgattaacgcgacacgaaaaacgataaatactcaacacctcctcctcgtcctactcgtcgataacccgacactaacgcaaatacgacgtaaacttaaccgaattcaaaacgcgaaccaaccgataccgaacgccctcgattcgctcccacaacgcgtcctcctccgcctcaaaccccgaaccgaccccgacctcctcctcgacctcccccgcctccgcccgacccgacataaccgtatcctcaaaatctacgaacaaaaaacgcacgaaaatcgaccaaaactccctaaaactaaatatacgaccaaacacccccgaaacgtcgtccgcaaacccgccgtcgaaaacgcgccccgaactccccgcgactcaccccgcacgctacaatcgcctcgaactcccgaatccgcactcgaacgacgactccgccgacgcaaaaaaacgatacccgtaacgcccccgactccgcccccgtccccgcaacctcctaaactacccgaacctccccacattaccgcccgccccgaatcgtacgtccgacccccgaccaccccgcgcgtccgtctacacgccctccctcccgaccgtccgactacgcctccccctacttcctatttcccgccgactctccaacccgactcgacgaaatcctaaccgcccgcccacacctacccgacctctaaacgaaacgaaaacgaacaaacgcgctcacaccccccgcgcgccgcgacacaccttccccgaaccacgcgcatcgcctccccacgcccacaacgcgcccgcccgtacgaaactaaccgctcacgcccgacgcaacccgcgaacactcaaactaaacttacccttctcgaatccccacatacactacgaacgcgaaaacttccctaaaacgcaaaacaaccccgcgaaaaacaacaa

SEQ ID NO: 26461 - DNA, 824 bp, Artificial Sequence
  chemically treated genomic DNA (Homo sapiens) CpG-island No: 26461
tcgttttttcggggtagttcgtacgtttttcggttggttttgttcggggtggcgagtagaggtttggtttggttttttagtcgcgtttttgttagttttcggcggtcgcgaggacggtgtcggggagggggtcggggagggggtcgggtttcgttcgcgggcgggaggagacgggcgggaggcgggagcgtttatatttcgttttcgttttcggatttagttcgcggagttcgcggttagggcggcgtagatcggtttagcgattttttcgggttgttagtcgggacgcgcggtcgtcgtcgttgtagacgacgagttcgttttcgtttcgcgttttcggggttcgcggagttaggtaatagttcgggcgcgcgggttttcggggcggaggtcgtggaggtcggcgggtttcggcgttcgcggggattttgtattttattaggttttcggggtcggaacggggacgggattcgttcgggagaggcgttttcgggtgtttataggaaggtcgggcgcggtcgcggagtcgcgcgaggaaatttcgagttttcgggtttcgtgtttcgttttaggttggtggagggggtagaggatcggatacggttgagcggttaaaatgcgcgaggagggggcgagtcgaggggtagagcgggggttgttttcgcgtttttttgcgcgggggaaggaagggtcggggcgggtagcgggcgacgcggcggaatgtttttttttcgtcgaggtttacgcggagagcgggaagtggggggtggggggttcggggagatggataggtattttgttttttttttcgatcgtcgtatttt

SEQ ID NO: 26462 - DNA, 824 bp, Artificial Sequence
  chemically treated genomic DNA (Homo sapiens) CpG-island No: 26462
aaaatacgacgatcgaaaaaaaaaacaaaatacctatccatctccccgaaccccccaccccccacttcccgctctccgcgtaaacctcgacgaaaaaaaaacattccgccgcgtcgcccgctacccgccccgacccttccttcccccgcgcaaaaaaacgcgaaaacaacccccgctctacccctcgactcgccccctcctcgcgcattttaaccgctcaaccgtatccgatcctctaccccctccaccaacctaaaacgaaacacgaaacccgaaaactcgaaatttcctcgcgcgactccgcgaccgcgcccgaccttcctataaacacccgaaaacgcctctcccgaacgaatcccgtccccgttccgaccccgaaaacctaataaaatacaaaatccccgcgaacgccgaaacccgccgacctccacgacctccgccccgaaaacccgcgcgcccgaactattacctaactccgcgaaccccgaaaacgcgaaacgaaaacgaactcgtcgtctacaacgacgacgaccgcgcgtcccgactaacaacccgaaaaaatcgctaaaccgatctacgccgccctaaccgcgaactccgcgaactaaatccgaaaacgaaaacgaaatataaacgctcccgcctcccgcccgtctcctcccgcccgcgaacgaaacccgaccccctccccgaccccctccccgacaccgtcctcgcgaccgccgaaaactaacaaaaacgcgactaaaaaaccaaaccaaacctctactcgccaccccgaacaaaaccaaccgaaaaacgtacgaactaccccgaaaaaacga

SEQ ID NO: 26463 - DNA, 824 bp, Artificial Sequence
  chemically treated genomic DNA (Homo sapiens) CpG-island No: 26463
ggaatgcggcggtcggggaggggggtagggtgtttgtttattttttcgggttttttattttttatttttcgtttttcgcgtgggtttcggcggaggggagatatttcgtcgcgtcgttcgttgttcgtttcggtttttttttttttcgcgtaggaaggcgcggagatagttttcgttttgtttttcggttcgtttttttttcgcgtattttggtcgtttagtcgtgttcgattttttgttttttttattagtttggaacgggatacgaagttcgaaagttcggagttttttcgcgcggtttcgcggtcgcgttcggtttttttgtgggtattcgggggcgtttttttcgggcgggtttcgttttcgtttcggtttcgggagtttagtagggtgtagagttttcgcgggcgtcgggattcgtcggtttttacggttttcgtttcgaggattcgcgcgttcgggttgttatttggtttcgcgagtttcgggggcgcgggacgagggcggattcgtcgtttgtagcggcggcggtcgcgcgtttcggttggtagttcgggagagtcgttgggtcggtttgcgtcgttttggtcgcgggtttcgcgggttggattcgggggcgggggcggggtgtgggcgttttcgtttttcgttcgttttttttcgttcgcgggcggggttcggtttttttttcggtttttttttcggtatcgttttcgcggtcgtcgagagttggtagggacgcggttggggggttaggttaggtttttgttcgttatttcggataaggttagtcggggaacgtgcgggttgtttcggggaggcga

SEQ ID NO: 26464 - DNA, 824 bp, Artificial Sequence
  chemically treated genomic DNA (Homo sapiens) CpG-island No: 26464
tcgcctccccgaaacaacccgcacgttccccgactaaccttatccgaaataacgaacaaaaacctaacctaaccccccaaccgcgtccctaccaactctcgacgaccgcgaaaacgataccgaaaaaaaaaccgaaaaaaaaaccgaaccccgcccgcgaacgaaaaaaaacgaacgaaaaacgaaaacgcccacaccccgcccccgcccccgaatccaacccgcgaaacccgcgaccaaaacgacgcaaaccgacccaacgactctcccgaactaccaaccgaaacgcgcgaccgccgccgctacaaacgacgaatccgccctcgtcccgcgcccccgaaactcgcgaaaccaaataacaacccgaacgcgcgaatcctcgaaacgaaaaccgtaaaaaccgacgaatcccgacgcccgcgaaaactctacaccctactaaactcccgaaaccgaaacgaaaacgaaacccgcccgaaaaaaacgcccccgaatacccacaaaaaaaccgaacgcgaccgcgaaaccgcgcgaaaaaactccgaactttcgaacttcgtatcccgttccaaactaataaaaaaaacaaaaaatcgaacacgactaaacgaccaaaatacgcgaaaaaaaaacgaaccgaaaaacaaaacgaaaactatctccgcgccttcctacgcgaaaaaaaaaaaaaccgaaacgaacaacgaacgacgcgacgaaatatctcccctccgccgaaacccacgcgaaaaacgaaaaataaaaaataaaaaacccgaaaaaataaacaaacaccctacccccctccccgaccgccgcattcc

SEQ ID NO: 26465 - DNA, 514 bp, Artificial Sequence
  chemically treated genomic DNA (Homo sapiens) CpG-island No: 26465
cgagttttttagtttgtcgtagagttagtcgttttgggtttcgggtattaatatttttattacgtttttagcggagaagcgtagtagcgtgtggttggcgtttttcgagtgggagattagggcgcggatttttttggcgttttcgtcgtcgttcgggcgttcgttaaaggagttggagcgcgagttttgggcgttgtcgttgtagagcgaggttgtgggcgggagagcgcggcggtacgtgggtaggaagttttttttggcgtttgttttcgattttttttgttgtagttttattttcgcgtttttttcggtttttttgtcgtttcggggcgggggtatttataggtcgacggcgtgcggggtagggagcgacggtttggttttagttgggacgcgggtttcgcgtcgggttcggtgtcgtaggagtcggagtcgtgtcggttgcggggggagttgaatttttttaggggtttcgggggttgcgggggagatgggtaggggagggtggggcggg

SEQ ID NO: 26466 - DNA, 514 bp, Artificial Sequence
  chemically treated genomic DNA (Homo sapiens) CpG-island No: 26466
cccgccccaccctcccctacccatctcccccgcaacccccgaaacccctaaaaaaattcaactccccccgcaaccgacacgactccgactcctacgacaccgaacccgacgcgaaacccgcgtcccaactaaaaccaaaccgtcgctccctaccccgcacgccgtcgacctataaatacccccgccccgaaacgacaaaaaaaccgaaaaaaacgcgaaaataaaactacaacaaaaaaaatcgaaaacaaacgccaaaaaaaacttcctacccacgtaccgccgcgctctcccgcccacaacctcgctctacaacgacaacgcccaaaactcgcgctccaactcctttaacgaacgcccgaacgacgacgaaaacgccaaaaaaatccgcgccctaatctcccactcgaaaaacgccaaccacacgctactacgcttctccgctaaaaacgtaataaaaatattaatacccgaaacccaaaacgactaactctacgacaaactaaaaaactcg

SEQ ID NO: 26467 - DNA, 514 bp, Artificial Sequence
  chemically treated genomic DNA (Homo sapiens) CpG-island No: 26467
ttcgttttatttttttttgtttatttttttcgtagttttcgaggtttttgggagagtttagtttttttcgtagtcggtacggtttcggtttttacggtatcgagttcgacgcgaggttcgcgttttagttagagttagatcgtcgttttttgtttcgtacgtcgtcggtttgtgagtgttttcgtttcggggcggtaggagggtcgggagaggcgcgggggtggggttgtagtaggagggatcgagggtagacgttaggaagaattttttgtttacgtgtcgtcgcgttttttcgtttatagtttcgttttatagcggtagcgtttaaagttcgcgttttaatttttttggcgagcgttcgggcggcggcgggggcgttaggagagttcgcgttttggttttttattcggagggcgttaattatacgttgttgcgttttttcgttggggacgtggtggaggtgttggtgttcgaggtttagaacggttggttttacggtaagttggagggttcg

SEQ ID NO: 26468 - DNA, 514 bp, Artificial Sequence
  chemically treated genomic DNA (Homo sapiens) CpG-island No: 26468
cgaaccctccaacttaccgtaaaaccaaccgttctaaacctcgaacaccaacacctccaccacgtccccaacgaaaaaacgcaacaacgtataattaacgccctccgaataaaaaaccaaaacgcgaactctcctaacgcccccgccgccgcccgaacgctcgccaaaaaaattaaaacgcgaactttaaacgctaccgctataaaacgaaactataaacgaaaaaacgcgacgacacgtaaacaaaaaattcttcctaacgtctaccctcgatccctcctactacaaccccacccccgcgcctctcccgaccctcctaccgccccgaaacgaaaacactcacaaaccgacgacgtacgaaacaaaaaacgacgatctaactctaactaaaacgcgaacctcgcgtcgaactcgataccgtaaaaaccgaaaccgtaccgactacgaaaaaaactaaactctcccaaaaacctcgaaaactacgaaaaaaataaacaaaaaaaaataaaacgaa

SEQ ID NO: 26469 - DNA, 918 bp, Artificial Sequence
  chemically treated genomic DNA (Homo sapiens) CpG-island No: 26469
ttttcgttgtaattttagtcggttttcggagtacgcgggtcggtcgcgcggtcgttggaaatagagtcgcgaatcggtttttcgggttaggttcgttttcgggttttaagttttaatttggtgttcggttcgggttatacgggtttagcgcgggttcggtttttggttttttacgggcgcgggtaggtgaggatcggtcggcgtcgttcgcgcgttttttttatcggttcgggacgcggcgttttcggggatggttcgggtagggacggcggggggattttcggtgcgcgttttaattcgtttttaattcgtttttaaggcggcggtggcgttcgtgtatttggtcgcggggtcgttcgggttattgtattagtagttcgcggtttcgggtcggttcgcgtttatttatttgcggcgggggtcgggtagtcgtatagcgttagtagtagcggttacggcggttcgggtagtgtagtttttatgttgtttagcggtcggacgggttggcgtcgcgtttattcgggttttatagcgcggcggcggcggttgcggcggtttttcgcgcgtgtttttgtattttcgtttttttcgttgggcgtcgcggattaggacgattgggaggagggagtagggcgcgcgtgagcggaagtagcgtcgcgttttcgtttttcgttgacgtagtcgttcgcgttttagggagtcggtcggcggtcgggcgggttttacggttttagcggttcgggttttcgcggttttttttcgcgtttttcgttttgttttgggggcgtcgtcgggaggttcggcgcggggttggggcgcggggttttcgtttcgcggggttcgggggtagatttgggttaggagttcggtgtgttatttgtggagtttttatgagtggggaaattgaggtacggggcg

SEQ ID NO: 26470 - DNA, 918 bp, Artificial Sequence
  chemically treated genomic DNA (Homo sapiens) CpG-island No: 26470
cgccccgtacctcaatttccccactcataaaaactccacaaataacacaccgaactcctaacccaaatctacccccgaaccccgcgaaacgaaaaccccgcgccccaaccccgcgccgaacctcccgacgacgcccccaaaacaaaacgaaaaacgcgaaaaaaaaccgcgaaaacccgaaccgctaaaaccgtaaaacccgcccgaccgccgaccgactccctaaaacgcgaacgactacgtcaacgaaaaacgaaaacgcgacgctacttccgctcacgcgcgccctactccctcctcccaatcgtcctaatccgcgacgcccaacgaaaaaaacgaaaatacaaaaacacgcgcgaaaaaccgccgcaaccgccgccgccgcgctataaaacccgaataaacgcgacgccaacccgtccgaccgctaaacaacataaaaactacactacccgaaccgccgtaaccgctactactaacgctatacgactacccgacccccgccgcaaataaataaacgcgaaccgacccgaaaccgcgaactactaatacaataacccgaacgaccccgcgaccaaatacacgaacgccaccgccgccttaaaaacgaattaaaaacgaattaaaacgcgcaccgaaaatccccccgccgtccctacccgaaccatccccgaaaacgccgcgtcccgaaccgataaaaaaaacgcgcgaacgacgccgaccgatcctcacctacccgcgcccgtaaaaaaccaaaaaccgaacccgcgctaaacccgtataacccgaaccgaacaccaaattaaaacttaaaacccgaaaacgaacctaacccgaaaaaccgattcgcgactctatttccaacgaccgcgcgaccgacccgcgtactccgaaaaccgactaaaattacaacgaaaa

SEQ ID NO: 26471 - DNA, 918 bp, Artificial Sequence
  chemically treated genomic DNA (Homo sapiens) CpG-island No: 26471
cgtttcgtgttttagtttttttatttatagaggttttataggtaatatatcgggtttttggtttagatttgttttcgggtttcgcggggcggaaatttcgcgttttagtttcgcgtcgagtttttcggcggcgtttttagggtagggcgaggagcgcggggaggggtcgcggggattcgggtcgttggggtcgtggggttcgttcggtcgtcggtcggttttttggggcgcgggcggttgcgttagcggggggcggagacgcggcgttgttttcgtttacgcgcgttttgttttttttttttagtcgttttggttcgcggcgtttaacggggaagacgaagatgtagggatacgcgcgaggagtcgtcgtagtcgtcgtcgtcgcgttgtggagttcgagtgagcgcggcgttagttcgttcggtcgttggataatatggaggttgtattgttcgggtcgtcgtggtcgttgttgttggcgttgtgcggttgttcggttttcgtcgtaggtaggtgggcgcgggtcgattcgggatcgcgggttgttagtataatggttcgggcggtttcgcgattaagtgtacgggcgttatcgtcgttttggaagcgagttgggggcgagttggggcgcgtatcggggattttttcgtcgtttttgttcgggttattttcggggacgtcgcgtttcgggtcggtgaggagggcgcgcgggcggcgtcggtcggtttttatttgttcgcgttcgtaggaagttaggagtcgagttcgcgttgggttcgtgtggttcgggtcgggtattaagttgggatttggggttcggaggcgggtttggttcgggaagtcggttcgcgattttgtttttagcggtcgcgcggtcggttcgcgtgtttcgaggatcggttgaggttgtagcgagaa

SEQ ID NO: 26472 - DNA, 918 bp, Artificial Sequence
  chemically treated genomic DNA (Homo sapiens) CpG-island No: 26472
ttctcgctacaacctcaaccgatcctcgaaacacgcgaaccgaccgcgcgaccgctaaaaacaaaatcgcgaaccgacttcccgaaccaaacccgcctccgaaccccaaatcccaacttaatacccgacccgaaccacacgaacccaacgcgaactcgactcctaacttcctacgaacgcgaacaaataaaaaccgaccgacgccgcccgcgcgccctcctcaccgacccgaaacgcgacgtccccgaaaataacccgaacaaaaacgacgaaaaaatccccgatacgcgccccaactcgcccccaactcgcttccaaaacgacgataacgcccgtacacttaatcgcgaaaccgcccgaaccattatactaacaacccgcgatcccgaatcgacccgcgcccacctacctacgacgaaaaccgaacaaccgcacaacgccaacaacaacgaccacgacgacccgaacaatacaacctccatattatccaacgaccgaacgaactaacgccgcgctcactcgaactccacaacgcgacgacgacgactacgacgactcctcgcgcgtatccctacatcttcgtcttccccgttaaacgccgcgaaccaaaacgactaaaaaaaaaaaacaaaacgcgcgtaaacgaaaacaacgccgcgtctccgccccccgctaacgcaaccgcccgcgccccaaaaaaccgaccgacgaccgaacgaaccccacgaccccaacgacccgaatccccgcgacccctccccgcgctcctcgccctaccctaaaaacgccgccgaaaaactcgacgcgaaactaaaacgcgaaatttccgccccgcgaaacccgaaaacaaatctaaaccaaaaacccgatatattacctataaaacctctataaataaaaaaactaaaacacgaaacg

SEQ ID NO: 26473 - DNA, 607 bp, Artificial Sequence
  chemically treated genomic DNA (Homo sapiens) CpG-island No: 26473
tttcgtagattttcgttgaaggagcggtgggcggcgcgtcgcgattttggcgggttatagattatatcgtttgtagggcgttgttggggcgcgtagagcggggttgttttagggtggtttttttaggttggggcgcggcgggcggcggtcgcgggcgcgcgttttattcgggtttcgagtaatcgttatcgtcgttgttaaagttcgttaatatggtggatttggaggtcgtggtggtcgatgttagttatttgatggttatggagaagagtaaggcgatttcggtcgattacgtttgtaagaggatcgttttgttcgaatttacgtattatttgtttcggttcgcgtcggttttcgacgtcgtcgttttttgcggtcgttagcgattttttgcgttcgggagaatcgggagttgagtcgtcgttgtttcggagcgggtgatatagcggagcgggcgatgcggggtcggttttttggttttagtttttgaaatggggtatcggagggcgggtggggggtatttcgggagagagcgttttaaagtgtttggcgtcgcgttttgcgcgtagttagtattttagtaaggggttggttatgatttggttgg

SEQ ID NO: 26474 - DNA, 607 bp, Artificial Sequence
  chemically treated genomic DNA (Homo sapiens) CpG-island No: 26474
ccaaccaaatcataaccaaccccttactaaaatactaactacgcgcaaaacgcgacgccaaacactttaaaacgctctctcccgaaataccccccacccgccctccgataccccatttcaaaaactaaaaccaaaaaaccgaccccgcatcgcccgctccgctatatcacccgctccgaaacaacgacgactcaactcccgattctcccgaacgcaaaaaatcgctaacgaccgcaaaaaacgacgacgtcgaaaaccgacgcgaaccgaaacaaataatacgtaaattcgaacaaaacgatcctcttacaaacgtaatcgaccgaaatcgccttactcttctccataaccatcaaataactaacatcgaccaccacgacctccaaatccaccatattaacgaactttaacaacgacgataacgattactcgaaacccgaataaaacgcgcgcccgcgaccgccgcccgccgcgccccaacctaaaaaaaccaccctaaaacaaccccgctctacgcgccccaacaacgccctacaaacgatataatctataacccgccaaaatcgcgacgcgccgcccaccgctccttcaacgaaaatctacgaaa

SEQ ID NO: 26475 - DNA, 607 bp, Artificial Sequence
  chemically treated genomic DNA (Homo sapiens) CpG-island No: 26475
ttagttaagttataattagttttttgttggggtgttagttgcgcgtagggcgcggcgttaggtattttggagcgttttttttcggagtgttttttattcgtttttcgatgttttattttagagattggagttaggaggtcggtttcgtatcgttcgtttcgttgtgttattcgtttcgggatagcgacggtttagttttcgattttttcggacgtagggggtcgttggcggtcgtagggggcggcggcgtcggggatcggcgcgggtcggggtaggtggtacgtgggttcgggtaggacggtttttttgtaggcgtggtcggtcggggtcgttttgtttttttttatggttattaggtaattgatatcggttattacggtttttaggtttattatgttggcgagttttggtagcggcggtggcggttattcgggattcggatgggacgcgcgttcgcggtcgtcgttcgtcgcgttttaatttgggggagttattttggggtagtttcgttttgcgcgttttagtagcgttttgtaagcggtgtaatttgtagttcgttagggtcgcggcgcgtcgtttatcgtttttttagcgagggtttgcgggg

SEQ ID NO: 26476 - DNA, 607 bp, Artificial Sequence
  chemically treated genomic DNA (Homo sapiens) CpG-island No: 26476
ccccgcaaaccctcgctaaaaaaacgataaacgacgcgccgcgaccctaacgaactacaaattacaccgcttacaaaacgctactaaaacgcgcaaaacgaaactaccccaaaataactcccccaaattaaaacgcgacgaacgacgaccgcgaacgcgcgtcccatccgaatcccgaataaccgccaccgccgctaccaaaactcgccaacataataaacctaaaaaccgtaataaccgatatcaattacctaataaccataaaaaaaaacaaaacgaccccgaccgaccacgcctacaaaaaaaccgtcctacccgaacccacgtaccacctaccccgacccgcgccgatccccgacgccgccgccccctacgaccgccaacgaccccctacgtccgaaaaaatcgaaaactaaaccgtcgctatcccgaaacgaataacacaacgaaacgaacgatacgaaaccgacctcctaactccaatctctaaaataaaacatcgaaaaacgaataaaaaacactccgaaaaaaaacgctccaaaatacctaacgccgcgccctacgcgcaactaacaccccaacaaaaaactaattataacttaactaa

SEQ ID NO: 26477 - DNA, 510 bp, Artificial Sequence
  chemically treated genomic DNA (Homo sapiens) CpG-island No: 26477
ggcggcggcggcggtggcggtagcgcgttttattcgggttcgagtaatcgtcgtcgtcgttaaaattcgttaacgtggcggattcggaggttgtgttggtagatgttagttatttgatggttatggagaagagtaaggcgatttcggtcgttcgcgttagtaagaggatcgttttgttcgattttaggtattagttgtttcggttcgcgttggtttttacgtcgtcgtttttaagcggtcgttagcgattttttgcgttcgggagggtcgggtattgagtcgtcgttgttttgggtgcgggtgatatcgcggaattggcgatgcggggtcggttttttcgttttagtttttgaaatggggtatcggatggtcggtgggggggatttcgggagagagcgttttaaagtgtttagcgcggcgttttgcgcgtagcgagcgttttagggaggggttggttatgatttggttggattagttttatttttgtcgtttttttttttcggttttgtt

SEQ ID NO: 26478 - DNA, 510 bp, Artificial Sequence
  chemically treated genomic DNA (Homo sapiens) CpG-island No: 26478
aacaaaaccgaaaaaaaaaaacgacaaaaataaaactaatccaaccaaatcataaccaacccctccctaaaacgctcgctacgcgcaaaacgccgcgctaaacactttaaaacgctctctcccgaaatcccccccaccgaccatccgataccccatttcaaaaactaaaacgaaaaaaccgaccccgcatcgccaattccgcgatatcacccgcacccaaaacaacgacgactcaatacccgaccctcccgaacgcaaaaaatcgctaacgaccgcttaaaaacgacgacgtaaaaaccaacgcgaaccgaaacaactaatacctaaaatcgaacaaaacgatcctcttactaacgcgaacgaccgaaatcgccttactcttctccataaccatcaaataactaacatctaccaacacaacctccgaatccgccacgttaacgaattttaacgacgacgacgattactcgaacccgaataaaacgcgctaccgccaccgccgccgccgcc

SEQ ID NO: 26479 - DNA, 510 bp, Artificial Sequence
  chemically treated genomic DNA (Homo sapiens) CpG-island No: 26479
gatagggtcggggggagggggcgatagggatggagttggtttagttaagttataattagtttttttttggggcgttcgttgcgcgtagggcgtcgcgttgggtattttggagcgttttttttcggagttttttttatcggttattcgatgttttattttagagattggaacggggaggtcggtttcgtatcgttagtttcgcggtgttattcgtatttaggatagcgacgatttaatgttcgattttttcggacgtaggaggtcgttgacggtcgtttggggacggcggcgtggggattagcgcgggtcggggtagttggtatttgggatcgggtaggacggtttttttgttggcgcgggcggtcggagtcgttttgtttttttttatggttattaggtaattggtatttgttagtatagttttcgggttcgttacgttggcgagttttggcggcggcggcggttattcggattcggatgggacgcgttgtcgttatcgtcgtcgtcgtt

SEQ ID NO: 26480 - DNA, 510 bp, Artificial Sequence
  chemically treated genomic DNA (Homo sapiens) CpG-island No: 26480
aacgacgacgacgataacgacaacgcgtcccatccgaatccgaataaccgccgccgccgccaaaactcgccaacgtaacgaacccgaaaactatactaacaaataccaattacctaataaccataaaaaaaaacaaaacgactccgaccgcccgcgccaacaaaaaaaccgtcctacccgatcccaaataccaactaccccgacccgcgctaatccccacgccgccgtccccaaacgaccgtcaacgacctcctacgtccgaaaaaatcgaacattaaatcgtcgctatcctaaatacgaataacaccgcgaaactaacgatacgaaaccgacctccccgttccaatctctaaaataaaacatcgaataaccgataaaaaaaactccgaaaaaaaacgctccaaaatacccaacgcgacgccctacgcgcaacgaacgccccaaaaaaaaactaattataacttaactaaaccaactccatccctatcgccccctccccccgaccctatc

SEQ ID NO: 26481 - DNA, 541 bp, Artificial Sequence
  chemically treated genomic DNA (Homo sapiens) CpG-island No: 26481
ttttcgcgaaggaggagggcgttggaatcgtggcgcgttcgatttggtcgggcgtaagtcgttggagatttcggtcgagtgggtaggcggtcggattttatgcgggttatttgcggttaggtcgggcgtgcgtgtgagcgcgtgcgtagacgttagttttcgaggttcgggtcgttttttgggtaaggtgcgcgcgtttagcggtttcggttttacgcgttcggatacgcggaatcgtagatcgcggcgtttcggaggtcgcgaaagggatgggcggggtcgggtcgcgggattcgttttttattggtcgggcgtcggggcgaggcggggcgtcggggtggggcggggcgagcgggttttggggggtagacgttggcgttgggcggcgggaggcgcggttcgcggggggtcgaaggagtaggtgggcgacgttcgtaggggcgcgggagggtgtcgttgggatcgttattaggagtttggggttttgttatttttcggagggattagcgattttttcgttttgcgggtgatagtggggtat

SEQ ID NO: 26482 - DNA, 541 bp, Artificial Sequence
  chemically treated genomic DNA (Homo sapiens) CpG-island No: 26482
ataccccactatcacccgcaaaacgaaaaaatcgctaatccctccgaaaaataacaaaaccccaaactcctaataacgatcccaacgacaccctcccgcgcccctacgaacgtcgcccacctactccttcgaccccccgcgaaccgcgcctcccgccgcccaacgccaacgtctaccccccaaaacccgctcgccccgccccaccccgacgccccgcctcgccccgacgcccgaccaataaaaaacgaatcccgcgacccgaccccgcccatccctttcgcgacctccgaaacgccgcgatctacgattccgcgtatccgaacgcgtaaaaccgaaaccgctaaacgcgcgcaccttacccaaaaaacgacccgaacctcgaaaactaacgtctacgcacgcgctcacacgcacgcccgacctaaccgcaaataacccgcataaaatccgaccgcctacccactcgaccgaaatctccaacgacttacgcccgaccaaatcgaacgcgccacgattccaacgccctcctccttcgcgaaaa

SEQ ID NO: 26483 - DNA, 541 bp, Artificial Sequence
  chemically treated genomic DNA (Homo sapiens) CpG-island No: 26483
atgttttattgttattcgtagggcgaagaggtcgttgattttttcgaaaggtggtagaattttaggtttttgatgacggttttagcggtattttttcgcgtttttgcgagcgtcgtttatttgttttttcggtttttcgcgagtcgcgtttttcgtcgtttagcgttagcgtttgttttttagagttcgttcgtttcgttttatttcggcgtttcgtttcgtttcggcgttcggttaatgggaggcgggtttcgcggttcggtttcgtttatttttttcgcggttttcggggcgtcgcggtttgcggtttcgcgtgttcgggcgcgtggggtcggggtcgttgggcgcgcgtattttgtttagaaggcggttcgggtttcggaggttgacgtttgcgtacgcgtttatacgtacgttcggtttggtcgtaggtgattcgtatggggttcggtcgtttgtttattcggtcggggtttttagcggtttgcgttcggttaggtcgagcgcgttacggttttagcgtttttttttttcgcggaag

SEQ ID NO: 26484 - DNA, 541 bp, Artificial Sequence
  chemically treated genomic DNA (Homo sapiens) CpG-island No: 26484
cttccgcgaaaaaaaaaaacgctaaaaccgtaacgcgctcgacctaaccgaacgcaaaccgctaaaaaccccgaccgaataaacaaacgaccgaaccccatacgaatcacctacgaccaaaccgaacgtacgtataaacgcgtacgcaaacgtcaacctccgaaacccgaaccgccttctaaacaaaatacgcgcgcccaacgaccccgaccccacgcgcccgaacacgcgaaaccgcaaaccgcgacgccccgaaaaccgcgaaaaaaataaacgaaaccgaaccgcgaaacccgcctcccattaaccgaacgccgaaacgaaacgaaacgccgaaataaaacgaaacgaacgaactctaaaaaacaaacgctaacgctaaacgacgaaaaacgcgactcgcgaaaaaccgaaaaaacaaataaacgacgctcgcaaaaacgcgaaaaaataccgctaaaaccgtcatcaaaaacctaaaattctaccacctttcgaaaaaatcaacgacctcttcgccctacgaataacaataaaacat

SEQ ID NO: 26485 - DNA, 662 bp, Artificial Sequence
  chemically treated genomic DNA (Homo sapiens) CpG-island No: 26485
agcgtacgtcggcggggtgcggggataggggtttttcgaggtttttcgcgttttttacgtcgcgagggagtgatattagaggttttcgtggatcgattacgtagtaaagttaggtatcgggcgtgtatgcgcggggagtttggttttttttcgggtggaagttcggtaagtattaattttttttaaatttatttaggtagtcggagttgtagaaggagcgtacggaggtcgtgttttagtagtcgcgtttttttatttttcgcggcggggtagtttttaatcggcggggcgttatatggcgtcgggtttcgggggtttgtacggacgcgtgtatagttcggtgggtcgttcggcggaggcggcggatattcgtgggtttcggcgtcgcgttattataatgtattattgtcgttcgttattcggtatatgagcgcgttaatttcgttcgcgtcgcgggagtcgagtttagtttgagcggcggtgttgtttattattttttttcgttttaggagcgcggtttcgtttcgcgcgtcgtttgttggttcgtgcgatttcgcggacgtttatgtaggttttttattttaatgttatattttaatgcgaaaattcgagcgaaagtgttgttttttgtagtaataagttcggcgttgttttattttaaa

SEQ ID NO: 26486 - DNA, 662 bp, Artificial Sequence
  chemically treated genomic DNA (Homo sapiens) CpG-island No: 26486
tttaaaataaaacaacgccgaacttattactacaaaaaacaacactttcgctcgaattttcgcattaaaatataacattaaaataaaaaacctacataaacgtccgcgaaatcgcacgaaccaacaaacgacgcgcgaaacgaaaccgcgctcctaaaacgaaaaaaaataataaacaacaccgccgctcaaactaaactcgactcccgcgacgcgaacgaaattaacgcgctcatataccgaataacgaacgacaataatacattataataacgcgacgccgaaacccacgaatatccgccgcctccgccgaacgacccaccgaactatacacgcgtccgtacaaacccccgaaacccgacgccatataacgccccgccgattaaaaactaccccgccgcgaaaaataaaaaaacgcgactactaaaacacgacctccgtacgctccttctacaactccgactacctaaataaatttaaaaaaaattaatacttaccgaacttccacccgaaaaaaaaccaaactccccgcgcatacacgcccgatacctaactttactacgtaatcgatccacgaaaacctctaatatcactccctcgcgacgtaaaaaacgcgaaaaacctcgaaaaacccctatccccgcaccccgccgacgtacgct

SEQ ID NO: 26487 - DNA, 662 bp, Artificial Sequence
  chemically treated genomic DNA (Homo sapiens) CpG-island No: 26487
tttgagataaagtaacgtcgagtttgttgttgtaggggatagtattttcgttcggattttcgtattaaaatgtgatattgaagtggggagtttgtatgggcgttcgcggggtcgtacggattagtaggcgacgcgcgggacgaggtcgcgtttttggggcgggaggaagtggtaggtagtatcgtcgtttaggttgggttcggttttcgcggcgcggacggggttaacgcgtttatgtatcgggtggcgggcggtagtggtgtattgtggtaacgcggcgtcgggatttacgagtgttcgtcgttttcgtcgggcggtttatcgagttgtgtacgcgttcgtgtaagttttcgggattcggcgttatgtagcgtttcgtcgattggaggttgtttcgtcgcgggaaatgaagggacgcggttgttgggatacggttttcgtgcgttttttttgtagtttcggttgtttgaataaatttaagaagggttagtgtttgtcgggtttttattcggagggaggttaggtttttcgcgtatgtacgttcggtgtttggttttgttgcgtgatcgatttacgggagtttttgatgttattttttcgcggcgtggggagcgcggggagtttcggggaatttttgttttcgtatttcgtcggcgtgcgtt

SEQ ID NO: 26488 - DNA, 662 bp, Artificial Sequence
  chemically treated genomic DNA (Homo sapiens) CpG-island No: 26488
aacgcacgccgacgaaatacgaaaacaaaaattccccgaaactccccgcgctccccacgccgcgaaaaaataacatcaaaaactcccgtaaatcgatcacgcaacaaaaccaaacaccgaacgtacatacgcgaaaaacctaacctccctccgaataaaaacccgacaaacactaacccttcttaaatttattcaaacaaccgaaactacaaaaaaaacgcacgaaaaccgtatcccaacaaccgcgtcccttcatttcccgcgacgaaacaacctccaatcgacgaaacgctacataacgccgaatcccgaaaacttacacgaacgcgtacacaactcgataaaccgcccgacgaaaacgacgaacactcgtaaatcccgacgccgcgttaccacaatacaccactaccgcccgccacccgatacataaacgcgttaaccccgtccgcgccgcgaaaaccgaacccaacctaaacgacgatactacctaccacttcctcccgccccaaaaacgcgacctcgtcccgcgcgtcgcctactaatccgtacgaccccgcgaacgcccatacaaactccccacttcaatatcacattttaatacgaaaatccgaacgaaaatactatcccctacaacaacaaactcgacgttactttatctcaaa

SEQ ID NO: 26489 - DNA, 644 bp, Artificial Sequence
  chemically treated genomic DNA (Homo sapiens) CpG-island No: 26489
gtcgtcgtcgttttttcgtcgtcgcgtttttagtttatttgggtgtagtgtcggttgttatcgttttttcgagtttgggaggagggcggtttcgggattgggtgtgtgttgttcggcggtttcgggttcgtttttttgtcgcgggcgtcgttttagtatcgcggatagcgtttagttcgcgagtttagagagtagtcggatttagaggagtcgtgcgttcgtttcgttcgttcgttcgttagtttgagcgttgtaagggcgcgtcgtgttgcgtttttatttttttagttttttttttatcgttcgaggaggtttttttcgttttttggagtattgttcggagagcgatgagagtcgcgcgaggttatcgatcggttttcggaggattcggtacgttttagttagttttgttttaggttgggattagtttttttttttcgtttagagggttagataaaggcgagtttttcgtggcgggacgtaggcgggtagcggaaggcgtattttagttttttaaaatgttcgagcgtggtttggaattcgatacgatattaagggcgttatcgcgttttaatcgaggttggagagggtcggttttttgtttggatttagtaggggaggggttttcggatggtttacggttt

SEQ ID NO: 26490 - DNA, 644 bp, Artificial Sequence
  chemically treated genomic DNA (Homo sapiens) CpG-island No: 26490
aaaccgtaaaccatccgaaaacccctcccctactaaatccaaacaaaaaaccgaccctctccaacctcgattaaaacgcgataacgcccttaatatcgtatcgaattccaaaccacgctcgaacattttaaaaaactaaaatacgccttccgctacccgcctacgtcccgccacgaaaaactcgcctttatctaaccctctaaacgaaaaaaaaaaactaatcccaacctaaaacaaaactaactaaaacgtaccgaatcctccgaaaaccgatcgataacctcgcgcgactctcatcgctctccgaacaatactccaaaaaacgaaaaaaacctcctcgaacgataaaaaaaaaactaaaaaaataaaaacgcaacacgacgcgcccttacaacgctcaaactaacgaacgaacgaacgaaacgaacgcacgactcctctaaatccgactactctctaaactcgcgaactaaacgctatccgcgatactaaaacgacgcccgcgacaaaaaaacgaacccgaaaccgccgaacaacacacacccaatcccgaaaccgccctcctcccaaactcgaaaaaacgataacaaccgacactacacccaaataaactaaaaacgcgacgacgaaaaaacgacgacgac

SEQ ID NO: 26491 - DNA, 644 bp, Artificial Sequence
  chemically treated genomic DNA (Homo sapiens) CpG-island No: 26491
gagtcgtggattattcgagggttttttttttgttgggtttaggtaaagggtcggttttttttagtttcgattggggcgcgatagcgtttttagtgtcgtgtcgggttttaggttacgttcgggtattttaagaggttgaggtgcgtttttcgttgttcgtttgcgtttcgttacggagagttcgtttttatttagttttttgggcgagagaagaaggttaattttagtttgggataaggttggttgaggcgtgtcggatttttcggggatcgatcggtggtttcgcgcggtttttatcgtttttcgagtagtgttttagggggcggagggagttttttcgggcggtggggaggaggttggaggaatgaggacgtagtacggcgcgtttttgtagcgtttaggttgacgggcgggcgggcggagcgggcgtacggtttttttaggttcggttgttttttgagttcgcgggttggacgttgttcgcggtgttgaagcggcgttcgcggtagggaggcggattcggagtcgtcgggtagtatatatttaatttcgggatcgttttttttttaggttcggagaggcggtggtagtcggtattgtatttagatggattgagagcgcggcggcgggaaggcggcggcggt

SEQ ID NO: 26492 - DNA, 644 bp, Artificial Sequence
  chemically treated genomic DNA (Homo sapiens) CpG-island No: 26492
accgccgccgccttcccgccgccgcgctctcaatccatctaaatacaataccgactaccaccgcctctccgaacctaaaaaaaaaacgatcccgaaattaaatatatactacccgacgactccgaatccgcctccctaccgcgaacgccgcttcaacaccgcgaacaacgtccaacccgcgaactcaaaaaacaaccgaacctaaaaaaaccgtacgcccgctccgcccgcccgcccgtcaacctaaacgctacaaaaacgcgccgtactacgtcctcattcctccaacctcctccccaccgcccgaaaaaactccctccgccccctaaaacactactcgaaaaacgataaaaaccgcgcgaaaccaccgatcgatccccgaaaaatccgacacgcctcaaccaaccttatcccaaactaaaattaaccttcttctctcgcccaaaaaactaaataaaaacgaactctccgtaacgaaacgcaaacgaacaacgaaaaacgcacctcaacctcttaaaatacccgaacgtaacctaaaacccgacacgacactaaaaacgctatcgcgccccaatcgaaactaaaaaaaaccgaccctttacctaaacccaacaaaaaaaaaaccctcgaataatccacgactc

SEQ ID NO: 26493 - DNA, 673 bp, Artificial Sequence
  chemically treated genomic DNA (Homo sapiens) CpG-island No: 26493
acgggcgagggcgttggggttattttcgtcgacgttaggcgtgagttttagaattcgtttttaatcgttcggtttcgtgagcgcggggagtttggttttcgtttgataataaagaaattattacggatagaaggaaagaggagcgaggttgggaagggagcggttttaattcggggttcgttttttttaattttttagcgtagcggtttcgaaagtggggtggggacggggattgaggttgagttcgttttttttttgtttttcgggtttcgcgtttttgaagcgaattgggtttggaggggtgttggggatcgagggagcggcgttggtgggtgatcgagggaaaggtggggttagtttttgggtatcggtcggaggaggattacgaggcggagtcgttgtttgttcgcgttttattcgtttggtttatttaatagtttcgttgtagattcgcggcggtaggagcggcgggttagatggtgattataattcggggcgttatttttttggaatttgatttttaatttcgtttagtaatcggattttcggaagtcgcgatttcgaagtttttagcgtttttttatcgacggcggggtcggggtttttggaagtttcggagtcgtagttttagtttgtagcgtacgttttggtttttagggagtagagaggtaga

SEQ ID NO: 26494 - DNA, 673 bp, Artificial Sequence
  chemically treated genomic DNA (Homo sapiens) CpG-island No: 26494
tctacctctctactccctaaaaaccaaaacgtacgctacaaactaaaactacgactccgaaacttccaaaaaccccgaccccgccgtcgataaaaaaacgctaaaaacttcgaaatcgcgacttccgaaaatccgattactaaacgaaattaaaaatcaaattccaaaaaaataacgccccgaattataatcaccatctaacccgccgctcctaccgccgcgaatctacaacgaaactattaaataaaccaaacgaataaaacgcgaacaaacaacgactccgcctcgtaatcctcctccgaccgatacccaaaaactaaccccacctttccctcgatcacccaccaacgccgctccctcgatccccaacacccctccaaacccaattcgcttcaaaaacgcgaaacccgaaaaacaaaaaaaaaacgaactcaacctcaatccccgtccccaccccactttcgaaaccgctacgctaaaaaattaaaaaaaacgaaccccgaattaaaaccgctcccttcccaacctcgctcctctttccttctatccgtaataatttctttattatcaaacgaaaaccaaactccccgcgctcacgaaaccgaacgattaaaaacgaattctaaaactcacgcctaacgtcgacgaaaataaccccaacgccctcgcccgt

SEQ ID NO: 26495 - DNA, 673 bp, Artificial Sequence
  chemically treated genomic DNA (Homo sapiens) CpG-island No: 26495
tttgtttttttgttttttgggggttaaggcgtgcgttgtaggttggagttgcggtttcgaggtttttaggagtttcggtttcgtcgtcggtggagaaacgttgggggtttcgaggtcgcggttttcggaaattcggttattgagcggagttgggggttaggttttaaagggatagcgtttcgggttgtaattattatttggttcgtcgtttttgtcgtcgcgagtttatagcggagttattgggtggattaagcgggtgaggcgcgggtaggtagcggtttcgtttcgtaattttttttcgatcggtgtttaggggttggttttatttttttttcggttatttattaacgtcgttttttcgatttttagtatttttttaggtttagttcgttttagaggcgcgagattcggaaaataaggaagaagcgagtttagttttaattttcgtttttattttattttcggggtcgttgcgttggagaattgaagggggcggatttcggattaaagtcgttttttttttagtttcgtttttttttttttttgttcgtgatgatttttttattgttaggcgagagttaggtttttcgcgtttacgggatcgggcggttgggagcgggttttggagtttacgtttggcgtcggcggaggtgattttagcgttttcgttcgt

SEQ ID NO: 26496 - DNA, 673 bp, Artificial Sequence
  chemically treated genomic DNA (Homo sapiens) CpG-island No: 26496
acgaacgaaaacgctaaaatcacctccgccgacgccaaacgtaaactccaaaacccgctcccaaccgcccgatcccgtaaacgcgaaaaacctaactctcgcctaacaataaaaaaatcatcacgaacaaaaaaaaaaaaaaacgaaactaaaaaaaaaacgactttaatccgaaatccgcccccttcaattctccaacgcaacgaccccgaaaataaaataaaaacgaaaattaaaactaaactcgcttcttccttattttccgaatctcgcgcctctaaaacgaactaaacctaaaaaaatactaaaaatcgaaaaaacgacgttaataaataaccgaaaaaaaaataaaaccaacccctaaacaccgatcgaaaaaaaattacgaaacgaaaccgctacctacccgcgcctcacccgcttaatccacccaataactccgctataaactcgcgacgacaaaaacgacgaaccaaataataattacaacccgaaacgctatccctttaaaacctaacccccaactccgctcaataaccgaatttccgaaaaccgcgacctcgaaacccccaacgtttctccaccgacgacgaaaccgaaactcctaaaaacctcgaaaccgcaactccaacctacaacgcacgccttaacccccaaaaaacaaaaaaacaaa

SEQ ID NO: 26497 - DNA, 575 bp, Artificial Sequence
  chemically treated genomic DNA (Homo sapiens) CpG-island No: 26497
aatgtgttttttttcggtttttgtattatattaattaatcggcgttaggtcgtagagtcgttttggttttcggcgagaatttaggcgagcgcggcgtacgttgtttcggagttttatcgcggaagttgaggtcgcggatttcgagggcggggtggagaggaatttggaaggatttggattcggtggaacgtattgcgcggacggcgtttgcgttcgtatttagttgtttagttttttttttttaggtttttttttgaaagtcgtttttatgtcggttttttttttttgtttttttgttttttttcggcgagttagcgcgattgtgaattttcgttttcggcggtgtttatgttgatttgaggagtcgcggttgcgagtaggttcggtgttgcgggttggggtaggcggcggtggggtttttggttttggggtattgggaagatcgcgagtcgtgcgtgtgggaaggttttttttcggtttttcgggttatttttgttttcgaggagcggtatattttttatttggcggaggtgttttggggtagttgggtgagtgacgtgatgaatttttgtaga

SEQ ID NO: 26498 - DNA, 575 bp, Artificial Sequence
  chemically treated genomic DNA (Homo sapiens) CpG-island No: 26498
tctacaaaaattcatcacgtcactcacccaactaccccaaaacacctccgccaaataaaaaatataccgctcctcgaaaacaaaaataacccgaaaaaccgaaaaaaaaccttcccacacgcacgactcgcgatcttcccaataccccaaaaccaaaaaccccaccgccgcctaccccaacccgcaacaccgaacctactcgcaaccgcgactcctcaaatcaacataaacaccgccgaaaacgaaaattcacaatcgcgctaactcgccgaaaaaaaacaaaaaaacaaaaaaaaaaaaccgacataaaaacgactttcaaaaaaaaacctaaaaaaaaaaaactaaacaactaaatacgaacgcaaacgccgtccgcgcaatacgttccaccgaatccaaatccttccaaattcctctccaccccgccctcgaaatccgcgacctcaacttccgcgataaaactccgaaacaacgtacgccgcgctcgcctaaattctcgccgaaaaccaaaacgactctacgacctaacgccgattaattaatataatacaaaaaccgaaaaaaaacacatt

SEQ ID NO: 26499 - DNA, 575 bp, Artificial Sequence
  chemically treated genomic DNA (Homo sapiens) CpG-island No: 26499
tttgtagggatttattacgttatttatttaattattttaggatattttcgttagatgagaaatatgtcgtttttcgggagtaaagatgattcggaggatcgggggaggatttttttatacgtacgattcgcgatttttttagtgttttagaattagggattttatcgtcgtttattttaattcgtagtatcgaatttgttcgtagtcgcgattttttaggttagtatggatatcgtcggaaacggaaatttatagtcgcgttgattcgtcggagggaaataagaaggtagaaaaaagagatcggtatggggacggtttttaggggagagtttgaagaaagagggttgaatagttgagtgcggacgtaggcgtcgttcgcgtagtgcgttttatcgggtttaggtttttttagatttttttttatttcgttttcggaattcgcggttttaattttcgcggtgggatttcggagtagcgtgcgtcgcgttcgtttgagttttcgtcgaaggttagggcggttttgcggtttggcgtcggttagttagtgtggtgtaaaagtcggaaggagatatatt

SEQ ID NO: 26500 - DNA, 575 bp, Artificial Sequence
  chemically treated genomic DNA (Homo sapiens) CpG-island No: 26500
aatatatctccttccgacttttacaccacactaactaaccgacgccaaaccgcaaaaccgccctaaccttcgacgaaaactcaaacgaacgcgacgcacgctactccgaaatcccaccgcgaaaattaaaaccgcgaattccgaaaacgaaataaaaaaaaatctaaaaaaacctaaacccgataaaacgcactacgcgaacgacgcctacgtccgcactcaactattcaaccctctttcttcaaactctcccctaaaaaccgtccccataccgatctcttttttctaccttcttatttccctccgacgaatcaacgcgactataaatttccgtttccgacgatatccatactaacctaaaaaatcgcgactacgaacaaattcgatactacgaattaaaataaacgacgataaaatccctaattctaaaacactaaaaaaatcgcgaatcgtacgtataaaaaaatcctcccccgatcctccgaatcatctttactcccgaaaaacgacatatttctcatctaacgaaaatatcctaaaataattaaataaataacgtaataaatccctacaaa

SEQ ID NO: 26501 - DNA, 1495 bp, Artificial Sequence
  chemically treated genomic DNA (Homo sapiens) CpG-island No: 26501
ttcgtttttgagaaatggcgtagtaagcgtttcgcggagagtttggaggcggggcgtttttttttgagttcgcggggtcgtatttcgagttagtcggttagatttgtatttcgcgtagtatttttgttttttttgtgtagcggaaagggtaaaaggtagggattgtaagcgggcgcgtatcgggtaggaagagaggttttgcgtaggtgcgcggattcgggtttttgggttttattttcgtcgcgtatttcggggttcgtattcggtttttgtcgggtttttttcggtcgtatttcgttttcgtatttcgtttttttttaagttttattcggtttaagtcgcgcgtttcgtattgagtttttatacgcgtcgcgtttcggtcgtatttcgcgtagttagagtaagtattggagtttcgttttttttcgtattttattcgttttcggtttcgtttggtttatttttggatcgttttcgtttcgtttcgtttttattcgttttttcggcgtagtcggcgtttatttcgttttagtttcgcgatcgaagtagggcgcgtagtagcgttgagtgtttcggaacgtgcgtcgcgtttttagtgttcgtcgcgttcgtcgcgtttcgggcggggatggggcggttagattgagcgtcgtattcgttatttagattcgtcggttttagtcgtagtttttttagtcgtggttttagcgcgtacgggcgatggcgaaggcgacgttcggtgtcgcggggttgcgtttgttgttgttgttgttgttgtcgttgttaggtaaaggtgagttttgtcggtcgtcggttttcgtaggggttagggcgaagttggcgtcgagtagcggagcgggcgcgtttagaagcgtttttttgtttgtcgtgggtagcgggttgtgcggtcgtcggttattcggtttcggttgggagcgtagtggttgcggcgggcggcgggcgaagggtaggacgtttcgggtcgggcgtttcgggtcggggttgggcgggtttcgggcgggagcggagcgcgggtcgggtcgcgggggtcggtgtttagaattttagttatagtcgtaggttttaatttggtcgcgttttgcgttaaagtcgcgttttggagtaaacgggatagtcgtttcggggtcgatttggcggacgggttagggagtttcgaaagttcgcgattcgtgcggagagttttgtttcggtaggagacggtttcgttttggtttttttttttcgtttagcgttcgtgcgttttttttttagttttgtcgttttggttagtcgagggattcggaggtttttttgaaaagattgtttttttttcgtgcgtttttgtcgttttgtttttaaatatttaaaaatcgtggtttttggggtggtttttttcgaggggtcgtcgtgataggcgttttattcggtagttttggagtcgtgtggcgttgtttggtagagatgttgaagatgcggttataggaggtttagggtt

SEQ ID NO: 26502 - DNA, 1495 bp, Artificial Sequence
  chemically treated genomic DNA (Homo sapiens) CpG-island No: 26502
aaccctaaacctcctataaccgcatcttcaacatctctaccaaacaacgccacacgactccaaaactaccgaataaaacgcctatcacgacgacccctcgaaaaaaaccaccccaaaaaccacgatttttaaatatttaaaaacaaaacgacaaaaacgcacgaaaaaaaaacaatcttttcaaaaaaacctccgaatccctcgactaaccaaaacgacaaaactaaaaaaaaaacgcacgaacgctaaacgaaaaaaaaaaaccaaaacgaaaccgtctcctaccgaaacaaaactctccgcacgaatcgcgaactttcgaaactccctaacccgtccgccaaatcgaccccgaaacgactatcccgtttactccaaaacgcgactttaacgcaaaacgcgaccaaattaaaacctacgactataactaaaattctaaacaccgacccccgcgacccgacccgcgctccgctcccgcccgaaacccgcccaaccccgacccgaaacgcccgacccgaaacgtcctacccttcgcccgccgcccgccgcaaccactacgctcccaaccgaaaccgaataaccgacgaccgcacaacccgctacccacgacaaacaaaaaaacgcttctaaacgcgcccgctccgctactcgacgccaacttcgccctaacccctacgaaaaccgacgaccgacaaaactcacctttacctaacaacgacaacaacaacaacaacaacaaacgcaaccccgcgacaccgaacgtcgccttcgccatcgcccgtacgcgctaaaaccacgactaaaaaaactacgactaaaaccgacgaatctaaataacgaatacgacgctcaatctaaccgccccatccccgcccgaaacgcgacgaacgcgacgaacactaaaaacgcgacgcacgttccgaaacactcaacgctactacgcgccctacttcgatcgcgaaactaaaacgaaataaacgccgactacgccgaaaaaacgaataaaaacgaaacgaaacgaaaacgatccaaaaataaaccaaacgaaaccgaaaacgaataaaatacgaaaaaaaacgaaactccaatacttactctaactacgcgaaatacgaccgaaacgcgacgcgtataaaaactcaatacgaaacgcgcgacttaaaccgaataaaacttaaaaaaaaacgaaatacgaaaacgaaatacgaccgaaaaaaacccgacaaaaaccgaatacgaaccccgaaatacgcgacgaaaataaaacccaaaaacccgaatccgcgcacctacgcaaaacctctcttcctacccgatacgcgcccgcttacaatccctaccttttaccctttccgctacacaaaaaaaacaaaaatactacgcgaaatacaaatctaaccgactaactcgaaatacgaccccgcgaactcaaaaaaaaacgccccgcctccaaactctccgcgaaacgcttactacgccatttctcaaaaacgaa

SEQ ID NO: 26503 - DNA, 1495 bp, Artificial Sequence
  chemically treated genomic DNA (Homo sapiens) CpG-island No: 26503
agttttgggttttttatggtcgtatttttagtatttttgttaggtagcgttatacgattttagggttgtcgggtgggacgtttattacggcggtttttcggggggagttattttagaaattacggtttttaggtgtttaaagatagggcggtaaaaacgtacgagggaaaagtaatttttttaaaagagttttcgaatttttcggttggttaggacggtagagttgggggaggaacgtacggacgttgagcgggaaaaggaaattaggacggagtcgttttttgtcgaaatagaatttttcgtacgaatcgcgggttttcggggttttttgattcgttcgttaggtcggtttcgaaacggttgtttcgtttgttttaggacgcggttttggcgtagggcgcggttagattgagatttgcggttatggttagggttttgagtatcgattttcgcggttcggttcgcgtttcgttttcgttcgagattcgtttagtttcggttcgaggcgttcggttcgaggcgttttgtttttcgttcgtcgttcgtcgtagttattgcgtttttagtcgaggtcgggtggtcggcgatcgtatagttcgttgtttacggtaaatagaaaggcgtttttgaacgcgttcgtttcgttgttcggcgttaatttcgttttggtttttgcgggagtcggcggtcggtagaatttatttttgtttagtagcggtagtagtagtagtaatagtagacgtagtttcgcggtatcggacgtcgttttcgttatcgttcgtgcgcgttggggttacggttggagggattgcggttagggtcggcgggtttggatggcgggtacggcgtttagtttggtcgttttattttcgttcggggcgcggcggacgcgacggatattgggggcgcgacgtacgtttcggggtatttagcgttgttgcgcgttttgtttcggtcgcgggattgaagcgaggtaagcgtcggttgcgtcggaggagcgggtaggggcggggcggggcgggggcggtttaggggtgggttaggcggggtcggaggcgggtggggtgcgggaaggggcggggttttagtgtttgttttggttgcgcggggtgcggtcggggcgcggcgcgtgtaggagtttagtgcgggacgcgcggtttgggtcgggtggggtttggggaggagcggggtgcgggagcggggtgcggtcgaaaagggttcggtaggagtcgggtgcggatttcgaggtgcgcggcggggatggaatttaggagttcgggttcgcgtatttacgtagagtttttttttttattcggtgcgcgttcgtttgtagtttttgttttttgtttttttcgttgtatagagagggtagggatgttacgcgggatgtaggtttggtcgattggttcggggtgcgatttcgcggatttagagaagggcgtttcgtttttaggtttttcgcggagcgtttgttgcgttattttttagaggcgag

SEQ ID NO: 26504 - DNA, 1495 bp, Artificial Sequence
  chemically treated genomic DNA (Homo sapiens) CpG-island No: 26504
ctcgcctctaaaaaataacgcaacaaacgctccgcgaaaaacctaaaaacgaaacgcccttctctaaatccgcgaaatcgcaccccgaaccaatcgaccaaacctacatcccgcgtaacatccctaccctctctatacaacgaaaaaaacaaaaaacaaaaactacaaacgaacgcgcaccgaataaaaaaaaaaactctacgtaaatacgcgaacccgaactcctaaattccatccccgccgcgcacctcgaaatccgcacccgactcctaccgaacccttttcgaccgcaccccgctcccgcaccccgctcctccccaaaccccacccgacccaaaccgcgcgtcccgcactaaactcctacacgcgccgcgccccgaccgcaccccgcgcaaccaaaacaaacactaaaaccccgccccttcccgcaccccacccgcctccgaccccgcctaacccacccctaaaccgcccccgccccgccccgcccctacccgctcctccgacgcaaccgacgcttacctcgcttcaatcccgcgaccgaaacaaaacgcgcaacaacgctaaataccccgaaacgtacgtcgcgcccccaatatccgtcgcgtccgccgcgccccgaacgaaaataaaacgaccaaactaaacgccgtacccgccatccaaacccgccgaccctaaccgcaatccctccaaccgtaaccccaacgcgcacgaacgataacgaaaacgacgtccgataccgcgaaactacgtctactattactactactactaccgctactaaacaaaaataaattctaccgaccgccgactcccgcaaaaaccaaaacgaaattaacgccgaacaacgaaacgaacgcgttcaaaaacgcctttctatttaccgtaaacaacgaactatacgatcgccgaccacccgacctcgactaaaaacgcaataactacgacgaacgacgaacgaaaaacaaaacgcctcgaaccgaacgcctcgaaccgaaactaaacgaatctcgaacgaaaacgaaacgcgaaccgaaccgcgaaaatcgatactcaaaaccctaaccataaccgcaaatctcaatctaaccgcgccctacgccaaaaccgcgtcctaaaacaaacgaaacaaccgtttcgaaaccgacctaacgaacgaatcaaaaaaccccgaaaacccgcgattcgtacgaaaaattctatttcgacaaaaaacgactccgtcctaatttccttttcccgctcaacgtccgtacgttcctcccccaactctaccgtcctaaccaaccgaaaaattcgaaaactcttttaaaaaaattacttttccctcgtacgtttttaccgccctatctttaaacacctaaaaaccgtaatttctaaaataactccccccgaaaaaccgccgtaataaacgtcccacccgacaaccctaaaatcgtataacgctacctaacaaaaatactaaaaatacgaccataaaaaacccaaaact

SEQ ID NO: 26505 - DNA, 743 bp, Artificial Sequence
  chemically treated genomic DNA (Homo sapiens) CpG-island No: 26505
aatttttttagggaaatgtagtgatgcgtttacggttgtcggcggtttagcgttaaggggcgttttatagtttcgcggttcgaagttttcgattcggttgttacgtaggtttcgcggtttcgttcggatttttaggatcggttttcgagcgggatagcgttgtagtttacgagttcgggtaggggcgtttttaggtcggagcggttttttgtttcgggtattttgttgtttttataaacggtttttggaggtatatatacggatattttaaatacgtcggtgatgaatcggtatttagttgttagtggcggagttttttgggcggggtcgcgggcgcgcggcggttttattttttcgcgcgcgtcggaagtggttttttaggcgcggcggcgcgttcgggggtgggtggttgaggcggcggcgggtttaaggcgtgaggcgtcgttcgggtgttttcgcggcgtaggaggcggtggagcgtagagcgggcgagcgcggtgagtatttggttcggtttcgttcgtcggttcgcgattttcgtcggtttcggttcgggcggtgcgggcgtcggggttgcgggtttttgtgtggtcgggtggggtcgtttagcggatcggttttgcggggggttttgttttttagggatgagtttgtcggagtcggtatcggttttagggaaagcgcggttagagacgattggttcgtttgttagtgttgggttttgttttgtttcgttttgtttt

SEQ ID NO: 26506 - DNA, 743 bp, Artificial Sequence
  chemically treated genomic DNA (Homo sapiens) CpG-island No: 26506
aaaacaaaacgaaacaaaacaaaacccaacactaacaaacgaaccaatcgtctctaaccgcgctttccctaaaaccgataccgactccgacaaactcatccctaaaaaacaaaaccccccgcaaaaccgatccgctaaacgaccccacccgaccacacaaaaacccgcaaccccgacgcccgcaccgcccgaaccgaaaccgacgaaaatcgcgaaccgacgaacgaaaccgaaccaaatactcaccgcgctcgcccgctctacgctccaccgcctcctacgccgcgaaaacacccgaacgacgcctcacgccttaaacccgccgccgcctcaaccacccacccccgaacgcgccgccgcgcctaaaaaaccacttccgacgcgcgcgaaaaaataaaaccgccgcgcgcccgcgaccccgcccaaaaaactccgccactaacaactaaataccgattcatcaccgacgtatttaaaatatccgtatatatacctccaaaaaccgtttataaaaacaacaaaatacccgaaacaaaaaaccgctccgacctaaaaacgcccctacccgaactcgtaaactacaacgctatcccgctcgaaaaccgatcctaaaaatccgaacgaaaccgcgaaacctacgtaacaaccgaatcgaaaacttcgaaccgcgaaactataaaacgccccttaacgctaaaccgccgacaaccgtaaacgcatcactacatttccctaaaaaaatt

SEQ ID NO: 26507 - DNA, 743 bp, Artificial Sequence
  chemically treated genomic DNA (Homo sapiens) CpG-island No: 26507
aaaataaaacgaaataaaataaaatttaatattgataagcgaattaatcgtttttggtcgcgttttttttaaaatcggtgtcgatttcggtaggtttatttttgagagatagggtttttcgtaggatcggttcgttaggcgattttattcgattatataggagttcgtagtttcggcgttcgtatcgttcgggtcggagtcggcgggagtcgcggatcggcgggcgaggtcgggttaggtatttatcgcgttcgttcgttttgcgttttatcgttttttgcgtcgcggggatattcgggcggcgttttacgttttgggttcgtcgtcgttttagttatttattttcgggcgcgtcgtcgcgtttgagaggttattttcggcgcgcgcgaggaaatgaagtcgtcgcgcgttcgcggtttcgtttaggaagtttcgttattggtagttgggtatcgatttattatcgacgtgtttaaagtattcgtgtgtgtgtttttaaaaatcgtttgtggagatagtagagtgttcgaggtaggaaatcgtttcggtttggaggcgtttttgttcggattcgtggattgtagcgttgtttcgttcggaagtcgattttgggagttcgagcggggtcgcggggtttgcgtggtagtcgagtcgagggtttcgggtcgcggggttgtggagcgttttttggcgttgggtcgtcggtagtcgtgagcgtattattgtatttttttggaggaatt

SEQ ID NO: 26508 - DNA, 743 bp, Artificial Sequence
  chemically treated genomic DNA (Homo sapiens) CpG-island No: 26508
aattcctccaaaaaaatacaataatacgctcacgactaccgacgacccaacgccaaaaaacgctccacaaccccgcgacccgaaaccctcgactcgactaccacgcaaaccccgcgaccccgctcgaactcccaaaatcgacttccgaacgaaacaacgctacaatccacgaatccgaacaaaaacgcctccaaaccgaaacgatttcctacctcgaacactctactatctccacaaacgatttttaaaaacacacacacgaatactttaaacacgtcgataataaatcgatacccaactaccaataacgaaacttcctaaacgaaaccgcgaacgcgcgacgacttcatttcctcgcgcgcgccgaaaataacctctcaaacgcgacgacgcgcccgaaaataaataactaaaacgacgacgaacccaaaacgtaaaacgccgcccgaatatccccgcgacgcaaaaaacgataaaacgcaaaacgaacgaacgcgataaatacctaacccgacctcgcccgccgatccgcgactcccgccgactccgacccgaacgatacgaacgccgaaactacgaactcctatataatcgaataaaatcgcctaacgaaccgatcctacgaaaaaccctatctctcaaaaataaacctaccgaaatcgacaccgattttaaaaaaaacgcgaccaaaaacgattaattcgcttatcaatattaaattttattttatttcgttttatttt

SEQ ID NO: 26509 - DNA, 666 bp, Artificial Sequence
  chemically treated genomic DNA (Homo sapiens) CpG-island No: 26509
cggttttcggtttttttttgcgggttaacggtagcgttacgcgcgcgagcgcggtttgtaaagtttttagcgttgggcgttacgcggggattgttgtcgtcgttgttagtcgtagtagcgacgcgaattcggggcgttcggttcgggcgcgcgggggcggggacgcgtacgcggcgagggcggcgggtgcgacgggggcggggacgggggcggggacgggggcgaagggggcggggacgggggcgtttcggtttaagcgggattaggagggcgcgttattcgttttcgttgttcgtcggggaatttttcgggttggcgcgtagggaagttttcgaacgcgcgggtataaaagggtagtcggcgttcgcgcgttatagttttgtagttcgtggtagcggcgtagcgttttagttatgtcgcgcggtttttagtttttgtttttgagttgcggtagggttcgcgagcgtttgtttcgtttgtcgtttttcgtttttttacgatattttttttcgtcggtcgtttgtttacgacgcgtttttttttttttgtagtttatagtttggttttcgcgacgtcggaggtgaaggtggtttgtttcgaagatgtggatttgttttgtatcgttttttgggattcgtaggttttttatacggttttttgggttaa

SEQ ID NO: 26510 - DNA, 666 bp, Artificial Sequence
  chemically treated genomic DNA (Homo sapiens) CpG-island No: 26510
ttaacccaaaaaaccgtataaaaaacctacgaatcccaaaaaacgatacaaaacaaatccacatcttcgaaacaaaccaccttcacctccgacgtcgcgaaaaccaaactataaactacaaaaaaaaaaaaacgcgtcgtaaacaaacgaccgacgaaaaaaaatatcgtaaaaaaacgaaaaacgacaaacgaaacaaacgctcgcgaaccctaccgcaactcaaaaacaaaaactaaaaaccgcgcgacataactaaaacgctacgccgctaccacgaactacaaaactataacgcgcgaacgccgactacccttttatacccgcgcgttcgaaaacttccctacgcgccaacccgaaaaattccccgacgaacaacgaaaacgaataacgcgccctcctaatcccgcttaaaccgaaacgcccccgtccccgcccccttcgcccccgtccccgcccccgtccccgcccccgtcgcacccgccgccctcgccgcgtacgcgtccccgcccccgcgcgcccgaaccgaacgccccgaattcgcgtcgctactacgactaacaacgacgacaacaatccccgcgtaacgcccaacgctaaaaactttacaaaccgcgctcgcgcgcgtaacgctaccgttaacccgcaaaaaaaaaccgaaaaccg

SEQ ID NO: 26511 - DNA, 666 bp, Artificial Sequence
  chemically treated genomic DNA (Homo sapiens) CpG-island No: 26511
ttgatttaggagatcgtgtagggaatttgcggattttagggggcggtgtagggtaagtttatattttcggagtaagttatttttattttcggcgtcgcgggagttaggttgtaggttataagaaagagagagcgcgtcgtgagtaagcgatcgacgggagggggtgtcgtggaggggcggggggcgataggcgagataggcgttcgcgagttttatcgtagtttaggagtagaagttggaggtcgcgcgatatggttggagcgttgcgtcgttgttacgagttgtagagttgtggcgcgcgggcgtcggttgtttttttatgttcgcgcgttcgggaatttttttgcgcgttagttcgggggatttttcggcgggtagcggaagcgggtggcgcgtttttttagtttcgtttaggtcggggcgttttcgttttcgtttttttcgttttcgttttcgttttcgttttcgttttcgtcgtattcgtcgttttcgtcgcgtgcgcgttttcgttttcgcgcgttcgggtcgggcgtttcgagttcgcgtcgttgttgcggttggtagcggcgatagtaattttcgcgtgacgtttagcgttgggggttttgtagatcgcgttcgcgcgcgtgacgttgtcgttgattcgtaaaaggaagtcgggaatcg

SEQ ID NO: 26512 - DNA, 666 bp, Artificial Sequence
  chemically treated genomic DNA (Homo sapiens) CpG-island No: 26512
cgattcccgacttccttttacgaatcaacgacaacgtcacgcgcgcgaacgcgatctacaaaacccccaacgctaaacgtcacgcgaaaattactatcgccgctaccaaccgcaacaacgacgcgaactcgaaacgcccgacccgaacgcgcgaaaacgaaaacgcgcacgcgacgaaaacgacgaatacgacgaaaacgaaaacgaaaacgaaaacgaaaacgaaaaaaacgaaaacgaaaacgccccgacctaaacgaaactaaaaaaacgcgccacccgcttccgctacccgccgaaaaatcccccgaactaacgcgcaaaaaaattcccgaacgcgcgaacataaaaaaacaaccgacgcccgcgcgccacaactctacaactcgtaacaacgacgcaacgctccaaccatatcgcgcgacctccaacttctactcctaaactacgataaaactcgcgaacgcctatctcgcctatcgccccccgcccctccacgacaccccctcccgtcgatcgcttactcacgacgcgctctctctttcttataacctacaacctaactcccgcgacgccgaaaataaaaataacttactccgaaaatataaacttaccctacaccgccccctaaaatccgcaaattccctacacgatctcctaaatcaa

SEQ ID NO: 26513 - DNA, 817 bp, Artificial Sequence
  chemically treated genomic DNA (Homo sapiens) CpG-island No: 26513
cgtttttatagcgtcgtttttatgggttttcgtttttttttcgagtcgattttattcgttttcgttttttttaagatgttttttttaggcgtttttcggggtttcgagtattcgtttttttttatagagataggaagtttcgcgcggttcgattcgttttttttagggcgcggagttcggcgcggcggttttgacggggcgcgggttcggtcgcggattagcgttttcgcgtttcgttcgcggcgttttaatcgtcgcggcgatttttgatttcggcggttatttattttttaattcgtcgtatatttcgtttaggttgttacggcgtttttagatttagtttcggtcgggttttcgttatcgtttttgtttcggtagtattgtttagttttgtttagatttttgcggtcgtttttgtcgttagtcgcgatcgtatcgttttcgtcgttttcgttgggttttgtttattggttatcggatatcgagtttcgttttatagttttttcggcgttttcgattgggttagatgagtagagaggcggtttatttcgcgtgaggacgagggaaagttttaggacgcgtattggtgattttttttgttaattaaacggggagtgtttatttaatgggttgcgagggtggcgtagattatttttttaaagtcgttcgttggtggtggtttttgagacgcgtttttcggggttggagttttgcggtttcgtcggtatttaggggtaagagggcgcggtagggtagtatcgtatttgatcggaagtttagggaaggtaattttatagttttttagaaagtttttttt

SEQ ID NO: 26514 - DNA, 817 bp, Artificial Sequence
  chemically treated genomic DNA (Homo sapiens) CpG-island No: 26514
aaaaaaaactttctaaaaaactataaaattaccttccctaaacttccgatcaaatacgatactaccctaccgcgccctcttacccctaaataccgacgaaaccgcaaaactccaaccccgaaaaacgcgtctcaaaaaccaccaccaacgaacgactttaaaaaaataatctacgccaccctcgcaacccattaaataaacactccccgtttaattaacaaaaaaaatcaccaatacgcgtcctaaaactttccctcgtcctcacgcgaaataaaccgcctctctactcatctaacccaatcgaaaacgccgaaaaaactataaaacgaaactcgatatccgataaccaataaacaaaacccaacgaaaacgacgaaaacgatacgatcgcgactaacgacaaaaacgaccgcaaaaatctaaacaaaactaaacaatactaccgaaacaaaaacgataacgaaaacccgaccgaaactaaatctaaaaacgccgtaacaacctaaacgaaatatacgacgaattaaaaaataaataaccgccgaaatcaaaaatcgccgcgacgattaaaacgccgcgaacgaaacgcgaaaacgctaatccgcgaccgaacccgcgccccgtcaaaaccgccgcgccgaactccgcgccctaaaaaaaacgaatcgaaccgcgcgaaacttcctatctctataaaaaaaaacgaatactcgaaaccccgaaaaacgcctaaaaaaaacatcttaaaaaaaacgaaaacgaataaaatcgactcgaaaaaaaaacgaaaacccataaaaacgacgctataaaaacg

SEQ ID NO: 26515 - DNA, 817 bp, Artificial Sequence
  chemically treated genomic DNA (Homo sapiens) CpG-island No: 26515
agaggaaattttttgaaagattgtaggattattttttttgaattttcggttaggtgcggtgttgttttgtcgcgtttttttatttttggatgtcgacgaaatcgtaaaattttagtttcgggaagcgcgttttaaggattattattagcgagcggttttgggagagtaatttgcgttattttcgtagtttattaaataggtatttttcgtttgattgataggagaagttattaatgcgcgttttggggttttttttcgtttttacgcggggtgagtcgtttttttatttatttggtttaatcgggggcgtcggggaggttgtggggcggggttcggtgttcggtagttaatggatagagtttagcgggagcggcgggggcggtgcggtcgcggttggcggtagaagcggtcgtaggggtttgggtagggttgggtagtgttgtcggagtaaaagcggtagcgggagttcggtcggagttgggtttggagacgtcgtggtagtttgaacggagtgtgcgacggattgggaggtgagtggtcgtcgaggttaggggtcgtcgcgacggttggggcgtcgcgggcgggacgcgggggcgttggttcgcggtcgggttcgcgtttcgttagggtcgtcgcgtcgagtttcgcgttttgagggaagcgggtcgggtcgcgcggaattttttgtttttgtgggagggggcgagtgttcggggtttcggggggcgtttggagaagatattttggggaggacgagggcgagtggggtcggttcggggaaggggcgggggtttatgggggcggcgttgtgggagcg

SEQ ID NO: 26516 - DNA, 817 bp, Artificial Sequence
  chemically treated genomic DNA (Homo sapiens) CpG-island No: 26516
cgctcccacaacgccgcccccataaacccccgccccttccccgaaccgaccccactcgccctcgtcctccccaaaatatcttctccaaacgccccccgaaaccccgaacactcgccccctcccacaaaaacaaaaaattccgcgcgacccgacccgcttccctcaaaacgcgaaactcgacgcgacgaccctaacgaaacgcgaacccgaccgcgaaccaacgcccccgcgtcccgcccgcgacgccccaaccgtcgcgacgacccctaacctcgacgaccactcacctcccaatccgtcgcacactccgttcaaactaccacgacgtctccaaacccaactccgaccgaactcccgctaccgcttttactccgacaacactacccaaccctacccaaacccctacgaccgcttctaccgccaaccgcgaccgcaccgcccccgccgctcccgctaaactctatccattaactaccgaacaccgaaccccgccccacaacctccccgacgcccccgattaaaccaaataaataaaaaaacgactcaccccgcgtaaaaacgaaaaaaaaccccaaaacgcgcattaataacttctcctatcaatcaaacgaaaaatacctatttaataaactacgaaaataacgcaaattactctcccaaaaccgctcgctaataataatccttaaaacgcgcttcccgaaactaaaattttacgatttcgtcgacatccaaaaataaaaaaacgcgacaaaacaacaccgcacctaaccgaaaattcaaaaaaaataatcctacaatctttcaaaaaatttcctct

SEQ ID NO: 26517 - DNA, 1413 bp, Artificial Sequence
  chemically treated genomic DNA (Homo sapiens) CpG-island No: 26517
agtgtttcgatttcggtttagcgtcgttcggtaaaatttcggaagttcgagggtgtgagtaggaagtttttgcgaagcggcgcgggaggaggggtgttggaggcggagggtaggtttttttatcgttcgtattttattcgcggtgtttttgtttttgtttcgggattttttttttcgttattcgtagggttgtatttgagcgattcgggttaggggggcgtaaaattttattcgtttattttcgtattaacgtttttacgtaaggcgttttaaaatttaggtggagcggggtaatttcgttaaaagttatttttgtagggcgtatttaaaacggaacgtcgaggtttcggagtcgagcgcgtagttagattgaatcgggtgttcgggtgtcgtcgcggcgtttcgggtattttttatttttattgttttcgaggttttggttttcgtagtttagacgttcggagttttagggtcggcgttttttcgtttcgggtttcgtatttattttgaaggcgacgggtagcgttttgttgtagcgttagtgcgagggtagtacggagtagaggaagttggggttgtcggtgcgtacgagttcgtttgcgtggttcgttagtacgtttattatcgagcgtatttcgggtcgggcgcgtttttcgggttttacggtcgtttgcgcgtttagcgcgtcgttgttttcgtttattttgtcgtcgtcgtcgtcgtaggggaaggtcggggagggaggtgtgaagcggcggttggtgtttgggtttacgggaatacgtataatagcggtcgttagggcgtcgggtaggcggagacggcgcggtttttttcgggggcggtcggcgcgggcgttttttcggtcgtcgttgtcgcgagaagcgggaaagtagaagcggcggggttcgggttttagggcgtagggggcggcgttcggttattattcgttagggttcgttcgttgcgaggtttcgttggttcgacggtcgttcgtagtttgttcggttagtttcgtattttcggcgcgcggtttcgcgtgcggtcgtttttcgtggttgtttcggttgtttgggtcgcggcggggttcgcgcggggttgtgtcgttgtcgtcgtttttcgtttcgaagttcgttcgcggtcgtttcgatttcgcggtcgtagttttagaataaattttttagaattaagtggcggggtcgcggtcgttcgcgcggggttagtattttcggggttcgcggggcggggttggcggagcgacgcgtcgtatagttaatcggcggagtttttatcgcgggtatttcggtggcgttcgcggggaggaacggggtttgtcggaggtcgtttaacggggaggggcggaaggcgttatttcgcggaggaggttttagtgttatagtttagggttttcga

SEQ ID NO: 26518 - DNA, 1413 bp, Artificial Sequence
  chemically treated genomic DNA (Homo sapiens) CpG-island No: 26518
tcgaaaaccctaaactataacactaaaacctcctccgcgaaataacgccttccgcccctccccgttaaacgacctccgacaaaccccgttcctccccgcgaacgccaccgaaatacccgcgataaaaactccgccgattaactatacgacgcgtcgctccgccaaccccgccccgcgaaccccgaaaatactaaccccgcgcgaacgaccgcgaccccgccacttaattctaaaaaatttattctaaaactacgaccgcgaaatcgaaacgaccgcgaacgaacttcgaaacgaaaaacgacgacaacgacacaaccccgcgcgaaccccgccgcgacccaaacaaccgaaacaaccacgaaaaacgaccgcacgcgaaaccgcgcgccgaaaatacgaaactaaccgaacaaactacgaacgaccgtcgaaccaacgaaacctcgcaacgaacgaaccctaacgaataataaccgaacgccgccccctacgccctaaaacccgaaccccgccgcttctactttcccgcttctcgcgacaacgacgaccgaaaaaacgcccgcgccgaccgcccccgaaaaaaaccgcgccgtctccgcctacccgacgccctaacgaccgctattatacgtattcccgtaaacccaaacaccaaccgccgcttcacacctccctccccgaccttcccctacgacgacgacgacgacaaaataaacgaaaacaacgacgcgctaaacgcgcaaacgaccgtaaaacccgaaaaacgcgcccgacccgaaatacgctcgataataaacgtactaacgaaccacgcaaacgaactcgtacgcaccgacaaccccaacttcctctactccgtactaccctcgcactaacgctacaacaaaacgctacccgtcgccttcaaaataaatacgaaacccgaaacgaaaaaacgccgaccctaaaactccgaacgtctaaactacgaaaaccaaaacctcgaaaacaataaaaataaaaaatacccgaaacgccgcgacgacacccgaacacccgattcaatctaactacgcgctcgactccgaaacctcgacgttccgttttaaatacgccctacaaaaataacttttaacgaaattaccccgctccacctaaattttaaaacgccttacgtaaaaacgttaatacgaaaataaacgaataaaattttacgcccccctaacccgaatcgctcaaatacaaccctacgaataacgaaaaaaaaaatcccgaaacaaaaacaaaaacaccgcgaataaaatacgaacgataaaaaaacctaccctccgcctccaacacccctcctcccgcgccgcttcgcaaaaacttcctactcacaccctcgaacttccgaaattttaccgaacgacgctaaaccgaaatcgaaacact

SEQ ID NO: 26519 - DNA, 1413 bp, Artificial Sequence
  chemically treated genomic DNA (Homo sapiens) CpG-island No: 26519
tcgggggttttgggttgtggtattggggtttttttcgcggggtggcgtttttcgttttttttcgttgggcggttttcggtaggtttcgttttttttcgcgaacgttatcgaggtgttcgcgatgggggtttcgtcgattggttgtgcgacgcgtcgtttcgttagtttcgtttcgcgggtttcgggggtattaatttcgcgcgggcggtcgcggtttcgttatttgattttggaggatttgttttggggttgcggtcgcggagtcggggcggtcgcgggcgagtttcggggcgggaggcggcggtagcggtatagtttcgcgcgggtttcgtcgcggtttaggtagtcgggatagttacgaggggcggtcgtacgcggggtcgcgcgtcgaggatgcgggattagtcgggtaggttgcgggcggtcgtcgggttagcgaggtttcgtagcgggcgggttttggcgagtagtggtcgggcgtcgttttttgcgttttgaggttcgggtttcgtcgtttttgttttttcgtttttcgcggtagcggcggtcgaggaggcgttcgcgtcggtcgttttcgggggaagtcgcgtcgttttcgtttgttcggcgttttgacggtcgttgttatgcgtattttcgtagatttaagtattagtcgtcgttttatattttttttttcggtttttttttgcggcggcggcggcggtaagatgggcgagaatagcggcgcgttgagcgcgtaggcggtcgtggggttcggagggcgcgttcggttcgaggtgcgttcgatggtggacgtgttggcggattacgtaggcgagttcgtgcgtatcgatagttttaattttttttgtttcgtgttgttttcgtattggcgttgtaataagacgttgttcgtcgtttttaaggtgagtgcgggattcggggcgggagggcgtcggttttggggtttcgggcgtttgagttgcgggagttagagtttcgggagtagtggggatgggaggtgttcgagacgtcgcggcgatattcgggtattcggtttagtttggttgcgcgttcggtttcgggatttcggcgtttcgttttggatgcgttttgtaggaatgatttttaacggggttgtttcgttttatttgggttttggggcgttttgcgtagagacgttggtgcggaaatgggcggatggggttttgcgtttttttaattcggatcgtttagatatagttttgcgggtaacggagaagaggatttcgggataggggtaaggatatcgcgggtggggtgcgaacggtgaaagggtttatttttcgtttttagtattttttttttcgcgtcgtttcgtaaaagttttttgtttatattttcgggttttcgaaattttatcggacggcgttaggtcgggatcggggtatt

SEQ ID NO: 26520 - DNA, 1413 bp, Artificial Sequence
  chemically treated genomic DNA (Homo sapiens) CpG-island No: 26520
aataccccgatcccgacctaacgccgtccgataaaatttcgaaaacccgaaaatataaacaaaaaacttttacgaaacgacgcgaaaaaaaaaatactaaaaacgaaaaataaaccctttcaccgttcgcaccccacccgcgatatccttacccctatcccgaaatcctcttctccgttacccgcaaaactatatctaaacgatccgaattaaaaaaacgcaaaaccccatccgcccatttccgcaccaacgtctctacgcaaaacgccccaaaacccaaataaaacgaaacaaccccgttaaaaatcattcctacaaaacgcatccaaaacgaaacgccgaaatcccgaaaccgaacgcgcaaccaaactaaaccgaatacccgaatatcgccgcgacgtctcgaacacctcccatccccactactcccgaaactctaactcccgcaactcaaacgcccgaaaccccaaaaccgacgccctcccgccccgaatcccgcactcaccttaaaaacgacgaacaacgtcttattacaacgccaatacgaaaacaacacgaaacaaaaaaaattaaaactatcgatacgcacgaactcgcctacgtaatccgccaacacgtccaccatcgaacgcacctcgaaccgaacgcgccctccgaaccccacgaccgcctacgcgctcaacgcgccgctattctcgcccatcttaccgccgccgccgccgcaaaaaaaaaccgaaaaaaaaaatataaaacgacgactaatacttaaatctacgaaaatacgcataacaacgaccgtcaaaacgccgaacaaacgaaaacgacgcgacttcccccgaaaacgaccgacgcgaacgcctcctcgaccgccgctaccgcgaaaaacgaaaaaacaaaaacgacgaaacccgaacctcaaaacgcaaaaaacgacgcccgaccactactcgccaaaacccgcccgctacgaaacctcgctaacccgacgaccgcccgcaacctacccgactaatcccgcatcctcgacgcgcgaccccgcgtacgaccgcccctcgtaactatcccgactacctaaaccgcgacgaaacccgcgcgaaactataccgctaccgccgcctcccgccccgaaactcgcccgcgaccgccccgactccgcgaccgcaaccccaaaacaaatcctccaaaatcaaataacgaaaccgcgaccgcccgcgcgaaattaatacccccgaaacccgcgaaacgaaactaacgaaacgacgcgtcgcacaaccaatcgacgaaacccccatcgcgaacacctcgataacgttcgcgaaaaaaaacgaaacctaccgaaaaccgcccaacgaaaaaaaacgaaaaacgccaccccgcgaaaaaaaccccaataccacaacccaaaacccccga

SEQ ID NO: 26521 - DNA, 581 bp, Artificial Sequence
  chemically treated genomic DNA (Homo sapiens) CpG-island No: 26521
tgattcggaggatcgggggaggatttttttatacgtacgattcgcgatttttttagtgttttagaattagggattttatcgtcgtttattttaattcgtagtatcgaatttgttcgtagtcgcgattttttaggttagtatggatatcgtcggaaacggaaatttatagtcgcgttgattcgtcggagggaaataagaaggtagaaaaaagagatcggtatggggacggtttttaggggagagtttgaagaaagagggttgaatagttgagtgcggacgtaggcgtcgttcgcgtagtgcgttttatcgggtttaggtttttttagatttttttttatttcgttttcggaattcgcggttttaattttcgcggtgggatttcggagtagcgtgcgtcgcgttcgtttgagttttcgtcgaaggttagggcggttttgcggtttggcgtcggttagttagtgtggtgtaaaagtcggaaggagatatatttggttttggtttttcggtagttatcgtgttaaggacggatggattatcgtttgatttggagtatatttttttttttttaaagattatagatg

SEQ ID NO: 26522 - DNA, 581 bp, Artificial Sequence
  chemically treated genomic DNA (Homo sapiens) CpG-island No: 26522
catctataatctttaaaaaaaaaaaaatatactccaaatcaaacgataatccatccgtccttaacacgataactaccgaaaaaccaaaaccaaatatatctccttccgacttttacaccacactaactaaccgacgccaaaccgcaaaaccgccctaaccttcgacgaaaactcaaacgaacgcgacgcacgctactccgaaatcccaccgcgaaaattaaaaccgcgaattccgaaaacgaaataaaaaaaaatctaaaaaaacctaaacccgataaaacgcactacgcgaacgacgcctacgtccgcactcaactattcaaccctctttcttcaaactctcccctaaaaaccgtccccataccgatctcttttttctaccttcttatttccctccgacgaatcaacgcgactataaatttccgtttccgacgatatccatactaacctaaaaaatcgcgactacgaacaaattcgatactacgaattaaaataaacgacgataaaatccctaattctaaaacactaaaaaaatcgcgaatcgtacgtataaaaaaatcctcccccgatcctccgaatca

SEQ ID NO: 26523 - DNA, 581 bp, Artificial Sequence
  chemically treated genomic DNA (Homo sapiens) CpG-island No: 26523
tatttgtaatttttaaagaggaggaagtgtattttaaattaagcgatagtttattcgtttttggtacggtgattgtcgggaggttaggattaaatgtgttttttttcggtttttgtattatattaattaatcggcgttaggtcgtagagtcgttttggttttcggcgagaatttaggcgagcgcggcgtacgttgtttcggagttttatcgcggaagttgaggtcgcggatttcgagggcggggtggagaggaatttggaaggatttggattcggtggaacgtattgcgcggacggcgtttgcgttcgtatttagttgtttagttttttttttttaggtttttttttgaaagtcgtttttatgtcggttttttttttttgtttttttgttttttttcggcgagttagcgcgattgtgaattttcgttttcggcggtgtttatgttgatttgaggagtcgcggttgcgagtaggttcggtgttgcgggttggggtaggcggcggtggggtttttggttttggggtattgggaagatcgcgagtcgtgcgtgtgggaaggttttttttcggtttttcgggtta

SEQ ID NO: 26524 - DNA, 581 bp, Artificial Sequence
  chemically treated genomic DNA (Homo sapiens) CpG-island No: 26524
taacccgaaaaaccgaaaaaaaaccttcccacacgcacgactcgcgatcttcccaataccccaaaaccaaaaaccccaccgccgcctaccccaacccgcaacaccgaacctactcgcaaccgcgactcctcaaatcaacataaacaccgccgaaaacgaaaattcacaatcgcgctaactcgccgaaaaaaaacaaaaaaacaaaaaaaaaaaaccgacataaaaacgactttcaaaaaaaaacctaaaaaaaaaaaactaaacaactaaatacgaacgcaaacgccgtccgcgcaatacgttccaccgaatccaaatccttccaaattcctctccaccccgccctcgaaatccgcgacctcaacttccgcgataaaactccgaaacaacgtacgccgcgctcgcctaaattctcgccgaaaaccaaaacgactctacgacctaacgccgattaattaatataatacaaaaaccgaaaaaaaacacatttaatcctaacctcccgacaatcaccgtaccaaaaacgaataaactatcgcttaatttaaaatacacttcctcctctttaaaaattacaaata

SEQ ID NO: 26525 - DNA, 634 bp, Artificial Sequence
  chemically treated genomic DNA (Homo sapiens) CpG-island No: 26525
gggtcgatttcgtagtagtatttttagttttgttcgggaagtagaggtcgtcgtcggttatagtcgtgggtgagaaaaagggcgcgaggcggtcggggtttttgtcgggtattttaagtacgcgtcgggtttttttatgatagttgcggttcgggttgtttggggtttgggatttcggcgcggttcggtcgcgagaaaggtaggcgttgttttagtggggaaggggtaaggttgcggtttcggttatcgggcgggggtatagaaacgatttcggcgtcgtttgagcgtttagtttcgtttttgtcgcggttaaaagatattcgagagcgtcggcggttgggggattatagggttttggaatttattaggcggtttcgcggcgtaaaagcgggcggagttagaaaaggggttcggttaggcggttacgttttattttcggagggcggcgggattcggatttcgtttttggtttaaaaattgtgtttgcggagtttaggacgttgggaggagcgttttgcgttttttcggtcgcggttttcgtattaaatcgatttttagagtcgtttttgttttttgtagtggcggaggggcgggtatcgaagttttattaagtcgtaggtttttagtttggggt

SEQ ID NO: 26526 - DNA, 634 bp, Artificial Sequence
  chemically treated genomic DNA (Homo sapiens) CpG-island No: 26526
accccaaactaaaaacctacgacttaataaaacttcgatacccgcccctccgccactacaaaaaacaaaaacgactctaaaaatcgatttaatacgaaaaccgcgaccgaaaaaacgcaaaacgctcctcccaacgtcctaaactccgcaaacacaatttttaaaccaaaaacgaaatccgaatcccgccgccctccgaaaataaaacgtaaccgcctaaccgaaccccttttctaactccgcccgcttttacgccgcgaaaccgcctaataaattccaaaaccctataatcccccaaccgccgacgctctcgaatatcttttaaccgcgacaaaaacgaaactaaacgctcaaacgacgccgaaatcgtttctatacccccgcccgataaccgaaaccgcaaccttaccccttccccactaaaacaacgcctacctttctcgcgaccgaaccgcgccgaaatcccaaaccccaaacaacccgaaccgcaactatcataaaaaaacccgacgcgtacttaaaatacccgacaaaaaccccgaccgcctcgcgccctttttctcacccacgactataaccgacgacgacctctacttcccgaacaaaactaaaaatactactacgaaatcgaccc

SEQ ID NO: 26527 - DNA, 634 bp, Artificial Sequence
  chemically treated genomic DNA (Homo sapiens) CpG-island No: 26527
gttttaggttgaggatttgcgatttggtgggatttcggtgttcgttttttcgttattatagggagtagaggcggttttggaagtcggtttagtgcggagatcgcgatcggaggagcgtagaacgttttttttagcgttttgggtttcgtaggtataatttttaaattagaggcgaaattcgagtttcgtcgtttttcggggatggagcgtggtcgtttagtcgagttttttttttggtttcgttcgtttttgcgtcgcgaggtcgtttggtgagttttagggttttgtggttttttagtcgtcggcgttttcgggtgttttttggtcgcggtaggaacggagttgggcgtttagacggcgtcggggtcgtttttgtgttttcgttcggtggtcggagtcgtagttttgttttttttttattggggtagcgtttgtttttttcgcggtcggatcgcgtcggagttttaggttttaggtagttcgggtcgtagttgttatggagaagttcggcgcgtatttggggtgttcggtaggagtttcggtcgtttcgcgtttttttttttatttacgattgtggtcggcggcggtttttgtttttcggataaagttggagatgttgttgcggagtcggttt

SEQ ID NO: 26528 - DNA, 634 bp, Artificial Sequence
  chemically treated genomic DNA (Homo sapiens) CpG-island No: 26528
aaaccgactccgcaacaacatctccaactttatccgaaaaacaaaaaccgccgccgaccacaatcgtaaataaaaaaaaaaacgcgaaacgaccgaaactcctaccgaacaccccaaatacgcgccgaacttctccataacaactacgacccgaactacctaaaacctaaaactccgacgcgatccgaccgcgaaaaaaacaaacgctaccccaataaaaaaaaaacaaaactacgactccgaccaccgaacgaaaacacaaaaacgaccccgacgccgtctaaacgcccaactccgttcctaccgcgaccaaaaaacacccgaaaacgccgacgactaaaaaaccacaaaaccctaaaactcaccaaacgacctcgcgacgcaaaaacgaacgaaaccaaaaaaaaaactcgactaaacgaccacgctccatccccgaaaaacgacgaaactcgaatttcgcctctaatttaaaaattatacctacgaaacccaaaacgctaaaaaaaacgttctacgctcctccgatcgcgatctccgcactaaaccgacttccaaaaccgcctctactccctataataacgaaaaaacgaacaccgaaatcccaccaaatcgcaaatcctcaacctaaaac

SEQ ID NO: 26529 - DNA, 750 bp, Artificial Sequence
  chemically treated genomic DNA (Homo sapiens) CpG-island No: 26529
attttcggttttcggtacgtacggtttattttggagcgcgcgttttaggttagttaagcgtcgagtcgggttgttgcgggttgggagggcgcgtagggtcggcgttgattgacggggcgcgtagttaggtgatttggggcgttaagttttcgacgcggtggtcgcggtgatcgtcgaggttcggtagacgttgattcgggaacgtagtggggttgatttttcggaataaagttgttgggtcggcggcggcggggcgagagcgtcgagggggagtcggagcgttgtagaggcgcgggtcggagggttggcgttgatttgtattttttttatttggagagcggatttttggttgttcggaggcgagttttttttcggggggtgggggcggtaacgcgcgatttagcggttttgcgttttattttttttttttcgtttttagcgttcggttttaataaaggggtaggttcgtagcggggaggaggaggaggagtcgtcgaaggagcgagtttttttcgcgtataaagttgtggagtcgttttttttcggagtagggaagcgggtagtagtagtcggtcgcgggttttttttcgtcgaggggcgaggaggagtttttggttttagaagtcgattggggaattacggggagcggcgtttttttttttttgggttatttttgtaaacggaaaattttgtagcgtttggtaaagttggtgtttgcgcgttttttttaggtttgcgttttgattgttt

SEQ ID NO: 26530 - DNA, 750 bp, Artificial Sequence
  chemically treated genomic DNA (Homo sapiens) CpG-island No: 26530
aaacaatcaaaacgcaaacctaaaaaaaacgcgcaaacaccaactttaccaaacgctacaaaattttccgtttacaaaaataacccaaaaaaaaaaaaacgccgctccccgtaattccccaatcgacttctaaaaccaaaaactcctcctcgcccctcgacgaaaaaaaacccgcgaccgactactactacccgcttccctactccgaaaaaaaacgactccacaactttatacgcgaaaaaaactcgctccttcgacgactcctcctcctcctccccgctacgaacctacccctttattaaaaccgaacgctaaaaacgaaaaaaaaaaaataaaacgcaaaaccgctaaatcgcgcgttaccgcccccaccccccgaaaaaaaactcgcctccgaacaaccaaaaatccgctctccaaataaaaaaaatacaaatcaacgccaaccctccgacccgcgcctctacaacgctccgactccccctcgacgctctcgccccgccgccgccgacccaacaactttattccgaaaaatcaaccccactacgttcccgaatcaacgtctaccgaacctcgacgatcaccgcgaccaccgcgtcgaaaacttaacgccccaaatcacctaactacgcgccccgtcaatcaacgccgaccctacgcgccctcccaacccgcaacaacccgactcgacgcttaactaacctaaaacgcgcgctccaaaataaaccgtacgtaccgaaaaccgaaaat

SEQ ID NO: 26531 - DNA, 750 bp, Artificial Sequence
  chemically treated genomic DNA (Homo sapiens) CpG-island No: 26531
aaatagttaaagcgtaaatttggaaggggcgcgtaggtattaattttgttaaacgttatagagtttttcgtttgtagaaatgatttaaaagaaggggggcgtcgtttttcgtgattttttaatcggtttttggagttagaggttttttttcgtttttcggcgggagaaagttcgcggtcggttgttgttgttcgtttttttgtttcgaggaaaaacgattttataattttgtgcgcgagagaggttcgttttttcggcggtttttttttttttttttcgttgcgggtttgtttttttgttggagtcgagcgttggaggcggaggagggagggtggggcgtaggatcgttgggtcgcgcgttgtcgtttttatttttcgggaaggggttcgttttcgggtagttaggggttcgttttttagatgagaagggtgtagattagcgttagtttttcggttcgcgtttttgtagcgtttcggttttttttcggcgttttcgtttcgtcgtcgtcggtttagtaattttgtttcggaagattagttttattacgttttcgggttagcgtttgtcgggtttcggcggttatcgcggttatcgcgtcgggaatttggcgttttaagttatttgattgcgcgtttcgttaattagcgtcggttttgcgcgtttttttagttcgtagtagttcggttcggcgtttggttggtttggggcgcgcgttttagagtgaatcgtgcgtgtcgggagtcgggagt

SEQ ID NO: 26532 - DNA, 750 bp, Artificial Sequence
  chemically treated genomic DNA (Homo sapiens) CpG-island No: 26532
actcccgactcccgacacgcacgattcactctaaaacgcgcgccccaaaccaaccaaacgccgaaccgaactactacgaactaaaaaaacgcgcaaaaccgacgctaattaacgaaacgcgcaatcaaataacttaaaacgccaaattcccgacgcgataaccgcgataaccgccgaaacccgacaaacgctaacccgaaaacgtaataaaactaatcttccgaaacaaaattactaaaccgacgacgacgaaacgaaaacgccgaaaaaaaaccgaaacgctacaaaaacgcgaaccgaaaaactaacgctaatctacacccttctcatctaaaaaacgaacccctaactacccgaaaacgaaccccttcccgaaaaataaaaacgacaacgcgcgacccaacgatcctacgccccaccctccctcctccgcctccaacgctcgactccaacaaaaaaacaaacccgcaacgaaaaaaaaaaaaaaaaaccgccgaaaaaacgaacctctctcgcgcacaaaattataaaatcgtttttcctcgaaacaaaaaaacgaacaacaacaaccgaccgcgaactttctcccgccgaaaaacgaaaaaaaacctctaactccaaaaaccgattaaaaaatcacgaaaaacgacgccccccttcttttaaatcatttctacaaacgaaaaactctataacgtttaacaaaattaatacctacgcgccccttccaaatttacgctttaactattt

SEQ ID NO: 26533 - DNA, 730 bp, Artificial Sequence
  chemically treated genomic DNA (Homo sapiens) CpG-island No: 26533
ttttcgagtcggcgtttatttgggggtcggcgtttttcggggttttttagttcggcgtttttatagtttgggtcgtcgcgttttcggtcgtttcggggtttggttggagcggttcggttatgggcggcgttgacgttttgggagtttggttagtcgcgtagaggtttcgtatttcgggtcgtttcgtttgcgtgtgcgcgtttcgtcgaggtttcgagttttcgtttcgtagattcggttttttttttcggtcgggttggagattcgagtttattcgatgcgtttgtttttggatcgcgagggggcgtcgttattaaggcggggtcggtttacgatttcggatagtttcggtcggagttgcgcgttttgttttcgttttttcgcggcgatagggagtcgtatttcgtttcggttcgtttttttttgaggtattttcgttttcgtttcgtttttgtttttgaaggaaaggtatatataggtggtttcgcgggtagtagggggtggcgttgtttttgtgtaatcggtttgggaatttttgtcgcggtttcgttcgcgttgggaatcgcgggcgttgagtcgtttcgagggtgttttagcgtatcgtaggtagagaaaggtaggaggtggcggttggcgattcgattttcgcggtttttgttcgtatttttggggtttagttagggcgaatggtcgtatttattttaagaagttgttttaggttttagatagt

SEQ ID NO: 26534 - DNA, 730 bp, Artificial Sequence
  chemically treated genomic DNA (Homo sapiens) CpG-island No: 26534
actatctaaaacctaaaacaacttcttaaaataaatacgaccattcgccctaactaaaccccaaaaatacgaacaaaaaccgcgaaaatcgaatcgccaaccgccacctcctacctttctctacctacgatacgctaaaacaccctcgaaacgactcaacgcccgcgattcccaacgcgaacgaaaccgcgacaaaaattcccaaaccgattacacaaaaacaacgccaccccctactacccgcgaaaccacctatatatacctttccttcaaaaacaaaaacgaaacgaaaacgaaaatacctcaaaaaaaaacgaaccgaaacgaaatacgactccctatcgccgcgaaaaaacgaaaacaaaacgcgcaactccgaccgaaactatccgaaatcgtaaaccgaccccgccttaataacgacgccccctcgcgatccaaaaacaaacgcatcgaataaactcgaatctccaacccgaccgaaaaaaaaaaccgaatctacgaaacgaaaactcgaaacctcgacgaaacgcgcacacgcaaacgaaacgacccgaaatacgaaacctctacgcgactaaccaaactcccaaaacgtcaacgccgcccataaccgaaccgctccaaccaaaccccgaaacgaccgaaaacgcgacgacccaaactataaaaacgccgaactaaaaaaccccgaaaaacgccgacccccaaataaacgccgactcgaaaa

SEQ ID NO: 26535 - DNA, 730 bp, Artificial Sequence
  chemically treated genomic DNA (Homo sapiens) CpG-island No: 26535
gttgtttgggatttaggataattttttgggatgagtacggttattcgttttggttgagttttaggagtgcgggtaggggtcgcgggggtcgggtcgttagtcgttattttttgtttttttttgtttgcggtgcgttgggatattttcgaggcggtttagcgttcgcggtttttagcgcgggcggggtcgcggtagaggtttttaaatcggttgtatagaaatagcgttattttttattgttcgcggggttatttgtgtgtgttttttttttaaaaataaaggcggggcgggggcggaagtgttttaaaagaaggcgggtcgaagcgaggtgcggttttttgtcgtcgcggaggggcgggggtaggacgcgtaatttcggtcggagttgttcggggtcgtgagtcggtttcgttttggtggcggcgttttttcgcggtttagaggtagacgtatcgggtgggttcgggtttttagttcggtcgggaggagggatcgggtttgcggagcggggattcggggtttcggcggggcgcgtatacgtaggcggggcggttcggggtgcggggtttttgcgcggttgattaggtttttagagcgttagcgtcgtttatggtcgagtcgttttagttagatttcggggcggtcgaggacgcggcggtttaagttgtggagacgtcgggttggaaggtttcggaggacgtcggtttttaggtaggcgtcgattcgggag

SEQ ID NO: 26536 - DNA, 730 bp, Artificial Sequence
  chemically treated genomic DNA (Homo sapiens) CpG-island No: 26536
ctcccgaatcgacgcctacctaaaaaccgacgtcctccgaaaccttccaacccgacgtctccacaacttaaaccgccgcgtcctcgaccgccccgaaatctaactaaaacgactcgaccataaacgacgctaacgctctaaaaacctaatcaaccgcgcaaaaaccccgcaccccgaaccgccccgcctacgtatacgcgccccgccgaaaccccgaatccccgctccgcaaacccgatccctcctcccgaccgaactaaaaacccgaacccacccgatacgtctacctctaaaccgcgaaaaaacgccgccaccaaaacgaaaccgactcacgaccccgaacaactccgaccgaaattacgcgtcctacccccgcccctccgcgacgacaaaaaaccgcacctcgcttcgacccgccttcttttaaaacacttccgcccccgccccgcctttatttttaaaaaaaaaacacacacaaataaccccgcgaacaataaaaaataacgctatttctatacaaccgatttaaaaacctctaccgcgaccccgcccgcgctaaaaaccgcgaacgctaaaccgcctcgaaaatatcccaacgcaccgcaaacaaaaaaaaacaaaaaataacgactaacgacccgacccccgcgacccctacccgcactcctaaaactcaaccaaaacgaataaccgtactcatcccaaaaaattatcctaaatcccaaacaac

SEQ ID NO: 26537 - DNA, 1291 bp, Artificial Sequence
  chemically treated genomic DNA (Homo sapiens) CpG-island No: 26537
tcgaagggtcgataggaaggtgaaaaggatattgttggggcgtttgagtttggagggttttgatgttcgggtgaggaggggggatcgttgtcgtcgtcgtcgtcgtcgtcgtcgtcgtcgtcgttgttgtcgtcgtcgggtgaggaggcggtatcgttgttgtcgtcgtcgtcgtcgtttcggtgtcgggttcggtttttgttgtagtcgttgtgtttgattttagagtcggtttttgcggtaaatttatggtaaagcgaagttattaatttttttagagcgggatcgggcgcgtcggggtgtaggggtcgggggtagcgggggggcgggatgggggtagattcggggaggcggcgggagcggggggttggggggagtttggggggaggaggaggagggggtcggggtcggttatatacgttcgacgtcgtcgtcgtcgtcgtcgtcgttttcgtcgtcgtcgtcgtcggtagtagtagtcgtttcgcgggttagtattatcggttgtcggttttcgtgataacgcgattttagggggggggtcggattcggcgggggtaggaggcggagagatcggattttttacggtaatatttttatgggtcggcggcgggggatttttattttttttttcggaggaagcggcgtttttttcggtagcggggtttaggcgatgtcggtggattttttttatttaacgagtagagtatttaatatggcgttgtggtcgtttttagtagttcggtaggacggttgttcggaaaatttcggattttttcggaatggttcgggaaatcgagggtgggaagttttttcggtttttttcggagattgttaggggtcgggatttttcggagacgttcgggtgcgttttcggtcgtcgttcgggagggtttaggggttaattcgttttttcggtaaagatcggcgagggaggtttcgttggtttatagcggcgcgggtgcggggcggagggaaagattaaaggcgaggtttggtttgcgagagtttttttttgcggtttagtttcgaagaataatggtaatggtttcggagtcggttgttcgttgagtttcgttcgtaggggcggagaggtagcggcgaggcgaaaaatttttggagaaggaatcgtttaatcggaatggaattcgttggatagggatttttcgcggggatttcgcgtaattaatgttattcgtcggtttgtaatttacgtattttatatttattgtgtcgatatttttttagacgttttgagaggtgaatgaggagttttatttttagaggatat

SEQ ID NO: 26538 - DNA, 1291 bp, Artificial Sequence
  chemically treated genomic DNA (Homo sapiens) CpG-island No: 26538
atatcctctaaaaataaaactcctcattcacctctcaaaacgtctaaaaaaatatcgacacaataaatataaaatacgtaaattacaaaccgacgaataacattaattacgcgaaatccccgcgaaaaatccctatccaacgaattccattccgattaaacgattccttctccaaaaatttttcgcctcgccgctacctctccgcccctacgaacgaaactcaacgaacaaccgactccgaaaccattaccattattcttcgaaactaaaccgcaaaaaaaaactctcgcaaaccaaacctcgcctttaatctttccctccgccccgcacccgcgccgctataaaccaacgaaacctccctcgccgatctttaccgaaaaaacgaattaacccctaaaccctcccgaacgacgaccgaaaacgcacccgaacgtctccgaaaaatcccgacccctaacaatctccgaaaaaaaccgaaaaaacttcccaccctcgatttcccgaaccattccgaaaaaatccgaaattttccgaacaaccgtcctaccgaactactaaaaacgaccacaacgccatattaaatactctactcgttaaataaaaaaaatccaccgacatcgcctaaaccccgctaccgaaaaaaacgccgcttcctccgaaaaaaaaaataaaaatcccccgccgccgacccataaaaatattaccgtaaaaaatccgatctctccgcctcctacccccgccgaatccgaccccccccctaaaatcgcgttatcacgaaaaccgacaaccgataatactaacccgcgaaacgactactactaccgacgacgacgacgacgaaaacgacgacgacgacgacgacgacgtcgaacgtatataaccgaccccgaccccctcctcctcctccccccaaactccccccaaccccccgctcccgccgcctccccgaatctacccccatcccgcccccccgctacccccgacccctacaccccgacgcgcccgatcccgctctaaaaaaattaataacttcgctttaccataaatttaccgcaaaaaccgactctaaaatcaaacacaacgactacaacaaaaaccgaacccgacaccgaaacgacgacgacgacgacaacaacgataccgcctcctcacccgacgacgacaacaacgacgacgacgacgacgacgacgacgacgacgacaacgatcccccctcctcacccgaacatcaaaaccctccaaactcaaacgccccaacaatatccttttcaccttcctatcgacccttcga

SEQ ID NO: 26539 - DNA, 1291 bp, Artificial Sequence
  chemically treated genomic DNA (Homo sapiens) CpG-island No: 26539
gtgttttttggaaatggggttttttatttattttttagagcgtttgaggaagtgtcgatataatgggtgtgaaatgcgtgggttataggtcggcgggtggtattggttacgcgaagttttcgcggggggtttttatttaacgggttttatttcggttaagcggttttttttttaggggtttttcgtttcgtcgttgttttttcgtttttgcgagcggggtttagcgaatagtcgatttcggggttattattattgtttttcgaggttgggtcgtaggggaggattttcgtaagttagatttcgtttttggttttttttttcgtttcgtattcgcgtcgttgtaagttagcgaagtttttttcgtcgatttttgtcgaggaagcgagttagtttttgagttttttcgaacggcggtcgaggacgtattcgagcgttttcgaagaatttcgatttttagtagttttcggaaagagtcgaagaggttttttattttcggtttttcgagttatttcgaaaaagttcgaagtttttcgagtagtcgttttgtcggattgttggaggcggttatagcgttatgttggatgttttgttcgttgagtgaagaaaatttatcggtatcgtttgagtttcgttatcgagaagggcgtcgtttttttcggggagggggataaagatttttcgtcgtcggtttatgaggatattgtcgtgaaaggttcggttttttcgttttttgttttcgtcgggttcggttttttttttggggtcgcgttgttacggagatcggtagtcggtggtgttggttcgcggggcggttgttgttgtcggcggcggcggcggcggaggcggcggcggcggcggcggcggcgtcgggcgtgtgtgatcggtttcggtttttttttttttttttttttaggttttttttagtttttcgttttcgtcgttttttcgggtttgtttttatttcgttttttcgttgttttcggtttttgtatttcggcgcgttcggtttcgttttgggggggttggtggtttcgttttgttatgagtttatcgtagaaatcggttttgaaattaggtatagcgattgtagtaggaatcggattcggtatcggagcggcggcggcggcggtagtagcggtatcgtttttttattcggcggcggtagtagcggcggcggcggcggcggcggcggcggcggcggtagcggttttttttttttattcgaatattagggttttttagatttaggcgttttaatagtattttttttatttttttgtcggtttttcgg

SEQ ID NO: 26540 - DNA, 1291 bp, Artificial Sequence
  chemically treated genomic DNA (Homo sapiens) CpG-island No: 26540
ccgaaaaaccgacaaaaaaataaaaaaaatactattaaaacgcctaaatctaaaaaaccctaatattcgaataaaaaaaaaaaaccgctaccgccgccgccgccgccgccgccgccgccgccgctactaccgccgccgaataaaaaaacgataccgctactaccgccgccgccgccgctccgataccgaatccgattcctactacaatcgctatacctaatttcaaaaccgatttctacgataaactcataacaaaacgaaaccaccaacccccccaaaacgaaaccgaacgcgccgaaatacaaaaaccgaaaacaacgaaaaaacgaaataaaaacaaacccgaaaaaacgacgaaaacgaaaaactaaaaaaaacctaaaaaaaaaaaaaaaaaaaaaccgaaaccgatcacacacgcccgacgccgccgccgccgccgccgccgcctccgccgccgccgccgccgacaacaacaaccgccccgcgaaccaacaccaccgactaccgatctccgtaacaacgcgaccccaaaaaaaaaaccgaacccgacgaaaacaaaaaacgaaaaaaccgaacctttcacgacaatatcctcataaaccgacgacgaaaaatctttatccccctccccgaaaaaaacgacgcccttctcgataacgaaactcaaacgataccgataaattttcttcactcaacgaacaaaacatccaacataacgctataaccgcctccaacaatccgacaaaacgactactcgaaaaacttcgaactttttcgaaataactcgaaaaaccgaaaataaaaaacctcttcgactctttccgaaaactactaaaaatcgaaattcttcgaaaacgctcgaatacgtcctcgaccgccgttcgaaaaaactcaaaaactaactcgcttcctcgacaaaaatcgacgaaaaaaacttcgctaacttacaacgacgcgaatacgaaacgaaaaaaaaaaccaaaaacgaaatctaacttacgaaaatcctcccctacgacccaacctcgaaaaacaataataataaccccgaaatcgactattcgctaaaccccgctcgcaaaaacgaaaaaacaacgacgaaacgaaaaacccctaaaaaaaaaaccgcttaaccgaaataaaacccgttaaataaaaaccccccgcgaaaacttcgcgtaaccaataccacccgccgacctataacccacgcatttcacacccattatatcgacacttcctcaaacgctctaaaaaataaataaaaaaccccatttccaaaaaacac

SEQ ID NO: 26541 - DNA, 1050 bp, Artificial Sequence
  chemically treated genomic DNA (Homo sapiens) CpG-island No: 26541
gttcgttcggttttatttcgttcggttttgtttagcgtatttttagatcggggcgtaagggttgtgaggtgtttgagcgaagcgtttgcgtagggtagcggcgcgcggggcggaggttttataattatttcgtcgttgtcgttcggtttttatcgtcgggagggcggttgaggcggtggtggcggcgtcggcggcggtcgggcgttggttgaggggcgttgaggcgggagttgtggcggcgttgggcgtttttggtttttcggtttttgtcggttatgggtttcgagaaggatttcgagtcgtcgcgttttatatcgttatatgcggtcgtattcgattttaagtgtcgtagcggcggtcggcgtcggcgttttattttgtatagcgttttttttgtttcggttcgcggtcgtcgcgttcgggttaagtcgtaggtcgagtcgtcgttttcggttgcgtagtcgtcgttcgtttcggtttttgtcgcggtttagggttcgtcgttcgaggcgttgttcgtcgagtcggtcgtcgaggtcgaggcggaggtcgcggcggcggcggcggagtttgggttcgacgatgaggaggcggcggagggcggtggttcgggcgcggaggaggtggagtgttcgttgtgtttggtgcggttgtcgtttgagcgggtttcgcgtttttttagttgttcgtatcgttcgtgtcgggattgttttcgttattatttgcgtttggagataagcgagagtagggtgtttattagttgtttcgagtgtagcgagcgatttaattcgtacgatattcgtttgttgttcgtcgattcgtcgtttatgtataagtacgaggagtttatgttgcgtcgttatttagtttcggatttcgattgtcgttggtgttcggtttcggattgcgggtgagcgcgggggcgtggcgcgggtggcggcgggttgtagtcgaggggcgtggttgggggtagtagggatttcgcgtgggtgttttaagtagggaaattcgtaaggcggtagtttcggcggggtggtaattattaggtaa

SEQ ID NO: 26542 - DNA, 1050 bp, Artificial Sequence
  chemically treated genomic DNA (Homo sapiens) CpG-island No: 26542
ttacctaataattaccaccccgccgaaactaccgccttacgaatttccctacttaaaacacccacgcgaaatccctactacccccaaccacgcccctcgactacaacccgccgccacccgcgccacgcccccgcgctcacccgcaatccgaaaccgaacaccaacgacaatcgaaatccgaaactaaataacgacgcaacataaactcctcgtacttatacataaacgacgaatcgacgaacaacaaacgaatatcgtacgaattaaatcgctcgctacactcgaaacaactaataaacaccctactctcgcttatctccaaacgcaaataataacgaaaacaatcccgacacgaacgatacgaacaactaaaaaaacgcgaaacccgctcaaacgacaaccgcaccaaacacaacgaacactccacctcctccgcgcccgaaccaccgccctccgccgcctcctcatcgtcgaacccaaactccgccgccgccgccgcgacctccgcctcgacctcgacgaccgactcgacgaacaacgcctcgaacgacgaaccctaaaccgcgacaaaaaccgaaacgaacgacgactacgcaaccgaaaacgacgactcgacctacgacttaacccgaacgcgacgaccgcgaaccgaaacaaaaaaaacgctatacaaaataaaacgccgacgccgaccgccgctacgacacttaaaatcgaatacgaccgcatataacgatataaaacgcgacgactcgaaatccttctcgaaacccataaccgacaaaaaccgaaaaaccaaaaacgcccaacgccgccacaactcccgcctcaacgcccctcaaccaacgcccgaccgccgccgacgccgccaccaccgcctcaaccgccctcccgacgataaaaaccgaacgacaacgacgaaataattataaaacctccgccccgcgcgccgctaccctacgcaaacgcttcgctcaaacacctcacaacccttacgccccgatctaaaaatacgctaaacaaaaccgaacgaaataaaaccgaacgaac

SEQ ID NO: 26543 - DNA, 1050 bp, Artificial Sequence
  chemically treated genomic DNA (Homo sapiens) CpG-island No: 26543
ttgtttgatggttattatttcgtcgaagttgtcgttttgcgggtttttttgtttgggatatttacgcggggtttttgttgtttttagttacgtttttcggttgtagttcgtcgttattcgcgttacgttttcgcgtttattcgtagttcggggtcgggtattagcggtagtcggggttcgaggttaggtagcggcgtagtatgaatttttcgtatttgtgtataagcggcgggtcggcgagtagtaagcggatgtcgtgcgggttgagtcgttcgttgtattcggggtagttgatgggtattttgttttcgtttatttttaggcgtaggtagtggcggaggtagtttcggtacgagcggtgcggatagttgaggaggcgcggggttcgtttaggcggtagtcgtattaggtatagcggatattttatttttttcgcgttcgggttatcgtttttcgtcgtttttttatcgtcgaatttaggtttcgtcgtcgtcgtcgcggttttcgtttcggtttcggcggtcggttcggcgggtagcgtttcgggcggcgggttttgggtcgcggtaggggtcggggcgggcggcggttgcgtagtcgggggcggcggttcggtttgcggtttggttcgggcgcggcggtcgcgggtcgaggtagagaagacgttgtgtaaggtgaggcgtcggcgtcggtcgtcgttgcggtatttagggtcgggtgcggtcgtatgtagcgatgtggagcgcggcgattcggagtttttttcggagtttatggtcggtagaggtcgaggagttaggggcgtttagcgtcgttatagttttcgttttagcgttttttagttagcgttcggtcgtcgtcgacgtcgttattatcgttttaatcgttttttcggcgatagaagtcgagcggtaacgacgaagtgattataaagttttcgtttcgcgcgtcgttgttttgcgtaggcgtttcgtttaaatattttataatttttgcgtttcggtttaggagtgcgttgggtagggtcgagcggggtggggtcgagcgagt

SEQ ID NO: 26544 - DNA, 1050 bp, Artificial Sequence
  chemically treated genomic DNA (Homo sapiens) CpG-island No: 26544
actcgctcgaccccaccccgctcgaccctacccaacgcactcctaaaccgaaacgcaaaaattataaaatatttaaacgaaacgcctacgcaaaacaacgacgcgcgaaacgaaaactttataatcacttcgtcgttaccgctcgacttctatcgccgaaaaaacgattaaaacgataataacgacgtcgacgacgaccgaacgctaactaaaaaacgctaaaacgaaaactataacgacgctaaacgcccctaactcctcgacctctaccgaccataaactccgaaaaaaactccgaatcgccgcgctccacatcgctacatacgaccgcacccgaccctaaataccgcaacgacgaccgacgccgacgcctcaccttacacaacgtcttctctacctcgacccgcgaccgccgcgcccgaaccaaaccgcaaaccgaaccgccgcccccgactacgcaaccgccgcccgccccgacccctaccgcgacccaaaacccgccgcccgaaacgctacccgccgaaccgaccgccgaaaccgaaacgaaaaccgcgacgacgacgacgaaacctaaattcgacgataaaaaaacgacgaaaaacgataacccgaacgcgaaaaaaataaaatatccgctatacctaatacgactaccgcctaaacgaaccccgcgcctcctcaactatccgcaccgctcgtaccgaaactacctccgccactacctacgcctaaaaataaacgaaaacaaaatacccatcaactaccccgaatacaacgaacgactcaacccgcacgacatccgcttactactcgccgacccgccgcttatacacaaatacgaaaaattcatactacgccgctacctaacctcgaaccccgactaccgctaatacccgaccccgaactacgaataaacgcgaaaacgtaacgcgaataacgacgaactacaaccgaaaaacgtaactaaaaacaacaaaaaccccgcgtaaatatcccaaacaaaaaaacccgcaaaacgacaacttcgacgaaataataaccatcaaacaa

SEQ ID NO: 26545 - DNA, 785 bp, Artificial Sequence
  chemically treated genomic DNA (Homo sapiens) CpG-island No: 26545
aggggattagagacggcgttttatttttgtatggtagtagcgtgtttttagtttcgcgtcgtcgggacggtttacgttttgtttcggtttttttcgatggtcgtcgtttatttgtttcggaattcgtcgagcgcgcgttgcgtttcggtgttttggcgttttagtcgggcgcgttcggtttttaggtttcggacgcgttggcggttgttttcgatttggcgggcgagggcgttttcgggttcggttagttcgtttaggcgttggaaggtatttagttgttttcggagttcggtatggcgttgttcgagggcgcgggttcgttggacgtgggcggttacgcgttcgtcgagtttttgtagcgtcgttaggttcgttgttttagtttagttttcgtcggtcgggcgttcgggttcggcggcgcgcgaagtttcgtcggcgtgttcgtattgttttttgcgggtttggaagacgtagttgcgtcggtatatggttgttttggcgcgggcgcgcgggcggcgtcgagtcggttttttaggaggttttcggcgtagttcgtagttcgttaaataaatatcggaggttttcggcgcgttgttgggacgttttagagtcgattagtagttgggcgttacgttgggttcgggcgcgggagaagaaaagagtagcggttcgttttgtgcggcggattagcggtttatatagtttcggggttggaaggttacgttgggtaatgaggtttttgtttcgtgattgtttaggtttgttgtttttgattgaatggaggg

SEQ ID NO: 26546 - DNA, 785 bp, Artificial Sequence
  chemically treated genomic DNA (Homo sapiens) CpG-island No: 26546
ccctccattcaatcaaaaacaacaaacctaaacaatcacgaaacaaaaacctcattacccaacgtaaccttccaaccccgaaactatataaaccgctaatccgccgcacaaaacgaaccgctactcttttcttctcccgcgcccgaacccaacgtaacgcccaactactaatcgactctaaaacgtcccaacaacgcgccgaaaacctccgatatttatttaacgaactacgaactacgccgaaaacctcctaaaaaaccgactcgacgccgcccgcgcgcccgcgccaaaacaaccatataccgacgcaactacgtcttccaaacccgcaaaaaacaatacgaacacgccgacgaaacttcgcgcgccgccgaacccgaacgcccgaccgacgaaaactaaactaaaacaacgaacctaacgacgctacaaaaactcgacgaacgcgtaaccgcccacgtccaacgaacccgcgccctcgaacaacgccataccgaactccgaaaacaactaaataccttccaacgcctaaacgaactaaccgaacccgaaaacgccctcgcccgccaaatcgaaaacaaccgccaacgcgtccgaaacctaaaaaccgaacgcgcccgactaaaacgccaaaacaccgaaacgcaacgcgcgctcgacgaattccgaaacaaataaacgacgaccatcgaaaaaaaccgaaacaaaacgtaaaccgtcccgacgacgcgaaactaaaaacacgctactaccatacaaaaataaaacgccgtctctaatcccct

SEQ ID NO: 26547 - DNA, 785 bp, Artificial Sequence
  chemically treated genomic DNA (Homo sapiens) CpG-island No: 26547
ttttttatttaattaaaagtaataggtttgaataattacggaataaaaattttattgtttagcgtaattttttaatttcggagttgtatgggtcgttaattcgtcgtataaagcgggtcgttgttttttttttttttcgcgttcgggtttagcgtggcgtttaattgttgatcggttttggaacgttttagtagcgcgtcgggggttttcggtgtttatttagcgggttgcgggttgcgtcgggggttttttggagagtcggttcggcgtcgttcgcgcgttcgcgttagagtagttatgtatcggcgtagttacgttttttagattcgtaaggagtagtacgagtacgtcgacgaggtttcgcgcgtcgtcgagttcgagcgttcggtcgacgagggttgggttggggtaacgagtttggcggcgttgtaggggttcggcgagcgcgtggtcgtttacgtttagcgggttcgcgttttcgagtagcgttatgtcgggtttcggaggtagttggatgttttttagcgtttgggcgagttggtcgggttcgaggacgttttcgttcgttaagtcgagagtaatcgttagcgcgttcgggatttggaggtcgagcgcgttcggttggagcgttagggtatcgaggcgtagcgcgcgttcgacgagtttcgaagtaagtaagcggcggttatcgggggaaatcgaggtagggcgtgggtcgtttcggcggcgcggggttgggagtacgttgttattatgtaggggtggagcgtcgtttttggtttttt

SEQ ID NO: 26548 - DNA, 785 bp, Artificial Sequence
  chemically treated genomic DNA (Homo sapiens) CpG-island No: 26548
aaaaaaccaaaaacgacgctccacccctacataataacaacgtactcccaaccccgcgccgccgaaacgacccacgccctacctcgatttcccccgataaccgccgcttacttacttcgaaactcgtcgaacgcgcgctacgcctcgataccctaacgctccaaccgaacgcgctcgacctccaaatcccgaacgcgctaacgattactctcgacttaacgaacgaaaacgtcctcgaacccgaccaactcgcccaaacgctaaaaaacatccaactacctccgaaacccgacataacgctactcgaaaacgcgaacccgctaaacgtaaacgaccacgcgctcgccgaacccctacaacgccgccaaactcgttaccccaacccaaccctcgtcgaccgaacgctcgaactcgacgacgcgcgaaacctcgtcgacgtactcgtactactccttacgaatctaaaaaacgtaactacgccgatacataactactctaacgcgaacgcgcgaacgacgccgaaccgactctccaaaaaacccccgacgcaacccgcaacccgctaaataaacaccgaaaacccccgacgcgctactaaaacgttccaaaaccgatcaacaattaaacgccacgctaaacccgaacgcgaaaaaaaaaaaaaacaacgacccgctttatacgacgaattaacgacccatacaactccgaaattaaaaaattacgctaaacaataaaatttttattccgtaattattcaaacctattacttttaattaaataaaaaa

SEQ ID NO: 26549 - DNA, 931 bp, Artificial Sequence
  chemically treated genomic DNA (Homo sapiens) CpG-island No: 26549
ttcgcgtgcgggcgaggagatttcgggtcgcgtttttagttttagttgggttgcgggcgacgattttttttttttaggcgggatttttcgggtttggcgtcgcgagttaatacggcgtgaggcgtcggcgtcgggtgcgtgtgggaatgtgggtggcggcggtttttattttttagttcgtttatagtattcggggttcggtcggttttttaggttgcgttttatttttaaagtttcgtttgaggtgtggcgtgttagagtaggggttgcgaggagtcgttaagttagtttggtcgggtttttggcgtcgttgggcgtttgtaatgcgcggtaggcgcggggcggggaggggcggggcgtggagaaggcggggtagtgggcgagggcggggcgtgtaggggacggggcggagtagtgggcgaggggcggggcgtgtaggggacggggcggggtagtgggcgagggcggggcgtgtaggggacggggcggggcgtgtaggagacggggcggggtagtgggcgatggacgggattgataggggatggggcggggtagtgggcgaggggcggggcgtgtaggggatggagagggacgggtaggatatggggaggggcgtggaggggtatggacgggcggggcggggtagtggttgagggatcgggggtagggggcggggaagggcgggttagcgatcgagggattgggcgcggcggcggcggcggcggttgggggtacggatagagtagggtagtgcgttagagtggagaggatcgggattgagagggacgagggcgtagggcgttggtggggatagtggacggggtaggagggatagagttagatagtgagtaaggcgtatcggttttagtgcgtagttttcggttttgttttggcgttcggatttgagatatttgagtaggggtatgatagg

SEQ ID NO: 26550 - DNA, 931 bp, Artificial Sequence
  chemically treated genomic DNA (Homo sapiens) CpG-island No: 26550
cctatcatacccctactcaaatatctcaaatccgaacgccaaaacaaaaccgaaaactacgcactaaaaccgatacgccttactcactatctaactctatccctcctaccccgtccactatccccaccaacgccctacgccctcgtccctctcaatcccgatcctctccactctaacgcactaccctactctatccgtacccccaaccgccgccgccgccgccgcgcccaatccctcgatcgctaacccgcccttccccgccccctacccccgatccctcaaccactaccccgccccgcccgtccatacccctccacgcccctccccatatcctacccgtccctctccatcccctacacgccccgcccctcgcccactaccccgccccatcccctatcaatcccgtccatcgcccactaccccgccccgtctcctacacgccccgccccgtcccctacacgccccgccctcgcccactaccccgccccgtcccctacacgccccgcccctcgcccactactccgccccgtcccctacacgccccgccctcgcccactaccccgccttctccacgccccgcccctccccgccccgcgcctaccgcgcattacaaacgcccaacgacgccaaaaacccgaccaaactaacttaacgactcctcgcaacccctactctaacacgccacacctcaaacgaaactttaaaaataaaacgcaacctaaaaaaccgaccgaaccccgaatactataaacgaactaaaaaataaaaaccgccgccacccacattcccacacgcacccgacgccgacgcctcacgccgtattaactcgcgacgccaaacccgaaaaatcccgcctaaaaaaaaaaaatcgtcgcccgcaacccaactaaaactaaaaacgcgacccgaaatctcctcgcccgcacgcgaa

SEQ ID NO: 26551 - DNA, 931 bp, Artificial Sequence
  chemically treated genomic DNA (Homo sapiens) CpG-island No: 26551
tttgttatgtttttgtttaggtgttttaggttcgagcgttaggataaagtcggagattgcgtattaggatcggtgcgttttgtttattgtttgattttattttttttgtttcgtttattgtttttattaacgttttgcgttttcgttttttttagtttcggttttttttattttagcgtattgttttattttgttcgtatttttagtcgtcgtcgtcgtcgtcgcgtttagtttttcggtcgttggttcgttttttttcgttttttgttttcggttttttagttattgtttcgtttcgttcgtttatatttttttacgtttttttttatgttttgttcgtttttttttattttttgtacgtttcgtttttcgtttattgtttcgttttattttttgttagtttcgtttatcgtttattgtttcgtttcgttttttgtacgtttcgtttcgttttttgtacgtttcgttttcgtttattgtttcgtttcgttttttgtacgtttcgtttttcgtttattgtttcgtttcgttttttgtacgtttcgttttcgtttattgtttcgttttttttacgtttcgttttttttcgtttcgcgtttgtcgcgtattgtagacgtttagcggcgttaagaattcggttaagttgatttggcgatttttcgtagtttttgttttggtacgttatattttagacgaggttttgaaagtagggcgtagtttgagaggtcggtcggatttcgagtgttgtaggcgggttgggagatgggggtcgtcgttatttatatttttatacgtattcggcgtcggcgttttacgtcgtgttagttcgcggcgttaagttcggagggtttcgtttgaggaagaaaggtcgtcgttcgtagtttagttggggttggaggcgcgattcggggttttttcgttcgtacgcgga

SEQ ID NO: 26552 - DNA, 931 bp, Artificial Sequence
  chemically treated genomic DNA (Homo sapiens) CpG-island No: 26552
tccgcgtacgaacgaaaaaaccccgaatcgcgcctccaaccccaactaaactacgaacgacgacctttcttcctcaaacgaaaccctccgaacttaacgccgcgaactaacacgacgtaaaacgccgacgccgaatacgtataaaaatataaataacgacgacccccatctcccaacccgcctacaacactcgaaatccgaccgacctctcaaactacgccctactttcaaaacctcgtctaaaatataacgtaccaaaacaaaaactacgaaaaatcgccaaatcaacttaaccgaattcttaacgccgctaaacgtctacaatacgcgacaaacgcgaaacgaaaaaaaacgaaacgtaaaaaaaacgaaacaataaacgaaaacgaaacgtacaaaaaacgaaacgaaacaataaacgaaaaacgaaacgtacaaaaaacgaaacgaaacaataaacgaaaacgaaacgtacaaaaaacgaaacgaaacgtacaaaaaacgaaacgaaacaataaacgataaacgaaactaacaaaaaataaaacgaaacaataaacgaaaaacgaaacgtacaaaaaataaaaaaaaacgaacaaaacataaaaaaaaacgtaaaaaaatataaacgaacgaaacgaaacaataactaaaaaaccgaaaacaaaaaacgaaaaaaaacgaaccaacgaccgaaaaactaaacgcgacgacgacgacgacgactaaaaatacgaacaaaataaaacaatacgctaaaataaaaaaaaccgaaactaaaaaaaacgaaaacgcaaaacgttaataaaaacaataaacgaaacaaaaaaaataaaatcaaacaataaacaaaacgcaccgatcctaatacgcaatctccgactttatcctaacgctcgaacctaaaacacctaaacaaaaacataacaaa

SEQ ID NO: 26553 - DNA, 878 bp, Artificial Sequence
  chemically treated genomic DNA (Homo sapiens) CpG-island No: 26553
gttttcgtcggtcgcgggcggagtttttttcgcggcgttcggcgagtttcggttttcgttttttttttcgttttttcgttttcggatttttttttcgtttttttagcggtcgttatcgtcgtcgtatagtttcgcgcggcgcgagtaggtacgtgcgtttcggtagtggtttcgggtcgggtcgggaagggggcgggagatcgggagggcgaggcggtggcggtcgggttcgcgtttttcgggttgcgtcgtaggagagagattttcgtaggcgagattttcgtaggcgtacgtcggttgtaggaaggcggacgggtatcggagaggacgtattttcgttcgtcggcggtcgggcgtttttcgttttagcgtggtgaggcggggagggaggttcggtataggtacgtacgcggagaggggatcgttgggggcggtaggaggtcgagggtcgggggcggggagtggcggcgaaggacggcgagtttgatttcgcggttcgtcgaaggatatgcgattaggggattcggttttttcgggttttcgtttggttcggttcggtttttcgggtttcgcgtttgtgggtaagggtaggagtagggggtgtggattgggtcggcgggagcgggcgcggtgggtagtcggcgtgttggggttttttgcgcgtaattttgggtataatagcgtggatttgcgtgtgcgtatttgcgcgttttaaggttttgtgtataattcgtgcgtgtgtttatcgattgggttttgtgaagttttatttatagtcgttgtgcgttttttttttcgggtgttagtgcgcgcggcgggtggggtattgggtttttgcgggttttggtggatttggtttgggttttatttttaggggt

SEQ ID NO: 26554 - DNA, 878 bp, Artificial Sequence
  chemically treated genomic DNA (Homo sapiens) CpG-island No: 26554
acccctaaaaataaaacccaaaccaaatccaccaaaacccgcaaaaacccaataccccacccgccgcgcgcactaacacccgaaaaaaaaaacgcacaacgactataaataaaacttcacaaaacccaatcgataaacacacgcacgaattatacacaaaaccttaaaacgcgcaaatacgcacacgcaaatccacgctattatacccaaaattacgcgcaaaaaaccccaacacgccgactacccaccgcgcccgctcccgccgacccaatccacaccccctactcctacccttacccacaaacgcgaaacccgaaaaaccgaaccgaaccaaacgaaaacccgaaaaaaccgaatcccctaatcgcatatccttcgacgaaccgcgaaatcaaactcgccgtccttcgccgccactccccgcccccgaccctcgacctcctaccgcccccaacgatcccctctccgcgtacgtacctataccgaacctccctccccgcctcaccacgctaaaacgaaaaacgcccgaccgccgacgaacgaaaatacgtcctctccgatacccgtccgccttcctacaaccgacgtacgcctacgaaaatctcgcctacgaaaatctctctcctacgacgcaacccgaaaaacgcgaacccgaccgccaccgcctcgccctcccgatctcccgcccccttcccgacccgacccgaaaccactaccgaaacgcacgtacctactcgcgccgcgcgaaactatacgacgacgataacgaccgctaaaaaaacgaaaaaaaaatccgaaaacgaaaaaacgaaaaaaaaaacgaaaaccgaaactcgccgaacgccgcgaaaaaaactccgcccgcgaccgacgaaaac

SEQ ID NO: 26555 - DNA, 878 bp, Artificial Sequence
  chemically treated genomic DNA (Homo sapiens) CpG-island No: 26555
gtttttgggagtgagatttaagttagatttattaagattcgtaggggtttaatattttattcgtcgcgcgtattgatattcggagagagggacgtatagcggttgtgggtgaagttttataaaatttagtcgatagatatacgtacgagttgtatataaagttttggggcgcgtagatacgtatacgtaggtttacgttgttgtatttaaagttgcgcgtagaaagttttagtacgtcggttgtttatcgcgttcgttttcgtcggtttagtttatattttttgtttttgtttttgtttatagacgcgggattcggaaggtcgaatcggattaggcggaggttcggggaggtcgggttttttggtcgtatgtttttcggcgggtcgcgaggttaggttcgtcgtttttcgtcgttatttttcgttttcggttttcggttttttgtcgtttttagcggtttttttttcgcgtgcgtatttgtgtcgggttttttttttcgttttattacgttggggcgaagggcgttcggtcgtcggcgggcgagggtgcgtttttttcggtgttcgttcgtttttttgtagtcggcgtacgtttgcgggggtttcgtttgcgggggttttttttttgcggcgtagttcggagggcgcgggttcggtcgttatcgtttcgttttttcggtttttcgtttttttttcggttcggttcggagttattgtcgaggcgtacgtatttattcgcgtcgcgcggagttgtacggcggcggtggcggtcgttggggaggcgggggggggattcggggacggagggacgggagaaggggcgggggtcggggttcgtcgagcgtcgcggagggagtttcgttcgcggtcggcgagggt

SEQ ID NO: 26556 - DNA, 878 bp, Artificial Sequence
  chemically treated genomic DNA (Homo sapiens) CpG-island No: 26556
accctcgccgaccgcgaacgaaactccctccgcgacgctcgacgaaccccgacccccgccccttctcccgtccctccgtccccgaatcccccccccgcctccccaacgaccgccaccgccgccgtacaactccgcgcgacgcgaataaatacgtacgcctcgacaataactccgaaccgaaccgaaaaaaaaacgaaaaaccgaaaaaacgaaacgataacgaccgaacccgcgccctccgaactacgccgcaaaaaaaaaacccccgcaaacgaaacccccgcaaacgtacgccgactacaaaaaaacgaacgaacaccgaaaaaaacgcaccctcgcccgccgacgaccgaacgcccttcgccccaacgtaataaaacgaaaaaaaaaacccgacacaaatacgcacgcgaaaaaaaaaccgctaaaaacgacaaaaaaccgaaaaccgaaaacgaaaaataacgacgaaaaacgacgaacctaacctcgcgacccgccgaaaaacatacgaccaaaaaacccgacctccccgaacctccgcctaatccgattcgaccttccgaatcccgcgtctataaacaaaaacaaaaacaaaaaatataaactaaaccgacgaaaacgaacgcgataaacaaccgacgtactaaaactttctacgcgcaactttaaatacaacaacgtaaacctacgtatacgtatctacgcgccccaaaactttatatacaactcgtacgtatatctatcgactaaattttataaaacttcacccacaaccgctatacgtccctctctccgaatatcaatacgcgcgacgaataaaatattaaacccctacgaatcttaataaatctaacttaaatctcactcccaaaaac

SEQ ID NO: 26557 - DNA, 511 bp, Artificial Sequence
  chemically treated genomic DNA (Homo sapiens) CpG-island No: 26557
gaagtaatcgtgtgttattattttttaatgtaagaagtagacgagcgcgttttgtttgtaggtgatggtcggcgttgtcgatgcgaatagtatttttaggttcgttatgagcgttcgcgatttcggcgtttggaggaaagaagggggcgggggtagtgtagtgagtcggtttcgcggtcggggtagttataattttgttttttttttgcgttggtttttgtcgagtttatatttgagattaaaatggagacgttcggggacggggcggggcggggaagtcggaagtagttttaatagcgggcgtaattgcgtgaggcgcgtcgggttggtaacgcgagcgtagtattgaaaggtttcgttagggagtgcgagcggggcgtggttttttaaagtcggaagtcgggttttggcggtagtcgataggatcgtttgacgcgggtatagcgttttttaagaggttattttgttgagaggtagattttttatttataaaatggggtatgttaggtcg

SEQ ID NO: 26558 - DNA, 511 bp, Artificial Sequence
  chemically treated genomic DNA (Homo sapiens) CpG-island No: 26558
cgacctaacataccccattttataaataaaaaatctacctctcaacaaaataacctcttaaaaaacgctatacccgcgtcaaacgatcctatcgactaccgccaaaacccgacttccgactttaaaaaaccacgccccgctcgcactccctaacgaaacctttcaatactacgctcgcgttaccaacccgacgcgcctcacgcaattacgcccgctattaaaactacttccgacttccccgccccgccccgtccccgaacgtctccattttaatctcaaatataaactcgacaaaaaccaacgcaaaaaaaaaacaaaattataactaccccgaccgcgaaaccgactcactacactacccccgcccccttctttcctccaaacgccgaaatcgcgaacgctcataacgaacctaaaaatactattcgcatcgacaacgccgaccatcacctacaaacaaaacgcgctcgtctacttcttacattaaaaaataataacacacgattacttc

SEQ ID NO: 26559 - DNA, 511 bp, Artificial Sequence
  chemically treated genomic DNA (Homo sapiens) CpG-island No: 26559
cggtttagtatattttattttgtggatgggaagtttgttttttagtaaggtggttttttggaggacgttgtgttcgcgttaggcgattttgtcgattgtcgttaagattcggttttcggttttgaggggttacgtttcgttcgtattttttggcggaattttttagtgttgcgttcgcgttgttaattcggcgcgttttacgtagttgcgttcgttgttgggattattttcggttttttcgtttcgtttcgttttcgggcgtttttattttggttttaggtgtggattcggtaagaattagcgtaagagggaagtagagttatagttatttcggtcgcggagtcggtttattgtattattttcgttttttttttttttttagacgtcgaagtcgcgggcgtttatggcgggtttggaggtattgttcgtatcggtagcgtcggttattatttgtaggtaggacgcgttcgtttgttttttgtattgggaagtggtgatatacggttatttt

SEQ ID NO: 26560 - DNA, 511 bp, Artificial Sequence
  chemically treated genomic DNA (Homo sapiens) CpG-island No: 26560
aaaataaccgtatatcaccacttcccaatacaaaaaacaaacgaacgcgtcctacctacaaataataaccgacgctaccgatacgaacaatacctccaaacccgccataaacgcccgcgacttcgacgtctaaaaaaaaaaaaaaaacgaaaataatacaataaaccgactccgcgaccgaaataactataactctacttccctcttacgctaattcttaccgaatccacacctaaaaccaaaataaaaacgcccgaaaacgaaacgaaacgaaaaaaccgaaaataatcccaacaacgaacgcaactacgtaaaacgcgccgaattaacaacgcgaacgcaacactaaaaaattccgccaaaaaatacgaacgaaacgtaacccctcaaaaccgaaaaccgaatcttaacgacaatcgacaaaatcgcctaacgcgaacacaacgtcctccaaaaaaccaccttactaaaaaacaaacttcccatccacaaaataaaatatactaaaccg

SEQ ID NO: 26561 - DNA, 612 bp, Artificial Sequence
  chemically treated genomic DNA (Homo sapiens) CpG-island No: 26561
tcgcgtttgcgtattgtagattttgaagtcgtcgagtttttcgtcgaggtgggtggggaaattgttcgggtattcgggttttttatttcgttttcgttgtatgaatgagaggcgcggcgttcgtttttttttcggcgggttcgtttttcgcgaggggtcgtcgggcgtagttagtcgtcgttattttcgtcgcgttttgttcggacggacgttcgtcgttcgtagtttgtcgttcgtcgtagggcgttgacggtttcgtacgtttgtcgttgttatcggcgcgttcgagtaagtgagcgagcgagggcgggagcgtcgcggtcgtcgttttcgggttggggtttgggggatcgagtcgtttcgggttcgggatgttgaggagatcgcgggttcgcgttagttttttatatatatatattttttcggcgtttcggtcggtcgggcgcggtgtgtaggggtgaggcggtgtttttaggttgaggagggacgcggaggagggttcggcgcggtttcgggattggagggtgagttttttataaagggcggagcggggttgttatttggagattacggagggaaggtgcgtgggttttcgtacgttttgttcgttta

SEQ ID NO: 26562 - DNA, 612 bp, Artificial Sequence
  chemically treated genomic DNA (Homo sapiens) CpG-island No: 26562
taaacgaacaaaacgtacgaaaacccacgcaccttccctccgtaatctccaaataacaaccccgctccgccctttataaaaaactcaccctccaatcccgaaaccgcgccgaaccctcctccgcgtccctcctcaacctaaaaacaccgcctcacccctacacaccgcgcccgaccgaccgaaacgccgaaaaaatatatatatataaaaaactaacgcgaacccgcgatctcctcaacatcccgaacccgaaacgactcgatcccccaaaccccaacccgaaaacgacgaccgcgacgctcccgccctcgctcgctcacttactcgaacgcgccgataacaacgacaaacgtacgaaaccgtcaacgccctacgacgaacgacaaactacgaacgacgaacgtccgtccgaacaaaacgcgacgaaaataacgacgactaactacgcccgacgacccctcgcgaaaaacgaacccgccgaaaaaaaaacgaacgccgcgcctctcattcatacaacgaaaacgaaataaaaaacccgaatacccgaacaatttccccacccacctcgacgaaaaactcgacgacttcaaaatctacaatacgcaaacgcga

SEQ ID NO: 26563 - DNA, 612 bp, Artificial Sequence
  chemically treated genomic DNA (Homo sapiens) CpG-island No: 26563
tgggcgagtaggacgtgcgggggtttacgtatttttttttcgtgatttttaggtgatagtttcgtttcgttttttgtgagggatttattttttagtttcggggtcgcgtcggattttttttcgcgtttttttttagtttggagatatcgttttatttttgtatatcgcgttcggtcggtcgaggcgtcgggagagtgtgtgtgtgtgggaggttggcgcgggttcgcggtttttttagtatttcgaattcggagcggttcggttttttaaattttagttcgggggcggcggtcgcggcgttttcgttttcgttcgtttatttattcgggcgcgtcggtggtagcggtagacgtgcgggatcgttagcgttttgcggcgggcggtaggttgcgggcggcgagcgttcgttcggatagagcgcggcggaggtggcggcggttgattgcgttcggcggtttttcgcgaggggcgggttcgtcgggggaggggcgggcgtcgcgttttttatttatgtagcgggggcggggtgagggattcggatgttcgggtagtttttttatttatttcggcggagggttcggcggttttagagtttgtagtgcgtaggcgcgg

SEQ ID NO: 26564 - DNA, 612 bp, Artificial Sequence
  chemically treated genomic DNA (Homo sapiens) CpG-island No: 26564
ccgcgcctacgcactacaaactctaaaaccgccgaaccctccgccgaaataaataaaaaaactacccgaacatccgaatccctcaccccgcccccgctacataaataaaaaacgcgacgcccgcccctcccccgacgaacccgcccctcgcgaaaaaccgccgaacgcaatcaaccgccgccacctccgccgcgctctatccgaacgaacgctcgccgcccgcaacctaccgcccgccgcaaaacgctaacgatcccgcacgtctaccgctaccaccgacgcgcccgaataaataaacgaacgaaaacgaaaacgccgcgaccgccgcccccgaactaaaatttaaaaaaccgaaccgctccgaattcgaaatactaaaaaaaccgcgaacccgcgccaacctcccacacacacacactctcccgacgcctcgaccgaccgaacgcgatatacaaaaataaaacgatatctccaaactaaaaaaaaacgcgaaaaaaaatccgacgcgaccccgaaactaaaaaataaatccctcacaaaaaacgaaacgaaactatcacctaaaaatcacgaaaaaaaaatacgtaaacccccgcacgtcctactcgccca

SEQ ID NO: 26565 - DNA, 1233 bp, Artificial Sequence
  chemically treated genomic DNA (Homo sapiens) CpG-island No: 26565
ttcgatcgtatcgtttagatttcggggtagtttagttcgtcgtttttttcggcgtttcgagtttggttcggttttttttaggtttcggttttttaggttcgtcgtttcgtttagttcgggtttcgcgtattttgttttttatttttatagtgtttaggtagtcgttgttcgtttcgtgtcggtggttgcggtttatgttgaacgtcgagtttcgcgacggtttttttcggtcgggcggttttttaggagcgcggggagcgagtgcgcgattggggatttcggaaagcggttgcggttcgggcgtttttttataggtatttgtagagggggcggtcgtagtttcggcgttcgcgttgagttttattttattagttgtttatacggcgggatcgagggtcggattggtggcgcggtaggcggggaagtagtttttttttttcgggtttcggcggcgacggcgatagcgttggaggagaggagggggcggagcggaggttataagcgtcgtaatttttttttttgtcgtttttttcgcgagttcgcgcgcgcgtattcgagcggattatagtcgcggcgcgtgcgcgcgtttatttgtagttttcgaagatgtcgtaatttttcgcgtttcgtttatatttaatagaaagcgcgtatttgcgttcgcggcgttaattaatcgatatacgtttcgcgcggtgcgtgggcgggttgtttttttaaaatttcgtttattatcgtacgattggttttgcgttacgagggaggggcgggattatttgaagttatggtttttcgtttcgttttaggtcggagagttagaaggcgtatgcgcgggtgttggagttttcgtttcgggaaggtacgcggggaggtcggtcggaagcgcgagcgtatttgaagaagggttcggttgggtgggttttttgcgtacgcgcgagcgcgcgtttggttgttcggtttcgtcggggttcgcgtcgtttagcgcgcgttagttatacgtacggtttaggggattggatgcgtcgttcgttcggttgtcgaggcgttgcggggttattcggttttagtcgggtttttttttcgtttttattttgggatgttgtagtttttaacgacgtttttttatcgttttttatcgttgtttaggcgtttcgttgtaatttttggttgtaaaatttaagttttttcgtttttgtagcggttgttgggggagaagtttagggtttttttggt

SEQ ID NO: 26566 - DNA, 1233 bp, Artificial Sequence
  chemically treated genomic DNA (Homo sapiens) CpG-island No: 26566
accaaaaaaaccctaaacttctcccccaacaaccgctacaaaaacgaaaaaacttaaattttacaaccaaaaattacaacgaaacgcctaaacaacgataaaaaacgataaaaaaacgtcgttaaaaactacaacatcccaaaataaaaacgaaaaaaaaacccgactaaaaccgaataaccccgcaacgcctcgacaaccgaacgaacgacgcatccaatcccctaaaccgtacgtataactaacgcgcgctaaacgacgcgaaccccgacgaaaccgaacaaccaaacgcgcgctcgcgcgtacgcaaaaaacccacccaaccgaacccttcttcaaatacgctcgcgcttccgaccgacctccccgcgtaccttcccgaaacgaaaactccaacacccgcgcatacgccttctaactctccgacctaaaacgaaacgaaaaaccataacttcaaataatcccgcccctccctcgtaacgcaaaaccaatcgtacgataataaacgaaattttaaaaaaacaacccgcccacgcaccgcgcgaaacgtatatcgattaattaacgccgcgaacgcaaatacgcgctttctattaaatataaacgaaacgcgaaaaattacgacatcttcgaaaactacaaataaacgcgcgcacgcgccgcgactataatccgctcgaatacgcgcgcgcgaactcgcgaaaaaaacgacaaaaaaaaaaattacgacgcttataacctccgctccgccccctcctctcctccaacgctatcgccgtcgccgccgaaacccgaaaaaaaaaaactacttccccgcctaccgcgccaccaatccgaccctcgatcccgccgtataaacaactaataaaataaaactcaacgcgaacgccgaaactacgaccgccccctctacaaatacctataaaaaaacgcccgaaccgcaaccgctttccgaaatccccaatcgcgcactcgctccccgcgctcctaaaaaaccgcccgaccgaaaaaaaccgtcgcgaaactcgacgttcaacataaaccgcaaccaccgacacgaaacgaacaacgactacctaaacactataaaaataaaaaacaaaatacgcgaaacccgaactaaacgaaacgacgaacctaaaaaaccgaaacctaaaaaaaaccgaaccaaactcgaaacgccgaaaaaaacgacgaactaaactaccccgaaatctaaacgatacgatcgaa

SEQ ID NO: 26567 - DNA, 1233 bp, Artificial Sequence
  chemically treated genomic DNA (Homo sapiens) CpG-island No: 26567
gttaagagagttttaagttttttttttagtaatcgttgtagaggcgggaaaatttgaattttgtaattaagagttgtagcgggacgtttaagtaacgataaggggcggtggaggggcgtcgttgggggttgtagtattttaaagtggaagcgggaagggggttcggttggaatcgaatagtttcgtagcgtttcggtaatcggacgggcggcgtatttaattttttggatcgtgcgtgtgattggcgcgcgttaagcggcgcgagtttcggcggagtcgggtaattaggcgcgcgttcgcgcgtgcgtaaaaggtttatttagtcgagtttttttttaggtgcgttcgcgttttcggtcggttttttcgcgtgttttttcggggcggaaattttagtattcgcgtatgcgttttttggtttttcggtttgaagcggggcggagggttatggttttaggtgatttcgtttttttttcgtagcgtaggattaatcgtgcggtggtaggcggggttttgaggaggtagttcgtttacgtatcgcgcgaggcgtgtatcgattggttggcgtcgcgggcgtaggtgcgcgttttttattgggtgtgggcggaacgcgagggattgcggtattttcgggggttgtaggtgagcgcgcgtacgcgtcgcggttgtggttcgttcgggtgcgcgcgcgcgggttcgcgggggaggcggtagagggagaggttgcggcgtttgtggttttcgtttcgttttttttttttttttagcgttgtcgtcgtcgtcgtcggggttcggagggagggagttgttttttcgtttgtcgcgttattagttcgattttcggtttcgtcgtgtgagtagttggtggagtggagtttagcgcggacgtcggagttgcggtcgttttttttgtaggtgtttgtgaggaggcgttcgggtcgtaatcgtttttcgagatttttagtcgcgtattcgtttttcgcgtttttgaggggtcgttcggtcggaggaggtcgtcgcggggttcggcgtttagtatgaatcgtagttatcggtacggggcgggtagcggttgtttgggtattatggaggtgaagagtaaggtgcgcggggttcgggttgggcggagcggcgggtttggggggtcggggtttgggagaggtcgggttaggttcggagcgtcgggggaggcgacgggttgagttgtttcggggtttggacggtgcggtcggg

SEQ ID NO: 26568 - DNA, 1233 bp, Artificial Sequence
  chemically treated genomic DNA (Homo sapiens) CpG-island No: 26568
cccgaccgcaccgtccaaaccccgaaacaactcaacccgtcgcctcccccgacgctccgaacctaacccgacctctcccaaaccccgaccccccaaacccgccgctccgcccaacccgaaccccgcgcaccttactcttcacctccataatacccaaacaaccgctacccgccccgtaccgataactacgattcatactaaacgccgaaccccgcgacgacctcctccgaccgaacgacccctcaaaaacgcgaaaaacgaatacgcgactaaaaatctcgaaaaacgattacgacccgaacgcctcctcacaaacacctacaaaaaaaacgaccgcaactccgacgtccgcgctaaactccactccaccaactactcacacgacgaaaccgaaaatcgaactaataacgcgacaaacgaaaaaacaactccctccctccgaaccccgacgacgacgacgacaacgctaaaaaaaaaaaaaaaacgaaacgaaaaccacaaacgccgcaacctctccctctaccgcctcccccgcgaacccgcgcgcgcgcacccgaacgaaccacaaccgcgacgcgtacgcgcgctcacctacaacccccgaaaataccgcaatccctcgcgttccgcccacacccaataaaaaacgcgcacctacgcccgcgacgccaaccaatcgatacacgcctcgcgcgatacgtaaacgaactacctcctcaaaaccccgcctaccaccgcacgattaatcctacgctacgaaaaaaaaacgaaatcacctaaaaccataaccctccgccccgcttcaaaccgaaaaaccaaaaaacgcatacgcgaatactaaaatttccgccccgaaaaaacacgcgaaaaaaccgaccgaaaacgcgaacgcacctaaaaaaaaactcgactaaataaaccttttacgcacgcgcgaacgcgcgcctaattacccgactccgccgaaactcgcgccgcttaacgcgcgccaatcacacgcacgatccaaaaaattaaatacgccgcccgtccgattaccgaaacgctacgaaactattcgattccaaccgaacccccttcccgcttccactttaaaatactacaacccccaacgacgcccctccaccgccccttatcgttacttaaacgtcccgctacaactcttaattacaaaattcaaattttcccgcctctacaacgattactaaaaaaaaaacttaaaactctcttaac

SEQ ID NO: 26569 - DNA, 676 bp, Artificial Sequence
  chemically treated genomic DNA (Homo sapiens) CpG-island No: 26569
atcgtagttcgaagttacgtcgtagggtcggttgggtttggagtttcgtattcgtttggttttttgcgcgtttcgtttagatcgtttttttcggcgttttttcgaattttttttttagttcgcgtttttcgtcggaggcgttcggaaggagcgagacgtcggggtcgtagatttgagttttcgtcgttttggacggagcggggtggcgcggcgtttaggggacgtaaggtttgagtttacgtatcgttggttgtttatttgtttggttagtcggtggtcgtttagcgtttagttacggttcgagtcgggcgtcgcgcgtttgcgcgttcggggggcgggttcgtttttttgtaggacgtagagcgcggggttcgagcgtcgggtatatttgttcggtttaggcgtaggtttaggtttttgtggcgttcgcgtttttttgtttgttttcgaggttttggttgtgcgcgttttatgtttttttaatttaggataggtttgtcgtacgggcgtggcgggtcgagattttttttgttttcgaatttttgtattatagttagtagagcgtagcgggggcgtagggatcgcggagttcgaagagagagtttggagggttatcgagttgagtggttagtgataaaagacgaggttgtatttaggtatgtattttagtcgagtg

SEQ ID NO: 26570 - DNA, 676 bp, Artificial Sequence
  chemically treated genomic DNA (Homo sapiens) CpG-island No: 26570
cactcgactaaaatacatacctaaatacaacctcgtcttttatcactaaccactcaactcgataaccctccaaactctctcttcgaactccgcgatccctacgcccccgctacgctctactaactataatacaaaaattcgaaaacaaaaaaaatctcgacccgccacgcccgtacgacaaacctatcctaaattaaaaaaacataaaacgcgcacaaccaaaacctcgaaaacaaacaaaaaaacgcgaacgccacaaaaacctaaacctacgcctaaaccgaacaaatatacccgacgctcgaaccccgcgctctacgtcctacaaaaaaacgaacccgccccccgaacgcgcaaacgcgcgacgcccgactcgaaccgtaactaaacgctaaacgaccaccgactaaccaaacaaataaacaaccaacgatacgtaaactcaaaccttacgtcccctaaacgccgcgccaccccgctccgtccaaaacgacgaaaactcaaatctacgaccccgacgtctcgctccttccgaacgcctccgacgaaaaacgcgaactaaaaaaaaaattcgaaaaaacgccgaaaaaaacgatctaaacgaaacgcgcaaaaaaccaaacgaatacgaaactccaaacccaaccgaccctacgacgtaacttcgaactacgat

SEQ ID NO: 26571 - DNA, 676 bp, Artificial Sequence
  chemically treated genomic DNA (Homo sapiens) CpG-island No: 26571
tattcggttggggtgtatgtttgggtgtagtttcgttttttgttattaattatttagttcggtagttttttaggtttttttttcgagtttcgcggtttttgcgttttcgttgcgttttgttagttgtgatgtaggggttcgggggtaggaaaaatttcgattcgttacgttcgtgcggtaaatttgttttaggttgagggggtatgaggcgcgtataattagggtttcgaaggtaggtaagagggcgcgggcgttatagaagtttgggtttgcgtttgggtcgggtagatgtgttcggcgttcgggtttcgcgttttgcgttttgtagggaggcggattcgtttttcgaacgcgtaggcgcgcggcgttcggttcggatcgtagttaggcgttgggcggttatcggttggttaggtaggtaagtaattagcggtgcgtgggtttagattttgcgttttttgggcgtcgcgttatttcgtttcgtttagggcggcgagggtttaggtttgcggtttcggcgtttcgtttttttcgagcgttttcggcggggggcgcgggttggggaggaggttcgggaaaacgtcggggaaagcggtttgggcggagcgcgtagggggttaggcgggtgcgggattttaggtttagtcgattttgcggcgtggtttcgggttgcgat

SEQ ID NO: 26572 - DNA, 676 bp, Artificial Sequence
  chemically treated genomic DNA (Homo sapiens) CpG-island No: 26572
atcgcaacccgaaaccacgccgcaaaatcgactaaacctaaaatcccgcacccgcctaaccccctacgcgctccgcccaaaccgctttccccgacgttttcccgaacctcctccccaacccgcgccccccgccgaaaacgctcgaaaaaaacgaaacgccgaaaccgcaaacctaaaccctcgccgccctaaacgaaacgaaataacgcgacgcccaaaaaacgcaaaatctaaacccacgcaccgctaattacttacctacctaaccaaccgataaccgcccaacgcctaactacgatccgaaccgaacgccgcgcgcctacgcgttcgaaaaacgaatccgcctccctacaaaacgcaaaacgcgaaacccgaacgccgaacacatctacccgacccaaacgcaaacccaaacttctataacgcccgcgccctcttacctaccttcgaaaccctaattatacgcgcctcataccccctcaacctaaaacaaatttaccgcacgaacgtaacgaatcgaaatttttcctacccccgaacccctacatcacaactaacaaaacgcaacgaaaacgcaaaaaccgcgaaactcgaaaaaaaaacctaaaaaactaccgaactaaataattaataacaaaaaacgaaactacacccaaacatacaccccaaccgaata

SEQ ID NO: 26573 - DNA, 829 bp, Artificial Sequence
  chemically treated genomic DNA (Homo sapiens) CpG-island No: 26573
gtagtcgtcgcgatcgcgacgcgggtttcgggcgtgttttacgattacgcgttcgtcgtagagttttttgtcgtttagttcgtaaacggcgtcgtcggcgtcgcgggagttttcgaattttacgaagtcgtatttaggggcggtgcgagggtcggataatcgcgggggagtcgttagttaggacgcgtacgtgcgcgcgttcgtattttatcgcgcgttttcgcgacgtcgcgtcgtcgttatttttgaggttttgttacgcggcgtcgcggttttggtcgtttttttttttggagagttttcgtcgttattaggtttgggacgttgggcgcgggcgtttaggttcgatttatttatttttgaggtttatttcgaggaggcggttatagttattgaaaaagcgttggatgtttttttttcggacgttgtagtttaggcgttttatgtagacgcgcggtatgttcgtggcgggcggggatttaagggttggttgtcgaacggcggatcgtaagttagtaatcgcggtgcgggtgcggggacggtaagagttcgaatacgcgttttatattataggggcggtcgagtttagttatataatggcgcgcgcgcgcgttaggttttcgttatatgggcggtcggtggggcggggtttggagcgtgatgttagcgcgtagcggtacgttcgtttcgcgtcgtttttgggttagatggtgattggcgagttcgttgttcgcgacgtttcggtgtagtgcggttttgttagtttttaggatttttttttagttttttttatcgtttttgaaaatataatgtttttaatttagtcgta

SEQ ID NO: 26574 - DNA, 829 bp, Artificial Sequence
  chemically treated genomic DNA (Homo sapiens) CpG-island No: 26574
tacgactaaattaaaaacattatattttcaaaaacgataaaaaaaactaaaaaaaaatcctaaaaactaacaaaaccgcactacaccgaaacgtcgcgaacaacgaactcgccaatcaccatctaacccaaaaacgacgcgaaacgaacgtaccgctacgcgctaacatcacgctccaaaccccgccccaccgaccgcccatataacgaaaacctaacgcgcgcgcgcgccattatataactaaactcgaccgcccctataatataaaacgcgtattcgaactcttaccgtccccgcacccgcaccgcgattactaacttacgatccgccgttcgacaaccaacccttaaatccccgcccgccacgaacataccgcgcgtctacataaaacgcctaaactacaacgtccgaaaaaaaaacatccaacgctttttcaataactataaccgcctcctcgaaataaacctcaaaaataaataaatcgaacctaaacgcccgcgcccaacgtcccaaacctaataacgacgaaaactctccaaaaaaaaaaacgaccaaaaccgcgacgccgcgtaacaaaacctcaaaaataacgacgacgcgacgtcgcgaaaacgcgcgataaaatacgaacgcgcgcacgtacgcgtcctaactaacgactcccccgcgattatccgaccctcgcaccgcccctaaatacgacttcgtaaaattcgaaaactcccgcgacgccgacgacgccgtttacgaactaaacgacaaaaaactctacgacgaacgcgtaatcgtaaaacacgcccgaaacccgcgtcgcgatcgcgacgactac

SEQ ID NO: 26575 - DNA, 829 bp, Artificial Sequence
  chemically treated genomic DNA (Homo sapiens) CpG-island No: 26575
tgcggttggattagagatattgtgtttttaaagacggtggggagggttagagaaaaattttagaagttagtaagatcgtattatatcgaaacgtcgcgggtaacggattcgttagttattatttagtttagggacgacgcgggacggacgtgtcgttgcgcgttgatattacgttttaggtttcgttttatcggtcgtttatatagcgaaagtttggcgcgcgcgcgcgttattgtgtggttggattcggtcgtttttgtggtgtgaggcgcgtgttcgggtttttgtcgttttcgtattcgtatcgcggttattggtttgcggttcgtcgttcgataattagtttttgggttttcgttcgttacggatatgtcgcgcgtttatataggacgtttgagttataacgttcgggagaaggatatttagcgtttttttagtggttatggtcgttttttcgaagtagattttaaaaatgggtgagtcgggtttgggcgttcgcgtttagcgttttaggtttggtggcggcgggaattttttaaggaaagaagcggttaaggtcgcggcgtcgcgtggtagggttttaaagatggcgacggcgcggcgtcgcgggggcgcgcggtggggtacgggcgcgcgtacgtgcgcgttttggttaacgattttttcgcggttgttcggttttcgtatcgtttttaggtacggtttcgtggagttcgaggattttcgcgacgtcgacgacgtcgtttacgagttgaacggtaaggagttttgcggcgagcgcgtgatcgtagagtacgttcggggttcgcgtcgcgatcgcgacggttat

SEQ ID NO: 26576 - DNA, 829 bp, Artificial Sequence
  chemically treated genomic DNA (Homo sapiens) CpG-island No: 26576
ataaccgtcgcgatcgcgacgcgaaccccgaacgtactctacgatcacgcgctcgccgcaaaactccttaccgttcaactcgtaaacgacgtcgtcgacgtcgcgaaaatcctcgaactccacgaaaccgtacctaaaaacgatacgaaaaccgaacaaccgcgaaaaaatcgttaaccaaaacgcgcacgtacgcgcgcccgtaccccaccgcgcgcccccgcgacgccgcgccgtcgccatctttaaaaccctaccacgcgacgccgcgaccttaaccgcttctttccttaaaaaattcccgccgccaccaaacctaaaacgctaaacgcgaacgcccaaacccgactcacccatttttaaaatctacttcgaaaaaacgaccataaccactaaaaaaacgctaaatatccttctcccgaacgttataactcaaacgtcctatataaacgcgcgacatatccgtaacgaacgaaaacccaaaaactaattatcgaacgacgaaccgcaaaccaataaccgcgatacgaatacgaaaacgacaaaaacccgaacacgcgcctcacaccacaaaaacgaccgaatccaaccacacaataacgcgcgcgcgcgccaaactttcgctatataaacgaccgataaaacgaaacctaaaacgtaatatcaacgcgcaacgacacgtccgtcccgcgtcgtccctaaactaaataataactaacgaatccgttacccgcgacgtttcgatataatacgatcttactaacttctaaaatttttctctaaccctccccaccgtctttaaaaacacaatatctctaatccaaccgca

SEQ ID NO: 26577 - DNA, 519 bp, Artificial Sequence
  chemically treated genomic DNA (Homo sapiens) CpG-island No: 26577
gcggtttgcgttacgttcggtttgtttattttcgggttttagttttagacgtagcgatggttcgttaggttttaaagtgcggtttcgtcggtttcgttttcgtttttcggtttttcgttttgtttttcgtttttgggttgtagttttcgtcggtcgcgggtatcgatcgtttttcggagttagcgcgtagtcgtggtttatttttttttcgggttcgttttatggtgatattattttcgggtcgagtgttttcgggtcgttgttggttttcgggtattggttttagtatttttgtagtcggtcggagaggttagagttcgacggggttcggtttcggcggtagtcgcgtttttcgtttgtttttttcggtcgggtcgttttcggcggtagtgttagggtgagtgacgggcggtcgcgggcggaaattgttttcggggtttttttaggcggagggggcgttagatagcggtagggttcggttggttcgggagcggggtatttttacggtaggtaggatta

SEQ ID NO: 26578 - DNA, 519 bp, Artificial Sequence
  chemically treated genomic DNA (Homo sapiens) CpG-island No: 26578
taatcctacctaccgtaaaaataccccgctcccgaaccaaccgaaccctaccgctatctaacgccccctccgcctaaaaaaaccccgaaaacaatttccgcccgcgaccgcccgtcactcaccctaacactaccgccgaaaacgacccgaccgaaaaaaacaaacgaaaaacgcgactaccgccgaaaccgaaccccgtcgaactctaacctctccgaccgactacaaaaatactaaaaccaatacccgaaaaccaacaacgacccgaaaacactcgacccgaaaataatatcaccataaaacgaacccgaaaaaaaaataaaccacgactacgcgctaactccgaaaaacgatcgatacccgcgaccgacgaaaactacaacccaaaaacgaaaaacaaaacgaaaaaccgaaaaacgaaaacgaaaccgacgaaaccgcactttaaaacctaacgaaccatcgctacgtctaaaactaaaacccgaaaataaacaaaccgaacgtaacgcaaaccgc

SEQ ID NO: 26579 - DNA, 519 bp, Artificial Sequence
  chemically treated genomic DNA (Homo sapiens) CpG-island No: 26579
tagttttgtttgtcgtgagggtatttcgttttcgggttagtcgagttttgtcgttgtttggcgtttttttcgtttggggaagtttcgaaggtagttttcgttcgcggtcgttcgttatttattttgatattgtcgtcgaggacggttcggtcgagggaagtaagcgagaggcgcggttgtcgtcggagtcgggtttcgtcgggttttagttttttcggtcggttgtaggggtattgagattagtattcgggggttagtagcgattcggaaatattcggttcggaaatgatgttattatgaggcgggttcgaagagagggtggattacggttgcgcgttggtttcgggaagcggtcgatgttcgcggtcgacggagattataatttagaggcggaggataaagcggaaggtcgaagagcgaggacgaaatcggcggaatcgtattttggagtttaacgagttatcgttgcgtttgagattgggattcggaagtaaataggtcggacgtgacgtaagtcgt

SEQ ID NO: 26580 - DNA, 519 bp, Artificial Sequence
  chemically treated genomic DNA (Homo sapiens) CpG-island No: 26580
acgacttacgtcacgtccgacctatttacttccgaatcccaatctcaaacgcaacgataactcgttaaactccaaaatacgattccgccgatttcgtcctcgctcttcgaccttccgctttatcctccgcctctaaattataatctccgtcgaccgcgaacatcgaccgcttcccgaaaccaacgcgcaaccgtaatccaccctctcttcgaacccgcctcataataacatcatttccgaaccgaatatttccgaatcgctactaacccccgaatactaatctcaatacccctacaaccgaccgaaaaaactaaaacccgacgaaacccgactccgacgacaaccgcgcctctcgcttacttccctcgaccgaaccgtcctcgacgacaatatcaaaataaataacgaacgaccgcgaacgaaaactaccttcgaaacttccccaaacgaaaaaaacgccaaacaacgacaaaactcgactaacccgaaaacgaaataccctcacgacaaacaaaacta

SEQ ID NO: 26581 - DNA, 745 bp, Artificial Sequence
  chemically treated genomic DNA (Homo sapiens) CpG-island No: 26581
tttaggttgagtatgatttcgggtttttaattcgtgcgggttcgtttcgagcgtttttcggtttttttttagttttttttttgtcgttttttttcgatttttttatttaacgttttttttttttttttttcgatcgttgtttagtttagttttcgtgtttgattgtttggttcgttttttttcgttacgcgacgttttttttgggtttaggattcggttttttttttttttttaaggtttcggtagggtcgttatttttcgggggtttgacgagtcggcgcggtttagtttaggttcgtttttttagttttttagttttcggagtagacgttagtcgtaacgttcggttcggttttttttttttgcgtttttcgggtcgggtttttttttatcgtttgtcgcgtttcgatttttagggcgttttttatttattagggcgtagatttaggtttagtttttgttttcgggttttcgttcggcggtttttttagttttcgttcgtttcgtttttttgggatttcgtttcgtataggtcgggttcggtttttattgtttcgattcgtcgttacgttgaagtttttttttttaattaggttgtttgtttgttatttaagaaggggcgggtatagttgtcggtagaggggaaaaacgtcggtcgttttcgtttttttagtggaggttttttaaagaaataggacgttatttttttgcgggttatagggtttgaaggaaggtaattttttag

SEQ ID NO: 26582 - DNA, 745 bp, Artificial Sequence
  chemically treated genomic DNA (Homo sapiens) CpG-island No: 26582
ctaaaaaattaccttccttcaaaccctataacccgcaaaaaaataacgtcctatttctttaaaaaacctccactaaaaaaacgaaaacgaccgacgtttttcccctctaccgacaactatacccgccccttcttaaataacaaacaaacaacctaattaaaaaaaaaaacttcaacgtaacgacgaatcgaaacaataaaaaccgaacccgacctatacgaaacgaaatcccaaaaaaacgaaacgaacgaaaactaaaaaaaccgccgaacgaaaacccgaaaacaaaaactaaacctaaatctacgccctaataaataaaaaacgccctaaaaatcgaaacgcgacaaacgataaaaaaaaacccgacccgaaaaacgcaaaaaaaaaaaaccgaaccgaacgttacgactaacgtctactccgaaaactaaaaaactaaaaaaacgaacctaaactaaaccgcgccgactcgtcaaacccccgaaaaataacgaccctaccgaaaccttaaaaaaaaaaaaaaaaccgaatcctaaacccaaaaaaaacgtcgcgtaacgaaaaaaaacgaaccaaacaatcaaacacgaaaactaaactaaacaacgatcgaaaaaaaaaaaaaaaaaacgttaaataaaaaaatcgaaaaaaaacgacaaaaaaaaaactaaaaaaaaaccgaaaaacgctcgaaacgaacccgcacgaattaaaaacccgaaatcatactcaacctaaa

SEQ ID NO: 26583 - DNA, 745 bp, Artificial Sequence
  chemically treated genomic DNA (Homo sapiens) CpG-island No: 26583
ttgggaaattatttttttttagattttgtagttcgtaggggaatggcgttttgtttttttaagaggtttttattaggggggcggggacggtcggcgttttttttttttatcggtagttgtgttcgtttttttttgagtgatagataagtaatttaattgaagaaagagattttagcgtgacggcgagtcggagtaatagaagtcgggttcggtttgtgcggggcggggttttaagaaggcggggcgggcggaggttggaggagtcgtcgagcggagattcgggagtaggagttgggtttaggtttgcgttttggtgagtgaggggcgttttgggggtcggggcgcggtaggcggtggagaggggttcggttcgaaagacgtagggaagagaggtcgggtcgagcgttgcggttagcgtttgtttcggaggttgaggggttgagagggcgggtttgggttggatcgcgtcggttcgttaggttttcgaggggtggcggttttgtcggggttttaggaagggaggagagatcgggttttggatttagaaggggcgtcgcgtggcggaagagggcgggttaggtagttaggtacgggggttgggttgggtagcggtcggagggagaaggagggaggcgttgggtgggaagatcggggaggggcggtaaggagagggttgggaagaagtcggagagcgttcggggcgggttcgtacgagttgaaagttcggggttatgtttaatttgga

SEQ ID NO: 26584 - DNA, 745 bp, Artificial Sequence
  chemically treated genomic DNA (Homo sapiens) CpG-island No: 26584
tccaaattaaacataaccccgaactttcaactcgtacgaacccgccccgaacgctctccgacttcttcccaaccctctccttaccgcccctccccgatcttcccacccaacgcctccctccttctccctccgaccgctacccaacccaacccccgtacctaactacctaacccgccctcttccgccacgcgacgccccttctaaatccaaaacccgatctctcctcccttcctaaaaccccgacaaaaccgccacccctcgaaaacctaacgaaccgacgcgatccaacccaaacccgccctctcaacccctcaacctccgaaacaaacgctaaccgcaacgctcgacccgacctctcttccctacgtctttcgaaccgaacccctctccaccgcctaccgcgccccgacccccaaaacgcccctcactcaccaaaacgcaaacctaaacccaactcctactcccgaatctccgctcgacgactcctccaacctccgcccgccccgccttcttaaaaccccgccccgcacaaaccgaacccgacttctattactccgactcgccgtcacgctaaaatctctttcttcaattaaattacttatctatcactcaaaaaaaaacgaacacaactaccgataaaaaaaaaaaacgccgaccgtccccgcccccctaataaaaacctcttaaaaaaacaaaacgccattcccctacgaactacaaaatctaaaaaaaaataatttcccaa

SEQ ID NO: 26585 - DNA, 1042 bp, Artificial Sequence
  chemically treated genomic DNA (Homo sapiens) CpG-island No: 26585
gtttcggcgttttttagcgttttatatttcgcggggtttggcgagtttcgtttcgtttacgtagttttttcggttatcgagttcggcgcggttttcgaagattttagattttaggcgttttcgttagttcggtttcgtcgaggagtttcggggcgcgttttcgagtttatcgcgtttcggtcgtttttaggatcgagatacgcggcgtcgttagaaggtttacgagggcgcgggttgcggggcgtacgagggtttagttttttcgtttgcgttttgttcggttttatttggcgcgtagttttaggtttagtttcgtttagtagcggcgttttttcgtcgggtcgcgtcgtttttcgtagtagcggcgtcgttttttcgtcgtttcggtttcggtcggattaggatatttttttagagacgttggttatggttcgtcgcggagcgatatcggtcgggaagcgtcggttgttttcgtgtttgttttcgtgattcgcgtcggcggttacgtgacgcgcgacggggttacgtgatgagcgacggcgattatgtgatttgtaacggtaattatcgaggttcggtcgcgcgggggtttttgggagtcgcgttttcggcgggtcgtggcgtcgttcgttttagagaatcgtcgcggttttgaggatttcgttttgtttacgcgattgtaaaggcggtttcgttgggttgagcgtcgagtgtttgggaggcgaatggtcgttttcgggatttcgggttcgggagtcggggcgagggaagcgttcggggtttgagggtaggagtcggttggaggggtttttttaggttcggtcgttcgcgtcgatcgtgacggagtcgcggtggggaagggaggagggaggtaggggcgagggtaggtttttttttgttataggcggcggttaaagacgtgaaggatgaaattagaagtttcgaagtatgtattcgttttcgtagtaggtattcgggcgagggtcggagtggaggttttttttaggtagttttagagggttttttcgtttaatgagaaaag

SEQ ID NO: 26586 - DNA, 1042 bp, Artificial Sequence
  chemically treated genomic DNA (Homo sapiens) CpG-island No: 26586
cttttctcattaaacgaaaaaaccctctaaaactacctaaaaaaaacctccactccgaccctcgcccgaatacctactacgaaaacgaatacatacttcgaaacttctaatttcatccttcacgtctttaaccgccgcctataacaaaaaaaaacctaccctcgcccctacctccctcctcccttccccaccgcgactccgtcacgatcgacgcgaacgaccgaacctaaaaaaacccctccaaccgactcctaccctcaaaccccgaacgcttccctcgccccgactcccgaacccgaaatcccgaaaacgaccattcgcctcccaaacactcgacgctcaacccaacgaaaccgcctttacaatcgcgtaaacaaaacgaaatcctcaaaaccgcgacgattctctaaaacgaacgacgccacgacccgccgaaaacgcgactcccaaaaacccccgcgcgaccgaacctcgataattaccgttacaaatcacataatcgccgtcgctcatcacgtaaccccgtcgcgcgtcacgtaaccgccgacgcgaatcacgaaaacaaacacgaaaacaaccgacgcttcccgaccgatatcgctccgcgacgaaccataaccaacgtctctaaaaaaatatcctaatccgaccgaaaccgaaacgacgaaaaaacgacgccgctactacgaaaaacgacgcgacccgacgaaaaaacgccgctactaaacgaaactaaacctaaaactacgcgccaaataaaaccgaacaaaacgcaaacgaaaaaactaaaccctcgtacgccccgcaacccgcgccctcgtaaaccttctaacgacgccgcgtatctcgatcctaaaaacgaccgaaacgcgataaactcgaaaacgcgccccgaaactcctcgacgaaaccgaactaacgaaaacgcctaaaatctaaaatcttcgaaaaccgcgccgaactcgataaccgaaaaaactacgtaaacgaaacgaaactcgccaaaccccgcgaaatataaaacgctaaaaaacgccgaaac

SEQ ID NO: 26587 - DNA, 1042 bp, Artificial Sequence
  chemically treated genomic DNA (Homo sapiens) CpG-island No: 26587
ttttttttattaggcgggaggattttttggggttgtttggaggaagtttttatttcgattttcgttcgagtgtttattgcgagggcggatgtatgtttcgggatttttaattttattttttacgtttttagtcgtcgtttatggtaaggaaaggtttgttttcgtttttgtttttttttttttttttttatcgcggtttcgttacgatcggcgcgggcgatcgggtttgggggagtttttttagtcggtttttgtttttaggtttcgggcgtttttttcgtttcgattttcgggttcgaggtttcgggggcggttattcgttttttaagtattcggcgtttagtttaacggggtcgtttttgtagtcgcgtgggtagaacggggtttttagggtcgcggcgattttttagggcgggcggcgttacgattcgtcgggagcgcggtttttaggagttttcgcgcgatcgggtttcggtggttgtcgttgtaggttatatggtcgtcgtcgtttattacgtggtttcgtcgcgcgttacgtggtcgtcggcgcgggttacgagaataaatacgggggtagtcggcgtttttcggtcggtgtcgtttcgcggcgggttatggttaacgtttttaagaaggtgttttggttcggtcgggatcgggacgacgaggaggcggcgtcgttgttgcggaggacggcgcggttcggcggggggacgtcgttgttgaacggggttgggtttggggttgcgcgttaggtgaggtcgggtagggcgtaggcggggaaattgagttttcgtgcgtttcgtagttcgcgttttcgtgagttttttggcggcgtcgcgtgtttcggttttggaggcgatcgaggcgcggtggattcgggaacgcgtttcggggtttttcggcggggtcgggttggcgggggcgtttggggtttggagttttcggaggtcgcgtcgggttcggtggtcgggagggttgcgtgggcgaggcggagttcgttagatttcgcggaatgtggggcgttgaggggcgtcggggt

SEQ ID NO: 26588 - DNA, 1042 bp, Artificial Sequence
  chemically treated genomic DNA (Homo sapiens) CpG-island No: 26588
accccgacgcccctcaacgccccacattccgcgaaatctaacgaactccgcctcgcccacgcaaccctcccgaccaccgaacccgacgcgacctccgaaaactccaaaccccaaacgcccccgccaacccgaccccgccgaaaaaccccgaaacgcgttcccgaatccaccgcgcctcgatcgcctccaaaaccgaaacacgcgacgccgccaaaaaactcacgaaaacgcgaactacgaaacgcacgaaaactcaatttccccgcctacgccctacccgacctcacctaacgcgcaaccccaaacccaaccccgttcaacaacgacgtccccccgccgaaccgcgccgtcctccgcaacaacgacgccgcctcctcgtcgtcccgatcccgaccgaaccaaaacaccttcttaaaaacgttaaccataacccgccgcgaaacgacaccgaccgaaaaacgccgactacccccgtatttattctcgtaacccgcgccgacgaccacgtaacgcgcgacgaaaccacgtaataaacgacgacgaccatataacctacaacgacaaccaccgaaacccgatcgcgcgaaaactcctaaaaaccgcgctcccgacgaatcgtaacgccgcccgccctaaaaaatcgccgcgaccctaaaaaccccgttctacccacgcgactacaaaaacgaccccgttaaactaaacgccgaatacttaaaaaacgaataaccgcccccgaaacctcgaacccgaaaatcgaaacgaaaaaaacgcccgaaacctaaaaacaaaaaccgactaaaaaaactcccccaaacccgatcgcccgcgccgatcgtaacgaaaccgcgataaaaaaaaaaaaaaaaaaacaaaaacgaaaacaaacctttccttaccataaacgacgactaaaaacgtaaaaaataaaattaaaaatcccgaaacatacatccgccctcgcaataaacactcgaacgaaaatcgaaataaaaacttcctccaaacaaccccaaaaaatcctcccgcctaataaaaaaaa

SEQ ID NO: 26589 - DNA, 916 bp, Artificial Sequence
  chemically treated genomic DNA (Homo sapiens) CpG-island No: 26589
gagcgaacgttcggcgttttggagagaatgtgggattcgaggcggagggaagagacggttgatattattttagggtagggacgatcgagatgggagaaattaaggcgagaatttattattcgggcgtagcgaatttagttcgtagttacgtggggaagcgcggttttgtttttaggtttcgttttatttacgcgttaggtttcgtttattttatcgtttttcgttttcgcgtttaggtttcgtttcgttttcgcgtagcgtaggcgtagatgcgttttttcgtttggcgtttttcgtagattcgcgttgagaggttcgcggagattcgttttagaggtttaagaaaattcgcgggagtttcgttcggatttaggaattcgtgttcggggttaatcggttgggtcgcgatcgcgtttcgttcggggtcgcggcggtcgtggggaatcggttgtagcgaatcggtggcgcgcggcgtttgagcgcgttgtagttattcgggagtcgggtttaggtcgggttgggggtcggggatcggggatcgggggttcggttgggtcgggttgggttttaggtttggttgggtcgggtttaggtcgggtaggagttcggtcggggttcgggtataggtcggggttcgggtttggatcgggggcgggttcgcgtgcggtttttttagtttcgaattcgtgtttttcgtaagttgttggtttttaaggggcggaggaatggcgattggagttattttttatcgtttagggagtcgggagggtcggtagttttcgcgggtcgagtttttcgttttgggtgcgaggacgcgtggggtcgcgttgtgttcggggaatatttattagtatttttagtttttatttttttttcgcgttagtggtattttcggttgagataattgagaatgttt

SEQ ID NO: 26590 - DNA, 916 bp, Artificial Sequence
  chemically treated genomic DNA (Homo sapiens) CpG-island No: 26590
aaacattctcaattatctcaaccgaaaataccactaacgcgaaaaaaaaataaaaactaaaaatactaataaatattccccgaacacaacgcgaccccacgcgtcctcgcacccaaaacgaaaaactcgacccgcgaaaactaccgaccctcccgactccctaaacgataaaaaataactccaatcgccattcctccgccccttaaaaaccaacaacttacgaaaaacacgaattcgaaactaaaaaaaccgcacgcgaacccgcccccgatccaaacccgaaccccgacctatacccgaaccccgaccgaactcctacccgacctaaacccgacccaaccaaacctaaaacccaacccgacccaaccgaacccccgatccccgatccccgacccccaacccgacctaaacccgactcccgaataactacaacgcgctcaaacgccgcgcgccaccgattcgctacaaccgattccccacgaccgccgcgaccccgaacgaaacgcgatcgcgacccaaccgattaaccccgaacacgaattcctaaatccgaacgaaactcccgcgaattttcttaaacctctaaaacgaatctccgcgaacctctcaacgcgaatctacgaaaaacgccaaacgaaaaaacgcatctacgcctacgctacgcgaaaacgaaacgaaacctaaacgcgaaaacgaaaaacgataaaataaacgaaacctaacgcgtaaataaaacgaaacctaaaaacaaaaccgcgcttccccacgtaactacgaactaaattcgctacgcccgaataataaattctcgccttaatttctcccatctcgatcgtccctaccctaaaataatatcaaccgtctcttccctccgcctcgaatcccacattctctccaaaacgccgaacgttcgctc

SEQ ID NO: 26591 - DNA, 916 bp, Artificial Sequence
  chemically treated genomic DNA (Homo sapiens) CpG-island No: 26591
gaatatttttagttgttttaatcgggagtgttattggcgcgagagggaggtggaggttagagatgttggtgagtgtttttcgggtatagcgcggttttacgcgttttcgtatttaaggcgggaaattcggttcgcgggagttgtcggttttttcggttttttgagcggtgagaggtggttttagtcgttattttttcgttttttagaaattaatagtttacggggaatacgggttcggggttagaggagtcgtacgcggattcgttttcgatttaggttcggatttcgatttgtattcggatttcgatcggatttttattcgatttggattcgatttaattagatttggagtttaattcgatttaatcggattttcgattttcgattttcgatttttaattcgatttggattcggttttcgggtgattgtagcgcgtttaggcgtcgcgcgttatcgattcgttgtagtcgattttttacggtcgtcgcggtttcggacgaaacgcgatcgcggtttagtcggttggtttcgagtacgagtttttgggttcgggcgaggttttcgcgggtttttttgagtttttggggcgggttttcgcgggttttttagcgcgaatttgcggaggacgttaggcgggagggcgtatttgcgtttgcgttgcgcggggacggggcggagtttggacgcgggagcggggggcggtggggtgggcggggtttgacgcgtgagtggggcggggtttgagggtagggtcgcgtttttttacgtggttgcgagttgggttcgttgcgttcgggtggtgggttttcgttttagttttttttatttcggtcgtttttattttggagtgatgttagtcgtttttttttttcgtttcgggttttatattttttttagaacgtcgagcgttcgttt

SEQ ID NO: 26592 - DNA, 916 bp, Artificial Sequence
  chemically treated genomic DNA (Homo sapiens) CpG-island No: 26592
aaacgaacgctcgacgttctaaaaaaaatataaaacccgaaacgaaaaaaaaaaacgactaacatcactccaaaataaaaacgaccgaaataaaaaaaactaaaacgaaaacccaccacccgaacgcaacgaacccaactcgcaaccacgtaaaaaaacgcgaccctaccctcaaaccccgccccactcacgcgtcaaaccccgcccaccccaccgccccccgctcccgcgtccaaactccgccccgtccccgcgcaacgcaaacgcaaatacgccctcccgcctaacgtcctccgcaaattcgcgctaaaaaacccgcgaaaacccgccccaaaaactcaaaaaaacccgcgaaaacctcgcccgaacccaaaaactcgtactcgaaaccaaccgactaaaccgcgatcgcgtttcgtccgaaaccgcgacgaccgtaaaaaatcgactacaacgaatcgataacgcgcgacgcctaaacgcgctacaatcacccgaaaaccgaatccaaatcgaattaaaaatcgaaaatcgaaaatcgaaaatccgattaaatcgaattaaactccaaatctaattaaatcgaatccaaatcgaataaaaatccgatcgaaatccgaatacaaatcgaaatccgaacctaaatcgaaaacgaatccgcgtacgactcctctaaccccgaacccgtattccccgtaaactattaatttctaaaaaacgaaaaaataacgactaaaaccacctctcaccgctcaaaaaaccgaaaaaaccgacaactcccgcgaaccgaatttcccgccttaaatacgaaaacgcgtaaaaccgcgctatacccgaaaaacactcaccaacatctctaacctccacctccctctcgcgccaataacactcccgattaaaacaactaaaaatattc

SEQ ID NO: 26593 - DNA, 568 bp, Artificial Sequence
  chemically treated genomic DNA (Homo sapiens) CpG-island No: 26593
tcgagtttcgtagtcggtcgagggtggcggcggtagcgttagaggtacggcggtacggcgggggggcggtatatatgttcggattgtgacgtttagtttggttgttgtggtaattttattttatcgtttcggtagcgcgattagttaatagtagagaataagttgggggattagttttgagtcgtcgggtgagggtggggatcggggggcgtttcggtagggggagtcgtcgaggcgttcgcgcgttcgcggattcgacggtcgagcgggtagtcggggtttggcgagttcgggcgtagggggaggcgaggaaatatcgttttcgcgtatttcgggtagagttagtcgtcgtcgttcgtttgcgaaggcgttgggtttcgagtttttaagggcgcggaggtagggtttttagggtagcgcgcggttcgtttttttattcggtttataggcgtcgggatttatttcgttttcggtttcggtttcggtacgtttttaattttttttttaaagaggattagaagaaaaatgtgttttatatttggggaaaagacgttttggagattgtggg

SEQ ID NO: 26594 - DNA, 568 bp, Artificial Sequence
  chemically treated genomic DNA (Homo sapiens) CpG-island No: 26594
cccacaatctccaaaacgtcttttccccaaatataaaacacatttttcttctaatcctctttaaaaaaaaaattaaaaacgtaccgaaaccgaaaccgaaaacgaaataaatcccgacgcctataaaccgaataaaaaaacgaaccgcgcgctaccctaaaaaccctacctccgcgcccttaaaaactcgaaacccaacgccttcgcaaacgaacgacgacgactaactctacccgaaatacgcgaaaacgatatttcctcgcctccccctacgcccgaactcgccaaaccccgactacccgctcgaccgtcgaatccgcgaacgcgcgaacgcctcgacgactccccctaccgaaacgccccccgatccccaccctcacccgacgactcaaaactaatcccccaacttattctctactattaactaatcgcgctaccgaaacgataaaataaaattaccacaacaaccaaactaaacgtcacaatccgaacatatataccgcccccccgccgtaccgccgtacctctaacgctaccgccgccaccctcgaccgactacgaaactcga

SEQ ID NO: 26595 - DNA, 568 bp, Artificial Sequence
  chemically treated genomic DNA (Homo sapiens) CpG-island No: 26595
tttatagtttttagagcgttttttttttaagtgtggaatatattttttttttaattttttttggagagggggttaggaacgtgtcgaggtcggagtcgggagcggggtgggtttcggcgtttgtgaatcgagtgggggagcgggtcgcgcgttgttttgaagattttgttttcgcgtttttgggggttcggggtttagcgttttcgtaggcgagcggcggcggttggttttgttcggggtgcgcgggggcggtgttttttcgtttttttttgcgttcgggttcgttaagtttcgattgttcgttcggtcgtcgggttcgcgggcgcgcggacgtttcgacggttttttttgtcggggcgtttttcggtttttatttttattcggcggtttaggattagttttttaatttgttttttgttgttaattagtcgcgttgtcggaacgatgggatggggttgttatagtaattagattggacgttataattcgggtatgtgtgtcgttttttcgtcgtgtcgtcgtgtttttggcgttgtcgtcgttattttcggtcggttgcgggattcgg

SEQ ID NO: 26596 - DNA, 568 bp, Artificial Sequence
  chemically treated genomic DNA (Homo sapiens) CpG-island No: 26596
ccgaatcccgcaaccgaccgaaaataacgacgacaacgccaaaaacacgacgacacgacgaaaaaacgacacacatacccgaattataacgtccaatctaattactataacaaccccatcccatcgttccgacaacgcgactaattaacaacaaaaaacaaattaaaaaactaatcctaaaccgccgaataaaaataaaaaccgaaaaacgccccgacaaaaaaaaccgtcgaaacgtccgcgcgcccgcgaacccgacgaccgaacgaacaatcgaaacttaacgaacccgaacgcaaaaaaaaacgaaaaaacaccgcccccgcgcaccccgaacaaaaccaaccgccgccgctcgcctacgaaaacgctaaaccccgaacccccaaaaacgcgaaaacaaaatcttcaaaacaacgcgcgacccgctcccccactcgattcacaaacgccgaaacccaccccgctcccgactccgacctcgacacgttcctaaccccctctccaaaaaaaattaaaaaaaaaatatattccacacttaaaaaaaaaacgctctaaaaactataaa

SEQ ID NO: 26597 - DNA, 803 bp, Artificial Sequence
  chemically treated genomic DNA (Homo sapiens) CpG-island No: 26597
cgtagtgatacgcggcggttgcggttttcgcgttggtcgcggtcgggttttggcgtttttgagttcgcgttcggttcgtaggacgtggagattacgtatttttgtaatacgtgcggatagtttttatgcgcgcgttgtcgcgacgagacgtatcgagtacgtatgttcgcgcgttacgatatcgtggttttgggttagcgaagtcgcgacgtgttttagaagtgtagtgagtgaggtttgcggggtcggggatttgggggtgggggcggggcgggtattgatcggagtttttattatcgttcgtcgttttcgtagcgttgtacgtagagttttattttttgttttttatcgataagaagttgttgttgtgtattcgttgttttcgcgatatgtagaagtgcgtataggggacgcgaggggagggggttgggggtcgttggagcgggttttattcgtcgttttttgtagggagagtcgggtatattgcgtggatttggaatcggtttacgtgtagggttgcgagcggttggagtaggcggtgttggtgagcgtaggggtttggcgcgcggggtcgcgcggcggcgatcgcgagtttgattacgttttgtttttaggtcgtgaaggttttgtagacggttacgcgggaggttatcgcgttgttgtaggttatggtggaggaggtgcggtatagcgtcgtcgaggaggaggacgttatttacgtttttttcggtagtatgtaggtgaggggtgggggttgggggataaacgatttagtcgggatttggtgatatagggttggtttt

SEQ ID NO: 26598 - DNA, 803 bp, Artificial Sequence
  chemically treated genomic DNA (Homo sapiens) CpG-island No: 26598
aaaaccaaccctatatcaccaaatcccgactaaatcgtttatcccccaacccccacccctcacctacatactaccgaaaaaaacgtaaataacgtcctcctcctcgacgacgctataccgcacctcctccaccataacctacaacaacgcgataacctcccgcgtaaccgtctacaaaaccttcacgacctaaaaacaaaacgtaatcaaactcgcgatcgccgccgcgcgaccccgcgcgccaaacccctacgctcaccaacaccgcctactccaaccgctcgcaaccctacacgtaaaccgattccaaatccacgcaatatacccgactctccctacaaaaaacgacgaataaaacccgctccaacgacccccaaccccctcccctcgcgtcccctatacgcacttctacatatcgcgaaaacaacgaatacacaacaacaacttcttatcgataaaaaacaaaaaataaaactctacgtacaacgctacgaaaacgacgaacgataataaaaactccgatcaatacccgccccgcccccacccccaaatccccgaccccgcaaacctcactcactacacttctaaaacacgtcgcgacttcgctaacccaaaaccacgatatcgtaacgcgcgaacatacgtactcgatacgtctcgtcgcgacaacgcgcgcataaaaactatccgcacgtattacaaaaatacgtaatctccacgtcctacgaaccgaacgcgaactcaaaaacgccaaaacccgaccgcgaccaacgcgaaaaccgcaaccgccgcgtatcactacg

SEQ ID NO: 26599 - DNA, 803 bp, Artificial Sequence
  chemically treated genomic DNA (Homo sapiens) CpG-island No: 26599
gggattagttttgtgttattaggtttcggttgggtcgtttattttttaatttttattttttatttgtatgttgtcgaagagggcgtggatagcgttttttttttcggcggcgttgtgtcgtattttttttattatggtttgtagtagcgcgatggtttttcgcgtggtcgtttgtagggtttttacggtttggggatagggcgtggttaggttcgcgatcgtcgtcgcgcggtttcgcgcgttaggtttttgcgtttattagtatcgtttgttttagtcgttcgtagttttgtacgtaagtcgattttaggtttacgtagtgtgttcggttttttttgtagaaggcggcgggtgaggttcgttttagcggtttttagtttttttttttcgcgttttttgtacgtatttttgtatgtcgcggaagtagcggatgtataatagtaattttttgtcggtggagaataagaggtagggttttgcgtgtagcgttgcgggggcggcgggcggtggtgagggtttcggttagtgttcgtttcgtttttatttttaagttttcggtttcgtaagttttatttattgtatttttggggtacgtcgcggtttcgttgatttagggttacgatgtcgtggcgcgcgaatatgcgtgttcggtgcgtttcgtcgcggtagcgcgcgtataggggttgttcgtacgtgttgtagaagtacgtggtttttacgttttgcgggtcgagcgcgggtttaggagcgttagagttcgatcgcggttagcgcgggaatcgtagtcgtcgcgtgttattgcg

SEQ ID NO: 26600 - DNA, 803 bp, Artificial Sequence
  chemically treated genomic DNA (Homo sapiens) CpG-island No: 26600
cgcaataacacgcgacgactacgattcccgcgctaaccgcgatcgaactctaacgctcctaaacccgcgctcgacccgcaaaacgtaaaaaccacgtacttctacaacacgtacgaacaacccctatacgcgcgctaccgcgacgaaacgcaccgaacacgcatattcgcgcgccacgacatcgtaaccctaaatcaacgaaaccgcgacgtaccccaaaaatacaataaataaaacttacgaaaccgaaaacttaaaaataaaaacgaaacgaacactaaccgaaaccctcaccaccgcccgccgcccccgcaacgctacacgcaaaaccctacctcttattctccaccgacaaaaaattactattatacatccgctacttccgcgacatacaaaaatacgtacaaaaaacgcgaaaaaaaaaaactaaaaaccgctaaaacgaacctcacccgccgccttctacaaaaaaaaccgaacacactacgtaaacctaaaatcgacttacgtacaaaactacgaacgactaaaacaaacgatactaataaacgcaaaaacctaacgcgcgaaaccgcgcgacgacgatcgcgaacctaaccacgccctatccccaaaccgtaaaaaccctacaaacgaccacgcgaaaaaccatcgcgctactacaaaccataataaaaaaaatacgacacaacgccgccgaaaaaaaaaacgctatccacgccctcttcgacaacatacaaataaaaaataaaaattaaaaaataaacgacccaaccgaaacctaataacacaaaactaatccc

SEQ ID NO: 26601 - DNA, 690 bp, Artificial Sequence
  chemically treated genomic DNA (Homo sapiens) CpG-island No: 26601
ttttgcgatttgaattcgcggatgaagagcgcgcgcgtgggaggttattgcgggttcggggagaaaggtgtttacgcgtcgcgttaagcggatcgtcgttcgtttcgtcggttttcgtcggttttcgtcggtttgtatttggtagcgaggcggtcgatagagtagtagtagtagcgcgttgagttcggttacgtagagcgttagttcggtgcggttttgtaggtcggcgcgcgtgagtagcggtagcgcgagtatcgaggcgtttagtaggaaggtggcgaggttgagacgcgttttagagttcggcggagttcgcgtcgcgtagttcgttatggcgtcgggcggcggattagcgggcggcggcgtcggttgtagttcggagaaacgcgtcggttgcgtttgcgtattgtgtcgtcgatgtcggttcgggaagggtagttgttcgtagttgcgcgtcgtttgttagttttcgcgagaatttcggttcgttttgttgttgttcggaatttggcgggagcgtttcgttcgttcgttttttttcgtttttcggggatattcgggttttgagttagattttgtgtcgggcgggggtcgggaagtggtgggagaagtcgtcgttcgcgtttgtttaaatttagttttaaatttaggaggtttttgttttaagaagtaatgtaaagtttgaaacga

SEQ ID NO: 26602 - DNA, 690 bp, Artificial Sequence
  chemically treated genomic DNA (Homo sapiens) CpG-island No: 26602
tcgtttcaaactttacattacttcttaaaacaaaaacctcctaaatttaaaactaaatttaaacaaacgcgaacgacgacttctcccaccacttcccgacccccgcccgacacaaaatctaactcaaaacccgaatatccccgaaaaacgaaaaaaaacgaacgaacgaaacgctcccgccaaattccgaacaacaacaaaacgaaccgaaattctcgcgaaaactaacaaacgacgcgcaactacgaacaactacccttcccgaaccgacatcgacgacacaatacgcaaacgcaaccgacgcgtttctccgaactacaaccgacgccgccgcccgctaatccgccgcccgacgccataacgaactacgcgacgcgaactccgccgaactctaaaacgcgtctcaacctcgccaccttcctactaaacgcctcgatactcgcgctaccgctactcacgcgcgccgacctacaaaaccgcaccgaactaacgctctacgtaaccgaactcaacgcgctactactactactctatcgaccgcctcgctaccaaatacaaaccgacgaaaaccgacgaaaaccgacgaaacgaacgacgatccgcttaacgcgacgcgtaaacacctttctccccgaacccgcaataacctcccacgcgcgcgctcttcatccgcgaattcaaatcgcaaaa

SEQ ID NO: 26603 - DNA, 690 bp, Artificial Sequence
  chemically treated genomic DNA (Homo sapiens) CpG-island No: 26603
tcgttttaaattttatattgttttttgggataggaattttttgagtttgggattaagtttggatagacgcgggcggcgattttttttattatttttcggttttcgttcggtatagagtttggtttagagttcggatgttttcgaggggcggggaggggcgggcgggcggggcgttttcgttaaatttcggatagtaatagggcgggtcggagttttcgcgagaattggtaggcggcgcgtagttgcgggtagttgtttttttcgggtcggtatcggcggtatagtgcgtaggcgtagtcggcgcgttttttcgggttatagtcggcgtcgtcgttcgttagttcgtcgttcggcgttatggcgggttgcgcggcgcgggtttcgtcgggttttgaggcgcgttttagtttcgttatttttttgttgggcgtttcggtgttcgcgttgtcgttgtttacgcgcgtcggtttgtagggtcgtatcgggttggcgttttacgtggtcgggtttaacgcgttgttgttgttgttttatcggtcgtttcgttattaggtgtaggtcggcgggggtcggcgggggtcggcggggcgggcggcggttcgtttggcgcggcgcgtgggtattttttttttcgggttcgtagtggttttttacgcgcgcgttttttattcgcgagtttaggtcgtagga

SEQ ID NO: 26604 - DNA, 690 bp, Artificial Sequence
  chemically treated genomic DNA (Homo sapiens) CpG-island No: 26604
tcctacgacctaaactcgcgaataaaaaacgcgcgcgtaaaaaaccactacgaacccgaaaaaaaaaatacccacgcgccgcgccaaacgaaccgccgcccgccccgccgacccccgccgacccccgccgacctacacctaataacgaaacgaccgataaaacaacaacaacaacgcgttaaacccgaccacgtaaaacgccaacccgatacgaccctacaaaccgacgcgcgtaaacaacgacaacgcgaacaccgaaacgcccaacaaaaaaataacgaaactaaaacgcgcctcaaaacccgacgaaacccgcgccgcgcaacccgccataacgccgaacgacgaactaacgaacgacgacgccgactataacccgaaaaaacgcgccgactacgcctacgcactataccgccgataccgacccgaaaaaaacaactacccgcaactacgcgccgcctaccaattctcgcgaaaactccgacccgccctattactatccgaaatttaacgaaaacgccccgcccgcccgcccctccccgcccctcgaaaacatccgaactctaaaccaaactctataccgaacgaaaaccgaaaaataataaaaaaaatcgccgcccgcgtctatccaaacttaatcccaaactcaaaaaattcctatcccaaaaaacaatataaaatttaaaacga

SEQ ID NO: 26605 - DNA, 1060 bp, Artificial Sequence
  chemically treated genomic DNA (Homo sapiens) CpG-island No: 26605
ggcgcggcgggtagtgtcggggttggggtcggggggtaacggaggcggaagtttatttagtggattagggcggagcgacgtttgagaatttcgtttaggttttgaggcgggtttcgtttttcgtagttaaagtagaatattgcgaattagagtattttgcggttaattttttattgtttaagaaatattaagttatttacgtgagcgttttttcgttttcggttcgatgcgtttggaattttaggggacgggtttgggaggggtggtggttttgggaacggcgggtgtcggggttcgggcgggggtagtttcgtggtttttttatggcggttcggatttaggagagggggcgggttcggtatttagcggcgggtcgcgagagttgcgcggagggttattggtttgttaatgttttcgagttgaaaggcgcgggcggcggtttatagggaaggattgtaattagaggataaattgtttcgttgtttcgtagttcgagaacgcggggagggggaggttcgtcggggcgcgacgcgcgttaggtttttgtgtagatgtgtagtagttggaagttcgcgtttggcggggcgttcggagtttggtttcgagggggcgggggcgggcgcgggcgtcgttttgtggggttcgtataatgtttttaatattcggttgttttttttgtgttcggtcgcgtcgttcgttcgtttcgcggtgtttttatatcgcgtcgttatcgttttaagttcggagcgagtcgtatggaggacgtttcggttcggtcggttttggcgttttaaagttgttcggcgcgtgttagcgttcgtcgtttggtttcggttttcgtcgtttttttaggttcgggtcggttcggatttggttcgcgggttttgcggttcgggttggatagagttttagagttgttgttgtcgttgtttcggtttgaaagggggagggcgtggcgcgattttttacgttgtttggcgtttgggaacgtcgttattttgggaagggtaggcgggggcgggttggggggagatgttttggtttgatagagttggggggt

SEQ ID NO: 26606 - DNA, 1060 bp, Artificial Sequence
  chemically treated genomic DNA (Homo sapiens) CpG-island No: 26606
accccccaactctatcaaaccaaaacatctccccccaacccgcccccgcctacccttcccaaaataacgacgttcccaaacgccaaacaacgtaaaaaatcgcgccacgccctccccctttcaaaccgaaacaacgacaacaacaactctaaaactctatccaacccgaaccgcaaaacccgcgaaccaaatccgaaccgacccgaacctaaaaaaacgacgaaaaccgaaaccaaacgacgaacgctaacacgcgccgaacaactttaaaacgccaaaaccgaccgaaccgaaacgtcctccatacgactcgctccgaacttaaaacgataacgacgcgatataaaaacaccgcgaaacgaacgaacgacgcgaccgaacacaaaaaaaacaaccgaatattaaaaacattatacgaaccccacaaaacgacgcccgcgcccgcccccgccccctcgaaaccaaactccgaacgccccgccaaacgcgaacttccaactactacacatctacacaaaaacctaacgcgcgtcgcgccccgacgaacctccccctccccgcgttctcgaactacgaaacaacgaaacaatttatcctctaattacaatccttccctataaaccgccgcccgcgcctttcaactcgaaaacattaacaaaccaataaccctccgcgcaactctcgcgacccgccgctaaataccgaacccgccccctctcctaaatccgaaccgccataaaaaaaccacgaaactacccccgcccgaaccccgacacccgccgttcccaaaaccaccacccctcccaaacccgtcccctaaaattccaaacgcatcgaaccgaaaacgaaaaaacgctcacgtaaataacttaatatttcttaaacaataaaaaattaaccgcaaaatactctaattcgcaatattctactttaactacgaaaaacgaaacccgcctcaaaacctaaacgaaattctcaaacgtcgctccgccctaatccactaaataaacttccgcctccgttaccccccgaccccaaccccgacactacccgccgcgcc

SEQ ID NO: 26607 - DNA, 1060 bp, Artificial Sequence
  chemically treated genomic DNA (Homo sapiens) CpG-island No: 26607
gttttttagttttattaagttagggtatttttttttagttcgttttcgtttattttttttaggatagcggcgtttttaggcgttaagtagcgtggagaatcgcgttacgtttttttttttttaggtcgaggtagcggtaatagtagttttggggttttgtttagttcggatcgtagggttcgcgggttagattcgggtcgattcgggtttgggagggcggcgggggtcgagattaggcggcgggcgttggtacgcgtcgggtagttttgaagcgttaggatcggtcgggtcggggcgttttttatgcgattcgtttcgagtttggggcggtggcggcgcggtataaaggtatcgcggggcgggcgggcggcgcggtcgggtataaaaggggtagtcgagtgttaagggtattgtgcgggttttataaagcggcgttcgcgttcgttttcgttttttcggggttaaatttcgggcgtttcgttaggcgcggatttttagttgttgtatatttgtatagaggtttggcgcgcgtcgcgtttcggcgggttttttttttttcgcgttttcgagttgcggggtagcggggtaatttgttttttaattataatttttttttataaatcgtcgttcgcgttttttaattcgagggtattagtaaattaatggtttttcgcgtagttttcgcggttcgtcgttgggtgtcgggttcgtttttttttttgagttcgggtcgttataaaggggttacgaggttgttttcgttcgaatttcgatattcgtcgtttttagggttattattttttttaagttcgttttttgggattttaggcgtatcgggtcgggggcggggggacgtttacgtggatagtttagtgttttttaagtagtggaaaattgatcgtaaaatgttttaattcgtaatgttttgttttggttgcgggaggcgaggttcgttttaaggtttgggcggaatttttaggcgtcgtttcgttttggtttattgaatggattttcgttttcgttgtttttcgattttaatttcgatattgttcgtcgcgtt

SEQ ID NO: 26608 - DNA, 1060 bp, Artificial Sequence
  chemically treated genomic DNA (Homo sapiens) CpG-island No: 26608
aacgcgacgaacaatatcgaaattaaaatcgaaaaacaacgaaaacgaaaatccattcaataaaccaaaacgaaacgacgcctaaaaattccgcccaaaccttaaaacgaacctcgcctcccgcaaccaaaacaaaacattacgaattaaaacattttacgatcaattttccactacttaaaaaacactaaactatccacgtaaacgtccccccgcccccgacccgatacgcctaaaatcccaaaaaacgaacttaaaaaaaataataaccctaaaaacgacgaatatcgaaattcgaacgaaaacaacctcgtaacccctttataacgacccgaactcaaaaaaaaaaacgaacccgacacccaacgacgaaccgcgaaaactacgcgaaaaaccattaatttactaataccctcgaattaaaaaacgcgaacgacgatttataaaaaaaaattataattaaaaaacaaattaccccgctaccccgcaactcgaaaacgcgaaaaaaaaaaaacccgccgaaacgcgacgcgcgccaaacctctatacaaatatacaacaactaaaaatccgcgcctaacgaaacgcccgaaatttaaccccgaaaaaacgaaaacgaacgcgaacgccgctttataaaacccgcacaatacccttaacactcgactaccccttttatacccgaccgcgccgcccgcccgccccgcgatacctttataccgcgccgccaccgccccaaactcgaaacgaatcgcataaaaaacgccccgacccgaccgatcctaacgcttcaaaactacccgacgcgtaccaacgcccgccgcctaatctcgacccccgccgccctcccaaacccgaatcgacccgaatctaacccgcgaaccctacgatccgaactaaacaaaaccccaaaactactattaccgctacctcgacctaaaaaaaaaaaaacgtaacgcgattctccacgctacttaacgcctaaaaacgccgctatcctaaaaaaaataaacgaaaacgaactaaaaaaaaataccctaacttaataaaactaaaaaac

SEQ ID NO: 26609 - DNA, 839 bp, Artificial Sequence
  chemically treated genomic DNA (Homo sapiens) CpG-island No: 26609
gcgcgcggggcggaggcgggcgtttttggtgttgcggtttcggagagcggtttggtttgtttggcgttcgtggggaggcgtcggcggttttaggacgcggagtttagcgagttcgagtgtagcgtggcgtagttcgaggattcggagggggaatttaggaagttgttggtgttgtcgtcgtcgttcgtcgcgcgtagtttttcgggttcgttttacgacgcgtttaggtcggggcgtagagagtcggcgtgcgagtgcgtagaggggcgtggttttgggtttcgttgggcgttgtttgggggcgtcggggttttttcgggatttgcgtcgtcgggggcggcgggcgtagcggggaagggttcgggcgggcggcgtagggtttgtggttcgtattcgaaggcggttagggcgaaggcgtcgggtagtagcgaggtcgaggcggagcgggggtcgggttcggggcggcggcgcgggttgtcggggggcgagtcgcgggtttttcgcgggtcgttatttacggtcgagggtcgtagcgatagtaggttttcggtcgagcggcggcgcgcgcgggatagtggtgcgtttttcgcgaaggttaggaggttggcgcggggtcgttcgggttcggtaggtagtattaggtgcgttagggcggataggtttttgtcggagttttagcgcggtaggaaggcgggtagcgggacggcggtttatacgttcgtatcgtcgtgggagaagcgtcgcgtgggcgggatttgttaggacgcggttggtttttatttcgagttgtttttttgggaaacggggataaatttttttttattttggggaaaggtttt

SEQ ID NO: 26610 - DNA, 839 bp, Artificial Sequence
  chemically treated genomic DNA (Homo sapiens) CpG-island No: 26610
aaaacctttccccaaaataaaaaaaaatttatccccgtttcccaaaaaaacaactcgaaataaaaaccaaccgcgtcctaacaaatcccgcccacgcgacgcttctcccacgacgatacgaacgtataaaccgccgtcccgctacccgccttcctaccgcgctaaaactccgacaaaaacctatccgccctaacgcacctaatactacctaccgaacccgaacgaccccgcgccaacctcctaaccttcgcgaaaaacgcaccactatcccgcgcgcgccgccgctcgaccgaaaacctactatcgctacgaccctcgaccgtaaataacgacccgcgaaaaacccgcgactcgccccccgacaacccgcgccgccgccccgaacccgacccccgctccgcctcgacctcgctactacccgacgccttcgccctaaccgccttcgaatacgaaccacaaaccctacgccgcccgcccgaacccttccccgctacgcccgccgcccccgacgacgcaaatcccgaaaaaaccccgacgcccccaaacaacgcccaacgaaacccaaaaccacgcccctctacgcactcgcacgccgactctctacgccccgacctaaacgcgtcgtaaaacgaacccgaaaaactacgcgcgacgaacgacgacgacaacaccaacaacttcctaaattccccctccgaatcctcgaactacgccacgctacactcgaactcgctaaactccgcgtcctaaaaccgccgacgcctccccacgaacgccaaacaaaccaaaccgctctccgaaaccgcaacaccaaaaacgcccgcctccgccccgcgcgc

SEQ ID NO: 26611 - DNA, 839 bp, Artificial Sequence
  chemically treated genomic DNA (Homo sapiens) CpG-island No: 26611
aaggtttttttttagggtggagaagggtttgttttcgttttttaggagggtagttcggggtaaaagttagtcgcgttttgataggtttcgtttacgcggcgttttttttacgacgatgcggacgtgtgggtcgtcgtttcgttgttcgtttttttgtcgcgttggggtttcggtaaggatttgttcgttttggcgtatttggtgttgtttgtcgggttcgagcggtttcgcgttagttttttggttttcgcggaggacgtattattgtttcgcgcgcgtcgtcgttcggtcgagagtttgttgtcgttgcggttttcggtcgtggatagcggttcgcggggagttcgcgattcgtttttcggtagttcgcgtcgtcgtttcgggttcggttttcgtttcgtttcggtttcgttgttgttcgacgttttcgttttgatcgttttcgagtgcgagttataggttttgcgtcgttcgttcgggttttttttcgttgcgttcgtcgttttcgacggcgtagatttcggagaggtttcgacgtttttaagtagcgtttagcggagtttagggttacgtttttttgcgtattcgtacgtcggttttttgcgtttcggtttgagcgcgtcgtggggcgagttcggggggttgcgcgcggcgggcggcggcggtagtattagtagttttttgagtttttttttcgagttttcgggttacgttacgttgtattcggattcgttgggtttcgcgttttaggatcgtcggcgtttttttacggacgttaggtaggttaggtcgtttttcggggtcgtagtattaaagacgttcgttttcgtttcgcgcgt

SEQ ID NO: 26612 - DNA, 839 bp, Artificial Sequence
  chemically treated genomic DNA (Homo sapiens) CpG-island No: 26612
acgcgcgaaacgaaaacgaacgtctttaatactacgaccccgaaaaacgacctaacctacctaacgtccgtaaaaaaacgccgacgatcctaaaacgcgaaacccaacgaatccgaatacaacgtaacgtaacccgaaaactcgaaaaaaaaactcaaaaaactactaatactaccgccgccgcccgccgcgcgcaaccccccgaactcgccccacgacgcgctcaaaccgaaacgcaaaaaaccgacgtacgaatacgcaaaaaaacgtaaccctaaactccgctaaacgctacttaaaaacgtcgaaacctctccgaaatctacgccgtcgaaaacgacgaacgcaacgaaaaaaaacccgaacgaacgacgcaaaacctataactcgcactcgaaaacgatcaaaacgaaaacgtcgaacaacaacgaaaccgaaacgaaacgaaaaccgaacccgaaacgacgacgcgaactaccgaaaaacgaatcgcgaactccccgcgaaccgctatccacgaccgaaaaccgcaacgacaacaaactctcgaccgaacgacgacgcgcgcgaaacaataatacgtcctccgcgaaaaccaaaaaactaacgcgaaaccgctcgaacccgacaaacaacaccaaatacgccaaaacgaacaaatccttaccgaaaccccaacgcgacaaaaaaacgaacaacgaaacgacgacccacacgtccgcatcgtcgtaaaaaaaacgccgcgtaaacgaaacctatcaaaacgcgactaacttttaccccgaactaccctcctaaaaaacgaaaacaaacccttctccaccctaaaaaaaaacctt

SEQ ID NO: 26613 - DNA, 507 bp, Artificial Sequence
  chemically treated genomic DNA (Homo sapiens) CpG-island No: 26613
agcggcgttgttcgtagttagggttagcgttttcgaggggtagaggcggggtcggcggtggcgaattcgcggttttcggtaggggcggcggcggcggtgggggcggcggtggtagttttttggacgttttggggttcgcggcgtagtcgttaggaatatggtttttaggaagtagcgtcgtttgcgggggagcggaggggttttcgagtgagtcgcgggcggtagggtcgaggcgcgggtagtcggcgcgcgcgggttggcgggtacgtattttttcgttgtgcgttatgttcgggcgtgcggttagcgtttcgtcggggtagcggtttagttgtcggtagtagtttttcgtgttgggttgtttgttgaaggcgcggggtttgcggttggagttttgttttcgtagttcgtcgtggtcgttataggagtttagttgcgggaagatagtgatcggtggggttcgggtatttgttcggtaggcgttttttacgtttttttatttagttt

SEQ ID NO: 26614 - DNA, 507 bp, Artificial Sequence
  chemically treated genomic DNA (Homo sapiens) CpG-island No: 26614
aaactaaataaaaaaacgtaaaaaacgcctaccgaacaaatacccgaaccccaccgatcactatcttcccgcaactaaactcctataacgaccacgacgaactacgaaaacaaaactccaaccgcaaaccccgcgccttcaacaaacaacccaacacgaaaaactactaccgacaactaaaccgctaccccgacgaaacgctaaccgcacgcccgaacataacgcacaacgaaaaaatacgtacccgccaacccgcgcgcgccgactacccgcgcctcgaccctaccgcccgcgactcactcgaaaacccctccgctcccccgcaaacgacgctacttcctaaaaaccatattcctaacgactacgccgcgaaccccaaaacgtccaaaaaactaccaccgccgcccccaccgccgccgccgcccctaccgaaaaccgcgaattcgccaccgccgaccccgcctctacccctcgaaaacgctaaccctaactacgaacaacgccgct

SEQ ID NO: 26615 - DNA, 507 bp, Artificial Sequence
  chemically treated genomic DNA (Homo sapiens) CpG-island No: 26615
gagttgggtggggaggcgtggggggcgtttatcgggtaggtgttcgagttttatcggttattgttttttcgtagttgagtttttgtgacggttacgacgggttgcggaggtaggattttagtcgtaagtttcgcgtttttagtaagtagtttagtacgggggattattatcggtagttgggtcgttgtttcggcgagacgttggtcgtacgttcgggtatggcgtatagcgaggaggtgcgtgttcgttagttcgcgcgcgtcggttgttcgcgtttcggttttgtcgttcgcggtttattcgaaggttttttcgttttttcgtaggcggcgttgttttttgggaattatgtttttaacggttgcgtcgcggattttaaggcgtttagggagttgttatcgtcgtttttatcgtcgtcgtcgtttttgtcggaggtcgcgagttcgttatcgtcggtttcgtttttgtttttcgagagcgttggttttggttgcgggtagcgtcgtt

SEQ ID NO: 26616 - DNA, 507 bp, Artificial Sequence
  chemically treated genomic DNA (Homo sapiens) CpG-island No: 26616
aacgacgctacccgcaaccaaaaccaacgctctcgaaaaacaaaaacgaaaccgacgataacgaactcgcgacctccgacaaaaacgacgacgacgataaaaacgacgataacaactccctaaacgccttaaaatccgcgacgcaaccgttaaaaacataattcccaaaaaacaacgccgcctacgaaaaaacgaaaaaaccttcgaataaaccgcgaacgacaaaaccgaaacgcgaacaaccgacgcgcgcgaactaacgaacacgcacctcctcgctatacgccatacccgaacgtacgaccaacgtctcgccgaaacaacgacccaactaccgataataatcccccgtactaaactacttactaaaaacgcgaaacttacgactaaaatcctacctccgcaacccgtcgtaaccgtcacaaaaactcaactacgaaaaaacaataaccgataaaactcgaacacctacccgataaacgccccccacgcctccccacccaactc

SEQ ID NO: 26617 - DNA, 623 bp, Artificial Sequence
  chemically treated genomic DNA (Homo sapiens) CpG-island No: 26617
gtcggtggcggaggcgtcgtgggtcggtgtggcgtcgttgcgggcgcgggtcgcggcggggagggcggttttttttattaggaagcgtagatagtgtagttttttagcgcgggtcgcgtggtgtacgggtagcgcgtttagcgggtcgcgtagcgagggttttaggaggtttgcggcgtgtagcgattttagtacgtttagttcgttttgtcgcgtcgtttgtagcgtttgttttagggttatggtgtcgcgtgcggcgtcgcgatttcgtatttagcgttttttttaggacgttatgtacgtgtttttgcgggttagaggagttcgcggtgcggtcgtcggggatttgcgggtcgggaggcggagcggttgtgggtttggttttcgtttcgcgttgtttggcgtttcgtttcgtcgcgttttggggtcggagttcgcggacgtcggtttaagattcgggttcgtttttatttcgtttcgtttcgtttcgtagttttcgttcgagtttttcgttcgttttcgtcgcgacgcggggatattcgtgcgattggggtaaggtgtttaggggttttttttttaatttgttttacgtaatagttgagattttagagggtagtaaaatt

SEQ ID NO: 26618 - DNA, 623 bp, Artificial Sequence
  chemically treated genomic DNA (Homo sapiens) CpG-island No: 26618
aattttactaccctctaaaatctcaactattacgtaaaacaaattaaaaaaaaaacccctaaacaccttaccccaatcgcacgaatatccccgcgtcgcgacgaaaacgaacgaaaaactcgaacgaaaactacgaaacgaaacgaaacgaaataaaaacgaacccgaatcttaaaccgacgtccgcgaactccgaccccaaaacgcgacgaaacgaaacgccaaacaacgcgaaacgaaaaccaaacccacaaccgctccgcctcccgacccgcaaatccccgacgaccgcaccgcgaactcctctaacccgcaaaaacacgtacataacgtcctaaaaaaaacgctaaatacgaaatcgcgacgccgcacgcgacaccataaccctaaaacaaacgctacaaacgacgcgacaaaacgaactaaacgtactaaaatcgctacacgccgcaaacctcctaaaaccctcgctacgcgacccgctaaacgcgctacccgtacaccacgcgacccgcgctaaaaaactacactatctacgcttcctaataaaaaaaaccgccctccccgccgcgacccgcgcccgcaacgacgccacaccgacccacgacgcctccgccaccgac

SEQ ID NO: 26619 - DNA, 623 bp, Artificial Sequence
  chemically treated genomic DNA (Homo sapiens) CpG-island No: 26619
agttttgttgttttttggggttttaattgttacgtgaggtaaattaggagagaagtttttgggtattttgttttagtcgtacgagtgttttcgcgtcgcggcgggggcgggcggggaattcgggcggaggttgcggggcggggcggggcggggtgggggcgggttcgagttttaagtcggcgttcgcgggtttcggttttagagcgcggcggagcggagcgttaggtagcgcggagcggaggttaggtttatagtcgtttcgtttttcggttcgtagattttcgacggtcgtatcgcgggtttttttggttcgtaagaatacgtgtatggcgttttggggaaggcgttgagtgcggagtcgcggcgtcgtacgcggtattatggttttggagtaggcgttgtaggcggcgcggtagggcgagttggacgtgttgaggtcgttgtacgtcgtaggttttttggggttttcgttgcgcgattcgttggacgcgttgttcgtgtattacgcggttcgcgttgggaagttgtattgtttgcgttttttggtggaggaagtcgtttttttcgtcgcggttcgcgttcgtaacggcgttatatcggtttacgacgttttcgttatcggt

SEQ ID NO: 26620 - DNA, 623 bp, Artificial Sequence
  chemically treated genomic DNA (Homo sapiens) CpG-island No: 26620
accgataacgaaaacgtcgtaaaccgatataacgccgttacgaacgcgaaccgcgacgaaaaaaacgacttcctccaccaaaaaacgcaaacaatacaacttcccaacgcgaaccgcgtaatacacgaacaacgcgtccaacgaatcgcgcaacgaaaaccccaaaaaacctacgacgtacaacgacctcaacacgtccaactcgccctaccgcgccgcctacaacgcctactccaaaaccataataccgcgtacgacgccgcgactccgcactcaacgccttccccaaaacgccatacacgtattcttacgaaccaaaaaaacccgcgatacgaccgtcgaaaatctacgaaccgaaaaacgaaacgactataaacctaacctccgctccgcgctacctaacgctccgctccgccgcgctctaaaaccgaaacccgcgaacgccgacttaaaactcgaacccgcccccaccccgccccgccccgccccgcaacctccgcccgaattccccgcccgcccccgccgcgacgcgaaaacactcgtacgactaaaacaaaatacccaaaaacttctctcctaatttacctcacgtaacaattaaaaccccaaaaaacaacaaaact

SEQ ID NO: 26621 - DNA, 1289 bp, Artificial Sequence
  chemically treated genomic DNA (Homo sapiens) CpG-island No: 26621
gtcgttatttcgcggtagataggacgtaaaggcggggagcgggattttcgggggcgtcgcggttttttttttcggttttattttgcgtaggaataaaggtaggaggtgggattagcgggcggtcggatttcgcggggcggggcggggcgggcgagtcgtttttttaaagttcggtcgcgggcggggcgcgtattcgtttggtattagttcgggtcgcgttcgggattttatttcggatttcggtttttttttgcgtggggttcgtagttgttatcgttttttcgcggagtatggggttgtttcgtcgggtaggggacgcggcggagttgcgtaaggtgggtatcggggattgggggcggggttggggatttcggggattcgtttaattatcgcgtcgttcgttcgtagagtttgaagtcgttgttggagaagcgtcggcgcgcgcgtattaattagagtttgagttagtttaaggggtttattttgtcgttgttgggtcgggaggtgagcgcgttcgggcggagggtagagggttttggggcgcggagcgggggtagggggacggggtgtttttgcgggaggaatttattagggggtttcgcgcggcgttcgaggcggagtttgggtggggtgggcgcgtcggagcggatttttagtaggttacggcgcgttttatatttagttttcgattagagcgagggtgcgtacggtagtcggttaaagttttgttttggtggttttttgtcgttttttttcgtggtcgggcgtagaattttaattgttcgaagttagagaaggtagacgttttggaaatgatcgtgcgttttttgtaggagttgtttgcgtttttatggtttacggtagcgtttcgtgagtgagttttttttgttttgtcgcgcgttttgtatttcgtattcggtattttatttcgcgttttacgcggtttttcgttcgtagtgttttgcgatagttatcgcgagggttatagcgtttgtgtggcgcgtttggttcgcgtgttgttcgtttgtcgtgttttggagttcgtcgtgagcgcgcgtttgttggagtatttgtggcggagagcggttagcgttattttggacggcgggcgcgttggggattttagtggttcgtttgttttcgttttagcgttcgcgtttgttttagagttcgtattcgtttcggtgttttcgtcgttttcgtttttttgcggttttggtttttggcggtcgtggtagtttttcggtcgatttatagattttgtcgattgtttgggattttggggtatt

SEQ ID NO: 26622 - DNA, 1289 bp, Artificial Sequence
  chemically treated genomic DNA (Homo sapiens) CpG-island No: 26622
aataccccaaaatcccaaacaatcgacaaaatctataaatcgaccgaaaaactaccacgaccgccaaaaaccaaaaccgcaaaaaaacgaaaacgacgaaaacaccgaaacgaatacgaactctaaaacaaacgcgaacgctaaaacgaaaacaaacgaaccactaaaatccccaacgcgcccgccgtccaaaataacgctaaccgctctccgccacaaatactccaacaaacgcgcgctcacgacgaactccaaaacacgacaaacgaacaacacgcgaaccaaacgcgccacacaaacgctataaccctcgcgataactatcgcaaaacactacgaacgaaaaaccgcgtaaaacgcgaaataaaataccgaatacgaaatacaaaacgcgcgacaaaacaaaaaaaactcactcacgaaacgctaccgtaaaccataaaaacgcaaacaactcctacaaaaaacgcacgatcatttccaaaacgtctaccttctctaacttcgaacaattaaaattctacgcccgaccacgaaaaaaaacgacaaaaaaccaccaaaacaaaactttaaccgactaccgtacgcaccctcgctctaatcgaaaactaaatataaaacgcgccgtaacctactaaaaatccgctccgacgcgcccaccccacccaaactccgcctcgaacgccgcgcgaaaccccctaataaattcctcccgcaaaaacaccccgtccccctacccccgctccgcgccccaaaaccctctaccctccgcccgaacgcgctcacctcccgacccaacaacgacaaaataaaccccttaaactaactcaaactctaattaatacgcgcgcgccgacgcttctccaacaacgacttcaaactctacgaacgaacgacgcgataattaaacgaatccccgaaatccccaaccccgcccccaatccccgatacccaccttacgcaactccgccgcgtcccctacccgacgaaacaaccccatactccgcgaaaaaacgataacaactacgaaccccacgcaaaaaaaaaccgaaatccgaaataaaatcccgaacgcgacccgaactaataccaaacgaatacgcgccccgcccgcgaccgaactttaaaaaaacgactcgcccgccccgccccgccccgcgaaatccgaccgcccgctaatcccacctcctacctttattcctacgcaaaataaaaccgaaaaaaaaaaccgcgacgcccccgaaaatcccgctccccgcctttacgtcctatctaccgcgaaataacgac

SEQ ID NO: 26623 - DNA, 1289 bp, Artificial Sequence
  chemically treated genomic DNA (Homo sapiens) CpG-island No: 26623
agtgttttaaggttttaagtagtcggtagggtttgtggatcggtcgaggggttattacggtcgttagaggttagggtcgtagggaggcgagggcggcgagggtatcggagcggatgcgggttttggggtagacgcgggcgttggggcgggggtagacgggttattggaatttttagcgcgttcgtcgtttagggtggcgttggtcgtttttcgttataggtgttttagtaggcgcgcgtttacggcgggttttaggatacggtaggcgggtagtacgcgggttaggcgcgttatataggcgttgtagttttcgcggtagttgtcgtaaggtattgcgggcggagagtcgcgtgaggcgcggggtagggtgtcgggtgcggggtgtagagcgcgcggtagggtagggagggtttatttacggggcgttgtcgtgggttatgaggacgtaggtagtttttgtaggaagcgtacggttatttttaggacgtttgttttttttagtttcgagtagttggagttttgcgttcggttacgaggaagagcgatagagaattattaagatagaattttggtcggttatcgtgcgtattttcgttttagtcgggagttgggtgtggggcgcgtcgtggtttgttgggggttcgtttcgacgcgtttattttatttaggtttcgtttcgggcgtcgcgcggaattttttggtgggtttttttcgtaggagtatttcgtttttttgttttcgtttcgcgttttaggattttttgtttttcgttcgggcgcgtttatttttcggtttagtagcggtaggatgagttttttaagttggtttaggttttggttgatgcgcgcgcgtcggcgtttttttagtagcggttttaggttttgcggacgggcggcgcggtggttagacgggttttcggagtttttagtttcgtttttagttttcggtatttattttgcgtagtttcgtcgcgttttttgttcggcgaggtagttttatgtttcgcggggaagcggtggtagttgcgagttttacgtaaagggaaatcgaggttcgaaatgaggtttcgggcgcggttcgggttggtgttagacgagtgcgcgtttcgttcgcggtcgagttttaagggagcggttcgttcgtttcgtttcgtttcgcggagttcggtcgttcgttggttttattttttgtttttgtttttgcgtagggtggagtcgggaggggagatcgcgacgttttcggggatttcgtttttcgtttttgcgttttgtttatcgcggggtggcggt

SEQ ID NO: 26624 - DNA, 1289 bp, Artificial Sequence
  chemically treated genomic DNA (Homo sapiens) CpG-island No: 26624
accgccaccccgcgataaacaaaacgcaaaaacgaaaaacgaaatccccgaaaacgtcgcgatctcccctcccgactccaccctacgcaaaaacaaaaacaaaaaataaaaccaacgaacgaccgaactccgcgaaacgaaacgaaacgaacgaaccgctcccttaaaactcgaccgcgaacgaaacgcgcactcgtctaacaccaacccgaaccgcgcccgaaacctcatttcgaacctcgatttccctttacgtaaaactcgcaactaccaccgcttccccgcgaaacataaaactacctcgccgaacaaaaaacgcgacgaaactacgcaaaataaataccgaaaactaaaaacgaaactaaaaactccgaaaacccgtctaaccaccgcgccgcccgtccgcaaaacctaaaaccgctactaaaaaaacgccgacgcgcgcgcatcaaccaaaacctaaaccaacttaaaaaactcatcctaccgctactaaaccgaaaaataaacgcgcccgaacgaaaaacaaaaaatcctaaaacgcgaaacgaaaacaaaaaaacgaaatactcctacgaaaaaaacccaccaaaaaattccgcgcgacgcccgaaacgaaacctaaataaaataaacgcgtcgaaacgaacccccaacaaaccacgacgcgccccacacccaactcccgactaaaacgaaaatacgcacgataaccgaccaaaattctatcttaataattctctatcgctcttcctcgtaaccgaacgcaaaactccaactactcgaaactaaaaaaaacaaacgtcctaaaaataaccgtacgcttcctacaaaaactacctacgtcctcataacccacgacaacgccccgtaaataaaccctccctaccctaccgcgcgctctacaccccgcacccgacaccctaccccgcgcctcacgcgactctccgcccgcaataccttacgacaactaccgcgaaaactacaacgcctatataacgcgcctaacccgcgtactacccgcctaccgtatcctaaaacccgccgtaaacgcgcgcctactaaaacacctataacgaaaaacgaccaacgccaccctaaacgacgaacgcgctaaaaattccaataacccgtctacccccgccccaacgcccgcgtctaccccaaaacccgcatccgctccgataccctcgccgccctcgcctccctacgaccctaacctctaacgaccgtaataacccctcgaccgatccacaaaccctaccgactacttaaaaccttaaaacact

SEQ ID NO: 26625 - DNA, 1029 bp, Artificial Sequence
  chemically treated genomic DNA (Homo sapiens) CpG-island No: 26625
gcgcggtagcgaatcggcggcgcgggcggtcgggaacgtttagtataaatatttatcgtcgcgcggagagtgagggtttaagttcgttttgtttcgttatttaggtcgttttagacgtttttttcggggttgttatcgggtcgggcgcggttgtcgcggttagcgggtttttttcgtatcggcgcggtttaatcgttatcgaattttttggaagcggcggttgtttgggtttttacgtcgttagaatcgtacgttcgcgcgagttttttgtagttttggcggtttgggaggcggggttcggggtggggtcggcgcgggggcggggtcggcgcggggaggtcgcgttcgattgttttcggcgcgtaggtttcgttttattagttttatcgttttatttttgttttttttttttatggcgcggttcgggtttatttatttcgcgtcgggtttgttagatatttgcgtttttttgtagtcgttcgtcgtattcgtcgtcgtagtttttagtatgtcgggtttagacgtcgagacgtcgttcgttatttagatttgtcggtaagagagggttcgcgcgtagtttgtagcggttaggcgcgtcggttatcgttttaggtttgtttcgtttggttttgtggtttttattcgtcgaggtcgttttcgttcgtcgatttttcgtacggtttttcgcgtcgtcgtttcggacgttcgttcggtcgggatgcgattcgcgatgtcgtataagtcgggcggttttcgttcgtttttagtcggttttttttggtcgtatttttagggcggcggtcgcgttacgggtcgtttgggcgagaaagttaggtagggacggggcgggcggaggttaatgtatagttttagagttcggcgatcggcgttcgtgggtcgtttcgtttcgggtttcgttcgagtatttcggagttttagtttcgtggttttgtttagttttttcgaggattcgggattattatttcggcggttgtgttgcgttaattaaagtttttagaggtggagggg

SEQ ID NO: 26626 - DNA, 1029 bp, Artificial Sequence
  chemically treated genomic DNA (Homo sapiens) CpG-island No: 26626
cccctccacctctaaaaactttaattaacgcaacacaaccgccgaaataataatcccgaatcctcgaaaaaactaaacaaaaccacgaaactaaaactccgaaatactcgaacgaaacccgaaacgaaacgacccacgaacgccgatcgccgaactctaaaactatacattaacctccgcccgccccgtccctacctaactttctcgcccaaacgacccgtaacgcgaccgccgccctaaaaatacgaccaaaaaaaaccgactaaaaacgaacgaaaaccgcccgacttatacgacatcgcgaatcgcatcccgaccgaacgaacgtccgaaacgacgacgcgaaaaaccgtacgaaaaatcgacgaacgaaaacgacctcgacgaataaaaaccacaaaaccaaacgaaacaaacctaaaacgataaccgacgcgcctaaccgctacaaactacgcgcgaaccctctcttaccgacaaatctaaataacgaacgacgtctcgacgtctaaacccgacatactaaaaactacgacgacgaatacgacgaacgactacaaaaaaacgcaaatatctaacaaacccgacgcgaaataaataaacccgaaccgcgccataaaaaaaaaaaacaaaaataaaacgataaaactaataaaacgaaacctacgcgccgaaaacaatcgaacgcgacctccccgcgccgaccccgcccccgcgccgaccccaccccgaaccccgcctcccaaaccgccaaaactacaaaaaactcgcgcgaacgtacgattctaacgacgtaaaaacccaaacaaccgccgcttccaaaaaattcgataacgattaaaccgcgccgatacgaaaaaaacccgctaaccgcgacaaccgcgcccgacccgataacaaccccgaaaaaaacgtctaaaacgacctaaataacgaaacaaaacgaacttaaaccctcactctccgcgcgacgataaatatttatactaaacgttcccgaccgcccgcgccgccgattcgctaccgcgc

SEQ ID NO: 26627 - DNA, 1029 bp, Artificial Sequence
  chemically treated genomic DNA (Homo sapiens) CpG-island No: 26627
tttttttatttttgggggttttggttagcgtagtataatcgtcgaggtaatgatttcgaattttcgaggaggttaagtaggattacggggttgaggtttcgggatgttcgggcgaggttcgaggcggggcggtttacgggcgtcggtcgtcgggttttggagttgtgtattgattttcgttcgtttcgtttttgtttggttttttcgtttaaacggttcgtggcgcggtcgtcgttttggagatgcggttaggaggagtcggttggaggcgggcgggggtcgttcggtttgtgcggtatcgcgagtcgtatttcggtcgggcgggcgttcggggcggcggcgcggaaggtcgtgcggggaatcggcgggcgggggcggtttcggcgggtggggattatagagttaagcggggtaggtttggggcggtgatcggcgcgtttggtcgttgtaggttgcgcgcgggtttttttttatcggtagatttggatggcggacggcgtttcgacgtttgggttcgatatgttgggggttgcggcggcggatgcggcgggcggttgtagaagggcgtaggtgtttggtaggttcggcgcggaatgaatgagttcgggtcgcgttataaagggggagggtagaggtggagcgatggggttggtgaggcggggtttgcgcgtcgggggtaatcgaacgcggttttttcgcgtcgatttcgttttcgcgtcggttttatttcgagtttcgttttttaggtcgttaaggttgtagagagttcgcgcgggcgtacgattttggcggcgtgggggtttaggtagtcgtcgtttttagaaggttcggtggcggttgggtcgcgtcggtgcggggaaggttcgttagtcgcggtagtcgcgttcgattcggtggtagtttcgagggaagcgtttggggcggtttaagtggcggagtagggcggatttgggtttttatttttcgcgcggcggtaaatatttgtgttgggcgttttcggtcgttcgcgtcgtcgattcgttgtcgcgt

SEQ ID NO: 26628 - DNA, 1029 bp, Artificial Sequence
  chemically treated genomic DNA (Homo sapiens) CpG-island No: 26628
acgcgacaacgaatcgacgacgcgaacgaccgaaaacgcccaacacaaatatttaccgccgcgcgaaaaataaaaacccaaatccgccctactccgccacttaaaccgccccaaacgcttccctcgaaactaccaccgaatcgaacgcgactaccgcgactaacgaaccttccccgcaccgacgcgacccaaccgccaccgaaccttctaaaaacgacgactacctaaacccccacgccgccaaaatcgtacgcccgcgcgaactctctacaaccttaacgacctaaaaaacgaaactcgaaataaaaccgacgcgaaaacgaaatcgacgcgaaaaaaccgcgttcgattacccccgacgcgcaaaccccgcctcaccaaccccatcgctccacctctaccctccccctttataacgcgacccgaactcattcattccgcgccgaacctaccaaacacctacgcccttctacaaccgcccgccgcatccgccgccgcaacccccaacatatcgaacccaaacgtcgaaacgccgtccgccatccaaatctaccgataaaaaaaaacccgcgcgcaacctacaacgaccaaacgcgccgatcaccgccccaaacctaccccgcttaactctataatccccacccgccgaaaccgcccccgcccgccgattccccgcacgaccttccgcgccgccgccccgaacgcccgcccgaccgaaatacgactcgcgataccgcacaaaccgaacgacccccgcccgcctccaaccgactcctcctaaccgcatctccaaaacgacgaccgcgccacgaaccgtttaaacgaaaaaaccaaacaaaaacgaaacgaacgaaaatcaatacacaactccaaaacccgacgaccgacgcccgtaaaccgccccgcctcgaacctcgcccgaacatcccgaaacctcaaccccgtaatcctacttaacctcctcgaaaattcgaaatcattacctcgacgattatactacgctaaccaaaacccccaaaaataaaaaaa

SEQ ID NO: 26629 - DNA, 691 bp, Artificial Sequence
  chemically treated genomic DNA (Homo sapiens) CpG-island No: 26629
gcgcgtcgggtatttttttggttacggtaggtaacgcgtcgtttcgcgttcgggtgttagtttttcgtgttttttgttttcgtacggtcggagttgggtggtagtcgtcgatcgtaggttggttggttggttcgttcgttcgttcgttcgttcgttttttgttgtaagcggtagtttcgggggtggggggggtgtatcgggatagggggagagacggggaggcgtttcgggaggttcgcggagttgggggacgtgggggggtcgcggcggagggagcgtcgagttttttatttgtatttggggcggttttgggtgattttttaagttcgggggaaaaatgtgtgtgtgtttgggatggagcgtcgcgggcgcgtatgcgttgtttaaagttgtcggatttcggatttttcgtttttagttttcgttttcgttcgttgtgattatggaatttttcgcggtcgggcgggcgagtgggtggtatgtaaaattcgggtcggatcgcggggtcgggtttcgttttatttttatatttttagatttgtttttttcggattttttttatttatcgttcgggttgagtttagcgtgtgcgcgcggcgagtcgtacggtttgcggaggagtatttgagcgttcggtttttttttgtaggtttagaggtttttatatttttttttagttgagttgagttga

SEQ ID NO: 26630 - DNA, 691 bp, Artificial Sequence
  chemically treated genomic DNA (Homo sapiens) CpG-island No: 26630
tcaactcaactcaactaaaaaaaaatataaaaacctctaaacctacaaaaaaaaaccgaacgctcaaatactcctccgcaaaccgtacgactcgccgcgcgcacacgctaaactcaacccgaacgataaataaaaaaaatccgaaaaaaacaaatctaaaaatataaaaataaaacgaaacccgaccccgcgatccgacccgaattttacataccacccactcgcccgcccgaccgcgaaaaattccataatcacaacgaacgaaaacgaaaactaaaaacgaaaaatccgaaatccgacaactttaaacaacgcatacgcgcccgcgacgctccatcccaaacacacacacatttttcccccgaacttaaaaaatcacccaaaaccgccccaaatacaaataaaaaactcgacgctccctccgccgcgacccccccacgtcccccaactccgcgaacctcccgaaacgcctccccgtctctccccctatcccgatacaccccccccacccccgaaactaccgcttacaacaaaaaacgaacgaacgaacgaacgaacgaaccaaccaaccaacctacgatcgacgactaccacccaactccgaccgtacgaaaacaaaaaacacgaaaaactaacacccgaacgcgaaacgacgcgttacctaccgtaaccaaaaaaatacccgacgcgc

SEQ ID NO: 26631 - DNA, 691 bp, Artificial Sequence
  chemically treated genomic DNA (Homo sapiens) CpG-island No: 26631
ttaatttaatttagttgggggggggtgtagaagtttttggatttgtaaaagggggtcgagcgtttagatgttttttcgtaggtcgtgcgattcgtcgcgcgtatacgttgagtttagttcgggcggtgggtgggaaggattcgggaggggtaggtttgggggtgtgagggtggagcggagttcggtttcgcgattcggttcgggttttgtatgttatttattcgttcgttcggtcgcggagaattttataattatagcgggcgagagcggagattgggagcgaaaaattcgggattcggtaattttgggtagcgtatgcgcgttcgcggcgttttattttaaatatatatatatttttttttcggatttggaaagttatttaaagtcgttttaagtgtaggtaagagattcggcgtttttttcgtcgcggtttttttacgttttttagtttcgcgggtttttcggggcgttttttcgtttttttttttgtttcggtgtattttttttattttcggggttgtcgtttgtagtagggagcgggcgagcgagcgagcgagcgagttagttagttagtttgcgatcggcggttgttatttaatttcggtcgtgcggaggtagggggtacggagggttggtattcgggcgcggggcggcgcgttgtttgtcgtggttaggggaatgttcggcgcgt

SEQ ID NO: 26632 - DNA, 691 bp, Artificial Sequence
  chemically treated genomic DNA (Homo sapiens) CpG-island No: 26632
acgcgccgaacattcccctaaccacgacaaacaacgcgccgccccgcgcccgaataccaaccctccgtaccccctacctccgcacgaccgaaattaaataacaaccgccgatcgcaaactaactaactaactcgctcgctcgctcgctcgcccgctccctactacaaacgacaaccccgaaaataaaaaaaatacaccgaaacaaaaaaaaaaacgaaaaaacgccccgaaaaacccgcgaaactaaaaaacgtaaaaaaaccgcgacgaaaaaaacgccgaatctcttacctacacttaaaacgactttaaataactttccaaatccgaaaaaaaaatatatatatatttaaaataaaacgccgcgaacgcgcatacgctacccaaaattaccgaatcccgaatttttcgctcccaatctccgctctcgcccgctataattataaaattctccgcgaccgaacgaacgaataaataacatacaaaacccgaaccgaatcgcgaaaccgaactccgctccaccctcacacccccaaacctacccctcccgaatccttcccacccaccgcccgaactaaactcaacgtatacgcgcgacgaatcgcacgacctacgaaaaaacatctaaacgctcgacccccttttacaaatccaaaaacttctacacccccccccaactaaattaaattaa

SEQ ID NO: 26633 - DNA, 858 bp, Artificial Sequence
  chemically treated genomic DNA (Homo sapiens) CpG-island No: 26633
tagatagcgtcgcggttcgttttcggtagtatttttagggattcggattcgtgggcggcgggatttatcggttttaggagttttaatttagggtcgattcgtatttatattttcggcgggttttaggcgttgcgtttatttttatttcgattttagacgcgatttttattcgatttcgtagtttaggcgttgattttggtttttaagtttaagcgttatttcggattttgggcgattcgttgtgattttacggtcggtagtcggagtagagggtttcggttttcgagtttaggcgtaatttttaatttcggggcgtttttttttttttagaggcgcgtggatttcggaattaggtgttattttagattatgggcgtcgcgtttcgattttaggcggaggtcgtcgagagtagagggtcgtggtttttttagtttaggcgttgcgcggaggtcggggggcgcgggggcggcggaggcggcgcgagtttcggcgggaggtttcgagttgtatcgggcgcgggcggggggtcgtaggtcggacgggcgttgatttgtagtgggtcggttttttagtttgcgggggggattcgtttagcgtcgttgtcgtcgttttcgaaatcgacggtatttttagttaaaataatgtagcgcgtatgcgtcgcgtcggcgttttcgttttcggatattttcgcgcgttttcgcggttacgtttttcgcggtttcgtttttagttcgtagatttcggtttcgttttagtttcgcgtttttcgtagtttcgttttcggttcgtagatttcgttttagtttcgcgtttcgttttgttttgttttgttttgttttgttttgttttgttttgttt

SEQ ID NO: 26634 - DNA, 858 bp, Artificial Sequence
  chemically treated genomic DNA (Homo sapiens) CpG-island No: 26634
aaacaaaacaaaacaaaacaaaacaaaacaaaacaaaacaaaacgaaacgcgaaactaaaacgaaatctacgaaccgaaaacgaaactacgaaaaacgcgaaactaaaacgaaaccgaaatctacgaactaaaaacgaaaccgcgaaaaacgtaaccgcgaaaacgcgcgaaaatatccgaaaacgaaaacgccgacgcgacgcatacgcgctacattattttaactaaaaataccgtcgatttcgaaaacgacgacaacgacgctaaacgaatcccccccgcaaactaaaaaaccgacccactacaaatcaacgcccgtccgacctacgaccccccgcccgcgcccgatacaactcgaaacctcccgccgaaactcgcgccgcctccgccgcccccgcgccccccgacctccgcgcaacgcctaaactaaaaaaaccacgaccctctactctcgacgacctccgcctaaaatcgaaacgcgacgcccataatctaaaataacacctaattccgaaatccacgcgcctctaaaaaaaaaaaaacgccccgaaattaaaaattacgcctaaactcgaaaaccgaaaccctctactccgactaccgaccgtaaaatcacaacgaatcgcccaaaatccgaaataacgcttaaacttaaaaaccaaaatcaacgcctaaactacgaaatcgaataaaaatcgcgtctaaaatcgaaataaaaataaacgcaacgcctaaaacccgccgaaaatataaatacgaatcgaccctaaattaaaactcctaaaaccgataaatcccgccgcccacgaatccgaatccctaaaaatactaccgaaaacgaaccgcgacgctatcta

SEQ ID NO: 26635 - DNA, 858 bp, Artificial Sequence
  chemically treated genomic DNA (Homo sapiens) CpG-island No: 26635
gggtagggtagggtagggtagggtagggtagggtagggtagggcggggcgcggggttggggcggggtttgcgggtcgggggcggggttgcggggggcgcggggttggggcggggtcggggtttgcgggttgggggcggggtcgcggggggcgtggtcgcgggggcgcgcggggatattcgggggcgggggcgtcggcgcggcgtatgcgcgttgtattgttttgattgaaaatgtcgtcggtttcgaaagcggcggtagcggcgttgagcgggtttttttcgtagattgagaagtcgatttattataggttagcgttcgttcggtttgcggtttttcgttcgcgttcggtgtagttcggagtttttcgtcggggttcgcgtcgttttcgtcgttttcgcgtttttcggttttcgcgtagcgtttgggttgggggggttacgattttttgttttcggcggttttcgtttgaggtcggagcgcggcgtttatggtttgggatggtatttggtttcggggtttacgcgtttttggggagggaggaacgtttcggggttgggggttgcgtttgggttcggggatcgggattttttgtttcggttgtcgatcgtgaggttatagcgggtcgtttagggttcggggtggcgtttgggtttggggattagggttagcgtttgggttacgaggtcgggtgagggtcgcgtttggagtcgggatgggggtgggcgtagcgtttggggttcgtcgggaatgtgagtacgggtcgattttgggttgaggtttttgaggtcggtgggtttcgtcgtttacgagttcgagtttttggaggtgttgtcggaagcgagtcgcggcgttgtttg

SEQ ID NO: 26636 - DNA, 858 bp, Artificial Sequence
  chemically treated genomic DNA (Homo sapiens) CpG-island No: 26636
caaacaacgccgcgactcgcttccgacaacacctccaaaaactcgaactcgtaaacgacgaaacccaccgacctcaaaaacctcaacccaaaatcgacccgtactcacattcccgacgaaccccaaacgctacgcccacccccatcccgactccaaacgcgaccctcacccgacctcgtaacccaaacgctaaccctaatccccaaacccaaacgccaccccgaaccctaaacgacccgctataacctcacgatcgacaaccgaaacaaaaaatcccgatccccgaacccaaacgcaacccccaaccccgaaacgttcctccctccccaaaaacgcgtaaaccccgaaaccaaataccatcccaaaccataaacgccgcgctccgacctcaaacgaaaaccgccgaaaacaaaaaatcgtaacccccccaacccaaacgctacgcgaaaaccgaaaaacgcgaaaacgacgaaaacgacgcgaaccccgacgaaaaactccgaactacaccgaacgcgaacgaaaaaccgcaaaccgaacgaacgctaacctataataaatcgacttctcaatctacgaaaaaaacccgctcaacgccgctaccgccgctttcgaaaccgacgacattttcaatcaaaacaatacaacgcgcatacgccgcgccgacgcccccgcccccgaatatccccgcgcgcccccgcgaccacgccccccgcgaccccgcccccaacccgcaaaccccgaccccgccccaaccccgcgccccccgcaaccccgcccccgacccgcaaaccccgccccaaccccgcgccccgccctaccctaccctaccctaccctaccctaccctaccctaccc

SEQ ID NO: 26637 - DNA, 676 bp, Artificial Sequence
  chemically treated genomic DNA (Homo sapiens) CpG-island No: 26637
cggcggtagggtgggttcgatttcgggaatcgggtaacggatgaaggtttcgggaagtttagtttatgagttttagcgttcggacggttttggaagagagagagtagtaagcgtttcgttcgttcgtcggtgtttgttttcggtttttcgagattttgaggagtttattcggtcgtcggggtatataagatacgatttattgttgttttgatttttcgattgacgttttggcgcgtcgtgatagcgttattttcgtcgtcggaaatcggaaatcgggcgttatattaggttttcgtttacgattatagaacgtggttttagtagcgtagcggaaatgacgttcggttgcgaagagtttttttcgtcgtaggttcggagtgcgcgatggtatgtcgggaaatgtagtttttcgtttttttcgaataggatcgatatttcggtttttggtttcgaagagaggcgggcgtcgcgggggcggacgttgtttttagagagttgtttgagtttgtttcggagtagttttgaatcgttatgaaggtgcgcggggtttggttggggattcgcgtttttagttttgttcgtttgttttgggttgggcgttcgtatttttttgtcggttttttcgaaggtcgtggtatcgttttatttttttttttttttttttttcgtttagttt

SEQ ID NO: 26638 - DNA, 676 bp, Artificial Sequence
  chemically treated genomic DNA (Homo sapiens) CpG-island No: 26638
aaactaaacgaaaaaaaaaaaaaaaaaaaaataaaacgataccacgaccttcgaaaaaaccgacaaaaaaatacgaacgcccaacccaaaacaaacgaacaaaactaaaaacgcgaatccccaaccaaaccccgcgcaccttcataacgattcaaaactactccgaaacaaactcaaacaactctctaaaaacaacgtccgcccccgcgacgcccgcctctcttcgaaaccaaaaaccgaaatatcgatcctattcgaaaaaaacgaaaaactacatttcccgacataccatcgcgcactccgaacctacgacgaaaaaaactcttcgcaaccgaacgtcatttccgctacgctactaaaaccacgttctataatcgtaaacgaaaacctaatataacgcccgatttccgatttccgacgacgaaaataacgctatcacgacgcgccaaaacgtcaatcgaaaaatcaaaacaacaataaatcgtatcttatataccccgacgaccgaataaactcctcaaaatctcgaaaaaccgaaaacaaacaccgacgaacgaacgaaacgcttactactctctctcttccaaaaccgtccgaacgctaaaactcataaactaaacttcccgaaaccttcatccgttacccgattcccgaaatcgaacccaccctaccgccg

SEQ ID NO: 26639 - DNA, 676 bp, Artificial Sequence
  chemically treated genomic DNA (Homo sapiens) CpG-island No: 26639
gaattaaacggaaaaaaaaaaaaaaaaaaaatagggcggtgttacggttttcggggaagtcggtagagaggtgcgggcgtttagtttagggtaggcgggtagggttgagggcgcggatttttaattaggtttcgcgtatttttatgacggtttagaattgtttcgaggtaaatttagataattttttgaggataacgttcgttttcgcggcgttcgttttttttcggggttagggatcggggtgtcggttttattcgaaagggacggagaattatatttttcggtatgttatcgcgtatttcgggtttgcgacggaaagagtttttcgtagtcgaacgttattttcgttgcgttattgggattacgttttgtagtcgtgagcggaggtttggtatggcgttcggttttcggttttcggcgacggaagtgacgttattacggcgcgttaaggcgttagtcgaggagttaaggtagtaatgaatcgtgttttgtgtgtttcggcggtcgggtgagttttttaaggtttcggagggtcgagggtagatatcggcgggcgggcggagcgtttattgtttttttttttttagggtcgttcgggcgttgaggtttataggttgggtttttcgaagtttttattcgttgttcggttttcgggatcgggtttattttgtcgtcg

SEQ ID NO: 26640 - DNA, 676 bp, Artificial Sequence
  chemically treated genomic DNA (Homo sapiens) CpG-island No: 26640
cgacgacaaaataaacccgatcccgaaaaccgaacaacgaataaaaacttcgaaaaacccaacctataaacctcaacgcccgaacgaccctaaaaaaaaaaaaacaataaacgctccgcccgcccgccgatatctaccctcgaccctccgaaaccttaaaaaactcacccgaccgccgaaacacacaaaacacgattcattactaccttaactcctcgactaacgccttaacgcgccgtaataacgtcacttccgtcgccgaaaaccgaaaaccgaacgccataccaaacctccgctcacgactacaaaacgtaatcccaataacgcaacgaaaataacgttcgactacgaaaaactctttccgtcgcaaacccgaaatacgcgataacataccgaaaaatataattctccgtccctttcgaataaaaccgacaccccgatccctaaccccgaaaaaaaacgaacgccgcgaaaacgaacgttatcctcaaaaaattatctaaatttacctcgaaacaattctaaaccgtcataaaaatacgcgaaacctaattaaaaatccgcgccctcaaccctacccgcctaccctaaactaaacgcccgcacctctctaccgacttccccgaaaaccgtaacaccgccctattttttttttttttttttttccgtttaattc

SEQ ID NO: 26641 - DNA, 673 bp, Artificial Sequence
  chemically treated genomic DNA (Homo sapiens) CpG-island No: 26641
cgcgtagggaaatatgtcgtacgtatttaagggatcggtcgcgaaagttagtgcgtgggcggggtatagcgaacggggttagggttttgtcggggcggggttggcgttcggggcggtcgcgacgtagtttcgtttttagcgttggcgcgagattcgaacgtcgtcggtcgcggttttggcgttttttgaggcgtcgggagtttgcgtcggcgttttgtcggtttcgtttttttagcggttatgaggcggataggtttcgaggaggaggtttgcggcgtgtggttggacgcggcggcgttgaagaggcggaaagtgtaggtgggacgttgggggatgagagggcgttgggaattaggtagggtttggaggcgtaagacgggaggagtttgggggatatttggagatgatgaaagcgaagtcggggatagagaagggaatagcgttggggatttataggcgagagggattgtggtttgaagaaggttgaaaaacggggtttggggaggatgggagggacggaaggaaagagcgtgttgttggggggtttggaggagcggtgcgtagggaggggcggcgaaggtttaggtgtgggagaggcggagggaaagttcgttcggagtagttgaattgattaggttttttaggaggttatagtttttgcgagacgttttag

SEQ ID NO: 26642 - DNA, 673 bp, Artificial Sequence
  chemically treated genomic DNA (Homo sapiens) CpG-island No: 26642
ctaaaacgtctcgcaaaaactataacctcctaaaaaacctaatcaattcaactactccgaacgaactttccctccgcctctcccacacctaaaccttcgccgcccctccctacgcaccgctcctccaaaccccccaacaacacgctctttccttccgtccctcccatcctccccaaaccccgtttttcaaccttcttcaaaccacaatccctctcgcctataaatccccaacgctattcccttctctatccccgacttcgctttcatcatctccaaatatcccccaaactcctcccgtcttacgcctccaaaccctacctaattcccaacgccctctcatcccccaacgtcccacctacactttccgcctcttcaacgccgccgcgtccaaccacacgccgcaaacctcctcctcgaaacctatccgcctcataaccgctaaaaaaacgaaaccgacaaaacgccgacgcaaactcccgacgcctcaaaaaacgccaaaaccgcgaccgacgacgttcgaatctcgcgccaacgctaaaaacgaaactacgtcgcgaccgccccgaacgccaaccccgccccgacaaaaccctaaccccgttcgctataccccgcccacgcactaactttcgcgaccgatcccttaaatacgtacgacatatttccctacgcg

SEQ ID NO: 26643 - DNA, 673 bp, Artificial Sequence
  chemically treated genomic DNA (Homo sapiens) CpG-island No: 26643
ttaggacgtttcgtagggattgtggttttttagggagtttggttagtttaattgtttcgagcgaatttttttttcgttttttttatatttgaattttcgtcgtttttttttgcgtatcgtttttttagattttttaatagtacgtttttttttttcgttttttttattttttttaagtttcgttttttaattttttttagattataatttttttcgtttgtgaatttttaacgttgtttttttttttgttttcgatttcgtttttattatttttaggtgttttttaaatttttttcgttttacgtttttaggttttatttggtttttaacgtttttttattttttagcgttttatttgtatttttcgtttttttagcgtcgtcgcgtttagttatacgtcgtaggtttttttttcggggtttgttcgttttatggtcgttgaggagacgaagtcggtaggacgtcggcgtaggttttcggcgttttagggaacgttagaatcgcggtcggcgacgttcggatttcgcgttaacgttgggggcggggttacgtcgcgatcgtttcgggcgttagtttcgtttcggtaaggttttggtttcgttcgttgtgtttcgtttacgtattaattttcgcggtcggttttttgagtgcgtgcggtatatttttttgcgcg

SEQ ID NO: 26644 - DNA, 673 bp, Artificial Sequence
  chemically treated genomic DNA (Homo sapiens) CpG-island No: 26644
cgcgcaaaaaaatataccgcacgcactcaaaaaaccgaccgcgaaaattaatacgtaaacgaaacacaacgaacgaaaccaaaaccttaccgaaacgaaactaacgcccgaaacgatcgcgacgtaaccccgcccccaacgttaacgcgaaatccgaacgtcgccgaccgcgattctaacgttccctaaaacgccgaaaacctacgccgacgtcctaccgacttcgtctcctcaacgaccataaaacgaacaaaccccgaaaaaaaaacctacgacgtataactaaacgcgacgacgctaaaaaaacgaaaaatacaaataaaacgctaaaaaataaaaaaacgttaaaaaccaaataaaacctaaaaacgtaaaacgaaaaaaatttaaaaaacacctaaaaataataaaaacgaaatcgaaaacaaaaaaaaaaacaacgttaaaaattcacaaacgaaaaaaattataatctaaaaaaaattaaaaaacgaaacttaaaaaaaataaaaaaaacgaaaaaaaaaaacgtactattaaaaaatctaaaaaaacgatacgcaaaaaaaaacgacgaaaattcaaatataaaaaaaacgaaaaaaaaattcgctcgaaacaattaaactaaccaaactccctaaaaaaccacaatccctacgaaacgtcctaa

SEQ ID NO: 26645 - DNA, 530 bp, Artificial Sequence
  chemically treated genomic DNA (Homo sapiens) CpG-island No: 26645
gattacgttcgagtagtttgcgtatattatattacgtagcgcgagtttagttgcgttttttttcgttatattattttgtgcgaaagagttgagtcgcgagtgtcgaatcgtgttgcgacgtcgcgtcgagcgtcgagtacgggtgcgggataggttttggtatagtggaggagcgacgtgtatgggtgagacgggttttcgtagaatttgtgcgttgacgtggcgttgggagggcgagttgcgattttcgggaacggatatgatttgtgttgggtgaagtcgattacgcgtaggtgtcgcgggttgaaggtatgtggcgcgggcgcggataattatgaagtggttgaatattggggtcggttgtcgagtagtttagacgaagagattcggttcggtcggttttattcgttaagagattggggaggtaggatcgacgtgcgtagggtttgtttagttaagtatagtttgagagcgttttgcgatatttgtaatacgattttggtattcgcgtgaagtaatttaatttattt

SEQ ID NO: 26646 - DNA, 530 bp, Artificial Sequence
  chemically treated genomic DNA (Homo sapiens) CpG-island No: 26646
aaataaattaaattacttcacgcgaataccaaaatcgtattacaaatatcgcaaaacgctctcaaactatacttaactaaacaaaccctacgcacgtcgatcctacctccccaatctcttaacgaataaaaccgaccgaaccgaatctcttcgtctaaactactcgacaaccgaccccaatattcaaccacttcataattatccgcgcccgcgccacataccttcaacccgcgacacctacgcgtaatcgacttcacccaacacaaatcatatccgttcccgaaaatcgcaactcgccctcccaacgccacgtcaacgcacaaattctacgaaaacccgtctcacccatacacgtcgctcctccactataccaaaacctatcccgcacccgtactcgacgctcgacgcgacgtcgcaacacgattcgacactcgcgactcaactctttcgcacaaaataatataacgaaaaaaaacgcaactaaactcgcgctacgtaatataatatacgcaaactactcgaacgtaatc

SEQ ID NO: 26647 - DNA, 530 bp, Artificial Sequence
  chemically treated genomic DNA (Homo sapiens) CpG-island No: 26647
gagtaaattgagttattttacgcgaatattagaatcgtgttgtagatatcgtaaaacgtttttaagttgtgtttggttgggtaagttttgcgtacgtcggttttgtttttttaattttttgacggatggggtcggtcgggtcggattttttcgtttaagttgttcggtaatcgattttagtgtttaattattttatggttattcgcgttcgcgttatatgtttttagttcgcggtatttgcgcgtggtcgattttatttaatatagattatattcgttttcgggggtcgtagttcgtttttttaacgttacgttagcgtataagttttgcgaggattcgttttatttatatacgtcgtttttttattatattaggatttgtttcgtattcgtgttcggcgttcggcgcggcgtcgtagtacggttcggtattcgcggtttagttttttcgtatagagtgatgtgacgaggaggagcgtagttgagttcgcgttgcgtggtgtggtgtgcgtagattgttcggacgtagtt

SEQ ID NO: 26648 - DNA, 530 bp, Artificial Sequence
  chemically treated genomic DNA (Homo sapiens) CpG-island No: 26648
aactacgtccgaacaatctacgcacaccacaccacgcaacgcgaactcaactacgctcctcctcgtcacatcactctatacgaaaaaactaaaccgcgaataccgaaccgtactacgacgccgcgccgaacgccgaacacgaatacgaaacaaatcctaatataataaaaaaacgacgtatataaataaaacgaatcctcgcaaaacttatacgctaacgtaacgttaaaaaaacgaactacgacccccgaaaacgaatataatctatattaaataaaatcgaccacgcgcaaataccgcgaactaaaaacatataacgcgaacgcgaataaccataaaataattaaacactaaaatcgattaccgaacaacttaaacgaaaaaatccgacccgaccgaccccatccgtcaaaaaattaaaaaaacaaaaccgacgtacgcaaaacttacccaaccaaacacaacttaaaaacgttttacgatatctacaacacgattctaatattcgcgtaaaataactcaatttactc

SEQ ID NO: 26649 - DNA, 583 bp, Artificial Sequence
  chemically treated genomic DNA (Homo sapiens) CpG-island No: 26649
ttcgtcgcgtcggacggttttagatacgttcgacgtcgttttcgtcgttttttcgtcgtcgtcgtcgtcgtcgttaggaggtttcgcgcgttttttcggtttttttcgggtcgggtcgggcggcgatagcggcgcggttattgtttcgtagtttttttcgggcgcgtaggagaggtcggtcggtcgggcgcggggagggacggtcgggagtcggtgttcgttaacgtttatcgtcgtcgttcgcgttttttttttggtcgtttttaatttttcggagatagcgttgtagttgttgcgttttaggttgtaaatggcgttcgttcggtttggcgttttcggtttcgttttcggtcgggagacggttgagggtcgtacgttcgtggttcgtattttaacgtcgtcgtcgtcgtcgttcgttattaggttggttgtaggttcggggtagtttcgacgttttttcgttttttcgttttttcgttttttgttcgcgttgcgcgtagcggtaattattttttttttattttttttgttaaggggatttacgggcgttttaagaataataattagattattttaaaattgt

SEQ ID NO: 26650 - DNA, 583 bp, Artificial Sequence
  chemically treated genomic DNA (Homo sapiens) CpG-island No: 26650
acaattttaaaataatctaattattattcttaaaacgcccgtaaatccccttaacaaaaaaaataaaaaaaaaataattaccgctacgcgcaacgcgaacaaaaaacgaaaaaacgaaaaaacgaaaaaacgtcgaaactaccccgaacctacaaccaacctaataacgaacgacgacgacgacgacgttaaaatacgaaccacgaacgtacgaccctcaaccgtctcccgaccgaaaacgaaaccgaaaacgccaaaccgaacgaacgccatttacaacctaaaacgcaacaactacaacgctatctccgaaaaattaaaaacgaccaaaaaaaaaacgcgaacgacgacgataaacgttaacgaacaccgactcccgaccgtccctccccgcgcccgaccgaccgacctctcctacgcgcccgaaaaaaactacgaaacaataaccgcgccgctatcgccgcccgacccgacccgaaaaaaaccgaaaaaacgcgcgaaacctcctaacgacgacgacgacgacgacgaaaaaacgacgaaaacgacgtcgaacgtatctaaaaccgtccgacgcgacgaa

SEQ ID NO: 26651 - DNA, 583 bp, Artificial Sequence
  chemically treated genomic DNA (Homo sapiens) CpG-island No: 26651
ataattttaaaataatttaattattgtttttgggacgttcgtaggtttttttggtaggaggggtggagggggaatgattgtcgttgcgcgtagcgcgggtagagggcgagagggcgagagggcgggagggcgtcggggttgtttcggatttgtaattagtttggtagcgggcggcggcggcggcggcgttgggatgcgggttacgggcgtgcggtttttagtcgtttttcggtcgagagcgaggtcggaggcgttaagtcgagcgggcgttatttgtagtttggggcgtagtagttgtagcgttgttttcgaggggttgggaacggttaaggaggaggcgcgggcggcggcggtgggcgttggcgggtatcggttttcggtcgttttttttcgcgttcggtcggtcggttttttttgcgcgttcggaaggggttgcggaataatggtcgcgtcgttgtcgtcgttcggttcggttcggggaaagtcgggaaggcgcgcggagttttttggcggcggcggcggcggcggcgggaaggcggcggggacggcgtcgggcgtgtttggagtcgttcggcgcggcgga

SEQ ID NO: 26652 - DNA, 583 bp, Artificial Sequence
  chemically treated genomic DNA (Homo sapiens) CpG-island No: 26652
tccgccgcgccgaacgactccaaacacgcccgacgccgtccccgccgccttcccgccgccgccgccgccgccgccaaaaaactccgcgcgccttcccgactttccccgaaccgaaccgaacgacgacaacgacgcgaccattattccgcaaccccttccgaacgcgcaaaaaaaaccgaccgaccgaacgcgaaaaaaaacgaccgaaaaccgatacccgccaacgcccaccgccgccgcccgcgcctcctccttaaccgttcccaacccctcgaaaacaacgctacaactactacgccccaaactacaaataacgcccgctcgacttaacgcctccgacctcgctctcgaccgaaaaacgactaaaaaccgcacgcccgtaacccgcatcccaacgccgccgccgccgccgcccgctaccaaactaattacaaatccgaaacaaccccgacgccctcccgccctctcgccctctcgccctctacccgcgctacgcgcaacgacaatcattccccctccacccctcctaccaaaaaaacctacgaacgtcccaaaaacaataattaaattattttaaaattat

SEQ ID NO: 26653 - DNA, 720 bp, Artificial Sequence
  chemically treated genomic DNA (Homo sapiens) CpG-island No: 26653
acgagacggtttttttgagttttaaacgtttgttttcgtataaggagtgtaaggagaagttcggtaagtttaataagaggcgcggttttagcgcggggttgtgggaaatcgagaataattttacggtttaggttttcgattgtttattagttttagagaagggtagcggagacgggttttggtcggagttcgaggtcgtagagggcgacgaggataagtcgatttacgttggtggcggcggcgacgaattggggaagtcggacgacgataagtttattgaggaggagaaggggtcgttgaagaggagcgcgggggattcgtcggaggacgtttttaaacgatttaaggaggtagttttcgattaagaggaggaggcggaggcggagagggcggcggaagcggagagggcggcggcggcggcggcggcgacggtcgtcgacgaggagagttcgtttttcgtggcggtggagaacggtagcgtttttagcgagtcgggtttggtttgcgagtcgttttagttagaggaggaggagtttcgggaggaagaagtcgcggacgaggaggttttttaggagtggtatgtcgaggtatcgggcggcggagatcgcgatagtttgtagttattagcgtttttagaagagtttttgtttcgtttttgttgcggtttggtcgtttttggggaatttgattacggcgtgtaaattgggattgttttttttt

SEQ ID NO: 26654 - DNA, 720 bp, Artificial Sequence
  chemically treated genomic DNA (Homo sapiens) CpG-island No: 26654
aaaaaaaaacaatcccaatttacacgccgtaatcaaattccccaaaaacgaccaaaccgcaacaaaaacgaaacaaaaactcttctaaaaacgctaataactacaaactatcgcgatctccgccgcccgatacctcgacataccactcctaaaaaacctcctcgtccgcgacttcttcctcccgaaactcctcctcctctaactaaaacgactcgcaaaccaaacccgactcgctaaaaacgctaccgttctccaccgccacgaaaaacgaactctcctcgtcgacgaccgtcgccgccgccgccgccgccgccctctccgcttccgccgccctctccgcctccgcctcctcctcttaatcgaaaactacctccttaaatcgtttaaaaacgtcctccgacgaatcccccgcgctcctcttcaacgaccccttctcctcctcaataaacttatcgtcgtccgacttccccaattcgtcgccgccgccaccaacgtaaatcgacttatcctcgtcgccctctacgacctcgaactccgaccaaaacccgtctccgctacccttctctaaaactaataaacaatcgaaaacctaaaccgtaaaattattctcgatttcccacaaccccgcgctaaaaccgcgcctcttattaaacttaccgaacttctccttacactccttatacgaaaacaaacgtttaaaactcaaaaaaaccgtctcgt

SEQ ID NO: 26655 - DNA, 720 bp, Artificial Sequence
  chemically treated genomic DNA (Homo sapiens) CpG-island No: 26655
agggaaaggtagttttagtttgtacgtcgtggttagattttttaagaacggttaggtcgtagtaggaacggggtaggggtttttttggaaacgttggtaattataggttgtcgcgattttcgtcgttcggtgtttcggtatgttatttttgggaggttttttcgttcgcgatttttttttttcggagtttttttttttttggttgaggcggttcgtagattaggttcggttcgttaggggcgttgtcgttttttatcgttacgaggaacggatttttttcgtcgacggtcgtcgtcgtcgtcgtcgtcgtcgtttttttcgttttcgtcgtttttttcgttttcgttttttttttttggtcgggggttgtttttttgggtcgtttgggggcgtttttcggcgggtttttcgcgtttttttttagcggtttttttttttttttagtgggtttgtcgtcgttcggtttttttaattcgtcgtcgtcgttattagcgtgggtcggtttgttttcgtcgttttttgcggtttcgggtttcggttaaggttcgttttcgttgtttttttttgaggttaatgggtagtcggaggtttggatcgtggggttgttttcgattttttatagtttcgcgttgaagtcgcgttttttgttgggtttgtcgaatttttttttgtattttttgtacgggaataggcgtttgggatttaggaaggtcgtttcgt

SEQ ID NO: 26656 - DNA, 720 bp, Artificial Sequence
  chemically treated genomic DNA (Homo sapiens) CpG-island No: 26656
acgaaacgaccttcctaaatcccaaacgcctattcccgtacaaaaaatacaaaaaaaaattcgacaaacccaacaaaaaacgcgacttcaacgcgaaactataaaaaatcgaaaacaaccccacgatccaaacctccgactacccattaacctcaaaaaaaaacaacgaaaacgaaccttaaccgaaacccgaaaccgcaaaaaacgacgaaaacaaaccgacccacgctaataacgacgacgacgaattaaaaaaaccgaacgacgacaaacccactaaaaaaaaaaaaaaaccgctaaaaaaaaacgcgaaaaacccgccgaaaaacgcccccaaacgacccaaaaaaacaacccccgaccaaaaaaaaaaaacgaaaacgaaaaaaacgacgaaaacgaaaaaaacgacgacgacgacgacgacgacgaccgtcgacgaaaaaaatccgttcctcgtaacgataaaaaacgacaacgcccctaacgaaccgaacctaatctacgaaccgcctcaaccaaaaaaaaaaaaactccgaaaaaaaaaaatcgcgaacgaaaaaacctcccaaaaataacataccgaaacaccgaacgacgaaaatcgcgacaacctataattaccaacgtttccaaaaaaacccctaccccgttcctactacgacctaaccgttcttaaaaaatctaaccacgacgtacaaactaaaactacctttccct

SEQ ID NO: 26657 - DNA, 1047 bp, Artificial Sequence
  chemically treated genomic DNA (Homo sapiens) CpG-island No: 26657
attcgtcggttgcgtttcgtttaggttggtcggggtcggtgtgatcgtgtgatttcgtgtatattgcgttcgggttttcgtgaatgatagtagtttgtaatttttagtcggagagtagcggtggttatcgtcgggcggaaagggttataagttagaatgtaaagcgatttcgtttcgggtgtgggggatttcgggttttcggttattttcgaggtcgggcgtgttttgttcgttttttttcgttttgggcgtcggggcgattttattttgcgttttaagttgggggttttttatgttcgtcgtcgtcgagtttttcgtcgtcgaggcgttggtcgcggttttcgggttcgggtcggggtcgtcgtcgtcgtttagtttcgttagttttcggttggtggtcgtgagttcggttcgtaggttggttattttttggttggtcgattggatcgttttatcgatgcggagcgcgagttgtttattgttttttattatgtttaggattttggtttgggggcgagagaggtgataaagagttgtatgatgcgcggggggcgcgcggtcgggtattttcggttttatttgttgtgtttttcgcggttcggtttcgttcgcgtttcgatttttaggtatcggtagcgtcggttttttcggtataggaatgatagcggcgtttttagttttagtcgcggcggtggcgaggcggcggggggaggaggcggaggagaaaaaagaggaggagaaggaggaggaggagtagcgatcgtcgagatttcggcgggcgggcgtcgagagttgttttaagaaggatatcgcgcgttattaggtattttttaaatggagtttattattcgtcgtcggttcgggagggggtttcggtcggaggttgggggtatttttggtttttcgcgttttcgtatttcggagatatatttttcgggggggcggaggcggcggacggtagtcgggagggggttaaggtggcgtttttggcgaggggtaggggtcgtttggatcgaggtcggttttttgtttttttttttgagcggt

SEQ ID NO: 26658 - DNA, 1047 bp, Artificial Sequence
  chemically treated genomic DNA (Homo sapiens) CpG-island No: 26658
accgctcaaaaaaaaaaacaaaaaaccgacctcgatccaaacgacccctacccctcgccaaaaacgccaccttaaccccctcccgactaccgtccgccgcctccgcccccccgaaaaatatatctccgaaatacgaaaacgcgaaaaaccaaaaatacccccaacctccgaccgaaaccccctcccgaaccgacgacgaataataaactccatttaaaaaatacctaataacgcgcgatatccttcttaaaacaactctcgacgcccgcccgccgaaatctcgacgatcgctactcctcctcctccttctcctcctcttttttctcctccgcctcctccccccgccgcctcgccaccgccgcgactaaaactaaaaacgccgctatcattcctataccgaaaaaaccgacgctaccgatacctaaaaatcgaaacgcgaacgaaaccgaaccgcgaaaaacacaacaaataaaaccgaaaatacccgaccgcgcgccccccgcgcatcatacaactctttatcacctctctcgcccccaaaccaaaatcctaaacataataaaaaacaataaacaactcgcgctccgcatcgataaaacgatccaatcgaccaaccaaaaaataaccaacctacgaaccgaactcacgaccaccaaccgaaaactaacgaaactaaacgacgacgacgaccccgacccgaacccgaaaaccgcgaccaacgcctcgacgacgaaaaactcgacgacgacgaacataaaaaacccccaacttaaaacgcaaaataaaatcgccccgacgcccaaaacgaaaaaaaacgaacaaaacacgcccgacctcgaaaataaccgaaaacccgaaatcccccacacccgaaacgaaatcgctttacattctaacttataaccctttccgcccgacgataaccaccgctactctccgactaaaaattacaaactactatcattcacgaaaacccgaacgcaatatacacgaaatcacacgatcacaccgaccccgaccaacctaaacgaaacgcaaccgacgaat

SEQ ID NO: 26659 - DNA, 1047 bp, Artificial Sequence
  chemically treated genomic DNA (Homo sapiens) CpG-island No: 26659
atcgtttaagggaggggatagagggtcggtttcggtttaggcgatttttgtttttcgttaggggcgttattttggttttttttcgattgtcgttcgtcgttttcgttttttcggggggtgtgttttcgaagtacgggggcgcgggaggttaagggtgtttttagttttcgatcgagattttttttcgagtcggcggcgaatggtaggttttatttaaagagtgtttggtggcgcgcggtgttttttttggagtagttttcggcgttcgttcgtcggggtttcggcgatcgttgttttttttttttttttttttttttttttttttttttcgtttttttttttcgtcgtttcgttatcgtcgcggttagggttggaggcgtcgttgttatttttgtgtcggaggaatcggcgttgtcggtgtttgggggtcggggcgcgggcgaagtcgggtcgcggaggatataataggtagagtcgggggtgttcggtcgcgcgtttttcgcgtattatgtagttttttgttatttttttcgtttttaggttaaaattttgagtatgatggaagataataagtagttcgcgtttcgtatcgatggggcggtttagtcggttagttaggaggtgattaatttgcgagtcgaatttacggttattaatcggagattggcggaattgagcggcggcggcggtttcggttcgggttcgggagtcgcggttagcgtttcggcggcgggggattcggcggcgacgaatatggagaatttttagtttggagcgtaaggtaggatcgtttcggcgtttagggcggaggaaggcgagtagagtacgttcggtttcggaggtggtcggggattcggggttttttatattcggggcgaaatcgttttgtattttggtttgtaatttttttcgttcggcggtggttatcgttgtttttcggttgggagttgtaggttgttgttatttacgaaaattcgagcgtagtgtgtacggggttatacggttatatcggtttcggttagtttgagcgaggcgtagtcggcgggt

SEQ ID NO: 26660 - DNA, 1047 bp, Artificial Sequence
  chemically treated genomic DNA (Homo sapiens) CpG-island No: 26660
acccgccgactacgcctcgctcaaactaaccgaaaccgatataaccgtataaccccgtacacactacgctcgaattttcgtaaataacaacaacctacaactcccaaccgaaaaacaacgataaccaccgccgaacgaaaaaaattacaaaccaaaatacaaaacgatttcgccccgaatataaaaaaccccgaatccccgaccacctccgaaaccgaacgtactctactcgccttcctccgccctaaacgccgaaacgatcctaccttacgctccaaactaaaaattctccatattcgtcgccgccgaatcccccgccgccgaaacgctaaccgcgactcccgaacccgaaccgaaaccgccgccgccgctcaattccgccaatctccgattaataaccgtaaattcgactcgcaaattaatcacctcctaactaaccgactaaaccgccccatcgatacgaaacgcgaactacttattatcttccatcatactcaaaattttaacctaaaaacgaaaaaaataacaaaaaactacataatacgcgaaaaacgcgcgaccgaacacccccgactctacctattatatcctccgcgacccgacttcgcccgcgccccgacccccaaacaccgacaacgccgattcctccgacacaaaaataacaacgacgcctccaaccctaaccgcgacgataacgaaacgacgaaaaaaaaaaacgaaaaaaaaaaaaaaaaaaaaaaaaaaaaaaaaaaaacaacgatcgccgaaaccccgacgaacgaacgccgaaaactactccaaaaaaaacaccgcgcgccaccaaacactctttaaataaaacctaccattcgccgccgactcgaaaaaaaatctcgatcgaaaactaaaaacacccttaacctcccgcgcccccgtacttcgaaaacacaccccccgaaaaaacgaaaacgacgaacgacaatcgaaaaaaaaccaaaataacgcccctaacgaaaaacaaaaatcgcctaaaccgaaaccgaccctctatcccctcccttaaacgat

SEQ ID NO: 26661 - DNA, 841 bp, Artificial Sequence
  chemically treated genomic DNA (Homo sapiens) CpG-island No: 26661
gcgtttttcggttttatttcgttttgtttattttcgtttttgtttttttaggttatcgtgtatacgcggggattcgtcgtgtcgtttattgacgcgtttttttttcgttcgtagggacgtattaaggttagtttattaacggtatgcgttatggttacggagtacgttagagcgtgttttacgggatggtcgtggtggtgcgttcgtcgttgcgtacgtcgttgtcgtttttgcgtagcgagtatagtaacggtacggtggtttcggattttttcgtttcgtcggttttcgacggtttcgcgttgttttcgttcgttatttcgcgtggcggtttcgcgtttagttttttggttaatgtcgaggcggtcgcgcgggcgtttaagggcggcggttttttttagcggggcgcgttgttgggtaagttgcggcgcgtagagtcgcgtacgttcgtgggtagttagcgtagtcgtgttagtttttttaagagcgattttagttcgggcgttagcgacgtcgcgtttatcgttagtttgggagaggtcgtcgagggcgtcgacgaggtcgtatttttcgaggtcgatatcgacgttattattatcgagatttatatgggcgagtggaagaacgataaacgttcgggtttcggcgtgagcgaacgttttagtggttttcgttacgagggcgagtggttggataatttgcgttacggttatggttgtattacgttgttcgacggttatcgcgaggagggtaagtatcgttataacgtgttggttaaggatattaagcgtcgtatgttgtagtttaagagtaataaggttcgttagaaagtggagtatag

SEQ ID NO: 26662 - DNA, 841 bp, Artificial Sequence
  chemically treated genomic DNA (Homo sapiens) CpG-island No: 26662
ctatactccactttctaacgaaccttattactcttaaactacaacatacgacgcttaatatccttaaccaacacgttataacgatacttaccctcctcgcgataaccgtcgaacaacgtaatacaaccataaccgtaacgcaaattatccaaccactcgccctcgtaacgaaaaccactaaaacgttcgctcacgccgaaacccgaacgtttatcgttcttccactcgcccatataaatctcgataataataacgtcgatatcgacctcgaaaaatacgacctcgtcgacgccctcgacgacctctcccaaactaacgataaacgcgacgtcgctaacgcccgaactaaaatcgctcttaaaaaaactaacacgactacgctaactacccacgaacgtacgcgactctacgcgccgcaacttacccaacaacgcgccccgctaaaaaaaaccgccgcccttaaacgcccgcgcgaccgcctcgacattaaccaaaaaactaaacgcgaaaccgccacgcgaaataacgaacgaaaacaacgcgaaaccgtcgaaaaccgacgaaacgaaaaaatccgaaaccaccgtaccgttactatactcgctacgcaaaaacgacaacgacgtacgcaacgacgaacgcaccaccacgaccatcccgtaaaacacgctctaacgtactccgtaaccataacgcataccgttaataaactaaccttaatacgtccctacgaacgaaaaaaaaacgcgtcaataaacgacacgacgaatccccgcgtatacacgataacctaaaaaaacaaaaacgaaaataaacaaaacgaaataaaaccgaaaaacgc

SEQ ID NO: 26663 - DNA, 841 bp, Artificial Sequence
  chemically treated genomic DNA (Homo sapiens) CpG-island No: 26663
ttgtgttttattttttggcggattttgttgtttttgagttgtagtatgcggcgtttggtgtttttgattagtacgttgtggcggtatttgtttttttcgcggtggtcgtcgggtagcgtggtgtagttatagtcgtggcgtaggttgtttagttattcgttttcgtagcggaggttattggagcgttcgtttacgtcgaagttcgagcgtttgtcgtttttttattcgtttatgtaggtttcggtggtggtggcgtcgatatcggtttcgaagggtgcggtttcgtcggcgttttcggcggttttttttaggttggcggtggacgcggcgtcgttggcgttcgagttgaggtcgtttttaaggaagttgatacggttgcgttggttatttacggacgtgcgcgattttgcgcgtcgtagtttgtttagtagcgcgtttcgttggaagaggtcgtcgtttttgggcgttcgcgcggtcgtttcggtattggttaggaggttgagcgcgaagtcgttacgcgggatggcgggcgagggtagcgcggggtcgtcggaggtcggcgaggcgggagagttcggggttatcgtgtcgttgttgtgttcgttgcgtagggacgatagcgacgtgcgtagcggcgagcgtattattacggttatttcgtagggtacgttttggcgtatttcgtagttatggcgtatgtcgttggtgaattggttttggtacgtttttgcgggcgaggagagggcgcgttagtaggcggtacgacgggttttcgcgtgtgtacggtggtttgggagggtaagggcgggagtgggtaaggcggggtgggatcgagaggcgt

SEQ ID NO: 26664 - DNA, 841 bp, Artificial Sequence
  chemically treated genomic DNA (Homo sapiens) CpG-island No: 26664
acgcctctcgatcccaccccgccttacccactcccgcccttaccctcccaaaccaccgtacacacgcgaaaacccgtcgtaccgcctactaacgcgccctctcctcgcccgcaaaaacgtaccaaaaccaattcaccaacgacatacgccataactacgaaatacgccaaaacgtaccctacgaaataaccgtaataatacgctcgccgctacgcacgtcgctatcgtccctacgcaacgaacacaacaacgacacgataaccccgaactctcccgcctcgccgacctccgacgaccccgcgctaccctcgcccgccatcccgcgtaacgacttcgcgctcaacctcctaaccaataccgaaacgaccgcgcgaacgcccaaaaacgacgacctcttccaacgaaacgcgctactaaacaaactacgacgcgcaaaatcgcgcacgtccgtaaataaccaacgcaaccgtatcaacttccttaaaaacgacctcaactcgaacgccaacgacgccgcgtccaccgccaacctaaaaaaaaccgccgaaaacgccgacgaaaccgcacccttcgaaaccgatatcgacgccaccaccaccgaaacctacataaacgaataaaaaaacgacaaacgctcgaacttcgacgtaaacgaacgctccaataacctccgctacgaaaacgaataactaaacaacctacgccacgactataactacaccacgctacccgacgaccaccgcgaaaaaaacaaataccgccacaacgtactaatcaaaaacaccaaacgccgcatactacaactcaaaaacaacaaaatccgccaaaaaataaaacacaa

SEQ ID NO: 26665 - DNA, 559 bp, Artificial Sequence
  chemically treated genomic DNA (Homo sapiens) CpG-island No: 26665
ggggcgtcggcgtagcgggttttttatagtcgtttcgcgagagttcgtagttgtacgagcgtgagatttttcggttcgagggtggtttttcgttatcggtcgggacgttttcgtagtttaagcggtttaggttcggggtgtttaaggacggtttgttgagtttaggcgtttggaacggcgagtttagcggtgagggtagtcggttagttatttcgttcgagggcgcgggtcgtcgtagtttcgcgcgtttagttatcgagcgtatggttatcgaggttttgtaggtatcgtttgcgtcgtcgcgggagtcggaggtggcgttttattagggttattatagttatgttgtgcgtattacgtcgttcgagtttttattttttgaggattagttcgagttcgaggttttcgggttcgagttcgcgttttcgttttcggttatcgtttcgttgtaggtttttacgtttcgaggtttcgagtttgtacgcgagattttcgttaagttggagtttaagtttattatttttaaagtcgagtttagggttaaggttcgtaagattga

SEQ ID NO: 26666 - DNA, 559 bp, Artificial Sequence
  chemically treated genomic DNA (Homo sapiens) CpG-island No: 26666
tcaatcttacgaaccttaaccctaaactcgactttaaaaataataaacttaaactccaacttaacgaaaatctcgcgtacaaactcgaaacctcgaaacgtaaaaacctacaacgaaacgataaccgaaaacgaaaacgcgaactcgaacccgaaaacctcgaactcgaactaatcctcaaaaaataaaaactcgaacgacgtaatacgcacaacataactataataaccctaataaaacgccacctccgactcccgcgacgacgcaaacgatacctacaaaacctcgataaccatacgctcgataactaaacgcgcgaaactacgacgacccgcgccctcgaacgaaataactaaccgactaccctcaccgctaaactcgccgttccaaacgcctaaactcaacaaaccgtccttaaacaccccgaacctaaaccgcttaaactacgaaaacgtcccgaccgataacgaaaaaccaccctcgaaccgaaaaatctcacgctcgtacaactacgaactctcgcgaaacgactataaaaaacccgctacgccgacgcccc

SEQ ID NO: 26667 - DNA, 559 bp, Artificial Sequence
  chemically treated genomic DNA (Homo sapiens) CpG-island No: 26667
ttagttttgcgggttttggttttgggttcggttttggggatgatgggtttgggttttagtttggcgggggtttcgcgtgtaggttcggggtttcggagcgtgggggtttgtagcggggcggtggtcggggacgagggcgcggattcggattcggagatttcgggttcgggttggtttttaaagggtgggggttcgggcggcgtggtgcgtatagtatagttgtggtagttttggtaaagcgttattttcggttttcgcgacggcgtaggcggtgtttgtagagtttcgatggttatgcgttcggtggttggacgcgcggggttgcggcggttcgcgttttcggacggagtgattgatcggttgtttttatcgttgggttcgtcgttttaggcgtttgggtttagtaggtcgtttttggatatttcgggtttgggtcgtttgggttgcgggggcgtttcggtcggtgacggggagttattttcgggtcgaggggttttacgttcgtgtagttgcgggttttcgcggggcggttgtgggaggttcgttgcgtcggcgtttt

SEQ ID NO: 26668 - DNA, 559 bp, Artificial Sequence
  chemically treated genomic DNA (Homo sapiens) CpG-island No: 26668
aaaacgccgacgcaacgaacctcccacaaccgccccgcgaaaacccgcaactacacgaacgtaaaacccctcgacccgaaaataactccccgtcaccgaccgaaacgcccccgcaacccaaacgacccaaacccgaaatatccaaaaacgacctactaaacccaaacgcctaaaacgacgaacccaacgataaaaacaaccgatcaatcactccgtccgaaaacgcgaaccgccgcaaccccgcgcgtccaaccaccgaacgcataaccatcgaaactctacaaacaccgcctacgccgtcgcgaaaaccgaaaataacgctttaccaaaactaccacaactatactatacgcaccacgccgcccgaacccccaccctttaaaaaccaacccgaacccgaaatctccgaatccgaatccgcgccctcgtccccgaccaccgccccgctacaaacccccacgctccgaaaccccgaacctacacgcgaaacccccgccaaactaaaacccaaacccatcatccccaaaaccgaacccaaaaccaaaacccgcaaaactaa

SEQ ID NO: 26669 - DNA, 667 bp, Artificial Sequence
  chemically treated genomic DNA (Homo sapiens) CpG-island No: 26669
gagatggtttttgagagtttttcggggttgtcgcgtatattcgtttgttgtagggaaattagaaagtaggcggggagcggagcgacgaataaggtcggagaggaggttataaattttttttttttttacgcgtacgttaaaaatttattaggcgataatttggcgggtcgggatggagacgagatagtggaaaatcgtttcgtttttaaaattttcgcggtgaagtgatgaagtgggaatagagttggtttcgtcgtttttggcgcggttggggtttcgaatttttttcgatttgggaaacgttggtcgcggaagcgtgggttaggttagtcgcgggagttcgttttggttttttatttttttttttttatatttaagcgtaaatgtggaaagtcgagcgttttagaaaagttacgtaaaacgggaggtcggtgtattttagtggggttgtcgcgcgttcgttatttcggttattgggggttcgtattttcgggtttgtcgcggttatttttaggaagtcggaaattaaagatggttggaggttaggtttcgaaaggttagggcgaagatcggtaggcggcgtagttcgggtagaaaaggcgaaatttagaaaagaaaaaaattttaaagggaaatattgagttttttttttttatttttttgggtt

SEQ ID NO: 26670 - DNA, 667 bp, Artificial Sequence
  chemically treated genomic DNA (Homo sapiens) CpG-island No: 26670
aacccaaaaaaataaaaaaaaaaaactcaatatttccctttaaaatttttttcttttctaaatttcgccttttctacccgaactacgccgcctaccgatcttcgccctaacctttcgaaacctaacctccaaccatctttaatttccgacttcctaaaaataaccgcgacaaacccgaaaatacgaacccccaataaccgaaataacgaacgcgcgacaaccccactaaaatacaccgacctcccgttttacgtaacttttctaaaacgctcgactttccacatttacgcttaaatataaaaaaaaaaaaataaaaaaccaaaacgaactcccgcgactaacctaacccacgcttccgcgaccaacgtttcccaaatcgaaaaaaattcgaaaccccaaccgcgccaaaaacgacgaaaccaactctattcccacttcatcacttcaccgcgaaaattttaaaaacgaaacgattttccactatctcgtctccatcccgacccgccaaattatcgcctaataaatttttaacgtacgcgtaaaaaaaaaaaaaatttataacctcctctccgaccttattcgtcgctccgctccccgcctactttctaatttccctacaacaaacgaatatacgcgacaaccccgaaaaactctcaaaaaccatctc

SEQ ID NO: 26671 - DNA, 667 bp, Artificial Sequence
  chemically treated genomic DNA (Homo sapiens) CpG-island No: 26671
ggtttagagaggtgggggaggagggtttaatgtttttttttaaaattttttttttttttggatttcgttttttttgttcgggttgcgtcgtttgtcgattttcgttttaatttttcggggtttgatttttagttatttttgattttcgattttttaaaaataatcgcggtaagttcgagggtgcgagtttttagtggtcggggtggcgggcgcgcggtagttttattggggtgtatcggtttttcgttttgcgtggtttttttggagcgttcggttttttatatttgcgtttgggtgtgaaaggggagaggtggggggttagagcgaattttcgcggttgatttggtttacgttttcgcggttagcgttttttagatcgaggggagttcgggattttagtcgcgttaggaacggcggggttaattttgtttttattttattattttatcgcggaggttttaggagcgaggcggttttttattatttcgtttttatttcggttcgttaaattgtcgtttgataagtttttagcgtgcgcgtggggggaggggggatttgtagtttttttttcggttttgttcgtcgtttcgtttttcgtttgttttttaatttttttgtagtagacgggtgtgcgcggtaatttcggaggatttttagagattatttt

SEQ ID NO: 26672 - DNA, 667 bp, Artificial Sequence
  chemically treated genomic DNA (Homo sapiens) CpG-island No: 26672
aaaataatctctaaaaatcctccgaaattaccgcgcacacccgtctactacaaaaaaattaaaaaacaaacgaaaaacgaaacgacgaacaaaaccgaaaaaaaaactacaaatcccccctccccccacgcgcacgctaaaaacttatcaaacgacaatttaacgaaccgaaataaaaacgaaataataaaaaaccgcctcgctcctaaaacctccgcgataaaataataaaataaaaacaaaattaaccccgccgttcctaacgcgactaaaatcccgaactcccctcgatctaaaaaacgctaaccgcgaaaacgtaaaccaaatcaaccgcgaaaattcgctctaaccccccacctctcccctttcacacccaaacgcaaatataaaaaaccgaacgctccaaaaaaaccacgcaaaacgaaaaaccgatacaccccaataaaactaccgcgcgcccgccaccccgaccactaaaaactcgcaccctcgaacttaccgcgattatttttaaaaaatcgaaaatcaaaaataactaaaaatcaaaccccgaaaaattaaaacgaaaatcgacaaacgacgcaacccgaacaaaaaaaacgaaatccaaaaaaaaaaaaaattttaaaaaaaaacattaaaccctcctcccccacctctctaaacc

SEQ ID NO: 26673 - DNA, 716 bp, Artificial Sequence
  chemically treated genomic DNA (Homo sapiens) CpG-island No: 26673
ttcgtcgcggcgattattcggatttatcgcgggcgttacgtcgtcgtcgggtttgcgcgtttcgaggcggagttaggattaggatattcgttagcgtagggtagtttttagttttcgtcgttagttcgcggtttttgtcgcgatttcgtttattgcgggttttttcgttcgttttcgcggtcgggaggtttggatttattttcgggataaggtgattcggtaagtgcgtttaagcggtcgttcgcgattttttcgagcgagcgagcgtgcggggcggtgcggcgttcgtttttgttttttcgttgttaggttttttttttttttgttttttttttagcgtcgttttgttttttacgttttttttcgttttgcgtttttcgtttgcgttttcggttgtttcgagcgtcgggcgcggggtagcggcggtagttcgagcggcggggagtcgggagttgcggcgtcggggcggagtttaattttttcggttttcgggagaggaaggggtgcggggagattttcgtcgcgttcgtttggtcggtaggttgggcgaggggcgttttggggcgagtcgttttttttcgtttgtcgagtttgtcgacgcgcgtgttggaggtagcgggcgcgggtttcgggggaggagggtagggaagagaaggagggcgtagttcgcgcgaaggtggttattaattttggtttagattagggaggttttagcg

SEQ ID NO: 26674 - DNA, 716 bp, Artificial Sequence
  chemically treated genomic DNA (Homo sapiens) CpG-island No: 26674
cgctaaaacctccctaatctaaaccaaaattaataaccaccttcgcgcgaactacgccctccttctcttccctaccctcctcccccgaaacccgcgcccgctacctccaacacgcgcgtcgacaaactcgacaaacgaaaaaaaacgactcgccccaaaacgcccctcgcccaacctaccgaccaaacgaacgcgacgaaaatctccccgcaccccttcctctcccgaaaaccgaaaaaattaaactccgccccgacgccgcaactcccgactccccgccgctcgaactaccgccgctaccccgcgcccgacgctcgaaacaaccgaaaacgcaaacgaaaaacgcaaaacgaaaaaaaacgtaaaaaacaaaacgacgctaaaaaaaaaacaaaaaaaaaaaaaacctaacaacgaaaaaacaaaaacgaacgccgcaccgccccgcacgctcgctcgctcgaaaaaatcgcgaacgaccgcttaaacgcacttaccgaatcaccttatcccgaaaataaatccaaacctcccgaccgcgaaaacgaacgaaaaaacccgcaataaacgaaatcgcgacaaaaaccgcgaactaacgacgaaaactaaaaactaccctacgctaacgaatatcctaatcctaactccgcctcgaaacgcgcaaacccgacgacgacgtaacgcccgcgataaatccgaataatcgccgcgacgaa

SEQ ID NO: 26675 - DNA, 716 bp, Artificial Sequence
  chemically treated genomic DNA (Homo sapiens) CpG-island No: 26675
cgttagggtttttttggtttgggttaaagttggtggttattttcgcgcgggttgcgtttttttttttttttttgtttttttttttcggggttcgcgttcgttgtttttagtacgcgcgtcggtaggttcggtaagcgaagaggagcggttcgttttagggcgtttttcgtttagtttgtcggttaggcgagcgcgacgagagttttttcgtatttttttttttttcgggggtcgagagggttgggtttcgtttcggcgtcgtagttttcgatttttcgtcgttcgggttgtcgtcgttgtttcgcgttcggcgttcggggtagtcgggggcgtaggcggagagcgtagggcggggagaggcgtggggagtagagcggcgttgaggggagggtagaggaggagagagtttggtagcggaggagtagaggcgggcgtcgtatcgtttcgtacgttcgttcgttcgggagagtcgcgggcggtcgtttgggcgtatttgtcgggttattttgtttcggaggtaagtttagatttttcggtcgcgggggcgggcggaggggttcgtagtgggcggggtcgcggtaggggtcgcgagttggcggcgggagttggaggttgttttgcgttggcgggtgttttagttttggtttcgtttcggagcgcgtagattcggcggcggcgtggcgttcgcggtaagttcgggtggtcgtcgcgacgag

SEQ ID NO: 26676 - DNA, 716 bp, Artificial Sequence
  chemically treated genomic DNA (Homo sapiens) CpG-island No: 26676
ctcgtcgcgacgaccacccgaacttaccgcgaacgccacgccgccgccgaatctacgcgctccgaaacgaaaccaaaactaaaacacccgccaacgcaaaacaacctccaactcccgccgccaactcgcgacccctaccgcgaccccgcccactacgaacccctccgcccgcccccgcgaccgaaaaatctaaacttacctccgaaacaaaataacccgacaaatacgcccaaacgaccgcccgcgactctcccgaacgaacgaacgtacgaaacgatacgacgcccgcctctactcctccgctaccaaactctctcctcctctaccctcccctcaacgccgctctactccccacgcctctccccgccctacgctctccgcctacgcccccgactaccccgaacgccgaacgcgaaacaacgacgacaacccgaacgacgaaaaatcgaaaactacgacgccgaaacgaaacccaaccctctcgacccccgaaaaaaaaaaaaatacgaaaaaactctcgtcgcgctcgcctaaccgacaaactaaacgaaaaacgccctaaaacgaaccgctcctcttcgcttaccgaacctaccgacgcgcgtactaaaaacaacgaacgcgaaccccgaaaaaaaaaaacaaaaaaaaaaaaaaaaacgcaacccgcgcgaaaataaccaccaactttaacccaaaccaaaaaaaccctaacg

SEQ ID NO: 26677 - DNA, 548 bp, Artificial Sequence
  chemically treated genomic DNA (Homo sapiens) CpG-island No: 26677
tggtaaatggtcgtttagttttcggatttgtcgatttgttcgaattttttttttatttttatgacgggttagggcggttgttgcgtttttttttcggtttattgcgtcgtttgtcgttttaggtcgcgtcgcgtttttagtttcgaggttcgttgtaattttcgatttttgtagttatcgtcgttttagtcgttgttgtttttttatgttaatcggtagtcggaattacgtattacgtttgttaggggtttcgtttttgaagtagaaggattaattagcgatcgagaatttcgataagtattttcgcggggaggagtcgggggcggtgttaggggaagtggttttagtatcgcgagatatttaatagcgcgcgttttttttttcgttttggggttttgggttcgggcgcggcgcgcgtttgttgtttaggcgatttcgggagtttcgtttacggcgcgtgggttttttaggttcgggagggtattgagttttagtttcgattcggttcgttgagttatagagtgagtggttttaaagtagttatgtat

SEQ ID NO: 26678 - DNA, 548 bp, Artificial Sequence
  chemically treated genomic DNA (Homo sapiens) CpG-island No: 26678
atacataactactttaaaaccactcactctataactcaacgaaccgaatcgaaactaaaactcaataccctcccgaacctaaaaaacccacgcgccgtaaacgaaactcccgaaatcgcctaaacaacaaacgcgcgccgcgcccgaacccaaaaccccaaaacgaaaaaaaaaacgcgcgctattaaatatctcgcgatactaaaaccacttcccctaacaccgcccccgactcctccccgcgaaaatacttatcgaaattctcgatcgctaattaatccttctacttcaaaaacgaaacccctaacaaacgtaatacgtaattccgactaccgattaacataaaaaaacaacaacgactaaaacgacgataactacaaaaatcgaaaattacaacgaacctcgaaactaaaaacgcgacgcgacctaaaacgacaaacgacgcaataaaccgaaaaaaaaacgcaacaaccgccctaacccgtcataaaaataaaaaaaaaattcgaacaaatcgacaaatccgaaaactaaacgaccatttacca

SEQ ID NO: 26679 - DNA, 548 bp, Artificial Sequence
  chemically treated genomic DNA (Homo sapiens) CpG-island No: 26679
gtgtatgattattttaaggttatttattttgtgatttaacgggtcgggtcggggttggaatttaatgttttttcgggtttggagagtttacgcgtcgtgggcggggttttcggggtcgtttaggtaataggcgcgcgtcgcgttcgagtttagagttttaaagcggaggagggaacgcgcgttattagatatttcgcggtgttggggttattttttttagtatcgttttcggttttttttcgcggaagtgtttgtcgaaattttcgatcgttgattggtttttttgttttaggggcggagtttttggtaggcgtgatgcgtagtttcggttgtcggttgatatgaagaagtagtagcggttagggcggcggtagttgtaggggtcggggattgtagcgggtttcggggttaagagcgcgacgcggtttagagcggtagacggcgtagtgggtcgagaaggaggcgtagtagtcgttttggttcgttatggagatggaaaaggagttcgagtagatcgataagttcgggagttgggcggttatttatta

SEQ ID NO: 26680 - DNA, 548 bp, Artificial Sequence
  chemically treated genomic DNA (Homo sapiens) CpG-island No: 26680
taataaataaccgcccaactcccgaacttatcgatctactcgaactccttttccatctccataacgaaccaaaacgactactacgcctccttctcgacccactacgccgtctaccgctctaaaccgcgtcgcgctcttaaccccgaaacccgctacaatccccgacccctacaactaccgccgccctaaccgctactacttcttcatatcaaccgacaaccgaaactacgcatcacgcctaccaaaaactccgcccctaaaacaaaaaaaccaatcaacgatcgaaaatttcgacaaacacttccgcgaaaaaaaaccgaaaacgatactaaaaaaaataaccccaacaccgcgaaatatctaataacgcgcgttccctcctccgctttaaaactctaaactcgaacgcgacgcgcgcctattacctaaacgaccccgaaaaccccgcccacgacgcgtaaactctccaaacccgaaaaaacattaaattccaaccccgacccgacccgttaaatcacaaaataaataaccttaaaataatcatacac

SEQ ID NO: 26681 - DNA, 588 bp, Artificial Sequence
  chemically treated genomic DNA (Homo sapiens) CpG-island No: 26681
gatcgttcgttcgtttttagtttggatttcgttgtttagtagtttcggttggttcgcgtcgcgtttttttcgttttggtagttttggtattggtaggacgttcgtagttttttattttagagggcgtcgggcgggtacgcgttgggggcgacgggggtggggcgggggaggcggggcgacgtagcgcggggcggtcggcggttggtgttcgtagttcgcgcgttcgttttttcggttacgtgatttttgggtttcgtttagatcgggagtttcgcgcggatttttggtgcgatttcgttttattgagcgttcgggtcgggattttttcggtgtttttgtggggtagagtttcgttgtgtagaagaggcgagttgaggtacggtggtaggcggggcgtttaagtagttagcgtcgcgtttggtcgttcgttcgcgcgggaaagcgttgttttttttttttcggatggaattggaacggtagttttcgtagcgttcgaattgtgcggtttttgattttattgttgtatttatagtgcgtagagtataggggtacgcggtatattatttgaatgaataatttttttatttt

SEQ ID NO: 26682 - DNA, 588 bp, Artificial Sequence
  chemically treated genomic DNA (Homo sapiens) CpG-island No: 26682
aaaataaaaaaattattcattcaaataatataccgcgtacccctatactctacgcactataaatacaacaataaaatcaaaaaccgcacaattcgaacgctacgaaaactaccgttccaattccatccgaaaaaaaaaaaacaacgctttcccgcgcgaacgaacgaccaaacgcgacgctaactacttaaacgccccgcctaccaccgtacctcaactcgcctcttctacacaacgaaactctaccccacaaaaacaccgaaaaaatcccgacccgaacgctcaataaaacgaaatcgcaccaaaaatccgcgcgaaactcccgatctaaacgaaacccaaaaatcacgtaaccgaaaaaacgaacgcgcgaactacgaacaccaaccgccgaccgccccgcgctacgtcgccccgcctcccccgccccacccccgtcgcccccaacgcgtacccgcccgacgccctctaaaataaaaaactacgaacgtcctaccaataccaaaactaccaaaacgaaaaaaacgcgacgcgaaccaaccgaaactactaaacaacgaaatccaaactaaaaacgaacgaacgatc

SEQ ID NO: 26683 - DNA, 588 bp, Artificial Sequence
  chemically treated genomic DNA (Homo sapiens) CpG-island No: 26683
aggataagaaagttatttatttaaataatgtatcgcgtgtttttgtgttttgcgtattgtgggtatagtagtgaaattaaggatcgtatagttcgggcgttacgagagttgtcgttttaattttattcgaaggaagggagataacgttttttcgcgcggacgagcggttaggcgcggcgttaattgtttggacgtttcgtttgttatcgtgttttagttcgttttttttgtataacgggattttgttttatagggatatcgggaaggtttcgattcgagcgtttagtgggacggggtcgtattaagagttcgcgcggaattttcgatttgggcggggtttaaaggttacgtggtcgggaaggcgggcgcgcgggttgcgagtattaatcgtcggtcgtttcgcgttgcgtcgtttcgtttttttcgttttattttcgtcgtttttagcgcgtgttcgttcggcgttttttagggtggaaggttgcgggcgttttattagtgttaggattgttagagcgggaggagcgcggcgcgggttagtcgggattgttggatagcggggtttaggttagaggcgagcgagcggtt

SEQ ID NO: 26684 - DNA, 588 bp, Artificial Sequence
  chemically treated genomic DNA (Homo sapiens) CpG-island No: 26684
aaccgctcgctcgcctctaacctaaaccccgctatccaacaatcccgactaacccgcgccgcgctcctcccgctctaacaatcctaacactaataaaacgcccgcaaccttccaccctaaaaaacgccgaacgaacacgcgctaaaaacgacgaaaataaaacgaaaaaaacgaaacgacgcaacgcgaaacgaccgacgattaatactcgcaacccgcgcgcccgccttcccgaccacgtaacctttaaaccccgcccaaatcgaaaattccgcgcgaactcttaatacgaccccgtcccactaaacgctcgaatcgaaaccttcccgatatccctataaaacaaaatcccgttatacaaaaaaaacgaactaaaacacgataacaaacgaaacgtccaaacaattaacgccgcgcctaaccgctcgtccgcgcgaaaaaacgttatctcccttccttcgaataaaattaaaacgacaactctcgtaacgcccgaactatacgatccttaatttcactactatacccacaatacgcaaaacacaaaaacacgcgatacattatttaaataaataactttcttatcct

SEQ ID NO: 26685 - DNA, 605 bp, Artificial Sequence
  chemically treated genomic DNA (Homo sapiens) CpG-island No: 26685
gcgtttcgcgaattcgcggacgtgtaggtttcgagttatttttattgttgggttgcgtgatttagcggttcgaggagagaaattttttaaaatcgggggatcgagacggggtttaatttaaatttaggtgggagaatgagtttataagcgcgcgtttttgtagttgcggaggcgcgcgttcgtttattttcgggcgtttgaagtcgtagcggttgtagagtttcgagttcgtggatgcggcgcgcgtcgcggtttgggtttgcgcgagaggttgtcgttcgcgtcgggtttgggtttacgcgtgtttggtttgggtttgtcggtgtaatagtagttgtcgttatcggttttaggtcgcgtcgagcgagtcgtcgagaggggcgggaagaggggagaggttcgagattagggagcgggatttaaagggggtttttcgcgttcgataggttcgtcggggttagttttcgaggcggggagagggagcggggttttttaaggatcgtatgttcgcgatagtatatttgagttttggtaggttatttgggtcgttttttttcggaaattttgcggggtttttaagtaaggtttataatgggaaattttat

SEQ ID NO: 26686 - DNA, 605 bp, Artificial Sequence
  chemically treated genomic DNA (Homo sapiens) CpG-island No: 26686
ataaaatttcccattataaaccttacttaaaaaccccgcaaaatttccgaaaaaaaacgacccaaataacctaccaaaactcaaatatactatcgcgaacatacgatccttaaaaaaccccgctccctctccccgcctcgaaaactaaccccgacgaacctatcgaacgcgaaaaaccccctttaaatcccgctccctaatctcgaacctctcccctcttcccgcccctctcgacgactcgctcgacgcgacctaaaaccgataacgacaactactattacaccgacaaacccaaaccaaacacgcgtaaacccaaacccgacgcgaacgacaacctctcgcgcaaacccaaaccgcgacgcgcgccgcatccacgaactcgaaactctacaaccgctacgacttcaaacgcccgaaaataaacgaacgcgcgcctccgcaactacaaaaacgcgcgcttataaactcattctcccacctaaatttaaattaaaccccgtctcgatcccccgattttaaaaaatttctctcctcgaaccgctaaatcacgcaacccaacaataaaaataactcgaaacctacacgtccgcgaattcgcgaaacgc

SEQ ID NO: 26687 - DNA, 605 bp, Artificial Sequence
  chemically treated genomic DNA (Homo sapiens) CpG-island No: 26687
ataaagttttttattgtaaattttgtttggaaatttcgtaaggttttcgaaagaaggcggtttaggtggtttgttagggtttaaatgtgttatcgcgaatatgcggtttttgaaggatttcgtttttttttttcgtttcgaaggttaatttcggcggatttgtcgggcgcggaaagttttttttaggtttcgttttttggtttcggatttttttttttttttcgtttttttcggcgattcgttcggcgcggtttaggatcggtggcgataattgttgttgtatcggtaggtttaggttagatacgcgtaggtttaggttcgacgcgggcggtagtttttcgcgtaggtttagatcgcggcgcgcgtcgtatttacgggttcgaggttttgtaatcgttgcgattttaggcgttcgagggtgggcgggcgcgcgttttcgtagttgtaggggcgcgcgtttgtgggtttatttttttatttaggtttaaattgaatttcgtttcggtttttcggttttgagaggttttttttttcgagtcgttgagttacgtagtttaatagtaggagtggttcgaggtttatacgttcgcgagttcgcggggcgt

SEQ ID NO: 26688 - DNA, 605 bp, Artificial Sequence
  chemically treated genomic DNA (Homo sapiens) CpG-island No: 26688
acgccccgcgaactcgcgaacgtataaacctcgaaccactcctactattaaactacgtaactcaacgactcgaaaaaaaaaacctctcaaaaccgaaaaaccgaaacgaaattcaatttaaacctaaataaaaaaataaacccacaaacgcgcgcccctacaactacgaaaacgcgcgcccgcccaccctcgaacgcctaaaatcgcaacgattacaaaacctcgaacccgtaaatacgacgcgcgccgcgatctaaacctacgcgaaaaactaccgcccgcgtcgaacctaaacctacgcgtatctaacctaaacctaccgatacaacaacaattatcgccaccgatcctaaaccgcgccgaacgaatcgccgaaaaaaacgaaaaaaaaaaaaaaatccgaaaccaaaaaacgaaacctaaaaaaaactttccgcgcccgacaaatccgccgaaattaaccttcgaaacgaaaaaaaaaaacgaaatccttcaaaaaccgcatattcgcgataacacatttaaaccctaacaaaccacctaaaccgccttctttcgaaaaccttacgaaatttccaaacaaaatttacaataaaaaactttat

SEQ ID NO: 26689 - DNA, 684 bp, Artificial Sequence
  chemically treated genomic DNA (Homo sapiens) CpG-island No: 26689
gaaatttattttttatttattatttatagtcgcggttagttagggaggtataaagattaaatttagcgttaatatttttcgatatttatattttagagaaatttacgcgcgggtgtttaaagtaaatgaggttttatttttagtaaggaattttagagtttatgaattttcgttgtagcgtcgcggagggtttgcgcgtcgtttcgtggacgggtttcggtcggcggggaggatttggtggttggtgtttgcgggggcgggagggggcggaggagaaaggacggttttttagggtcgttcgagtcgcgggaagtacgtcgcgtatttttttttggttttcgcggttcggtttttttgttttcggtttttaaattagttgttgatttgggtggtggtgaggtcggtggtttcggttagttttcgttttttacgcggcgatgggtagggattgtgcgcgtattattttcgtaggatatttttcgatttttttttgaagtagtagttggttttttcgtcgttttagatggtgcgcggtagtggaaattttcggcgtattcgatatttgtttacggcgtttaggggtcggtcgcgtagtttttcggtttttacgtaatgcgtttttagttatagttgttgtagtttggggtggttgtgaggcgagaattggtggttttttaggatttt

SEQ ID NO: 26690 - DNA, 684 bp, Artificial Sequence
  chemically treated genomic DNA (Homo sapiens) CpG-island No: 26690
aaaatcctaaaaaaccaccaattctcgcctcacaaccaccccaaactacaacaactataactaaaaacgcattacgtaaaaaccgaaaaactacgcgaccgacccctaaacgccgtaaacaaatatcgaatacgccgaaaatttccactaccgcgcaccatctaaaacgacgaaaaaaccaactactacttcaaaaaaaaatcgaaaaatatcctacgaaaataatacgcgcacaatccctacccatcgccgcgtaaaaaacgaaaactaaccgaaaccaccgacctcaccaccacccaaatcaacaactaatttaaaaaccgaaaacaaaaaaaccgaaccgcgaaaaccaaaaaaaaatacgcgacgtacttcccgcgactcgaacgaccctaaaaaaccgtcctttctcctccgccccctcccgcccccgcaaacaccaaccaccaaatcctccccgccgaccgaaacccgtccacgaaacgacgcgcaaaccctccgcgacgctacaacgaaaattcataaactctaaaattccttactaaaaataaaacctcatttactttaaacacccgcgcgtaaatttctctaaaatataaatatcgaaaaatattaacgctaaatttaatctttatacctccctaactaaccgcgactataaataataaataaaaaataaatttc

SEQ ID NO: 26691 - DNA, 684 bp, Artificial Sequence
  chemically treated genomic DNA (Homo sapiens) CpG-island No: 26691
aagattttggagagttattagttttcgttttataattattttaaattgtagtaattgtggttgaaggcgtattacgtggaggtcgagaagttgcgcggtcgatttttgggcgtcgtgggtaaatatcgggtgcgtcgaaaatttttattgtcgcgtattatttgggacggcgaggagattagttattgttttaaggagaagtcgaggggtgttttgcgggagtggtacgcgtataatttttatttatcgtcgcgtgagaagcgggagttggtcgaggttatcggttttattattatttaggttagtaattggtttaagaatcggaggtaaagagatcgggtcgcggaggttaaggaaaggtacgcggcgtgtttttcgcgattcgggcgattttaggaagtcgttttttttttttcgttttttttcgttttcgtaggtattagttattaagtttttttcgtcggtcggagttcgtttacggggcggcgcgtaggtttttcgcggcgttgtagcgaaagtttatgaattttgaggttttttgttaaggatggggttttatttgttttgagtattcgcgcgtgggtttttttgggatgtgagtgtcgggaaatattggcgttagatttggtttttatgtttttttggttggtcgcggttatgagtggtgggtggagagtgagtttt

SEQ ID NO: 26692 - DNA, 684 bp, Artificial Sequence
  chemically treated genomic DNA (Homo sapiens) CpG-island No: 26692
aaaactcactctccacccaccactcataaccgcgaccaaccaaaaaaacataaaaaccaaatctaacgccaatatttcccgacactcacatcccaaaaaaacccacgcgcgaatactcaaaacaaataaaaccccatccttaacaaaaaacctcaaaattcataaactttcgctacaacgccgcgaaaaacctacgcgccgccccgtaaacgaactccgaccgacgaaaaaaacttaataactaatacctacgaaaacgaaaaaaaacgaaaaaaaaaaaacgacttcctaaaatcgcccgaatcgcgaaaaacacgccgcgtacctttccttaacctccgcgacccgatctctttacctccgattcttaaaccaattactaacctaaataataataaaaccgataacctcgaccaactcccgcttctcacgcgacgataaataaaaattatacgcgtaccactcccgcaaaacacccctcgacttctccttaaaacaataactaatctcctcgccgtcccaaataatacgcgacaataaaaattttcgacgcacccgatatttacccacgacgcccaaaaatcgaccgcgcaacttctcgacctccacgtaatacgccttcaaccacaattactacaatttaaaataattataaaacgaaaactaataactctccaaaatctt

SEQ ID NO: 26693 - DNA, 922 bp, Artificial Sequence
  chemically treated genomic DNA (Homo sapiens) CpG-island No: 26693
tgtcgcggtggaaggcgattatcgttttggttttgagtacgttttcgtttttgtgtaggtggtcgtaggcgggtagtgattataggaatttgtttaggcgttttaggttttcgttttgttgtagaatttcgtatacgtacgttatttgtttttgcgtaaagttaaacgacggtagtatcgatatggttggggtttgtcggggcgtacggtttaggcgtacgcggtagggagtagagtcgagaggtagggggcggcggtcgtagggaggggggcgcggttgtttttaattttttttttaggttttgtaaaggcgaaaatcggagtcggaatttggcggtgggcggttaaggaagagaaggcggaggagtaggggaggttttggatacggaacggtcggcgtatttagtagtttttaaggttttgttgttttcgatttttcgttcggtggatgttgttagttgtcggggaatttggtttttgtttttttcgtagcggttttaaagcgcgtagcgttttcggtacgttgattggttgtcggcggcgtttattcggggttggttagttagcgcgtcgttcggttgggtagagaggtcgtatcgtttagagcggggagggcgaggttgcggagttgggggttgggggtgttgtcggggttgcgcgggtagggagtggtgggaggagaaggaagaggaaaggtgggaagttagttggggtttgagggagttgcgttgcggaggtgtggggaggtagggagtgggtgagcgcgttaggattttgtaacgcgggattcgtcgttagtattatttaaggggagtcgcgtataatttcgtataaattaatgattttaaattttaatttttttttttttttttcgtatttttgtttttattttttgtagatttgttttttttcggtgagttta

SEQ ID NO: 26694 - DNA, 922 bp, Artificial Sequence
  chemically treated genomic DNA (Homo sapiens) CpG-island No: 26694
taaactcaccgaaaaaaaacaaatctacaaaaaataaaaacaaaaatacgaaaaaaaaaaaaaaaaattaaaatttaaaatcattaatttatacgaaattatacgcgactccccttaaataatactaacgacgaatcccgcgttacaaaatcctaacgcgctcacccactccctacctccccacacctccgcaacgcaactccctcaaaccccaactaacttcccacctttcctcttccttctcctcccaccactccctacccgcgcaaccccgacaacacccccaacccccaactccgcaacctcgccctccccgctctaaacgatacgacctctctacccaaccgaacgacgcgctaactaaccaaccccgaataaacgccgccgacaaccaatcaacgtaccgaaaacgctacgcgctttaaaaccgctacgaaaaaaacaaaaaccaaattccccgacaactaacaacatccaccgaacgaaaaatcgaaaacaacaaaaccttaaaaactactaaatacgccgaccgttccgtatccaaaacctcccctactcctccgccttctcttccttaaccgcccaccgccaaattccgactccgattttcgcctttacaaaacctaaaaaaaaaattaaaaacaaccgcgcccccctccctacgaccgccgccccctacctctcgactctactccctaccgcgtacgcctaaaccgtacgccccgacaaaccccaaccatatcgatactaccgtcgtttaactttacgcaaaaacaaataacgtacgtatacgaaattctacaacaaaacgaaaacctaaaacgcctaaacaaattcctataatcactacccgcctacgaccacctacacaaaaacgaaaacgtactcaaaaccaaaacgataatcgccttccaccgcgaca

SEQ ID NO: 26695 - DNA, 922 bp, Artificial Sequence
  chemically treated genomic DNA (Homo sapiens) CpG-island No: 26695
tgagtttatcgggagagggtaagtttgtaagggatgaggataagagtacggagggagaggggaggaattaaggtttggagttattgatttgtgcggagttgtgcgcgattttttttaggtgatattggcgacgggtttcgcgttgtagggttttgacgcgtttatttattttttatttttttatattttcgtagcgtagtttttttagattttaattggttttttatttttttttttttttttttttttattattttttattcgcgtagtttcggtaatatttttaatttttagtttcgtagtttcgtttttttcgttttgggcggtgcggtttttttgtttagtcgggcggcgcgttggttggttagtttcggataggcgtcgtcggtagttaattagcgtgtcggggacgttgcgcgttttaaggtcgttgcggggagaatagaaattaagtttttcggtaattagtagtatttatcgggcgggaggtcggaggtagtaaggttttaaaggttattgagtgcgtcggtcgtttcgtgtttagaattttttttattttttcgtttttttttttttggtcgtttatcgttaagtttcgatttcggttttcgtttttgtaaagtttaaggaggaggttaggaatagtcgcgtttttttttttgcggtcgtcgttttttgtttttcggttttgttttttgtcgcgtgcgtttgggtcgtgcgtttcggtaggttttagttatgtcgatgttgtcgtcgtttggttttacgtaggagtaagtggcgtgcgtgtgcgaggttttgtagtaaggcggaaatttggagcgtttgggtaggtttttgtggttattgttcgtttgcgattatttgtataagaacgagagcgtatttaaggttaaggcggtggtcgttttttatcgcggta

SEQ ID NO: 26696 - DNA, 922 bp, Artificial Sequence
  chemically treated genomic DNA (Homo sapiens) CpG-island No: 26696
taccgcgataaaaaacgaccaccgccttaaccttaaatacgctctcgttcttatacaaataatcgcaaacgaacaataaccacaaaaacctacccaaacgctccaaatttccgccttactacaaaacctcgcacacgcacgccacttactcctacgtaaaaccaaacgacgacaacatcgacataactaaaacctaccgaaacgcacgacccaaacgcacgcgacaaaaaacaaaaccgaaaaacaaaaaacgacgaccgcaaaaaaaaaaacgcgactattcctaacctcctccttaaactttacaaaaacgaaaaccgaaatcgaaacttaacgataaacgaccaaaaaaaaaaaaacgaaaaaataaaaaaaattctaaacacgaaacgaccgacgcactcaataacctttaaaaccttactacctccgacctcccgcccgataaatactactaattaccgaaaaacttaatttctattctccccgcaacgaccttaaaacgcgcaacgtccccgacacgctaattaactaccgacgacgcctatccgaaactaaccaaccaacgcgccgcccgactaaacaaaaaaaccgcaccgcccaaaacgaaaaaaacgaaactacgaaactaaaaattaaaaatattaccgaaactacgcgaataaaaaataataaaaaaaaaaaaaaaaaaaaaaataaaaaaccaattaaaatctaaaaaaactacgctacgaaaatataaaaaaataaaaaataaataaacgcgtcaaaaccctacaacgcgaaacccgtcgccaatatcacctaaaaaaaatcgcgcacaactccgcacaaatcaataactccaaaccttaattcctcccctctccctccgtactcttatcctcatcccttacaaacttaccctctcccgataaactca

SEQ ID NO: 26697 - DNA, 581 bp, Artificial Sequence
  chemically treated genomic DNA (Homo sapiens) CpG-island No: 26697
cgttatttttatttattaattttcgtgtaggttcgggtttacgtttcgcggattgattttgagttttagtataattcgttgtgttaggtgcgcgcgcgtagttaagtattcgcgcgcggacgtcggggaggttttatcgttcggtgtgttggcggtttcgttcgttggttcgtagagcggggtttcgtagagttgggttttattcgtcgtttcgtcgtttgtattagaaatttttttttcgggttgtgcgggagtttttgggcgtcgcgtttgcgtcggggtcgatttcgtttaggtttgtagttagaggtcgcgttatttcgtcgggttggttcggcgttttttggggttgttttttcgggcggtgtatggggtttataggcgtcggggtttgagggaagaggggtcggggtttgaagggcggggattataacgaggcgcggggaggttagtggagcggagagtcggcgtaggcgcgcgcggcgcggtcggaggagaaagagggcgttgtttttttggtaaaggagttttcgtttggtcggtaggaatcgaaataataataataataaaaaaaaaagaaa

SEQ ID NO: 26698 - DNA, 581 bp, Artificial Sequence
  chemically treated genomic DNA (Homo sapiens) CpG-island No: 26698
tttcttttttttttattattattattatttcgattcctaccgaccaaacgaaaactcctttaccaaaaaaacaacgccctctttctcctccgaccgcgccgcgcgcgcctacgccgactctccgctccactaacctccccgcgcctcgttataatccccgcccttcaaaccccgacccctcttccctcaaaccccgacgcctataaaccccatacaccgcccgaaaaaacaaccccaaaaaacgccgaaccaacccgacgaaataacgcgacctctaactacaaacctaaacgaaatcgaccccgacgcaaacgcgacgcccaaaaactcccgcacaacccgaaaaaaaaatttctaatacaaacgacgaaacgacgaataaaacccaactctacgaaaccccgctctacgaaccaacgaacgaaaccgccaacacaccgaacgataaaacctccccgacgtccgcgcgcgaatacttaactacgcgcgcgcacctaacacaacgaattatactaaaactcaaaatcaatccgcgaaacgtaaacccgaacctacacgaaaattaataaataaaaataacg

SEQ ID NO: 26699 - DNA, 581 bp, Artificial Sequence
  chemically treated genomic DNA (Homo sapiens) CpG-island No: 26699
ttttttttttttttgttgttgttgttgtttcggtttttgtcggttaggcgaaaatttttttgttaggaagatagcgttttttttttttttcggtcgcgtcgcgcgcgtttgcgtcggtttttcgttttattgattttttcgcgtttcgttgtggttttcgttttttaggtttcggtttttttttttttaagtttcgacgtttgtgggttttatgtatcgttcgagggaataattttagagagcgtcgggttagttcggcgagatagcgcgatttttggttataagtttgggcggagtcggtttcggcgtagacgcggcgtttaagagttttcgtatagttcggggagggagtttttggtgtaggcggcggggcgacgggtgaggtttagttttgcgagatttcgttttgcgagttagcgggcggggtcgttagtatatcgggcggtgaagttttttcggcgttcgcgcgcggatatttggttgcgcgcgcgtatttggtatagcgagttatattgaggtttaggattagttcgcgaaacgtggattcgggtttgtacgagggttgatgggtgagggtggcg

SEQ ID NO: 26700 - DNA, 581 bp, Artificial Sequence
  chemically treated genomic DNA (Homo sapiens) CpG-island No: 26700
cgccaccctcacccatcaaccctcgtacaaacccgaatccacgtttcgcgaactaatcctaaacctcaatataactcgctataccaaatacgcgcgcgcaaccaaatatccgcgcgcgaacgccgaaaaaacttcaccgcccgatatactaacgaccccgcccgctaactcgcaaaacgaaatctcgcaaaactaaacctcacccgtcgccccgccgcctacaccaaaaactccctccccgaactatacgaaaactcttaaacgccgcgtctacgccgaaaccgactccgcccaaacttataaccaaaaatcgcgctatctcgccgaactaacccgacgctctctaaaattattccctcgaacgatacataaaacccacaaacgtcgaaacttaaaaaaaaaaaaaccgaaacctaaaaaacgaaaaccacaacgaaacgcgaaaaaatcaataaaacgaaaaaccgacgcaaacgcgcgcgacgcgaccgaaaaaaaaaaaaaacgctatcttcctaacaaaaaaattttcgcctaaccgacaaaaaccgaaacaacaacaacaacaaaaaaaaaaaaaa

SEQ ID NO: 26701 - DNA, 583 bp, Artificial Sequence
  chemically treated genomic DNA (Homo sapiens) CpG-island No: 26701
tttgtgtgggtgtggggaaggtgtggaaggaatcgtttaggttcgtgtgggtgtggagaaggtgtggaaggaattcgtttaggttcgtgtgggtgtggagaaggtgtggaaggaattcgtttaggttcgtgtgggtgtgtataaggtgtggaaggaattcgtttaggttcgtgtgggtgtggaggtgtggaaggaatcgtttaggtttgtgtgggtgtggagaaggtttggaaggaattcgtttaggttcgtgtgggtgtggagaaggtgtggaaggaatcgtttaggtttgtgtgggtgtggggaaggtgtggaaggaatttatttaggttcgtgtgggtgtggaggtgtggaaggaatcgtttaggttcgtgtgggtgtggagaatgggtgtggggaaggtgtggaaggaatcgtttaggttcgtgtgggtgtggagaaggtgtggaaggaatttatttaggttcgtgtgggtgtggggaaggtgtggaaggaatcgtttaggttcgtgtaggtgtggagaagttacggaaggatatatgtttgggggattggaatagggggagatgattagttttttttt

SEQ ID NO: 26702 - DNA, 583 bp, Artificial Sequence
  chemically treated genomic DNA (Homo sapiens) CpG-island No: 26702
aaaaaaaaactaatcatctccccctattccaatcccccaaacatatatccttccgtaacttctccacacctacacgaacctaaacgattccttccacaccttccccacacccacacgaacctaaataaattccttccacaccttctccacacccacacgaacctaaacgattccttccacaccttccccacacccattctccacacccacacgaacctaaacgattccttccacacctccacacccacacgaacctaaataaattccttccacaccttccccacacccacacaaacctaaacgattccttccacaccttctccacacccacacgaacctaaacgaattccttccaaaccttctccacacccacacaaacctaaacgattccttccacacctccacacccacacgaacctaaacgaattccttccacaccttatacacacccacacgaacctaaacgaattccttccacaccttctccacacccacacgaacctaaacgaattccttccacaccttctccacacccacacgaacctaaacgattccttccacaccttccccacacccacacaaa

SEQ ID NO: 26703 - DNA, 583 bp, Artificial Sequence
  chemically treated genomic DNA (Homo sapiens) CpG-island No: 26703
aaggaaaagttaattatttttttttattttagttttttaggtatgtattttttcgtagtttttttatatttatacgaatttagacgattttttttatattttttttatatttatacgaatttagatgaattttttttatattttttttatatttatacgaatttagacgattttttttatattttttttatatttattttttatatttatacgaatttagacgattttttttatatttttatatttatacgaatttagatgaattttttttatattttttttatatttatataaatttagacgattttttttatattttttttatatttatacgaatttagacgaattttttttagattttttttatatttatatagatttagacgattttttttatatttttatatttatacgaatttagacgaattttttttatattttgtgtatatttatacgaatttagacgaattttttttatattttttttatatttatacgaatttagacgaattttttttatattttttttatatttatacgaatttagacgattttttttatattttttttatatttatataga

SEQ ID NO: 26704 - DNA, 583 bp, Artificial Sequence
  chemically treated genomic DNA (Homo sapiens) CpG-island No: 26704
tctatataaatataaaaaaaatataaaaaaaatcgtctaaattcgtataaatataaaaaaaatataaaaaaaattcgtctaaattcgtataaatataaaaaaaatataaaaaaaattcgtctaaattcgtataaatatacacaaaatataaaaaaaattcgtctaaattcgtataaatataaaaatataaaaaaaatcgtctaaatctatataaatataaaaaaaatctaaaaaaaattcgtctaaattcgtataaatataaaaaaaatataaaaaaaatcgtctaaatttatataaatataaaaaaaatataaaaaaaattcatctaaattcgtataaatataaaaatataaaaaaaatcgtctaaattcgtataaatataaaaaataaatataaaaaaaatataaaaaaaatcgtctaaattcgtataaatataaaaaaaatataaaaaaaattcatctaaattcgtataaatataaaaaaaatataaaaaaaatcgtctaaattcgtataaatataaaaaaactacgaaaaaatacatacctaaaaaactaaaataaaaaaaaataattaacttttcctt

SEQ ID NO: 26705 - DNA, 668 bp, Artificial Sequence
  chemically treated genomic DNA (Homo sapiens) CpG-island No: 26705
ttttagcgcggagttttaaaggcgttaagtcgggtagtcgggtcgttttgaatttgcgggttgtatacgttcgtcgggagttgtagcgttcggagtttagtagagcggtcgtcggtcgtagtcgtaaacgcgtggggtgtagggtcgcgttatcgcgggggaaagatacgaagaggagttgaggaatcgagcgggtagagattacgagaggttttaggtcgacgtcgcgcgcgcgggttcggaagagacggttacgtgatatcgatttgttggttttattgttgttttatatgtacgtcggttattgtggtcgtcgttagtagtatcgagaggtttagtattattttcgagtttttagatatttttacgttggcggtcgcggtttttttttttcgttcgttcgaggcgtagaggtcgtcgtagagtgcgtatcgtcgtttgtattgtttaggttcgatttttcgagcgtagagttttagtcgtcgcgtgcgtcgttcgtcgttgttaggcgtgagtaatcgagagtcgagtatagagcggcgtttaggttttacgaatttttggttttattaggggttttttgtatatttcgtaggcgatagcgttagattattttcgatttaaattttaggagtttcggtttaaattggtttcggtattttattagg

SEQ ID NO: 26706 - DNA, 668 bp, Artificial Sequence
  chemically treated genomic DNA (Homo sapiens) CpG-island No: 26706
cctaataaaataccgaaaccaatttaaaccgaaactcctaaaatttaaatcgaaaataatctaacgctatcgcctacgaaatatacaaaaaacccctaataaaaccaaaaattcgtaaaacctaaacgccgctctatactcgactctcgattactcacgcctaacaacgacgaacgacgcacgcgacgactaaaactctacgctcgaaaaatcgaacctaaacaatacaaacgacgatacgcactctacgacgacctctacgcctcgaacgaacgaaaaaaaaaaaccgcgaccgccaacgtaaaaatatctaaaaactcgaaaataatactaaacctctcgatactactaacgacgaccacaataaccgacgtacatataaaacaacaataaaaccaacaaatcgatatcacgtaaccgtctcttccgaacccgcgcgcgcgacgtcgacctaaaacctctcgtaatctctacccgctcgattcctcaactcctcttcgtatctttcccccgcgataacgcgaccctacaccccacgcgtttacgactacgaccgacgaccgctctactaaactccgaacgctacaactcccgacgaacgtatacaacccgcaaattcaaaacgacccgactacccgacttaacgcctttaaaactccgcgctaaaa

SEQ ID NO: 26707 - DNA, 668 bp, Artificial Sequence
  chemically treated genomic DNA (Homo sapiens) CpG-island No: 26707
tttggtaaggtgtcggggttagtttgggtcgggatttttagaatttgaatcgggggtggtttaacgttgtcgtttgcggggtgtgtaggaggtttttagtgaagttaagagttcgtagagtttgggcgtcgttttatgttcggttttcgattgtttacgtttggtagcggcgagcggcgtacgcgacggttggggttttgcgttcgaggggtcgagtttgggtagtataggcggcggtgcgtattttgcggcggtttttgcgtttcgggcgggcgggagagagaggtcgcggtcgttagcgtggggatgtttaggagttcgaaggtggtgttgggtttttcggtgttgttgacggcggttatagtggtcggcgtatatgtgaagtagtagtgggattagtaggtcggtgttacgtgatcgtttttttcgggttcgcgcgcgcggcgtcgatttggggtttttcgtggtttttgttcgttcggttttttagttttttttcgtgtttttttttcgcggtggcgcggttttgtattttacgcgtttgcggttgcggtcggcggtcgttttgttgggtttcgggcgttgtagttttcggcgggcgtgtgtagttcgtagatttaggacgattcggttgttcggtttagcgtttttggagtttcgcgttgaag

SEQ ID NO: 26708 - DNA, 668 bp, Artificial Sequence
  chemically treated genomic DNA (Homo sapiens) CpG-island No: 26708
cttcaacgcgaaactccaaaaacgctaaaccgaacaaccgaatcgtcctaaatctacgaactacacacgcccgccgaaaactacaacgcccgaaacccaacaaaacgaccgccgaccgcaaccgcaaacgcgtaaaatacaaaaccgcgccaccgcgaaaaaaaaacacgaaaaaaaactaaaaaaccgaacgaacaaaaaccacgaaaaaccccaaatcgacgccgcgcgcgcgaacccgaaaaaaacgatcacgtaacaccgacctactaatcccactactacttcacatatacgccgaccactataaccgccgtcaacaacaccgaaaaacccaacaccaccttcgaactcctaaacatccccacgctaacgaccgcgacctctctctcccgcccgcccgaaacgcaaaaaccgccgcaaaatacgcaccgccgcctatactacccaaactcgacccctcgaacgcaaaaccccaaccgtcgcgtacgccgctcgccgctaccaaacgtaaacaatcgaaaaccgaacataaaacgacgcccaaactctacgaactcttaacttcactaaaaacctcctacacaccccgcaaacgacaacgttaaaccacccccgattcaaattctaaaaatcccgacccaaactaaccccgacaccttaccaaa

SEQ ID NO: 26709 - DNA, 896 bp, Artificial Sequence
  chemically treated genomic DNA (Homo sapiens) CpG-island No: 26709
tggatattcgttttggtagatgttaatttgtgcgttcgaggttgtttttgttcgtttttagtgcgtttattgtataacgcgttttttgttttatttttacgacgttcgttttgttcggtgttcgagttagcgtttcgattcgggtcgttttaatatttatattattttatttgacgaatttggtgttttttttgaggttgtcggatacgtatacgggtttgagttgtaaggcgtgtatttcgggttgagtttcggttatttgggtttatttgggtttcgggcggttcgggcgagcgcggtagggattggggatcgtgcgcggggcgcggggcgcggggcgcgggtttttttttttgtttcggaggcgttcgattttgtttttcgtcggttttttcggtttttcggttttcgtattttttttcggcgtcgtttagtaggtagagcgcgcgggggcgtagcgttcggttatgtttcgggcgggacgcgaggtttggagttcgcggtggatgaggagtttcggaaggcgaagagaagtcgagtcggttagtcgaggttgttagtcgcggcggattttgttttttcgtcgtcgtcgttttaaagcgtattatttagtatattttttatatatagagggagagagcgagtgatatacgttcggcgttttttttaatcgttttttttttttttttttttttttttttttcgtttttttttttcgttattttcgttcgttgggttttttttttttttcgcggtttttagtttaattttgtacgttgggttaggcgttaggaagcggggacgtagcggtattttttggttttcgagttttattgtagttaacgtttgtttttcgtattcgttttgagtatgtttcgtgttttggttgtagaggt

SEQ ID NO: 26710 - DNA, 896 bp, Artificial Sequence
  chemically treated genomic DNA (Homo sapiens) CpG-island No: 26710
acctctacaaccaaaacacgaaacatactcaaaacgaatacgaaaaacaaacgttaactacaataaaactcgaaaaccaaaaaataccgctacgtccccgcttcctaacgcctaacccaacgtacaaaattaaactaaaaaccgcgaaaaaaaaaaaaaacccaacgaacgaaaataacgaaaaaaaaaaacgaaaaaaaaaaaaaaaaaaaaaaaaaaaaaacgattaaaaaaaacgccgaacgtatatcactcgctctctccctctatatataaaaaatatactaaataatacgctttaaaacgacgacgacgaaaaaacaaaatccgccgcgactaacaacctcgactaaccgactcgacttctcttcgccttccgaaactcctcatccaccgcgaactccaaacctcgcgtcccgcccgaaacataaccgaacgctacgcccccgcgcgctctacctactaaacgacgccgaaaaaaaatacgaaaaccgaaaaaccgaaaaaaccgacgaaaaacaaaatcgaacgcctccgaaacaaaaaaaaaaacccgcgccccgcgccccgcgccccgcgcacgatccccaatccctaccgcgctcgcccgaaccgcccgaaacccaaataaacccaaataaccgaaactcaacccgaaatacacgccttacaactcaaacccgtatacgtatccgacaacctcaaaaaaaacaccaaattcgtcaaataaaataatataaatattaaaacgacccgaatcgaaacgctaactcgaacaccgaacaaaacgaacgtcgtaaaaataaaacaaaaaacgcgttatacaataaacgcactaaaaacgaacaaaaacaacctcgaacgcacaaattaacatctaccaaaacgaatatcca

SEQ ID NO: 26711 - DNA, 896 bp, Artificial Sequence
  chemically treated genomic DNA (Homo sapiens) CpG-island No: 26711
atttttgtaattagggtacggggtatgtttagagcgaatgcgggaggtaggcgttggttgtaatggggttcgggagttaggaggtgtcgttgcgttttcgttttttggcgtttgatttagcgtgtaaagttgggttgggagtcgcggggggaaggaaggatttagcgagcgagggtggcggggaaggggggcgggggggaggaggagggaggagggaaaagagcggttagggggggcgtcgggcgtgtgttattcgttttttttttttgtgtatagaggatgtgttgaatggtgcgttttgaggcggcggcggcggaggagtagaattcgtcgcgattggtagtttcggttgatcggttcggttttttttcgtttttcgaggttttttatttatcgcgggttttagatttcgcgtttcgttcggggtatggtcgggcgttgcgttttcgcgcgttttgtttgttgagcggcgtcggagggaggtgcggaggtcgggaggtcggggaggtcggcggggagtagagtcgagcgttttcggagtagagaaaggagttcgcgtttcgcgtttcgcgtttcgcgtacggtttttagtttttgtcgcgttcgttcgggtcgttcggagtttagatgagtttagatggtcggggtttaattcggagtgtacgttttgtaatttaagttcgtgtgcgtgttcgatagttttaagaagggtattaaattcgttaagtgggatgatgtaagtattggggcggttcgagtcggggcgttggttcgggtatcgggtagggcgggcgtcgtgggggtggggtaaggggcgcgttatgtaatgggcgtattgggagcgggtaggggtagtttcgggcgtataggttggtatttgttaaagcggatgttta

SEQ ID NO: 26712 - DNA, 896 bp, Artificial Sequence
  chemically treated genomic DNA (Homo sapiens) CpG-island No: 26712
taaacatccgctttaacaaataccaacctatacgcccgaaactacccctacccgctcccaatacgcccattacataacgcgccccttaccccacccccacgacgcccgccctacccgatacccgaaccaacgccccgactcgaaccgccccaatacttacatcatcccacttaacgaatttaatacccttcttaaaactatcgaacacgcacacgaacttaaattacaaaacgtacactccgaattaaaccccgaccatctaaactcatctaaactccgaacgacccgaacgaacgcgacaaaaactaaaaaccgtacgcgaaacgcgaaacgcgaaacgcgaactcctttctctactccgaaaacgctcgactctactccccgccgacctccccgacctcccgacctccgcacctccctccgacgccgctcaacaaacaaaacgcgcgaaaacgcaacgcccgaccataccccgaacgaaacgcgaaatctaaaacccgcgataaataaaaaacctcgaaaaacgaaaaaaaaccgaaccgatcaaccgaaactaccaatcgcgacgaattctactcctccgccgccgccgcctcaaaacgcaccattcaacacatcctctatacacaaaaaaaaaaaacgaataacacacgcccgacgccccccctaaccgctcttttccctcctccctcctcctcccccccgccccccttccccgccaccctcgctcgctaaatccttccttccccccgcgactcccaacccaactttacacgctaaatcaaacgccaaaaaacgaaaacgcaacgacacctcctaactcccgaaccccattacaaccaacgcctacctcccgcattcgctctaaacataccccgtaccctaattacaaaaat

SEQ ID NO: 26713 - DNA, 937 bp, Artificial Sequence
  chemically treated genomic DNA (Homo sapiens) CpG-island No: 26713
cgtttcgggggcggcgcgggagttttcgtagaatcgggcgggcgtttcggttggcgcgggcggggggcgcgttttttttatttgcggtttcggtttttaggttatttttttacgcggcggcggtcgggattgagttgatattatttaggtcggtcgggtttgaatgaggaggagcgggcgcggagaggagggggcggggagggcggagggagggagggaggcgtcgcggagtttttttcggttttttgtgcggatatttttcggatttcgcgttcgtattcggttttttaaaagatacggggagtcgcgggcgaggggtgtagttattcgtcgaggcgtttagtgttttcgcgtttttaagatttatttttaataaaaaggagcgttttttatttttattttcgttcggaggatttagggtttaggtttatttcgggcgcggagttaagtgttggcgtcgggggtttttagagtcgtcggggcgtagcgagttcggcgttgggtaattgttgggttagaaattgtttaggtagtagttgttgtgtttttttttggtttcgtcgttcggagacgtttcgttttttgtttttaacggtcgcgtcggtttcgttttttgttttgaacggtcgttcggtttcgttttagcgtttacgtgattagtataggcgcgttttcgtttcgttcgtcgtcgtagatttcgttttcggaatgcgagcgagcggcgagcgcgcgtattgttagtttttgttcggcgattttttcgtacgcgcgcgtcgtgttatttttttcgtattttttttttcgttattcggtttaacgtggcgggcgcgcgtcgcggtagtagtcgtgataggtattcggcgggggggggggggagggggttggttcgcgagggtgtgcgtaggtatagattcgggttttgttttcgtcgtttttt

SEQ ID NO: 26714 - DNA, 937 bp, Artificial Sequence
  chemically treated genomic DNA (Homo sapiens) CpG-island No: 26714
aaaaaacgacgaaaacaaaacccgaatctatacctacgcacaccctcgcgaaccaaccccctcccccccccccccgccgaatacctatcacgactactaccgcgacgcgcgcccgccacgttaaaccgaataacgaaaaaaaaaatacgaaaaaaataacacgacgcgcgcgtacgaaaaaatcgccgaacaaaaactaacaatacgcgcgctcgccgctcgctcgcattccgaaaacgaaatctacgacgacgaacgaaacgaaaacgcgcctatactaatcacgtaaacgctaaaacgaaaccgaacgaccgttcaaaacaaaaaacgaaaccgacgcgaccgttaaaaacaaaaaacgaaacgtctccgaacgacgaaaccaaaaaaaaacacaacaactactacctaaacaatttctaacccaacaattacccaacgccgaactcgctacgccccgacgactctaaaaacccccgacgccaacacttaactccgcgcccgaaataaacctaaaccctaaatcctccgaacgaaaataaaaataaaaaacgctcctttttattaaaaataaatcttaaaaacgcgaaaacactaaacgcctcgacgaataactacacccctcgcccgcgactccccgtatcttttaaaaaaccgaatacgaacgcgaaatccgaaaaatatccgcacaaaaaaccgaaaaaaactccgcgacgcctccctccctccctccgccctccccgccccctcctctccgcgcccgctcctcctcattcaaacccgaccgacctaaataatatcaactcaatcccgaccgccgccgcgtaaaaaaataacctaaaaaccgaaaccgcaaataaaaaaaacgcgccccccgcccgcgccaaccgaaacgcccgcccgattctacgaaaactcccgcgccgcccccgaaacg

SEQ ID NO: 26715 - DNA, 937 bp, Artificial Sequence
  chemically treated genomic DNA (Homo sapiens) CpG-island No: 26715
agggggcggcggggataggattcgggtttgtgtttgcgtatattttcgcgggttaattttttttttttttttttcgtcgggtatttgttacggttattgtcgcggcgcgcgttcgttacgttaagtcggatggcgggaggaggggtgcggggagggtggtacggcgcgcgcgtgcgggggagtcgtcgagtaagaattggtagtgcgcgcgttcgtcgttcgttcgtatttcggaggcggagtttgcggcggcgggcggaacgggggcgcgtttatgttagttacgtgggcgttggggcggggtcgggcggtcgtttaaggtagggggcggggtcggcgcggtcgttgaaggtagggggcggggcgttttcgagcggcggggttaagggagggtataatagttgttatttgaatagtttttgatttaatagttatttagcgtcggattcgttgcgtttcggcggttttagggattttcggcgttaatatttagtttcgcgttcgaggtgagtttaggttttaaatttttcgggcgggggtaggggtgggggacgtttttttttgttgggggtgggttttggaggcgcgaaggtattaggcgtttcggcggatggttgtatttttcgttcgcggtttttcgtgttttttggggggtcgggtgcgggcgcggaattcgggaggtgttcgtataaaaggtcgagaaaaatttcgcgacgttttttttttttttttcgtttttttcgttttttttttttcgcgttcgtttttttttatttaaattcggtcggtttgagtggtgttagtttagtttcggtcgtcgtcgcgtgaggaaatggtttaggagtcggagtcgtaggtaaagggggcgcgtttttcgttcgcgttagtcggggcgttcgttcggttttgcggaggttttcgcgtcgttttcgaggcg

SEQ ID NO: 26716 - DNA, 937 bp, Artificial Sequence
  chemically treated genomic DNA (Homo sapiens) CpG-island No: 26716
cgcctcgaaaacgacgcgaaaacctccgcaaaaccgaacgaacgccccgactaacgcgaacgaaaaacgcgccccctttacctacgactccgactcctaaaccatttcctcacgcgacgacgaccgaaactaaactaacaccactcaaaccgaccgaatttaaataaaaaaaaacgaacgcgaaaaaaaaaaaacgaaaaaaacgaaaaaaaaaaaaaaaacgtcgcgaaatttttctcgaccttttatacgaacacctcccgaattccgcgcccgcacccgaccccccaaaaaacacgaaaaaccgcgaacgaaaaatacaaccatccgccgaaacgcctaataccttcgcgcctccaaaacccacccccaacaaaaaaaaacgtcccccacccctacccccgcccgaaaaatttaaaacctaaactcacctcgaacgcgaaactaaatattaacgccgaaaatccctaaaaccgccgaaacgcaacgaatccgacgctaaataactattaaatcaaaaactattcaaataacaactattataccctcccttaaccccgccgctcgaaaacgccccgccccctaccttcaacgaccgcgccgaccccgccccctaccttaaacgaccgcccgaccccgccccaacgcccacgtaactaacataaacgcgcccccgttccgcccgccgccgcaaactccgcctccgaaatacgaacgaacgacgaacgcgcgcactaccaattcttactcgacgactcccccgcacgcgcgcgccgtaccaccctccccgcacccctcctcccgccatccgacttaacgtaacgaacgcgcgccgcgacaataaccgtaacaaatacccgacgaaaaaaaaaaaaaaaaaattaacccgcgaaaatatacgcaaacacaaacccgaatcctatccccgccgccccct

SEQ ID NO: 26717 - DNA, 827 bp, Artificial Sequence
  chemically treated genomic DNA (Homo sapiens) CpG-island No: 26717
gcggcgtttttcgacgttatacgcgtttgttcgtatttagttacgcgtttggggttattttttatatttaggattgaaatttcgttcgcgagatcgcggggcgcggaggagggtcgaaatttaaggtttaggtttagggttcgttttcgcgcgttcgcgttggcgttcgcgcgtttttttcgtaggggttagtaagattgcgtttattttcgtttcggttgttttttattcgttcgttgttttggggtattaggttcgcggtcgcgtttttacgtttcggttggagttttgcggcgggtattggcgagcgcggtttcgttttttggtttagttaatcgcgagttacgtcgattagcgagggggaggtgtcgggcggaaggtttgggtcggtgcgcgggggcgggtgaggtggttttattcgttcgaggggggggcgtggtcggcgtcggtttttgcggtcgagtagagttgcggcgtgggaaagagtcgttaggagtagatcgcgtcgtcgtcggagtcgcgtttgtttaggttcggggagggaggaggcgggcgttagggtgttgcgtttcgttcggcgttcgagttttcggtcgggttgtgtttcgcgcggttttcgtcgggatgaagcgtttttgcgaggagacgattttcgagagcgatatggacgagattatcgacgtggggagcgagaataattattcggggtgagcgcgggtttcgcgggagcggttcgtagttcgggagtttggggtagttttgtgaatgcgtggttttttggaaatttcgaggttggttttcgtagtatttaggtagagagggaaagt

SEQ ID NO: 26718 - DNA, 827 bp, Artificial Sequence
  chemically treated genomic DNA (Homo sapiens) CpG-island No: 26718
actttccctctctacctaaatactacgaaaaccaacctcgaaatttccaaaaaaccacgcattcacaaaactaccccaaactcccgaactacgaaccgctcccgcgaaacccgcgctcaccccgaataattattctcgctccccacgtcgataatctcgtccatatcgctctcgaaaatcgtctcctcgcaaaaacgcttcatcccgacgaaaaccgcgcgaaacacaacccgaccgaaaactcgaacgccgaacgaaacgcaacaccctaacgcccgcctcctccctccccgaacctaaacaaacgcgactccgacgacgacgcgatctactcctaacgactctttcccacgccgcaactctactcgaccgcaaaaaccgacgccgaccacgcccccccctcgaacgaataaaaccacctcacccgcccccgcgcaccgacccaaaccttccgcccgacacctccccctcgctaatcgacgtaactcgcgattaactaaaccaaaaaacgaaaccgcgctcgccaatacccgccgcaaaactccaaccgaaacgtaaaaacgcgaccgcgaacctaataccccaaaacaacgaacgaataaaaaacaaccgaaacgaaaataaacgcaatcttactaacccctacgaaaaaaacgcgcgaacgccaacgcgaacgcgcgaaaacgaaccctaaacctaaaccttaaatttcgaccctcctccgcgccccgcgatctcgcgaacgaaatttcaatcctaaatataaaaaataaccccaaacgcgtaactaaatacgaacaaacgcgtataacgtcgaaaaacgccgc

SEQ ID NO: 26719 - DNA, 827 bp, Artificial Sequence
  chemically treated genomic DNA (Homo sapiens) CpG-island No: 26719
attttttttttttatttagatgttgcggagattagtttcgggatttttagggagttacgtatttataaagttattttaagttttcgagttgcgggtcgttttcgcggagttcgcgtttatttcgagtaattgttttcgttttttacgtcgatggtttcgtttatgtcgttttcggaggtcgttttttcgtaggggcgttttatttcggcgaagatcgcgcggggtatagttcggtcggaagttcggacgtcgagcggggcgtagtattttgacgttcgtttttttttttttcgggtttgggtaggcgcggtttcggcggcggcgcggtttgtttttagcggtttttttttacgtcgtaattttgttcggtcgtaagagtcggcgtcggttacgtttttttttcgagcgggtggggttattttattcgttttcgcgtatcggtttaggtttttcgttcggtatttttttttcgttggtcggcgtggttcgcgattggttgggttagggggcggggtcgcgttcgttaatgttcgtcgtaaggttttagtcgaggcgtgggaacgcggtcgcggatttggtattttagagtagcgagcgggtggggagtagtcggggcgagaatgagcgtaattttgttaatttttgcggagggagcgcgcgggcgttaacgcgggcgcgcgggggcgggttttggatttggattttgggtttcggttttttttcgcgtttcgcggtttcgcgggcgaagttttagttttgagtgtaaagaataattttaagcgcgtggttaagtgcgagtaggcgcgtgtgacgtcgggaggcgtcgt

SEQ ID NO: 26720 - DNA, 827 bp, Artificial Sequence
  chemically treated genomic DNA (Homo sapiens) CpG-island No: 26720
acgacgcctcccgacgtcacacgcgcctactcgcacttaaccacgcgcttaaaattattctttacactcaaaactaaaacttcgcccgcgaaaccgcgaaacgcgaaaaaaaaccgaaacccaaaatccaaatccaaaacccgcccccgcgcgcccgcgttaacgcccgcgcgctccctccgcaaaaattaacaaaattacgctcattctcgccccgactactccccacccgctcgctactctaaaataccaaatccgcgaccgcgttcccacgcctcgactaaaaccttacgacgaacattaacgaacgcgaccccgccccctaacccaaccaatcgcgaaccacgccgaccaacgaaaaaaaaataccgaacgaaaaacctaaaccgatacgcgaaaacgaataaaataaccccacccgctcgaaaaaaaaacgtaaccgacgccgactcttacgaccgaacaaaattacgacgtaaaaaaaaaccgctaaaaacaaaccgcgccgccgccgaaaccgcgcctacccaaacccgaaaaaaaaaaaaacgaacgtcaaaatactacgccccgctcgacgtccgaacttccgaccgaactataccccgcgcgatcttcgccgaaataaaacgcccctacgaaaaaacgacctccgaaaacgacataaacgaaaccatcgacgtaaaaaacgaaaacaattactcgaaataaacgcgaactccgcgaaaacgacccgcaactcgaaaacttaaaataactttataaatacgtaactccctaaaaatcccgaaactaatctccgcaacatctaaataaaaaaaaaaaat

SEQ ID NO: 26721 - DNA, 899 bp, Artificial Sequence
  chemically treated genomic DNA (Homo sapiens) CpG-island No: 26721
ggcggttcgttggggtagtaaggcgttcgtattcgggaggcgttataaagggtcgaggtttgcggaggtcgtacgcgtagtttttcggggcggagtcgtcgggatcgcggtagcggaggttgtagtagtcgcgggtagtcggggtgtttagttttttagttcggaggtcgcggggggcggggaggatgtcgtaattgtagttcgagcggtagagttcggcgcgagtttttaggttttcgtaatcgttgtgaggcgtagcgcgcgttattggtcgggaggagttagaggcgggcgtttgtatagcgtcgcgttattcgtgattgttcgtttttagtcgggttcgggatttcgtagcggtttatgttttgacggggggcgtagttgcggggttggcgaggcgtcgcgcgtgggaagaggtttaagatatttcgattgcggcggttgcgtatattcgattcggacgcggggtttcgcgggcgcgcgtttcggagttttcgttttttttttttgttttttttcggcgtacggtttttttttgatttttttttttattcgtcgagaggatgcgtttttcggcgtttagtagtagaggttatcgtttttagaaatgtatgcgatcgatttttttttttcggattttaggagtcggcgttttcgttttgtaggtaggtggtgaggcggggtttagttttcgtcgtcgttcgtcgttgatgttgtcgtcgagaggtcgcgagtagggtttaggatcggttaaatttgtttttcgtcgggggttcggtggagcgttcggaggtgtgttaatggcgttgggcgtagttttttgtgaatttgaaaatttttgtttgagttcgggaggtcgagcgggggcgaaggagagattgattttttttcgtttattt

SEQ ID NO: 26722 - DNA, 899 bp, Artificial Sequence
  chemically treated genomic DNA (Homo sapiens) CpG-island No: 26722
aaataaacgaaaaaaaatcaatctctccttcgcccccgctcgacctcccgaactcaaacaaaaattttcaaattcacaaaaaactacgcccaacgccattaacacacctccgaacgctccaccgaacccccgacgaaaaacaaatttaaccgatcctaaaccctactcgcgacctctcgacgacaacatcaacgacgaacgacgacgaaaactaaaccccgcctcaccacctacctacaaaacgaaaacgccgactcctaaaatccgaaaaaaaaaaatcgatcgcatacatttctaaaaacgataacctctactactaaacgccgaaaaacgcatcctctcgacgaataaaaaaaaaaatcaaaaaaaaaccgtacgccgaaaaaaaacaaaaaaaaaaaacgaaaactccgaaacgcgcgcccgcgaaaccccgcgtccgaatcgaatatacgcaaccgccgcaatcgaaatatcttaaacctcttcccacgcgcgacgcctcgccaaccccgcaactacgccccccgtcaaaacataaaccgctacgaaatcccgaacccgactaaaaacgaacaatcacgaataacgcgacgctatacaaacgcccgcctctaactcctcccgaccaataacgcgcgctacgcctcacaacgattacgaaaacctaaaaactcgcgccgaactctaccgctcgaactacaattacgacatcctccccgccccccgcgacctccgaactaaaaaactaaacaccccgactacccgcgactactacaacctccgctaccgcgatcccgacgactccgccccgaaaaactacgcgtacgacctccgcaaacctcgaccctttataacgcctcccgaatacgaacgccttactaccccaacgaaccgcc

SEQ ID NO: 26723 - DNA, 899 bp, Artificial Sequence
  chemically treated genomic DNA (Homo sapiens) CpG-island No: 26723
gggtgggcggggaagggttaatttttttttcgttttcgttcggtttttcgagtttaagtagaggtttttaggtttatagggggttacgtttagcgttattagtatattttcgagcgttttatcgagttttcggcgggaggtaagtttggtcggttttggattttgttcgcggtttttcggcggtagtattagcggcgggcggcggcgagggttgggtttcgttttattatttatttatagggcgggggcgtcggtttttggggttcgggagaaggggatcggtcgtatgtatttttgggagcggtggtttttgttgttgggcgtcggggagcgtattttttcggcgggtggaaggaggggttaggggaggatcgtacgtcgaggaggagtaagaggaggaggcgggagtttcgaggcgcgcgttcgcggggtttcgcgttcggatcgggtgtgcgtagtcgtcgtagtcggggtgttttaggtttttttttacgcgcgacgtttcgttagtttcgtagttgcgtttttcgttagggtatgggtcgttacggggtttcgggttcggttgaaggcgggtagttacgggtggcgcgacgttgtgtagacgttcgtttttagtttttttcggttagtggcgcgcgttgcgttttatagcggttgcgggggtttgggagttcgcgtcgggttttgtcgttcggattgtagttgcggtatttttttcgtttttcgcgattttcgagttgggaggttgggtatttcggttattcgcggttgttgtagttttcgttgtcgcgatttcggcggtttcgtttcggagagttgcgcgtgcggttttcgtaggtttcggttttttgtggcgtttttcgagtgcgggcgttttgttgttttagcgaatcgtt

SEQ ID NO: 26724 - DNA, 899 bp, Artificial Sequence
  chemically treated genomic DNA (Homo sapiens) CpG-island No: 26724
aacgattcgctaaaacaacaaaacgcccgcactcgaaaaacgccacaaaaaaccgaaacctacgaaaaccgcacgcgcaactctccgaaacgaaaccgccgaaatcgcgacaacgaaaactacaacaaccgcgaataaccgaaatacccaacctcccaactcgaaaatcgcgaaaaacgaaaaaaataccgcaactacaatccgaacgacaaaacccgacgcgaactcccaaacccccgcaaccgctataaaacgcaacgcgcgccactaaccgaaaaaaactaaaaacgaacgtctacacaacgtcgcgccacccgtaactacccgccttcaaccgaacccgaaaccccgtaacgacccataccctaacgaaaaacgcaactacgaaactaacgaaacgtcgcgcgtaaaaaaaaacctaaaacaccccgactacgacgactacgcacacccgatccgaacgcgaaaccccgcgaacgcgcgcctcgaaactcccgcctcctcctcttactcctcctcgacgtacgatcctcccctaacccctccttccacccgccgaaaaaatacgctccccgacgcccaacaacaaaaaccaccgctcccaaaaatacatacgaccgatccccttctcccgaaccccaaaaaccgacgcccccgccctataaataaataataaaacgaaacccaaccctcgccgccgcccgccgctaatactaccgccgaaaaaccgcgaacaaaatccaaaaccgaccaaacttacctcccgccgaaaactcgataaaacgctcgaaaatatactaataacgctaaacgtaaccccctataaacctaaaaacctctacttaaactcgaaaaaccgaacgaaaacgaaaaaaaaattaacccttccccgcccaccc

SEQ ID NO: 26725 - DNA, 610 bp, Artificial Sequence
  chemically treated genomic DNA (Homo sapiens) CpG-island No: 26725
tagtcgcgtatcgcgtttcgtagagtagtttcgtattaaaagtatttttgatgtatttggaaagcgtaagcgagagtttcgtttgtgttatttggaggcggtcgttttttttaggagcgtagcgagcgagagcgaaatcgagaggcggtaatatttttaggagttgcgagcgcgtttagatagtaaatagcgatttcgttttttttagatttttgtcgtttgcgtttattatttttttttcgcgattttttttgcgtcgttgttattttagttgcggtggtttcgaattggcggtttttgttgttatatacgttcgtgtttttggagttttagtagttgtgcggggaaaatgtttttagtattttttttatatcgggtttttttgcgttttcggggtttagagcggtacgttcgttatattttttttatttgtatagggcgtcgttttttttgttttttttcgttcgtagggtacgtagttgattagtttagtagttagtgcgggacgattgtcggtgagcgtgaggttttgggttgtatgtgcggatattgtgtgcgttcgtagatgcgtgtatttatatatatatttaatttatgtacgttttttttt

SEQ ID NO: 26726 - DNA, 610 bp, Artificial Sequence
  chemically treated genomic DNA (Homo sapiens) CpG-island No: 26726
aaaaaaaaacgtacataaattaaatatatatataaatacacgcatctacgaacgcacacaatatccgcacatacaacccaaaacctcacgctcaccgacaatcgtcccgcactaactactaaactaatcaactacgtaccctacgaacgaaaaaaaacaaaaaaaacgacgccctatacaaataaaaaaaatataacgaacgtaccgctctaaaccccgaaaacgcaaaaaaacccgatataaaaaaaatactaaaaacattttccccgcacaactactaaaactccaaaaacacgaacgtatataacaacaaaaaccgccaattcgaaaccaccgcaactaaaataacaacgacgcaaaaaaaatcgcgaaaaaaaaataataaacgcaaacgacaaaaatctaaaaaaaacgaaatcgctatttactatctaaacgcgctcgcaactcctaaaaatattaccgcctctcgatttcgctctcgctcgctacgctcctaaaaaaaacgaccgcctccaaataacacaaacgaaactctcgcttacgctttccaaatacatcaaaaatacttttaatacgaaactactctacgaaacgcgatacgcgacta

SEQ ID NO: 26727 - DNA, 610 bp, Artificial Sequence
  chemically treated genomic DNA (Homo sapiens) CpG-island No: 26727
gggagggggcgtatataaattaaatgtatgtataaatatacgtatttacgggcgtatatagtattcgtatatatagtttaggattttacgtttatcggtagtcgtttcgtattaattgttgggttagttagttgcgtgttttgcgggcgggggagggtagagggggcggcgttttatgtagatgaggagggtgtggcgaacgtgtcgttttgggtttcggaagcgtagagaagttcggtataaaaaaagtattgaagatatttttttcgtataattgttaaagttttagagatacgagcgtgtgtggtagtaagagtcgttagttcgggattatcgtagttggggtggtagcggcgtaggaggggtcgcggggagggagtggtgagcgtaggcggtaggggtttgggaaagacgaagtcgttatttgttgtttgagcgcgttcgtagtttttggaagtgttgtcgtttttcggtttcgttttcgttcgttgcgtttttagaaggggcggtcgtttttaggtgatatagacgggattttcgtttgcgttttttagatgtattagagatatttttggtgcggggttgttttgcggggcgcggtgcgcggttg

SEQ ID NO: 26728 - DNA, 610 bp, Artificial Sequence
  chemically treated genomic DNA (Homo sapiens) CpG-island No: 26728
caaccgcgcaccgcgccccgcaaaacaaccccgcaccaaaaatatctctaatacatctaaaaaacgcaaacgaaaatcccgtctatatcacctaaaaacgaccgccccttctaaaaacgcaacgaacgaaaacgaaaccgaaaaacgacaacacttccaaaaactacgaacgcgctcaaacaacaaataacgacttcgtctttcccaaacccctaccgcctacgctcaccactccctccccgcgacccctcctacgccgctaccaccccaactacgataatcccgaactaacgactcttactaccacacacgctcgtatctctaaaactttaacaattatacgaaaaaaatatcttcaatactttttttataccgaacttctctacgcttccgaaacccaaaacgacacgttcgccacaccctcctcatctacataaaacgccgccccctctaccctcccccgcccgcaaaacacgcaactaactaacccaacaattaatacgaaacgactaccgataaacgtaaaatcctaaactatatatacgaatactatatacgcccgtaaatacgtatatttatacatacatttaatttatatacgccccctccc

SEQ ID NO: 26729 - DNA, 723 bp, Artificial Sequence
  chemically treated genomic DNA (Homo sapiens) CpG-island No: 26729
tcgggtatcgtttcgggatcgattgggggcgtttttttcgtcggttttttttgtttttagtgtcgagttcgcggttttgttttttttttaggtttcgtttttttttttaggtttcgtttttcgttcgggtcgaggcgcgcggtcgcgcgtgcgttcgttcgttcgttttcgtttcgcgtatgcgtcgcgttcgttcgcgggagggtatggcgggggtcgtgtcgggcgttattatggacgaggattattacgggagcgcggtcgagtggggcgattaggttgacggcggttaggtgaggcggggtattgggcgtattttagagagaatcgttcgttttcgtcgtcggcgggtcggttttattttcggagaggtcgcgcggcgcgaggttgcgggcgtgcggggggtgtgcgcgcgtacggttcgcgcggttatcgtgtggtttaagtatagttcgtttcgttttcgttcgttcggggtttcgcggcgcggtcgtcggggttttcgttttttcgtttgtaggattttggggtgggggtgaggcgtcggaggttttggcgcggggcggttcgaggtttttagtattttttcgtttcggttaggttcggcgtcggttttgcgattttcgcggcgggcgggatattaacgttaaggtggagggttgggttcggagtttatagatttttaaataaaaataaagtggaaaaattttatagtagtattat

SEQ ID NO: 26730 - DNA, 723 bp, Artificial Sequence
  chemically treated genomic DNA (Homo sapiens) CpG-island No: 26730
ataatactactataaaatttttccactttatttttatttaaaaatctataaactccgaacccaaccctccaccttaacgttaatatcccgcccgccgcgaaaatcgcaaaaccgacgccgaacctaaccgaaacgaaaaaatactaaaaacctcgaaccgccccgcgccaaaacctccgacgcctcacccccaccccaaaatcctacaaacgaaaaaacgaaaaccccgacgaccgcgccgcgaaaccccgaacgaacgaaaacgaaacgaactatacttaaaccacacgataaccgcgcgaaccgtacgcgcgcacaccccccgcacgcccgcaacctcgcgccgcgcgacctctccgaaaataaaaccgacccgccgacgacgaaaacgaacgattctctctaaaatacgcccaataccccgcctcacctaaccgccgtcaacctaatcgccccactcgaccgcgctcccgtaataatcctcgtccataataacgcccgacacgacccccgccataccctcccgcgaacgaacgcgacgcatacgcgaaacgaaaacgaacgaacgaacgcacgcgcgaccgcgcgcctcgacccgaacgaaaaacgaaacctaaaaaaaaaaacgaaacctaaaaaaaaaacaaaaccgcgaactcgacactaaaaacaaaaaaaaccgacgaaaaaaacgcccccaatcgatcccgaaacgatacccga

SEQ ID NO: 26731 - DNA, 723 bp, Artificial Sequence
  chemically treated genomic DNA (Homo sapiens) CpG-island No: 26731
atgatgttgttgtgaagtttttttattttatttttgtttaaaagtttgtgagtttcggatttaattttttattttagcgttggtgtttcgttcgtcgcgggggtcgtagggtcggcgtcgggtttggtcggagcgagggggtattgggggtttcgggtcgtttcgcgttagagttttcggcgttttatttttattttaaggttttgtaggcgaggaggcggggatttcggcggtcgcgtcgcgggatttcgggcgggcgggggcggggcgggttgtgtttgaattatacggtgatcgcgcgggtcgtgcgcgcgtatatttttcgtacgttcgtagtttcgcgtcgcgcggttttttcgggagtggggtcggttcgtcggcggcggagacgaacgattttttttagggtgcgtttagtgtttcgttttatttggtcgtcgttagtttggtcgttttattcggtcgcgttttcgtagtagttttcgtttatgatggcgttcggtacggttttcgttatgttttttcgcgagcgagcgcggcgtatgcgcgaggcggggacgggcgggcgggcgtacgcgcggtcgcgcgtttcggttcgggcgggaggcggggtttggaagaaggggcggggtttggaggaagggtagggtcgcgggttcggtattgggaataaaggggatcggcggaaggaacgtttttagtcgatttcggagcgatgttcgg

SEQ ID NO: 26732 - DNA, 723 bp, Artificial Sequence
  chemically treated genomic DNA (Homo sapiens) CpG-island No: 26732
ccgaacatcgctccgaaatcgactaaaaacgttccttccgccgatcccctttattcccaataccgaacccgcgaccctacccttcctccaaaccccgccccttcttccaaaccccgcctcccgcccgaaccgaaacgcgcgaccgcgcgtacgcccgcccgcccgtccccgcctcgcgcatacgccgcgctcgctcgcgaaaaaacataacgaaaaccgtaccgaacgccatcataaacgaaaactactacgaaaacgcgaccgaataaaacgaccaaactaacgacgaccaaataaaacgaaacactaaacgcaccctaaaaaaaatcgttcgtctccgccgccgacgaaccgaccccactcccgaaaaaaccgcgcgacgcgaaactacgaacgtacgaaaaatatacgcgcgcacgacccgcgcgatcaccgtataattcaaacacaacccgccccgcccccgcccgcccgaaatcccgcgacgcgaccgccgaaatccccgcctcctcgcctacaaaaccttaaaataaaaataaaacgccgaaaactctaacgcgaaacgacccgaaacccccaataccccctcgctccgaccaaacccgacgccgaccctacgacccccgcgacgaacgaaacaccaacgctaaaataaaaaattaaatccgaaactcacaaacttttaaacaaaaataaaataaaaaaacttcacaacaacatcat

SEQ ID NO: 26733 - DNA, 523 bp, Artificial Sequence
  chemically treated genomic DNA (Homo sapiens) CpG-island No: 26733
ttcggcggaagtagaggtcgttttgcgtcgcgttcgttagtagtacgagtagtagaagcggtcgttattttggttcgcgtttcgttatggtttcgcgtcggtttttgggtttcgtttcggatttcgtttcgagttttagatttcgcgtcggttttcgttttggatttcgtttcggtttcggtttcggtttagtattcggtcgatttcgtattttgggtttttgtttcgttcggtttttaaggttgcggcggttaggtcgggatattttttcggggcggggttgttttatcgttgtttttgtttcgttcggtgatttttgtttttttcgttcggtttcgcgtttcgttttttttttggtttcggggtatttgaattcgcgggttaggcgcgaggtcgtcgggtagattttagtttgatttcgtcgtcggtcgtcgttttgagcgcgggattgttcggttggatttatttgtcggggtttttggtttcggggtggggggtcgtaggtttatgggtttttttggtt

SEQ ID NO: 26734 - DNA, 523 bp, Artificial Sequence
  chemically treated genomic DNA (Homo sapiens) CpG-island No: 26734
aaccaaaaaaacccataaacctacgaccccccaccccgaaaccaaaaaccccgacaaataaatccaaccgaacaatcccgcgctcaaaacgacgaccgacgacgaaatcaaactaaaatctacccgacgacctcgcgcctaacccgcgaattcaaataccccgaaaccaaaaaaaaaacgaaacgcgaaaccgaacgaaaaaaacaaaaatcaccgaacgaaacaaaaacaacgataaaacaaccccgccccgaaaaaatatcccgacctaaccgccgcaaccttaaaaaccgaacgaaacaaaaacccaaaatacgaaatcgaccgaatactaaaccgaaaccgaaaccgaaacgaaatccaaaacgaaaaccgacgcgaaatctaaaactcgaaacgaaatccgaaacgaaacccaaaaaccgacgcgaaaccataacgaaacgcgaaccaaaataacgaccgcttctactactcgtactactaacgaacgcgacgcaaaacgacctctacttccgccgaa

SEQ ID NO: 26735 - DNA, 523 bp, Artificial Sequence
  chemically treated genomic DNA (Homo sapiens) CpG-island No: 26735
ggttaagggggtttatgagtttgcggttttttatttcgaagttaggaatttcggtaaatgagtttagtcggatagtttcgcgtttagggcggcggtcggcggcggggttaggttggggtttgttcggcgatttcgcgtttggttcgcgagtttaggtgtttcggagttagggagggagcggggcgcggagtcgggcggggagggtaggggttatcgggcggggtaggagtagcgatgggatagtttcgtttcgggggagtgtttcggtttggtcgtcgtagttttaagggtcgggcggggtaggggtttaaagtgcggggtcggtcgggtgttgggtcgaggtcgaggtcggggcgggatttagagcgggagtcggcgcgggatttgggattcggagcgggattcggagcgggatttaggagtcggcgcggggttatggcgaggcgcgggttagggtggcggtcgtttttgttgttcgtgttgttggcgggcgcggcgtagggcggtttttattttcgtcggg

SEQ ID NO: 26736 - DNA, 523 bp, Artificial Sequence
  chemically treated genomic DNA (Homo sapiens) CpG-island No: 26736
cccgacgaaaataaaaaccgccctacgccgcgcccgccaacaacacgaacaacaaaaacgaccgccaccctaacccgcgcctcgccataaccccgcgccgactcctaaatcccgctccgaatcccgctccgaatcccaaatcccgcgccgactcccgctctaaatcccgccccgacctcgacctcgacccaacacccgaccgaccccgcactttaaacccctaccccgcccgacccttaaaactacgacgaccaaaccgaaacactcccccgaaacgaaactatcccatcgctactcctaccccgcccgataacccctaccctccccgcccgactccgcgccccgctccctccctaactccgaaacacctaaactcgcgaaccaaacgcgaaatcgccgaacaaaccccaacctaaccccgccgccgaccgccgccctaaacgcgaaactatccgactaaactcatttaccgaaattcctaacttcgaaataaaaaaccgcaaactcataaacccccttaacc

SEQ ID NO: 26737 - DNA, 565 bp, Artificial Sequence
  chemically treated genomic DNA (Homo sapiens) CpG-island No: 26737
ttgtagcgaaagcggagttcgtcgggtcgaatcgttaagacgtcggtaatgtcggtttagtcgggcggtttagtcgtaggaagattagattatagaagcggaagaggcggggcgtgcggatttgttaattatcgttttttattcggtttcgtttttgagtacggtttttgttgttttgtcgcggaagtttttcggcgtcgggagttaatgggcgcgcgcggtttggattgcgggtgttaatttcggggcgggtcggtcggtcgcgtttatttattggttttaagagttttcggggcgtgtgtttttcgatttttcgtattatttcggcggggacgacgggggtaagaaggtcggggtgttttcgttcgttaaggattattgagtcgcgtgttttcgggaagcgaggacgcgaggcggcgcgggtacggtcgtttcgagggtttggttttgcgttcgttttagggaaacggcgtcggtttttttaaatttgtggatagataagcgtgttttgagagttgagatttagaaaggtttttagggtattttttttttcggagtgatatta

SEQ ID NO: 26738 - DNA, 565 bp, Artificial Sequence
  chemically treated genomic DNA (Homo sapiens) CpG-island No: 26738
taatatcactccgaaaaaaaaaataccctaaaaacctttctaaatctcaactctcaaaacacgcttatctatccacaaatttaaaaaaaccgacgccgtttccctaaaacgaacgcaaaaccaaaccctcgaaacgaccgtacccgcgccgcctcgcgtcctcgcttcccgaaaacacgcgactcaataatccttaacgaacgaaaacaccccgaccttcttacccccgtcgtccccgccgaaataatacgaaaaatcgaaaaacacacgccccgaaaactcttaaaaccaataaataaacgcgaccgaccgacccgccccgaaattaacacccgcaatccaaaccgcgcgcgcccattaactcccgacgccgaaaaacttccgcgacaaaacaacaaaaaccgtactcaaaaacgaaaccgaataaaaaacgataattaacaaatccgcacgccccgcctcttccgcttctataatctaatcttcctacgactaaaccgcccgactaaaccgacattaccgacgtcttaacgattcgacccgacgaactccgctttcgctacaa

SEQ ID NO: 26739 - DNA, 565 bp, Artificial Sequence
  chemically treated genomic DNA (Homo sapiens) CpG-island No: 26739
tagtgttatttcgagaaagggggtgttttaagagtttttttaaattttagtttttaggatacgtttgtttgtttatagatttaaaaaagtcggcgtcgtttttttgaagcgggcgtaaagttaggttttcggggcggtcgtgttcgcgtcgtttcgcgttttcgtttttcgaaagtacgcggtttagtggtttttagcgagcggggatatttcggtttttttgttttcgtcgttttcgtcggggtaatacggaaggtcgggggatatacgtttcgggagtttttggagttaataggtgggcgcggtcggtcggttcgtttcgggattggtattcgtagtttagatcgcgcgcgtttattggttttcggcgtcggggggttttcgcggtagggtagtaggggtcgtgtttaggggcggggtcgggtaggaggcggtgattggtaggttcgtacgtttcgtttttttcgtttttgtggtttgatttttttgcggttgaatcgttcggttgagtcgatattgtcggcgttttggcgattcggttcgacgagtttcgttttcgttatag

SEQ ID NO: 26740 - DNA, 565 bp, Artificial Sequence
  chemically treated genomic DNA (Homo sapiens) CpG-island No: 26740
ctataacgaaaacgaaactcgtcgaaccgaatcgccaaaacgccgacaatatcgactcaaccgaacgattcaaccgcaaaaaaatcaaaccacaaaaacgaaaaaaacgaaacgtacgaacctaccaatcaccgcctcctacccgaccccgcccctaaacacgacccctactaccctaccgcgaaaaccccccgacgccgaaaaccaataaacgcgcgcgatctaaactacgaataccaatcccgaaacgaaccgaccgaccgcgcccacctattaactccaaaaactcccgaaacgtatatcccccgaccttccgtattaccccgacgaaaacgacgaaaacaaaaaaaccgaaatatccccgctcgctaaaaaccactaaaccgcgtactttcgaaaaacgaaaacgcgaaacgacgcgaacacgaccgccccgaaaacctaactttacgcccgcttcaaaaaaacgacgccgacttttttaaatctataaacaaacaaacgtatcctaaaaactaaaatttaaaaaaactcttaaaacaccccctttctcgaaataacacta

SEQ ID NO: 26741 - DNA, 533 bp, Artificial Sequence
  chemically treated genomic DNA (Homo sapiens) CpG-island No: 26741
tttgtgtgcggggtgggggggggtggtggagagcgggggcggggatttagcgcgtgtatgtaaaggtgtagttcgtgtgttaggcgttgggtgcgcgcgcggtgtttgttcgggtgcgcgcgcgcgtcgttgttcgtttgttcgtcggttcgtttgttcgtttgttggggttgtttcgtgggtttgacgggcgagcgggcgcggaggagttttgttcggaattatatagatattatcgtggaaatagtagcgtaggttacggcgtcgcgggttttgtattagacgttgggttttagaggtgggtgaatttttagcgggggttgtataagttgtatcgatacgcgtgttgtttttttttcgtttagtttagtagcgcgtgtgtttgcgtgtgtgtgtgtgagagatagagagagagagagagatttcgcgcgcgcgtacgcgagtcgagggggtaggtagtttattatttttagtttgggttttgttggtttggggtcggttgagtggttaaagtggtcgaggtggttaatttt

SEQ ID NO: 26742 - DNA, 533 bp, Artificial Sequence
  chemically treated genomic DNA (Homo sapiens) CpG-island No: 26742
aaaattaaccacctcgaccactttaaccactcaaccgaccccaaaccaacaaaacccaaactaaaaataataaactacctaccccctcgactcgcgtacgcgcgcgcgaaatctctctctctctctctatctctcacacacacacacgcaaacacacgcgctactaaactaaacgaaaaaaaaacaacacgcgtatcgatacaacttatacaacccccgctaaaaattcacccacctctaaaacccaacgtctaatacaaaacccgcgacgccgtaacctacgctactatttccacgataatatctatataattccgaacaaaactcctccgcgcccgctcgcccgtcaaacccacgaaacaaccccaacaaacgaacaaacgaaccgacgaacaaacgaacaacgacgcgcgcgcgcacccgaacaaacaccgcgcgcgcacccaacgcctaacacacgaactacacctttacatacacgcgctaaatccccgcccccgctctccaccacccccccccaccccgcacacaaa

SEQ ID NO: 26743 - DNA, 533 bp, Artificial Sequence
  chemically treated genomic DNA (Homo sapiens) CpG-island No: 26743
aggattagttatttcggttattttggttatttaatcggttttaaattaataggatttaaattaaaaataataagttatttgttttttcggttcgcgtgcgcgcgcgcgagatttttttttttttttttgttttttatatatatatacgtaggtatacgcgttattgagttgagcggggaagaggtagtacgcgtgtcggtgtagtttgtgtagttttcgttgaaaatttatttatttttagagtttagcgtttggtgtagggttcgcggcgtcgtgatttgcgttgttgtttttacgatggtatttatgtgatttcggatagagttttttcgcgttcgttcgttcgttaaatttacggagtagttttagtaggcgagtaggcgggtcggcgggtaggcgggtagcggcgcgcgcgcgtattcgagtagatatcgcgcgcgtatttagcgtttagtatacgggttgtatttttatatatacgcgttgaattttcgttttcgttttttattatttttttttatttcgtatataag

SEQ ID NO: 26744 - DNA, 533 bp, Artificial Sequence
  chemically treated genomic DNA (Homo sapiens) CpG-island No: 26744
cttatatacgaaataaaaaaaaataataaaaaacgaaaacgaaaattcaacgcgtatatataaaaatacaacccgtatactaaacgctaaatacgcgcgcgatatctactcgaatacgcgcgcgcgccgctacccgcctacccgccgacccgcctactcgcctactaaaactactccgtaaatttaacgaacgaacgaacgcgaaaaaactctatccgaaatcacataaataccatcgtaaaaacaacaacgcaaatcacgacgccgcgaaccctacaccaaacgctaaactctaaaaataaataaattttcaacgaaaactacacaaactacaccgacacgcgtactacctcttccccgctcaactcaataacgcgtatacctacgtatatatatataaaaaacaaaaaaaaaaaaaaaaatctcgcgcgcgcgcacgcgaaccgaaaaaacaaataacttattatttttaatttaaatcctattaatttaaaaccgattaaataaccaaaataaccgaaataactaatcct

SEQ ID NO: 26745 - DNA, 607 bp, Artificial Sequence
  chemically treated genomic DNA (Homo sapiens) CpG-island No: 26745
cgtattcgtgcgtcgagagtttttaagttcgtttttttttattttttcggtttagcgtttattttttcgaatcgcggtcgttgggagcggggttcgatttcgtgatgtcgcgtgggtgtcggttagagaagagtttcggaggtcggggcggtcggcgggcgtgcggtgagcgtttcggggcgggggtcggggcgggatcgagcgttgttatcggggttggatttttcgatttttattcggattttttttcggttttttcggtcgattcggtgttgttcggcgattacgtgacgcgggttgtttttgatttttattttcgagcgggtagggggcgggggtcggagggggtgttagatgtaggatttacgagggtcggggcggttgtttggcgttttcgaggcggtgattttcgggaaataaagttcggggggaaattaataagttattcggggttagagacgaaatagcgttgggggtcgggagaggcggtagagagaatgtgggagataaagattcgcgttcgcggcggtttcgagggttttgggaacgttttggttgggttcgagagggtttttaggtttttttatttttgggtttgtgatagttt

SEQ ID NO: 26746 - DNA, 607 bp, Artificial Sequence
  chemically treated genomic DNA (Homo sapiens) CpG-island No: 26746
aaactatcacaaacccaaaaataaaaaaacctaaaaaccctctcgaacccaaccaaaacgttcccaaaaccctcgaaaccgccgcgaacgcgaatctttatctcccacattctctctaccgcctctcccgacccccaacgctatttcgtctctaaccccgaataacttattaatttccccccgaactttatttcccgaaaatcaccgcctcgaaaacgccaaacaaccgccccgaccctcgtaaatcctacatctaacaccccctccgacccccgccccctacccgctcgaaaataaaaatcaaaaacaacccgcgtcacgtaatcgccgaacaacaccgaatcgaccgaaaaaaccgaaaaaaaatccgaataaaaatcgaaaaatccaaccccgataacaacgctcgatcccgccccgacccccgccccgaaacgctcaccgcacgcccgccgaccgccccgacctccgaaactcttctctaaccgacacccacgcgacatcacgaaatcgaaccccgctcccaacgaccgcgattcgaaaaaataaacgctaaaccgaaaaaataaaaaaaaacgaacttaaaaactctcgacgcacgaatacg

SEQ ID NO: 26747 - DNA, 607 bp, Artificial Sequence
  chemically treated genomic DNA (Homo sapiens) CpG-island No: 26747
gagttgttataagtttaggggtggaagagtttggaggttttttcgagtttagttagagcgtttttagggttttcggagtcgtcgcgggcgcgggtttttgttttttatattttttttgtcgtttttttcgatttttagcgttgtttcgtttttgatttcgaataatttgttggttttttttcgggttttgtttttcgggggttatcgtttcggggacgttaggtagtcgtttcggttttcgtgggttttgtatttgatatttttttcggttttcgttttttattcgttcggagataggggttaaaggtagttcgcgttacgtggtcgtcgagtagtatcgaatcggtcgggagggtcgagggagaattcgggtggaagtcgagaaatttagtttcgatagtagcgttcggtttcgtttcggttttcgtttcggggcgtttatcgtacgttcgtcggtcgtttcggttttcggagtttttttttggtcggtatttacgcggtattacgggatcgaatttcgtttttagcggtcgcgattcggggaggtaggcgttgggtcgaggaggtaaggggagacgggtttgggggttttcggcgtacgggtacg

SEQ ID NO: 26748 - DNA, 607 bp, Artificial Sequence
  chemically treated genomic DNA (Homo sapiens) CpG-island No: 26748
cgtacccgtacgccgaaaacccccaaacccgtctccccttacctcctcgacccaacgcctacctccccgaatcgcgaccgctaaaaacgaaattcgatcccgtaataccgcgtaaataccgaccaaaaaaaaactccgaaaaccgaaacgaccgacgaacgtacgataaacgccccgaaacgaaaaccgaaacgaaaccgaacgctactatcgaaactaaatttctcgacttccacccgaattctccctcgaccctcccgaccgattcgatactactcgacgaccacgtaacgcgaactacctttaacccctatctccgaacgaataaaaaacgaaaaccgaaaaaaatatcaaatacaaaacccacgaaaaccgaaacgactacctaacgtccccgaaacgataacccccgaaaaacaaaacccgaaaaaaaaccaacaaattattcgaaatcaaaaacgaaacaacgctaaaaatcgaaaaaaacgacaaaaaaaatataaaaaacaaaaacccgcgcccgcgacgactccgaaaaccctaaaaacgctctaactaaactcgaaaaaacctccaaactcttccacccctaaacttataacaactc

SEQ ID NO: 26749 - DNA, 688 bp, Artificial Sequence
  chemically treated genomic DNA (Homo sapiens) CpG-island No: 26749
aaagcgcgggtttgattatcggacgtggagacgttgtcgttgcgtttttggcggtcgagcgtaggcggcggacggttgggagttagcggggtagcgggttcggggtttttgggcggtaggaacggtacgttcgttaggagtaggtagggtgttcgagcggtcgtcggcggttgcgtgtcgaagttatagaggaggtcgagttttagcggtagggttttacgcgttaggttggagtcgttaagtttcgggttcgggtacggcgcgattgtcggattttcgtagttagatttttgttttgggttagcgggcgtcggtagttcggtttttaagtttagtaggttcgtgatggcgaagtttcgggggcgcgagtttttaggggaatcgttaggtattagcgttttgttgttagtgcgttcgtcggaaagcgagtttcggtcggttatggttttttagtaagtaaggcgcgagtttttttggatttcgtttgcggagggtttagtttagaggaagttttataggattgggttgtcggtcgggcgcgggaggtttgaagggttttaattagttgggcgcgggcgcgtcgtcgtttcggatttcgcgagatggggacgttattagttttttttttttcggttatcgtttatttagttgtagtttttttagttatttttttttttttttttttttt

SEQ ID NO: 26750 - DNA, 688 bp, Artificial Sequence
  chemically treated genomic DNA (Homo sapiens) CpG-island No: 26750
aaaaaaaaaaaaaaaaaaaaaataactaaaaaaactacaactaaataaacgataaccgaaaaaaaaaaaactaataacgtccccatctcgcgaaatccgaaacgacgacgcgcccgcgcccaactaattaaaacccttcaaacctcccgcgcccgaccgacaacccaatcctataaaacttcctctaaactaaaccctccgcaaacgaaatccaaaaaaactcgcgccttacttactaaaaaaccataaccgaccgaaactcgctttccgacgaacgcactaacaacaaaacgctaatacctaacgattcccctaaaaactcgcgcccccgaaacttcgccatcacgaacctactaaacttaaaaaccgaactaccgacgcccgctaacccaaaacaaaaatctaactacgaaaatccgacaatcgcgccgtacccgaacccgaaacttaacgactccaacctaacgcgtaaaaccctaccgctaaaactcgacctcctctataacttcgacacgcaaccgccgacgaccgctcgaacaccctacctactcctaacgaacgtaccgttcctaccgcccaaaaaccccgaacccgctaccccgctaactcccaaccgtccgccgcctacgctcgaccgccaaaaacgcaacgacaacgtctccacgtccgataatcaaacccgcgcttt

SEQ ID NO: 26751 - DNA, 688 bp, Artificial Sequence
  chemically treated genomic DNA (Homo sapiens) CpG-island No: 26751
agaagagaggaggagaaggaggtgattgaggggattgtagttgggtgggcggtaatcgaggggaggggaattggtggcgtttttatttcgcggggttcggaacggcgacgcgttcgcgtttagttgattggagttttttaggtttttcgcgttcgatcggtagtttaattttataaagttttttttaagttgggtttttcgtaaacgggatttagagaggttcgcgttttgtttgttaaggaattatgatcggtcgggattcgtttttcgacgggcgtattagtagtagggcgttggtgtttggcggtttttttaggggttcgcgttttcggggtttcgttattacggatttgttgggtttggaggtcgagttgtcggcgttcgttggtttaggatagggatttggttgcgagggttcggtagtcgcgtcgtgttcgggttcggggtttgacggttttagtttggcgcgtggggttttatcgttgggattcggttttttttgtggtttcggtacgtagtcgtcggcggtcgttcgagtattttgtttgtttttagcggacgtgtcgtttttgtcgtttaggggtttcgagttcgttgtttcgttggtttttagtcgttcgtcgtttgcgttcggtcgttagaagcgtagcgatagcgtttttacgttcggtaattaggttcgcgtttt

SEQ ID NO: 26752 - DNA, 688 bp, Artificial Sequence
  chemically treated genomic DNA (Homo sapiens) CpG-island No: 26752
aaaacgcgaacctaattaccgaacgtaaaaacgctatcgctacgcttctaacgaccgaacgcaaacgacgaacgactaaaaaccaacgaaacaacgaactcgaaacccctaaacgacaaaaacgacacgtccgctaaaaacaaacaaaatactcgaacgaccgccgacgactacgtaccgaaaccacaaaaaaaaccgaatcccaacgataaaaccccacgcgccaaactaaaaccgtcaaaccccgaacccgaacacgacgcgactaccgaaccctcgcaaccaaatccctatcctaaaccaacgaacgccgacaactcgacctccaaacccaacaaatccgtaataacgaaaccccgaaaacgcgaacccctaaaaaaaccgccaaacaccaacgccctactactaatacgcccgtcgaaaaacgaatcccgaccgatcataattccttaacaaacaaaacgcgaacctctctaaatcccgtttacgaaaaacccaacttaaaaaaaactttataaaattaaactaccgatcgaacgcgaaaaacctaaaaaactccaatcaactaaacgcgaacgcgtcgccgttccgaaccccgcgaaataaaaacgccaccaattcccctcccctcgattaccgcccacccaactacaatcccctcaatcacctccttctcctcctctcttct

SEQ ID NO: 26753 - DNA, 515 bp, Artificial Sequence
  chemically treated genomic DNA (Homo sapiens) CpG-island No: 26753
gggaggatatttttatagttttttatagtgagaaacgttttttattcgacgttgcgtttatttgtgttttcgttgttgtcggggttttggtatttatttgcgcgttttatgtggtggggatttatttagagtttagcgttaagttatacgggcgttttatttagcgttagttaagattagggaagcgttttttgtcgtttaggagacgtttgtaagagataaaaagttagtttacgatttatttataattttcgtgttttcggggtgttttcgtagttgttaaatttacgggtcgcgtttaggggaagttttcgcgttttggcggttaaaagaatgggttttttttagtttttttttatcggatattatttgtaaatttattgttagaggcgtagttttcgcgaacgttttcgtttcgggcggtttttaggagtcgttttgggtttttaaattcgttgagggtttcgaatttgtttttattagttaggattattcgggatttaattaatgaataa

SEQ ID NO: 26754 - DNA, 515 bp, Artificial Sequence
  chemically treated genomic DNA (Homo sapiens) CpG-island No: 26754
ttattcattaattaaatcccgaataatcctaactaataaaaacaaattcgaaaccctcaacgaatttaaaaacccaaaacgactcctaaaaaccgcccgaaacgaaaacgttcgcgaaaactacgcctctaacaataaatttacaaataatatccgataaaaaaaaactaaaaaaaacccattcttttaaccgccaaaacgcgaaaacttcccctaaacgcgacccgtaaatttaacaactacgaaaacaccccgaaaacacgaaaattataaataaatcgtaaactaactttttatctcttacaaacgtctcctaaacgacaaaaaacgcttccctaatcttaactaacgctaaataaaacgcccgtataacttaacgctaaactctaaataaatccccaccacataaaacgcgcaaataaataccaaaaccccgacaacaacgaaaacacaaataaacgcaacgtcgaataaaaaacgtttctcactataaaaaactataaaaatatcctccc

SEQ ID NO: 26755 - DNA, 515 bp, Artificial Sequence
  chemically treated genomic DNA (Homo sapiens) CpG-island No: 26755
ttatttattagttaaatttcgggtaattttggttgatgaagatagattcggaatttttaacggatttagggatttaaaacgatttttgggggtcgttcggggcgggaacgttcgcgggagttgcgtttttggtaatagatttgtaggtggtattcggtagggggaagttggaaggagtttatttttttggtcgttaggacgcggaggttttttttaaacgcggttcgtaggtttggtaattgcgagggtatttcggggatacgaggattgtgggtggatcgtgggttagttttttattttttgtagacgttttttaaacggtaagaagcgtttttttggttttggttgacgttgagtgaagcgttcgtataatttgacgttgggttttgggtggatttttattatatagggcgcgtaagtggatattagagtttcggtaatagcggggatatagatgagcgtagcgtcgggtggggggcgttttttattgtaggaggttatgaaaatgttttttt

SEQ ID NO: 26756 - DNA, 515 bp, Artificial Sequence
  chemically treated genomic DNA (Homo sapiens) CpG-island No: 26756
aaaaaaacattttcataacctcctacaataaaaaacgccccccacccgacgctacgctcatctatatccccgctattaccgaaactctaatatccacttacgcgccctatataataaaaatccacccaaaacccaacgtcaaattatacgaacgcttcactcaacgtcaaccaaaaccaaaaaaacgcttcttaccgtttaaaaaacgtctacaaaaaataaaaaactaacccacgatccacccacaatcctcgtatccccgaaataccctcgcaattaccaaacctacgaaccgcgtttaaaaaaaacctccgcgtcctaacgaccaaaaaaataaactccttccaacttccccctaccgaataccacctacaaatctattaccaaaaacgcaactcccgcgaacgttcccgccccgaacgacccccaaaaatcgttttaaatccctaaatccgttaaaaattccgaatctatcttcatcaaccaaaattacccgaaatttaactaataaataa

SEQ ID NO: 26757 - DNA, 1186 bp, Artificial Sequence
  chemically treated genomic DNA (Homo sapiens) CpG-island No: 26757
tcggcgattagggattggggacggggttcgagcgtttttcgttaggttagtcgtatttgtggttatgttaggggcgtcgatggtaaggaaagggcgagtatcggttttagtttcgaaatttggttttttcgggtcgcgattttaattcgtagttttttacgtaggttcgggtttagcggtttttttcggaggaagggcggagatcgtatttattgaggggcggtcggtcgtagggaggagggaggtcgaatttttcggttcgggcgttttaagttggagttagcgtaggttcgtagtcgtttttttcggttcggcggttcggttttcgttagttagttcgtcggttattcgtcggtcgttttgcgggtttcgcgtttttgtttattttttgcgggcgtttcggcgttcgcgtttacgtacgcgatttcgggagtaatgcgttcgcgttttttttatattcgggagtatcgggcgcgcggtgtttcggatttagtcgttatcgtcgtcgatttttattcggtgttttcgtcgttcggcggttttttgtttcggtcgtcgttttttttttcgttgttcgtatcggttttagcgtcgtttttcgtagttttcgttttcgcgtttttatttcgatcggtttgggttgtttttttttagtcgtcgtaattgtagttcggtttttcgtttttttttttcggtttttttttttttaataattttttttacgtattttggtttcggcgtcgtttttttcgtcgcgcgttcggatgtgaggtggttgtagcggtgtcgggcgaaaaagaagtatcgtcgcgcgtttttcggacgttagtttttgcgcgggtcggggggtgggaaggtggtggcggcgaggaggaggttacggtggggatagcggaaattcgttttcgtgcgcgtaggcggtcgtcgtgggtagtttagaggttatcgtcgtcgcgtttttacgcgcgttgtagggtagagcggacggtatttgggattcgcgattcgcggtacgttattttttcggaggcggtggttagatggggttgggttggcggttagtacggtttgtggcgcgacgatcgttgtatttgtatggttcgtataggtagagaatcgtggggtttcggtagtgggaatttgagataggagattggggtttttcgagtttttttagtgcgggttt

SEQ ID NO: 26758 - DNA, 1186 bp, Artificial Sequence
  chemically treated genomic DNA (Homo sapiens) CpG-island No: 26758
aaacccgcactaaaaaaactcgaaaaaccccaatctcctatctcaaattcccactaccgaaaccccacgattctctacctatacgaaccatacaaatacaacgatcgtcgcgccacaaaccgtactaaccgccaacccaaccccatctaaccaccgcctccgaaaaaataacgtaccgcgaatcgcgaatcccaaataccgtccgctctaccctacaacgcgcgtaaaaacgcgacgacgataacctctaaactacccacgacgaccgcctacgcgcacgaaaacgaatttccgctatccccaccgtaacctcctcctcgccgccaccaccttcccaccccccgacccgcgcaaaaactaacgtccgaaaaacgcgcgacgatacttctttttcgcccgacaccgctacaaccacctcacatccgaacgcgcgacgaaaaaaacgacgccgaaaccaaaatacgtaaaaaaaattattaaaaaaaaaaaaaccgaaaaaaaaaaacgaaaaaccgaactacaattacgacgactaaaaaaaaacaacccaaaccgatcgaaataaaaacgcgaaaacgaaaactacgaaaaacgacgctaaaaccgatacgaacaacgaaaaaaaaaacgacgaccgaaacaaaaaaccgccgaacgacgaaaacaccgaataaaaatcgacgacgataacgactaaatccgaaacaccgcgcgcccgatactcccgaatataaaaaaaacgcgaacgcattactcccgaaatcgcgtacgtaaacgcgaacgccgaaacgcccgcaaaaaataaacaaaaacgcgaaacccgcaaaacgaccgacgaataaccgacgaactaactaacgaaaaccgaaccgccgaaccgaaaaaaacgactacgaacctacgctaactccaacttaaaacgcccgaaccgaaaaattcgacctccctcctccctacgaccgaccgcccctcaataaatacgatctccgcccttcctccgaaaaaaaccgctaaacccgaacctacgtaaaaaactacgaattaaaatcgcgacccgaaaaaaccaaatttcgaaactaaaaccgatactcgccctttccttaccatcgacgcccctaacataaccacaaatacgactaacctaacgaaaaacgctcgaaccccgtccccaatccctaatcgccga

SEQ ID NO: 26759 - DNA, 1186 bp, Artificial Sequence
  chemically treated genomic DNA (Homo sapiens) CpG-island No: 26759
gaattcgtattgggaaggttcggaagattttaattttttattttaaatttttattgtcgaagttttacggttttttgtttatgcgaattatgtaaatatagcggtcgtcgcgttataggtcgtgttagtcgttagtttagttttatttagttatcgttttcgggagagtggcgtgtcgcgagtcgcgggttttaagtgtcgttcgttttgttttgtagcgcgcgtgggaacgcggcggcggtggtttttgggttgtttacggcgatcgtttgcgcgtacgggagcgggttttcgttatttttatcgtggtttttttttcgtcgttattatttttttatttttcggttcgcgtaggggttggcgttcgggaagcgcgcggcgatgtttttttttcgttcggtatcgttgtagttattttatattcgggcgcgcggcggggaaggcggcgtcggggttagggtgcgtggagggagttattaagggggagggggtcgaagaggaggggcggagggtcgggttgtagttacggcggttgaagagagatagtttaagtcggtcggggtgggggcgcgagagcgaaggttgcggggagcggcgttgggatcggtgcgggtagcggggaggggagcggcggtcgaggtaaagggtcgtcgagcggcggaggtatcgagtaagggtcggcggcggtggcggttgggttcggggtatcgcgcgttcggtgttttcgggtgtagaaggggcgcgggcgtattgttttcggggtcgcgtgcgtgagcgcgggcgtcggggcgttcgtagggggtgggtaggggcgcgaggttcgtaaggcggtcggcgggtagtcggcgggttggttggcggggatcgagtcgtcgggtcggggaggacggttgcgggtttgcgttagttttagtttgaagcgttcgggtcgggagattcggttttttttttttttgcggtcggtcgttttttagtgagtacggttttcgtttttttttcgaaggaggtcgttgggttcgggtttgcgtgaggggttgcgggttggggtcgcggttcggggaagttaagtttcggagttgaagtcggtgttcgttttttttttgttatcggcgtttttgatatggttataggtgcggttggtttggcgaggggcgttcgggtttcgtttttagtttttgatcgtcgg

SEQ ID NO: 26760 - DNA, 1186 bp, Artificial Sequence
  chemically treated genomic DNA (Homo sapiens) CpG-island No: 26760
ccgacgatcaaaaactaaaaacgaaacccgaacgcccctcgccaaaccaaccgcacctataaccatatcaaaaacgccgataacaaaaaaaaaacgaacaccgacttcaactccgaaacttaacttccccgaaccgcgaccccaacccgcaacccctcacgcaaacccgaacccaacgacctccttcgaaaaaaaaacgaaaaccgtactcactaaaaaacgaccgaccgcaaaaaaaaaaaaaaccgaatctcccgacccgaacgcttcaaactaaaactaacgcaaacccgcaaccgtcctccccgacccgacgactcgatccccgccaaccaacccgccgactacccgccgaccgccttacgaacctcgcgcccctacccaccccctacgaacgccccgacgcccgcgctcacgcacgcgaccccgaaaacaatacgcccgcgccccttctacacccgaaaacaccgaacgcgcgataccccgaacccaaccgccaccgccgccgacccttactcgatacctccgccgctcgacgaccctttacctcgaccgccgctcccctccccgctacccgcaccgatcccaacgccgctccccgcaaccttcgctctcgcgcccccaccccgaccgacttaaactatctctcttcaaccgccgtaactacaacccgaccctccgcccctcctcttcgaccccctcccccttaataactccctccacgcaccctaaccccgacgccgccttccccgccgcgcgcccgaatataaaataactacaacgataccgaacgaaaaaaaaacatcgccgcgcgcttcccgaacgccaacccctacgcgaaccgaaaaataaaaaaataataacgacgaaaaaaaaaccacgataaaaataacgaaaacccgctcccgtacgcgcaaacgatcgccgtaaacaacccaaaaaccaccgccgccgcgttcccacgcgcgctacaaaacaaaacgaacgacacttaaaacccgcgactcgcgacacgccactctcccgaaaacgataactaaataaaactaaactaacgactaacacgacctataacgcgacgaccgctatatttacataattcgcataaacaaaaaaccgtaaaacttcgacaataaaaatttaaaataaaaaattaaaatcttccgaaccttcccaatacgaattc

SEQ ID NO: 26761 - DNA, 740 bp, Artificial Sequence
  chemically treated genomic DNA (Homo sapiens) CpG-island No: 26761
ttcgaagtgcgttatttattcgattgaggttgcgtaagtttcggggtttgggcggggtggttttcgtgcgcgtcgcgtcgtcgtggagacgagggcgggttcgcgcgagattggcgtttagaggcgcgcgaagcgttgaggcgggcgtggatcgcgcgggagttaagaagtaggtttcggatcgtcgtatatcgtcgggtttttttttaacgttaggttcgatggttcggtttttttaggtacgaggttcggttttaacgtttttatttttttttgggttcggttttttcggtagtgagttcggtaaggattttagtcgggttttttcgagttcggtgaaatttgttcgagttttcgtttttttttttgaaagtgtaggtgatgttgtttatttgcgggtttgtggtgcgggaatggaggaagtgcgataagagggcgtaggacggggttcggagtttgttattttttttcgtcgcgttttttcggttttttgtttttcgttttgggggtatcgtatttttttaggcgtttagtgcgtttttggtcggtgttcgagtttacgtaatgttttttagcgtgcgcggatttaaattaggggtttttttttttcggtttcgtggtttaggagcggaagggttggtatatgggcgattttatttttattgagttcgtagggagtaacgtagtaaataaatttggaagtttttttcgcgtgggaggtgggtatttgtttttatggg

SEQ ID NO: 26762 - DNA, 740 bp, Artificial Sequence
  chemically treated genomic DNA (Homo sapiens) CpG-island No: 26762
cccataaaaacaaatacccacctcccacgcgaaaaaaacttccaaatttatttactacgttactccctacgaactcaataaaaataaaatcgcccatataccaacccttccgctcctaaaccacgaaaccgaaaaaaaaaaacccctaatttaaatccgcgcacgctaaaaaacattacgtaaactcgaacaccgaccaaaaacgcactaaacgcctaaaaaaatacgatacccccaaaacgaaaaacaaaaaaccgaaaaaacgcgacgaaaaaaaataacaaactccgaaccccgtcctacgccctcttatcgcacttcctccattcccgcaccacaaacccgcaaataaacaacatcacctacactttcaaaaaaaaaaacgaaaactcgaacaaatttcaccgaactcgaaaaaacccgactaaaatccttaccgaactcactaccgaaaaaaccgaacccaaaaaaaaataaaaacgttaaaaccgaacctcgtacctaaaaaaaccgaaccatcgaacctaacgttaaaaaaaaacccgacgatatacgacgatccgaaacctacttcttaactcccgcgcgatccacgcccgcctcaacgcttcgcgcgcctctaaacgccaatctcgcgcgaacccgccctcgtctccacgacgacgcgacgcgcacgaaaaccaccccgcccaaaccccgaaacttacgcaacctcaatcgaataaataacgcacttcgaa

SEQ ID NO: 26763 - DNA, 740 bp, Artificial Sequence
  chemically treated genomic DNA (Homo sapiens) CpG-island No: 26763
tttataaaaataggtatttattttttacgcggggaaggtttttaggtttgtttattgcgttattttttgcgggtttagtgggagtaaggtcgtttatatattagttttttcgtttttgggttacggagtcgggaggaggaaatttttgatttggattcgcgtacgttaaggggtattgcgtggattcgagtatcggttaggagcgtattagacgtttgggaggatgcggtgtttttagggcggaagataagaagtcgagaagacgcggcgggagaggatggtaggtttcgggtttcgttttgcgtttttttgtcgtattttttttattttcgtattatagattcgtaggtagataatattatttgtatttttaggggaggaagcggaggttcggatagattttatcgggttcggaggaattcgattgaggtttttgtcgggtttattgtcggaaaggtcgagtttagaagagggtggggacgttagggtcgggtttcgtatttggggaagtcgagttatcgggtttgacgttgggagaaaattcggcggtatacggcgattcgggatttgttttttaattttcgcgcggtttacgttcgttttagcgtttcgcgcgtttttagacgttagtttcgcgcgggttcgttttcgtttttacggcgacgcggcgcgtacgaggattatttcgtttagatttcggggtttgcgtagttttagtcgggtaggtggcgtatttcggg

SEQ ID NO: 26764 - DNA, 740 bp, Artificial Sequence
  chemically treated genomic DNA (Homo sapiens) CpG-island No: 26764
cccgaaatacgccacctacccgactaaaactacgcaaaccccgaaatctaaacgaaataatcctcgtacgcgccgcgtcgccgtaaaaacgaaaacgaacccgcgcgaaactaacgtctaaaaacgcgcgaaacgctaaaacgaacgtaaaccgcgcgaaaattaaaaaacaaatcccgaatcgccgtataccgccgaattttctcccaacgtcaaacccgataactcgacttccccaaatacgaaacccgaccctaacgtccccaccctcttctaaactcgacctttccgacaataaacccgacaaaaacctcaatcgaattcctccgaacccgataaaatctatccgaacctccgcttcctcccctaaaaatacaaataatattatctacctacgaatctataatacgaaaataaaaaaaatacgacaaaaaaacgcaaaacgaaacccgaaacctaccatcctctcccgccgcgtcttctcgacttcttatcttccgccctaaaaacaccgcatcctcccaaacgtctaatacgctcctaaccgatactcgaatccacgcaataccccttaacgtacgcgaatccaaatcaaaaatttcctcctcccgactccgtaacccaaaaacgaaaaaactaatatataaacgaccttactcccactaaacccgcaaaaaataacgcaataaacaaacctaaaaaccttccccgcgtaaaaaataaatacctatttttataaa

SEQ ID NO: 26765 - DNA, 739 bp, Artificial Sequence
  chemically treated genomic DNA (Homo sapiens) CpG-island No: 26765
agggatagcgtcggttttttttgttagttttttttaggttcgggtagtttcgttttttttcgtttcggtcggtcgataggagttgtttcggtattgcgttttttcgcggtcgtagaacgtttattttcgatagcgcgcggggttaaggggcggtgatagtcgtgcggcgggggcggagatgttattagttggggtgttatttagttcgggaggtgatacgcgttttttcgttcgggcggtcgtttggtcgtttatttttcgttagtacgttcggcgacgtttttcgtttcgttattttataatttttcgtttagcggtgtttttttagtttcggttggcgttttattttatttttttttttttttttatataatcgttatcggcgttttatcgcgttttatttttcgtcgttttcgtttcggttttcgggattttttcggtttcgggcgattgttgatatttatttgttatgtttcggattttatcgtagagggaggtgtattacggtcgcgagaaggtcggggacggtattttagagtagataaagggcgtcgttatgttagagtcgggcggaatcgatttcgtaggtttttcggttgtaattttcggcgtatgcgtagcgttttcgttaggagagcgtttatagatagacgtatgcgtttagttatttaaaagttttattttatagtatttcggcgtttagagttgtttttattgtatttttgttttggtttttttt

SEQ ID NO: 26766 - DNA, 739 bp, Artificial Sequence
  chemically treated genomic DNA (Homo sapiens) CpG-island No: 26766
aaaaaaaaccaaaacaaaaatacaataaaaacaactctaaacgccgaaatactataaaataaaacttttaaataactaaacgcatacgtctatctataaacgctctcctaacgaaaacgctacgcatacgccgaaaattacaaccgaaaaacctacgaaatcgattccgcccgactctaacataacgacgccctttatctactctaaaataccgtccccgaccttctcgcgaccgtaatacacctccctctacgataaaatccgaaacataacaaataaatatcaacaatcgcccgaaaccgaaaaaatcccgaaaaccgaaacgaaaacgacgaaaaataaaacgcgataaaacgccgataacgattatataaaaaaaaaaaaaaaaataaaataaaacgccaaccgaaactaaaaaaacaccgctaaacgaaaaattataaaataacgaaacgaaaaacgtcgccgaacgtactaacgaaaaataaacgaccaaacgaccgcccgaacgaaaaaacgcgtatcacctcccgaactaaataacaccccaactaataacatctccgcccccgccgcacgactatcaccgccccttaaccccgcgcgctatcgaaaataaacgttctacgaccgcgaaaaaacgcaataccgaaacaactcctatcgaccgaccgaaacgaaaaaaaacgaaactacccgaacctaaaaaaaactaacaaaaaaaaccgacgctatccct

SEQ ID NO: 26767 - DNA, 739 bp, Artificial Sequence
  chemically treated genomic DNA (Homo sapiens) CpG-island No: 26767
aagagaaattaaggtaggggtataatgaggataattttgagcgtcgaagtattgtaaggtggaatttttggatagttaggcgtatgcgtttgtttatgggcgtttttttagcgaggacgttgcgtatgcgtcggaagttgtagtcgggaagtttgcgaggtcggtttcgttcgattttaatatggcggcgttttttgtttgttttggagtgtcgttttcggttttttcgcggtcgtgatgtatttttttttgcggtggggttcgggatatggtaggtgagtgttaataatcgttcggggtcggggaagtttcgggagtcggggcggaggcggcggaggatggggcgcggtgggacgtcggtgacggttgtgtgggggaggggagggaagtggaatgggacgttaatcggggttgaggggatatcgttgggcgggagattgtggggtggcggggcggggggcgtcgtcgggcgtgttggcggggagtgggcggttaggcgatcgttcgggcgagggggcgcgtgttatttttcgggttggatgatattttagttggtagtattttcgttttcgtcgtacggttgttatcgttttttgatttcgcgcgttgtcgagggtgggcgttttgcggtcgcgagggagcgtagtgtcggggtagtttttgtcggtcggtcggggcgggagggagcggggttgttcgggtttaggaggagttgatagaggaggtcgacgttgttttt

SEQ ID NO: 26768 - DNA, 739 bp, Artificial Sequence
  chemically treated genomic DNA (Homo sapiens) CpG-island No: 26768
aaaaacaacgtcgacctcctctatcaactcctcctaaacccgaacaaccccgctccctcccgccccgaccgaccgacaaaaactaccccgacactacgctccctcgcgaccgcaaaacgcccaccctcgacaacgcgcgaaatcaaaaaacgataacaaccgtacgacgaaaacgaaaatactaccaactaaaatatcatccaacccgaaaaataacacgcgccccctcgcccgaacgatcgcctaaccgcccactccccgccaacacgcccgacgacgccccccgccccgccaccccacaatctcccgcccaacgatatcccctcaaccccgattaacgtcccattccacttccctcccctcccccacacaaccgtcaccgacgtcccaccgcgccccatcctccgccgcctccgccccgactcccgaaacttccccgaccccgaacgattattaacactcacctaccatatcccgaaccccaccgcaaaaaaaaatacatcacgaccgcgaaaaaaccgaaaacgacactccaaaacaaacaaaaaacgccgccatattaaaatcgaacgaaaccgacctcgcaaacttcccgactacaacttccgacgcatacgcaacgtcctcgctaaaaaaacgcccataaacaaacgcatacgcctaactatccaaaaattccaccttacaatacttcgacgctcaaaattatcctcattatacccctaccttaatttctctt

SEQ ID NO: 26769 - DNA, 1158 bp, Artificial Sequence
  chemically treated genomic DNA (Homo sapiens) CpG-island No: 26769
gcgttagaaagcggaatttttcgggttagtcgcgcggtggttatttttttgggagttggggaggaggttgcggaggttggttcggttttttcgggcgtcgtttttcggatcgggtgcgcggggtttttcggaacgtgtgttttaggttttttcgcgttagtgttcgtagttttcgtttggtcgcggcggcgtttcgggcgcgggtgtaggcgcgcggcgcgtaggcggggggcgttgtggttttggcgcggggatcgagtcgttcggttagattcgtttttttttttttttcgttagttcgttcgtttgttcgttttttacgcgtcgtgtcgtcgggaagtcgggcggagatagagcgtttgggatttacggcgttcggatcgttgttttttaatagcgtagggtagagcggttggcgtcgtcggagcgcggagttacgattttttttggtcgtttttgtttattggtcgtgcggttcggaatcgttattttttagggtcggggacgcgttcgtagttgtcggtgatagtttttttttatcgtaatttttcggggcggaggggcggtcgggtcgggttttgttagttcgcgatcgtaagttcgcgttcgcggatcgatgttttcgtagtagggggatttcgcgtttttcgatcgttgcgaggcgttttcggtgtcgtcgcgtcgggagcgcggtggacgcgggggacgcgggtttggggagtcggggggtcgggggcgtgcggggggtgtcgaggggcgcggcgttaagtgcgtgttggtcggcgacggcgcggtgggtaagacgagtttggtggtgagttatattattaacggttattttatcgagtatatttttattgttttcgataattttttcggtgagttggtcggggggtcggggtcgggggcgcgtggtcgcggtttatttaggggaaggaaggtggcgcgagggtcgcgaggtttttaagggggttgtagggtttcgggcgcggttttagttgggaagtcggataaatgaggagtgtaggacgttttttgagttttagggatcgggtaagcgcggagttaatacgaaaggattacggcggagtgggtttggagagaggagggcggagcggtagttagagttttgttaaaaaaaaaaaaaaaaaaaatttt

SEQ ID NO: 26770 - DNA, 1158 bp, Artificial Sequence
  chemically treated genomic DNA (Homo sapiens) CpG-island No: 26770
aaaattttttttttttttttttttaacaaaactctaactaccgctccgccctcctctctccaaacccactccgccgtaatcctttcgtattaactccgcgcttacccgatccctaaaactcaaaaaacgtcctacactcctcatttatccgacttcccaactaaaaccgcgcccgaaaccctacaacccccttaaaaacctcgcgaccctcgcgccaccttccttcccctaaataaaccgcgaccacgcgcccccgaccccgaccccccgaccaactcaccgaaaaaattatcgaaaacaataaaaatatactcgataaaataaccgttaataatataactcaccaccaaactcgtcttacccaccgcgccgtcgccgaccaacacgcacttaacgccgcgcccctcgacaccccccgcacgcccccgaccccccgactccccaaacccgcgtcccccgcgtccaccgcgctcccgacgcgacgacaccgaaaacgcctcgcaacgatcgaaaaacgcgaaatccccctactacgaaaacatcgatccgcgaacgcgaacttacgatcgcgaactaacaaaacccgacccgaccgcccctccgccccgaaaaattacgataaaaaaaaactatcaccgacaactacgaacgcgtccccgaccctaaaaaataacgattccgaaccgcacgaccaataaacaaaaacgaccaaaaaaaatcgtaactccgcgctccgacgacgccaaccgctctaccctacgctattaaaaaacaacgatccgaacgccgtaaatcccaaacgctctatctccgcccgacttcccgacgacacgacgcgtaaaaaacgaacaaacgaacgaactaacgaaaaaaaaaaaaaaacgaatctaaccgaacgactcgatccccgcgccaaaaccacaacgccccccgcctacgcgccgcgcgcctacacccgcgcccgaaacgccgccgcgaccaaacgaaaactacgaacactaacgcgaaaaaacctaaaacacacgttccgaaaaaccccgcgcacccgatccgaaaaacgacgcccgaaaaaaccgaaccaacctccgcaacctcctccccaactcccaaaaaaataaccaccgcgcgactaacccgaaaaattccgctttctaacgc

SEQ ID NO: 26771 - DNA, 1158 bp, Artificial Sequence
  chemically treated genomic DNA (Homo sapiens) CpG-island No: 26771
gagattttttttttttttttttttggtaaggttttgattgtcgtttcgtttttttttttttaagtttatttcgtcgtggttttttcgtgttagtttcgcgtttgttcggtttttgagatttaggaaacgttttgtattttttatttgttcggttttttagttggagtcgcgttcggggttttgtagtttttttgggaatttcgcgattttcgcgttatttttttttttttgggtggatcgcggttacgcgttttcggtttcggtttttcggttagtttatcggagaagttgtcgaaggtagtagggatgtattcggtggggtagtcgttggtggtgtagtttattattaggttcgttttgtttatcgcgtcgtcgtcgattagtacgtatttgacgtcgcgtttttcggtatttttcgtacgttttcggtttttcggttttttaggttcgcgtttttcgcgtttatcgcgttttcgacgcggcggtatcggaggcgtttcgtagcggtcggggaacgcggggtttttttgttgcgggggtatcgattcgcgagcgcgggtttgcggtcgcgggttagtagggttcggttcgatcgttttttcgtttcggagggttgcggtagggaggagttgttatcgatagttgcgggcgcgttttcggttttggagagtggcggtttcgggtcgtacggttagtagataaaggcggttagggagggtcgtggtttcgcgtttcggcggcgttagtcgttttgttttgcgttgttggaggatagcggttcgagcgtcgtggattttaagcgttttgttttcgttcggtttttcggcgatacgacgcgtggggggcgggtaggcgggcgggttggcggggagggaaaagaggcgggtttggtcgagcggttcggttttcgcgttaagattatagcgtttttcgtttgcgcgtcgcgcgtttgtattcgcgttcgaggcgtcgtcgcgattaggcggggattgcgaatattggcgcgggaggatttggaatatacgtttcgggggatttcgcgtattcggttcgggaagcgacgttcgaaggagtcgggttagttttcgtagttttttttttagtttttaagagggtgattatcgcgcgattggttcgggaggtttcgttttttggcgt

SEQ ID NO: 26772 - DNA, 1158 bp, Artificial Sequence
  chemically treated genomic DNA (Homo sapiens) CpG-island No: 26772
acgccaaaaaacgaaacctcccgaaccaatcgcgcgataatcaccctcttaaaaactaaaaaaaaaactacgaaaactaacccgactccttcgaacgtcgcttcccgaaccgaatacgcgaaatcccccgaaacgtatattccaaatcctcccgcgccaatattcgcaatccccgcctaatcgcgacgacgcctcgaacgcgaatacaaacgcgcgacgcgcaaacgaaaaacgctataatcttaacgcgaaaaccgaaccgctcgaccaaacccgcctcttttccctccccgccaacccgcccgcctacccgccccccacgcgtcgtatcgccgaaaaaccgaacgaaaacaaaacgcttaaaatccacgacgctcgaaccgctatcctccaacaacgcaaaacaaaacgactaacgccgccgaaacgcgaaaccacgaccctccctaaccgcctttatctactaaccgtacgacccgaaaccgccactctccaaaaccgaaaacgcgcccgcaactatcgataacaactcctccctaccgcaaccctccgaaacgaaaaaacgatcgaaccgaaccctactaacccgcgaccgcaaacccgcgctcgcgaatcgatacccccgcaacaaaaaaaccccgcgttccccgaccgctacgaaacgcctccgataccgccgcgtcgaaaacgcgataaacgcgaaaaacgcgaacctaaaaaaccgaaaaaccgaaaacgtacgaaaaataccgaaaaacgcgacgtcaaatacgtactaatcgacgacgacgcgataaacaaaacgaacctaataataaactacaccaccaacgactaccccaccgaatacatccctactaccttcgacaacttctccgataaactaaccgaaaaaccgaaaccgaaaacgcgtaaccgcgatccacccaaaaaaaaaaaaataacgcgaaaatcgcgaaattcccaaaaaaactacaaaaccccgaacgcgactccaactaaaaaaccgaacaaataaaaaatacaaaacgtttcctaaatctcaaaaaccgaacaaacgcgaaactaacacgaaaaaaccacgacgaaataaacttaaaaaaaaaaaaacgaaacgacaatcaaaaccttaccaaaaaaaaaaaaaaaaaaaatctc

SEQ ID NO: 26773 - DNA, 972 bp, Artificial Sequence
  chemically treated genomic DNA (Homo sapiens) CpG-island No: 26773
ttttgatcgattttagttcgtttatcgtcggttttttaggcgatagtagttttttggggggcgcgggcggcggcggcggcggcggttgttcgggaggcggtttcgcgtttttagcgttttcggcggcggcgtcgcgcgtgtcgtttacgatgacgttgtaggtcgcggtcgtttcggggttcgtcggggcgttcgggtttgggtcgtcggcggcgggcgggttgtagtggtcgtttttgtagtcgtcgtaggttttgcgtttcgcggcgttcggttcgcgtttcgttttgacgtgcgcgtgtagcgcgcggtggattacgttgtgtagtcgggttcggtggtttacggttaggtcgatgacgtcgttttgcgggttttgtagtacgtttgggaagtcgagttggtcgttcgcgttcggggggttcggggggttgtcggcgcgtcgcgttaggtttattatttcgtttcggttatgttcggcgggcgtgggcgttaggtttagggtttggttcgagtagtcggggggcgagttcgcggatttggacgagttttgtttggagtttcggggggatagggagtgttcgtttggtttgtcgttcgtcgtcgcggagtcgttaggggcgttcggaatgaagtttttttcgttgttggagaattcgttggggggtttggagtcgttgacgtgagggatagggatggggatggggatgggtatcggtaggggtacgattacggggtacggtacgagtagggtcgggggcggtattagcggggtaagcgacggtagttcgaaatttattatttggggtatcggtatcgggttatttggtattatgtttattggcgggaagggaagattcggtagcggggcgttcggaggcggcgggggtagtaggtttggggggttttcgggtatggtgggggtgttcggggggtggatgtggggcgatagtatgggtcggtgtatggggt

SEQ ID NO: 26774 - DNA, 972 bp, Artificial Sequence
  chemically treated genomic DNA (Homo sapiens) CpG-island No: 26774
accccatacaccgacccatactatcgccccacatccaccccccgaacacccccaccatacccgaaaaccccccaaacctactacccccgccgcctccgaacgccccgctaccgaatcttcccttcccgccaataaacataataccaaataacccgataccgataccccaaataataaatttcgaactaccgtcgcttaccccgctaataccgcccccgaccctactcgtaccgtaccccgtaatcgtacccctaccgatacccatccccatccccatccctatccctcacgtcaacgactccaaaccccccaacgaattctccaacaacgaaaaaaacttcattccgaacgcccctaacgactccgcgacgacgaacgacaaaccaaacgaacactccctatccccccgaaactccaaacaaaactcgtccaaatccgcgaactcgccccccgactactcgaaccaaaccctaaacctaacgcccacgcccgccgaacataaccgaaacgaaataataaacctaacgcgacgcgccgacaaccccccgaaccccccgaacgcgaacgaccaactcgacttcccaaacgtactacaaaacccgcaaaacgacgtcatcgacctaaccgtaaaccaccgaacccgactacacaacgtaatccaccgcgcgctacacgcgcacgtcaaaacgaaacgcgaaccgaacgccgcgaaacgcaaaacctacgacgactacaaaaacgaccactacaacccgcccgccgccgacgacccaaacccgaacgccccgacgaaccccgaaacgaccgcgacctacaacgtcatcgtaaacgacacgcgcgacgccgccgccgaaaacgctaaaaacgcgaaaccgcctcccgaacaaccgccgccgccgccgccgcccgcgccccccaaaaaactactatcgcctaaaaaaccgacgataaacgaactaaaatcgatcaaaa

SEQ ID NO: 26775 - DNA, 972 bp, Artificial Sequence
  chemically treated genomic DNA (Homo sapiens) CpG-island No: 26775
gttttatgtatcggtttatgttatcgttttatatttatttttcgagtatttttattatgttcgggaattttttaggtttgttgttttcgtcgttttcgggcgtttcgttgtcgagtttttttttttcgttagtgagtatgatgttaaatggttcgatgtcggtgttttagatgatgaatttcgggttgtcgtcgtttgtttcgttggtgtcgttttcgattttgttcgtgtcgtatttcgtgatcgtgtttttatcggtgtttatttttatttttatttttattttttacgttagcgattttaagttttttaacgggttttttagtaacggggagaattttatttcgaacgtttttggcgatttcgcggcggcgggcggtaagttaagcggatattttttgttttttcgggattttaagtagggttcgtttaagttcgcggattcgtttttcggttgttcgggttaggttttgagtttggcgtttacgttcgtcgagtatggtcggagcgaggtggtggatttgacgcggcgcgtcggtagtttttcgggtttttcgggcgcgggcggttagttcggttttttaggcgtgttgtagggttcgtaggacggcgttatcgatttgatcgtgggttatcgagttcggttgtataacgtgatttatcgcgcgttgtacgcgtacgttaaggcggagcgcgagtcgagcgtcgcggagcgtaggatttgcggcggttgtagggacggttattgtagttcgttcgtcgtcggcgatttaggttcgggcgtttcggcgggtttcgaggcggtcgcggtttgtaacgttatcgtgaacggtacgcgcggcgtcgtcgtcgagggcgttaagagcgcggagtcgtttttcgagtagtcgtcgtcgtcgtcgtcgttcgcgttttttaagaagttgttgtcgtttgaggaatcggcggtgagcgagttagagtcggttaagg

SEQ ID NO: 26776 - DNA, 972 bp, Artificial Sequence
  chemically treated genomic DNA (Homo sapiens) CpG-island No: 26776
ccttaaccgactctaactcgctcaccgccgattcctcaaacgacaacaacttcttaaaaaacgcgaacgacgacgacgacgacgactactcgaaaaacgactccgcgctcttaacgccctcgacgacgacgccgcgcgtaccgttcacgataacgttacaaaccgcgaccgcctcgaaacccgccgaaacgcccgaacctaaatcgccgacgacgaacgaactacaataaccgtccctacaaccgccgcaaatcctacgctccgcgacgctcgactcgcgctccgccttaacgtacgcgtacaacgcgcgataaatcacgttatacaaccgaactcgataacccacgatcaaatcgataacgccgtcctacgaaccctacaacacgcctaaaaaaccgaactaaccgcccgcgcccgaaaaacccgaaaaactaccgacgcgccgcgtcaaatccaccacctcgctccgaccatactcgacgaacgtaaacgccaaactcaaaacctaacccgaacaaccgaaaaacgaatccgcgaacttaaacgaaccctacttaaaatcccgaaaaaacaaaaaatatccgcttaacttaccgcccgccgccgcgaaatcgccaaaaacgttcgaaataaaattctccccgttactaaaaaacccgttaaaaaacttaaaatcgctaacgtaaaaaataaaaataaaaataaaaataaacaccgataaaaacacgatcacgaaatacgacacgaacaaaatcgaaaacgacaccaacgaaacaaacgacgacaacccgaaattcatcatctaaaacaccgacatcgaaccatttaacatcatactcactaacgaaaaaaaaaaactcgacaacgaaacgcccgaaaacgacgaaaacaacaaacctaaaaaattcccgaacataataaaaatactcgaaaaataaatataaaacgataacataaaccgatacataaaac

SEQ ID NO: 26777 - DNA, 661 bp, Artificial Sequence
  chemically treated genomic DNA (Homo sapiens) CpG-island No: 26777
gcggaaagggaggggttttttacgggttttgttgatttgtttaattttacgttattcggaggtttttacggatggcggataagagggagggggagggggtgggggtttcggttcgtgttttttttttttttttcgttttcgttttcgtcggagttatttgattcgtagcgaagttgtcggtttcgttgcgcgtcggtttttgtgcgtatcgaggcggtcgtcgggaatcgggagttcgagttggttcggtagcgtcgtcgtttttattttcgcgtttttttttatttttttattgttttcggagttggtaaataaataaatttataaataaattattcgtgtgtttcggagaggcggcggcgtgggcggcggcggagagaaggcgtcgggtaaggcgagattaggttttcgcggagcgggggaagtatagattttagttcgggttcggtagtagtaagttgatttttatgaaatttacgaagttcgcggggttatcgaaaaggtttttatcggagcggattttgcggggcgggcggggtagaggttgtaggcgggttttttttttcgcgcggtttttatcggtcggtttcgtttttaagttttggacggttttttttttagttcgtttggttgggggtcgttgtatatcgggggtggaagt

SEQ ID NO: 26778 - DNA, 661 bp, Artificial Sequence
  chemically treated genomic DNA (Homo sapiens) CpG-island No: 26778
acttccacccccgatatacaacgacccccaaccaaacgaactaaaaaaaaaaccgtccaaaacttaaaaacgaaaccgaccgataaaaaccgcgcgaaaaaaaaaacccgcctacaacctctaccccgcccgccccgcaaaatccgctccgataaaaaccttttcgataaccccgcgaacttcgtaaatttcataaaaatcaacttactactaccgaacccgaactaaaatctatacttcccccgctccgcgaaaacctaatctcgccttacccgacgccttctctccgccgccgcccacgccgccgcctctccgaaacacacgaataatttatttataaatttatttatttaccaactccgaaaacaataaaaaaataaaaaaaaacgcgaaaataaaaacgacgacgctaccgaaccaactcgaactcccgattcccgacgaccgcctcgatacgcacaaaaaccgacgcgcaacgaaaccgacaacttcgctacgaatcaaataactccgacgaaaacgaaaacgaaaaaaaaaaaaaaaacacgaaccgaaacccccaccccctccccctccctcttatccgccatccgtaaaaacctccgaataacgtaaaattaaacaaatcaacaaaacccgtaaaaaacccctccctttccgc

SEQ ID NO: 26779 - DNA, 661 bp, Artificial Sequence
  chemically treated genomic DNA (Homo sapiens) CpG-island No: 26779
atttttattttcggtgtgtagcggtttttagttaggcgggttgggggaagggtcgtttagggtttgggggcggagtcggtcggtaggagtcgcgcgggaaggggagttcgtttgtagtttttgtttcgttcgtttcgtagagttcgtttcggtggggattttttcggtggtttcgcgagtttcgtaggttttataaaagttaatttattgttgtcgggttcgggttggggtttgtgtttttttcgtttcgcgggggtttagtttcgttttgttcggcgtttttttttcgtcgtcgtttacgtcgtcgttttttcggagtatacggataatttgtttgtggatttgtttatttgttagtttcggggatagtgggggagtgaaaaggggcgcgaaggtgggggcggcggcgttgtcgggttagttcgggttttcggttttcggcggtcgtttcggtgcgtataaaggtcggcgcgtagcggggtcggtaatttcgttacgggttaggtggtttcggcgggggcgggagcgggaggaggggaggaaatacgggtcgagatttttatttttttttttttttttttgttcgttattcgtgaaagttttcgaatagcgtgggattaaataaattaatagaattcgtggagaattttttttttttcgt

SEQ ID NO: 26780 - DNA, 661 bp, Artificial Sequence
  chemically treated genomic DNA (Homo sapiens) CpG-island No: 26780
acgaaaaaaaaaaaattctccacgaattctattaatttatttaatcccacgctattcgaaaactttcacgaataacgaacaaaaaaaaaaaaaaaaaaataaaaatctcgacccgtatttcctcccctcctcccgctcccgcccccgccgaaaccacctaacccgtaacgaaattaccgaccccgctacgcgccgacctttatacgcaccgaaacgaccgccgaaaaccgaaaacccgaactaacccgacaacgccgccgcccccaccttcgcgccccttttcactcccccactatccccgaaactaacaaataaacaaatccacaaacaaattatccgtatactccgaaaaaacgacgacgtaaacgacgacgaaaaaaaaacgccgaacaaaacgaaactaaacccccgcgaaacgaaaaaaacacaaaccccaacccgaacccgacaacaataaattaacttttataaaacctacgaaactcgcgaaaccaccgaaaaaatccccaccgaaacgaactctacgaaacgaacgaaacaaaaactacaaacgaactccccttcccgcgcgactcctaccgaccgactccgcccccaaaccctaaacgacccttcccccaacccgcctaactaaaaaccgctacacaccgaaaataaaaat

SEQ ID NO: 26781 - DNA, 1382 bp, Artificial Sequence
  chemically treated genomic DNA (Homo sapiens) CpG-island No: 26781
  misc_feature (1357)..(1358): n is either a, c, g or t
  misc_feature (1378)..(1378): n is either a, c, g or t
tcggtgaggtatcgtcgggatcggtgttcgggtaacgttatcgcgcgttttagtgataatcggtcggtgtcggagcggagcgcgaatacgcgcggaggtagcgtcggcgacggcgacggcggcgggcgcggggatagttgtatcggggtcgggtcgggttagtaggagttgggcgtttgtagcgtggatttcgtggatattcggttcgtagtcggtttgcggcgttcggggatttgtttggtttttttttcggggttttcgcgttttttttcgtttagggtagtagcgcgcggggttttcgggagtcgaagagtaggcgggaattggcggcggcgcgggaggcgtagggagcggaggcggtagtagcggttttcgtcgggattggtaattacgttcggggtcgggtcggggcgagtcgggtaagcggtttttttgggttttttcgtttttttttttacgaatagttcgagcgttttttcgcgggttcgttgcgcgcggagaggacgagttcgttgggttgtaaaaagagacgagtttttatttttgagtatcgagattcgtttttttaatcgtattcggtgcgcgtttttgggtcggtacgggtagggcgacggtaggggaaggtagttgcggaggagttcgcgtcgtttagtcggagcggttttgcgtttttcggagtttcgcgggaggcggtcgggtgcgtacgcgtttattatttttattttcggaattcgttttcgcgattttcgggcgttttagttttaggaacgttcggagggacgtatttgggggtttattttttgtcgcggaaaggggagaagtgtgggttttttcgagtcgggggcggattgggatagtatagtcggttgagcgtagcgttttcgttttgttcgttacgcggcgaagacgtttgagcgttcgcgtttttcgggcgaggattttacgtaagttcgagtcggtttcgattttggtttcgacgttcgtcgttcgttttagttttgagggtttttttgcgtgtttatagcggattttgatttaatgtttatataattaaggtacgcggtgaatgttaagagaggcgttttcgtcgttttttttttatggaaatggttcgcgagttcgttcggtttagcgtttttttcgcgggaggaaggcgagttcggttttcggcggttattcgcgtcgcggataaattcggcgaataatgcgttcgtttagagtgcggtttagttgtcgggtcggggatttggtcgcgggatataaaggggttcgtacgtttttggcgtcgcggggcgggtgggggcggtcgagggcggtcgaggggggagtttgcggtcggggttaggttttttggggnnttttcggggggggggggggntttt

SEQ ID NO: 26782 - DNA, 1382 bp, Artificial Sequence
  chemically treated genomic DNA (Homo sapiens) CpG-island No: 26782
  misc_feature (5)..(5): n is either a, c, g or t
  misc_feature (25)..(26): n is either a, c, g or t
aaaanccccccccccccccgaaaannccccaaaaaacctaaccccgaccgcaaactcccccctcgaccgccctcgaccgcccccacccgccccgcgacgccaaaaacgtacgaacccctttatatcccgcgaccaaatccccgacccgacaactaaaccgcactctaaacgaacgcattattcgccgaatttatccgcgacgcgaataaccgccgaaaaccgaactcgccttcctcccgcgaaaaaaacgctaaaccgaacgaactcgcgaaccatttccataaaaaaaaaacgacgaaaacgcctctcttaacattcaccgcgtaccttaattatataaacattaaatcaaaatccgctataaacacgcaaaaaaaccctcaaaactaaaacgaacgacgaacgtcgaaaccaaaatcgaaaccgactcgaacttacgtaaaatcctcgcccgaaaaacgcgaacgctcaaacgtcttcgccgcgtaacgaacaaaacgaaaacgctacgctcaaccgactatactatcccaatccgcccccgactcgaaaaaacccacacttctcccctttccgcgacaaaaaataaacccccaaatacgtccctccgaacgttcctaaaactaaaacgcccgaaaatcgcgaaaacgaattccgaaaataaaaataataaacgcgtacgcacccgaccgcctcccgcgaaactccgaaaaacgcaaaaccgctccgactaaacgacgcgaactcctccgcaactaccttcccctaccgtcgccctacccgtaccgacccaaaaacgcgcaccgaatacgattaaaaaaacgaatctcgatactcaaaaataaaaactcgtctctttttacaacccaacgaactcgtcctctccgcgcgcaacgaacccgcgaaaaaacgctcgaactattcgtaaaaaaaaaaacgaaaaaacccaaaaaaaccgcttacccgactcgccccgacccgaccccgaacgtaattaccaatcccgacgaaaaccgctactaccgcctccgctccctacgcctcccgcgccgccgccaattcccgcctactcttcgactcccgaaaaccccgcgcgctactaccctaaacgaaaaaaaacgcgaaaaccccgaaaaaaaaaccaaacaaatccccgaacgccgcaaaccgactacgaaccgaatatccacgaaatccacgctacaaacgcccaactcctactaacccgacccgaccccgatacaactatccccgcgcccgccgccgtcgccgtcgccgacgctacctccgcgcgtattcgcgctccgctccgacaccgaccgattatcactaaaacgcgcgataacgttacccgaacaccgatcccgacgatacctcaccga

SEQ ID NO: 26783 - DNA, 1382 bp, Artificial Sequence
  chemically treated genomic DNA (Homo sapiens) CpG-island No: 26783
  misc_feature (5)..(5): n is either a, c, g or t
  misc_feature (25)..(26): n is either a, c, g or t
ggggntttttttttttttcgggggnnttttaaaaagtttggtttcggtcgtaggtttttttttcggtcgttttcggtcgtttttattcgtttcgcgacgttagaggcgtgcgggtttttttgtgtttcgcggttagattttcggttcggtagttgggtcgtattttgggcgggcgtattgttcgtcggatttgttcgcggcgcgaatggtcgtcgggggtcgggttcgtttttttttcgcgggaggggcgttgggtcggacgggttcgcgggttatttttatgagaaaggagcggcggaggcgttttttttggtatttatcgcgtgttttaattgtatagatattaaattaaggttcgttgtgaatacgtagaggggtttttagggttggggcgggcggcgagcgtcggggttagggtcgggatcggttcgggtttgcgtggggttttcgttcgaggggcgcgaacgtttaggcgttttcgtcgcgtggcgggtagggcgggggcgttgcgtttagtcgattgtgttgttttagttcgttttcgattcggaggagtttatatttttttttttttcgcggtagagagtgggtttttaagtgcgttttttcgggcgtttttggagttggggcgttcgggaatcgcgaagacggatttcgggggtgggggtggtgagcgcgtgcgtattcggtcgtttttcgcggggtttcgaggggcgtagaatcgtttcgattgggcggcgcgagttttttcgtagttgtttttttttgtcgtcgttttgttcgtgtcgatttaggagcgcgtatcgaatgcggttaaaagaacgaatttcgatgtttaaagatgaaaattcgtttttttttataatttagcgagttcgtttttttcgcgcgtagcgggttcgcgagaaggcgttcgagttgttcgtggagagaaagacggggagatttagagaggtcgtttgttcggttcgtttcggttcggtttcgagcgtaattattagtttcggcgggagtcgttgttgtcgttttcgttttttgcgtttttcgcgtcgtcgttagttttcgtttgtttttcggttttcgggggtttcgcgcgttgttgttttgggcggagaagggcgcgggaatttcgagaagggagttaggtaagttttcgagcgtcgtaggtcggttgcgagtcgagtgtttacggggtttacgttgtaggcgtttagtttttgttagttcggttcggtttcgatgtaattgttttcgcgttcgtcgtcgtcgtcgtcgtcgacgttgttttcgcgcgtattcgcgtttcgtttcggtatcggtcgattattattggggcgcgcggtgacgttattcggatatcggtttcgacggtgttttatcga

SEQ ID NO: 26784 - DNA, 1382 bp, Artificial Sequence
  chemically treated genomic DNA (Homo sapiens) CpG-island No: 26784
  misc_feature (1357)..(1358): n is either a, c, g or t
  misc_feature (1378)..(1378): n is either a, c, g or t
tcgataaaacaccgtcgaaaccgatatccgaataacgtcaccgcgcgccccaataataatcgaccgataccgaaacgaaacgcgaatacgcgcgaaaacaacgtcgacgacgacgacgacgacgaacgcgaaaacaattacatcgaaaccgaaccgaactaacaaaaactaaacgcctacaacgtaaaccccgtaaacactcgactcgcaaccgacctacgacgctcgaaaacttacctaactcccttctcgaaattcccgcgcccttctccgcccaaaacaacaacgcgcgaaacccccgaaaaccgaaaaacaaacgaaaactaacgacgacgcgaaaaacgcaaaaaacgaaaacgacaacaacgactcccgccgaaactaataattacgctcgaaaccgaaccgaaacgaaccgaacaaacgacctctctaaatctccccgtctttctctccacgaacaactcgaacgccttctcgcgaacccgctacgcgcgaaaaaaacgaactcgctaaattataaaaaaaaacgaattttcatctttaaacatcgaaattcgttcttttaaccgcattcgatacgcgctcctaaatcgacacgaacaaaacgacgacaaaaaaaaacaactacgaaaaaactcgcgccgcccaatcgaaacgattctacgcccctcgaaaccccgcgaaaaacgaccgaatacgcacgcgctcaccacccccacccccgaaatccgtcttcgcgattcccgaacgccccaactccaaaaacgcccgaaaaaacgcacttaaaaacccactctctaccgcgaaaaaaaaaaaaatataaactcctccgaatcgaaaacgaactaaaacaacacaatcgactaaacgcaacgcccccgccctacccgccacgcgacgaaaacgcctaaacgttcgcgcccctcgaacgaaaaccccacgcaaacccgaaccgatcccgaccctaaccccgacgctcgccgcccgccccaaccctaaaaacccctctacgtattcacaacgaaccttaatttaatatctatacaattaaaacacgcgataaataccaaaaaaaacgcctccgccgctcctttctcataaaaataacccgcgaacccgtccgacccaacgcccctcccgcgaaaaaaaaacgaacccgacccccgacgaccattcgcgccgcgaacaaatccgacgaacaatacgcccgcccaaaatacgacccaactaccgaaccgaaaatctaaccgcgaaacacaaaaaaacccgcacgcctctaacgtcgcgaaacgaataaaaacgaccgaaaacgaccgaaaaaaaaacctacgaccgaaaccaaactttttaaaanncccccgaaaaaaaaaaaaancccc

SEQ ID NO: 26785 - DNA, 1240 bp, Artificial Sequence
  chemically treated genomic DNA (Homo sapiens) CpG-island No: 26785
cggttttagacgtagttttttggatcgtttttttttcgtttttttttattttagttcgcgtcggtcgtttcgggatttcgtttatttttattattttgtttttttgttttttgtatcgtcgtaggtcgggacgtggggtatatataattcgggggaagagggaaatataaagttatttattagagaattggtttttaacgggtcgcgagtttcgtcggtttcgacgcgcggttacgtgcgatttcggtttcgagatttcggtttcgtttgggttcggttttcgcgatttcgggttttgcgttttagttttaggattttaatttagatttcgcgtttcggtttcggtcgcggtttttgtaattcggtttcgttatttgggtgtttacgttggtggtcgatatgttttatgaataattagacgcggggtcggggcgttcgtcggttcgggttttttttagaggtcgggtttgttattttagttcgcgcggtttcgggtttcgtcgttaatttttcgggcgtcggtcgggcggcggcggcggttgttgggcgcgcgggtttttggcgaggcggtagcggcggtgagttcgggacgcggacgtattgaggaggcgtcgattttaatggcggcggcggcggcgatagtagcggcgacggcggcggtaggggacgagattgcgcggcgttagcgtgtacgcggggtaggtcgggagcgtcgcgtcgggtcgttatatttcgcgtttgcgcgttttcgttttacgggatggatttcgtttttaggttttagtttcgtgcggcggggcggggatcgtagtcggttgggcggggaagttttgagtcggggaagttacgtggggcgtgttcggaggcgtcgcggggtttggcgggaaggggttggcgggttgttgttaggtgtatagtcgtttatatatatttcggttatagtcgtattttcgacgcgttatcggtattgaggtttttgtagttttttttaaggttcgaagattaaacgttgttttggttcgatagttgggttacgggtttgttcggggtcggtttgtttttttttcgcgcgtaaatatttgttcgtttagagtttcgagttttcgcgtgttttaggtcgcgcgtttcggtttttgtcgcgggatttgcgggttttgttcgttttgcggttttggtttttagtcgtagcggagttttgggttcggtttcggaggttagttgttgtgtggatgtatttttg

SEQ ID NO: 26786 - DNA, 1240 bp, Artificial Sequence
  chemically treated genomic DNA (Homo sapiens) CpG-island No: 26786
caaaaatacatccacacaacaactaacctccgaaaccgaacccaaaactccgctacgactaaaaaccaaaaccgcaaaacgaacaaaacccgcaaatcccgcgacaaaaaccgaaacgcgcgacctaaaacacgcgaaaactcgaaactctaaacgaacaaatatttacgcgcgaaaaaaaaacaaaccgaccccgaacaaacccgtaacccaactatcgaaccaaaacaacgtttaatcttcgaaccttaaaaaaaactacaaaaacctcaataccgataacgcgtcgaaaatacgactataaccgaaatatatataaacgactatacacctaacaacaacccgccaaccccttcccgccaaaccccgcgacgcctccgaacacgccccacgtaacttccccgactcaaaacttccccgcccaaccgactacgatccccgccccgccgcacgaaactaaaacctaaaaacgaaatccatcccgtaaaacgaaaacgcgcaaacgcgaaatataacgacccgacgcgacgctcccgacctaccccgcgtacacgctaacgccgcgcaatctcgtcccctaccgccgccgtcgccgctactatcgccgccgccgccgccattaaaatcgacgcctcctcaatacgtccgcgtcccgaactcaccgccgctaccgcctcgccaaaaacccgcgcgcccaacaaccgccgccgccgcccgaccgacgcccgaaaaattaacgacgaaacccgaaaccgcgcgaactaaaataacaaacccgacctctaaaaaaaacccgaaccgacgaacgccccgaccccgcgtctaattattcataaaacatatcgaccaccaacgtaaacacccaaataacgaaaccgaattacaaaaaccgcgaccgaaaccgaaacgcgaaatctaaattaaaatcctaaaactaaaacgcaaaacccgaaatcgcgaaaaccgaacccaaacgaaaccgaaatctcgaaaccgaaatcgcacgtaaccgcgcgtcgaaaccgacgaaactcgcgacccgttaaaaaccaattctctaataaataactttatatttccctcttcccccgaattatatataccccacgtcccgacctacgacgatacaaaaaacaaaaaaacaaaataataaaaataaacgaaatcccgaaacgaccgacgcgaactaaaataaaaaaaaacgaaaaaaaaacgatccaaaaaactacgtctaaaaccg

SEQ ID NO: 26787 - DNA, 1240 bp, Artificial Sequence
  chemically treated genomic DNA (Homo sapiens) CpG-island No: 26787
taggggtgtatttatataatagttgattttcgggatcgggtttagggtttcgttgcggttgaaggttagggtcgtaaagcgaataaagttcgtaggtttcgcggtaagggtcgaggcgcgcgatttggaatacgcgggggttcggagttttgggcgggtaggtgtttgcgcgcgggggaagggtagatcgatttcggatagattcgtagtttagttgtcggattagaatagcgtttagttttcggattttggggaaaattatagaggttttagtgtcggtagcgcgtcgggggtgcggttgtggtcggggtgtgtgtgggcggttgtatatttggtagtagttcgttagttttttttcgttaggtttcgcggcgttttcggatacgttttacgtgattttttcggtttagggttttttcgtttagtcggttgcggttttcgtttcgtcgtacgagattgggatttgagagcgaaatttatttcgtaagacgggagcgcgtaggcgcgaagtgtggcggttcggcgcggcgttttcggtttgtttcgcgtgtacgttgacgtcgcgtagtttcgttttttgtcgtcgtcgtcgtcgttgttgtcgtcgtcgtcgtcgttattggagtcgacgtttttttagtgcgttcgcgtttcgggtttatcgtcgttgtcgtttcgttaggggttcgcgcgtttagtagtcgtcgtcgtcgttcggtcggcgttcggggaattggcggcggggttcggggtcgcgcgagttagggtgataggttcggtttttaggggaggttcgagtcggcgggcgtttcggtttcgcgtttagttgtttatgaagtatgtcggttattagcgtggatatttaggtagcggggtcgggttataggggtcgcggtcggggtcgaggcgcggggtttgggttgaggttttggggttggaacgtagagttcggggtcgcggaggtcgggtttaggcgggatcggggtttcggggtcggggtcgtacgtgatcgcgcgtcggggtcggcggagttcgcggttcgttggagattagttttttggtgaataattttgtgttttttttttttttcgggttgtgtgtattttacgtttcggtttgcggcggtgtagagaataaaaggataagataataaaggtgagcggagtttcgggacggtcggcgcgggttggagtggaggaggacggggaaggaacggtttaggaagttgcgtttggaatcg

SEQ ID NO: 26788 - DNA, 1240 bp, Artificial Sequence
  chemically treated genomic DNA (Homo sapiens) CpG-island No: 26788
cgattccaaacgcaacttcctaaaccgttccttccccgtcctcctccactccaacccgcgccgaccgtcccgaaactccgctcacctttattatcttatccttttattctctacaccgccgcaaaccgaaacgtaaaatacacacaacccgaaaaaaaaaaaaaacacaaaattattcaccaaaaaactaatctccaacgaaccgcgaactccgccgaccccgacgcgcgatcacgtacgaccccgaccccgaaaccccgatcccgcctaaacccgacctccgcgaccccgaactctacgttccaaccccaaaacctcaacccaaaccccgcgcctcgaccccgaccgcgacccctataacccgaccccgctacctaaatatccacgctaataaccgacatacttcataaacaactaaacgcgaaaccgaaacgcccgccgactcgaacctcccctaaaaaccgaacctatcaccctaactcgcgcgaccccgaaccccgccgccaattccccgaacgccgaccgaacgacgacgacgactactaaacgcgcgaacccctaacgaaacgacaacgacgataaacccgaaacgcgaacgcactaaaaaaacgtcgactccaataacgacgacgacgacgacaacaacgacgacgacgacgacaaaaaacgaaactacgcgacgtcaacgtacacgcgaaacaaaccgaaaacgccgcgccgaaccgccacacttcgcgcctacgcgctcccgtcttacgaaataaatttcgctctcaaatcccaatctcgtacgacgaaacgaaaaccgcaaccgactaaacgaaaaaaccctaaaccgaaaaaatcacgtaaaacgtatccgaaaacgccgcgaaacctaacgaaaaaaaactaacgaactactaccaaatatacaaccgcccacacacaccccgaccacaaccgcacccccgacgcgctaccgacactaaaacctctataattttccccaaaatccgaaaactaaacgctattctaatccgacaactaaactacgaatctatccgaaatcgatctacccttcccccgcgcgcaaacacctacccgcccaaaactccgaacccccgcgtattccaaatcgcgcgcctcgacccttaccgcgaaacctacgaactttattcgctttacgaccctaaccttcaaccgcaacgaaaccctaaacccgatcccgaaaatcaactattatataaatacaccccta

SEQ ID NO: 26789 - DNA, 699 bp, Artificial Sequence
  chemically treated genomic DNA (Homo sapiens) CpG-island No: 26789
gtttatttttttttcggttttttgtttatttttttttcggttttttgtttatttttttttcggttcggcgtttatttttttttcggttttttgtttatttttttttcggtttttcgtttattttttttttggttttttagtttttcgtttatttttttttcggttttttatttatttttttttcggtttttcgtttattttttttcgggtttttcgtttatttttttttcggtttttcgtttattttttttcgggtttttcgtttattttttttcgggtttttcgtttatttttttttcggtttttcgtttattttttttcgggtttttcgtttattttttttcgggtttttcgtttatttttttttcggtttttcgtttattttttttcgggtttttcgtttatttttttttcggtttttcgtttattttttttcgggtttttcgtttatttttttttcggtttttcgtttattttttttcgggtttttcgtttattttttttcgggtttttcgtttatttttttttcggtttttcgtttattttttttcgggtttttcgtttatttttttttcgttttttcgtttatttttttttcgttttttcgtttatttttttttcggtttttcgtttattttttttttggttttttagtttttcgtttatttttttttcggttttttgtttattttttttttg

SEQ ID NO: 26790 - DNA, 699 bp, Artificial Sequence
  chemically treated genomic DNA (Homo sapiens) CpG-island No: 26790
caaaaaaaaaataaacaaaaaaccgaaaaaaaaataaacgaaaaactaaaaaaccaaaaaaaaaataaacgaaaaaccgaaaaaaaaataaacgaaaaaacgaaaaaaaaataaacgaaaaaacgaaaaaaaaataaacgaaaaacccgaaaaaaaataaacgaaaaaccgaaaaaaaaataaacgaaaaacccgaaaaaaaataaacgaaaaacccgaaaaaaaataaacgaaaaaccgaaaaaaaaataaacgaaaaacccgaaaaaaaataaacgaaaaaccgaaaaaaaaataaacgaaaaacccgaaaaaaaataaacgaaaaaccgaaaaaaaaataaacgaaaaacccgaaaaaaaataaacgaaaaacccgaaaaaaaataaacgaaaaaccgaaaaaaaaataaacgaaaaacccgaaaaaaaataaacgaaaaacccgaaaaaaaataaacgaaaaaccgaaaaaaaaataaacgaaaaacccgaaaaaaaataaacgaaaaaccgaaaaaaaaataaataaaaaaccgaaaaaaaaataaacgaaaaactaaaaaaccaaaaaaaaaataaacgaaaaaccgaaaaaaaaataaacaaaaaaccgaaaaaaaaataaacgccgaaccgaaaaaaaaataaacaaaaaaccgaaaaaaaaataaacaaaaaaccgaaaaaaaaataaac

SEQ ID NO: 26791 - DNA, 699 bp, Artificial Sequence
  chemically treated genomic DNA (Homo sapiens) CpG-island No: 26791
taggagagggatggatagggagtcgggagagggatggacggggagttggggagttaggagagggatggacggggagtcgggagagggatggacggggagacgggagagggatggacggggagacgggagagggatggacggggagttcggagagggatggacggggagtcgggagagggatggacggggagttcggagagggatggacggggagttcggagagggatggacggggagtcgggagagggatggacggggagttcggagagggatggacggggagtcgggagagggatggacggggagttcggagagggatggacggggagtcgggagagggatggacggggagttcggagagggatggacggggagttcggagagggatggacggggagtcgggagagggatggacggggagttcggagagggatggacggggagttcggagagggatggacggggagtcgggagagggatggacggggagttcggagagggatggacggggagtcggaagagggatggatggggagtcgggagagggatggacggggagttggggagttaggagagggatggacggggagtcgggagagggatggatagggagtcgggagagggatggacgtcgagtcgggagagggatggatagggagtcgggagagggatggatagggagtcgggagagggatggat

SEQ ID NO: 26792 - DNA, 699 bp, Artificial Sequence
  chemically treated genomic DNA (Homo sapiens) CpG-island No: 26792
atccatccctctcccgactccctatccatccctctcccgactccctatccatccctctcccgactcgacgtccatccctctcccgactccctatccatccctctcccgactccccgtccatccctctcctaactccccaactccccgtccatccctctcccgactccccatccatccctcttccgactccccgtccatccctctccgaactccccgtccatccctctcccgactccccgtccatccctctccgaactccccgtccatccctctccgaactccccgtccatccctctcccgactccccgtccatccctctccgaactccccgtccatccctctccgaactccccgtccatccctctcccgactccccgtccatccctctccgaactccccgtccatccctctcccgactccccgtccatccctctccgaactccccgtccatccctctcccgactccccgtccatccctctccgaactccccgtccatccctctccgaactccccgtccatccctctcccgactccccgtccatccctctccgaactccccgtccatccctctcccgtctccccgtccatccctctcccgtctccccgtccatccctctcccgactccccgtccatccctctcctaactccccaactccccgtccatccctctcccgactccctatccatccctctccta

SEQ ID NO: 26793 - DNA, 870 bp, Artificial Sequence
  chemically treated genomic DNA (Homo sapiens) CpG-island No: 26793
gcgtgaggaaacggggatttgttcggggtagtagatttttagcggtgaagacgtagagtatcgggttgacgttagaattgaagaaggttaaggtcgtagttttcgttcgcgtcgtttggtcggtttcgtttagtttcgttaaggtttttttcggtggagttagcgttgcgatcgtttgtagaaggttgattgcgtggtagggggtttagagtaagtcgaaggtaagtacgatggcgtttattagtcggtttattcgcgtttcgtgtcgttcggagttttagcgggcgtttcgtagtcgtgttagcgttacgttgtagtagtcgagtattagttcgaaaggaagtacgaaagcggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgtggtcgttagcggtcgttttcgtgtaggtcgttagttcgttaagttttatattacgaagtcgttgttaggtagttttagtagcgtcgttagtagtaggaaggttgtgtttgtggttcgcgaagtttttt

SEQ ID NO: 26794 - DNA, 870 bp, Artificial Sequence
  chemically treated genomic DNA (Homo sapiens) CpG-island No: 26794
aaaaaacttcgcgaaccacaaacacaaccttcctactactaacgacgctactaaaactacctaacaacgacttcgtaatataaaacttaacgaactaacgacctacacgaaaacgaccgctaacgaccacgcttatactacacctaacgctaaccgacgacgcgatactactactcacgccgctctttataaccttcctaacccgacaaacctaaccgctaaaccaaacgaactacaaaacgatatactacgtatacgcgctcaacatatacgccaacgtactactcaccgacctactcaacctacaacgctacctcgcaatcacccgccccttcctaacgcctcgactacgcaacccgaccctaacccgccgcctactactaacgatctaactaaccgccctattactcgccgtcccgaccgccgtctaccgccacctataaaaaaaccgcgtataccaactataccacccgtcgccgatccacgccgccgcccacctaaacctaaaaactctaaccgctttcgtacttcctttcgaactaatactcgactactacaacgtaacgctaacacgactacgaaacgcccgctaaaactccgaacgacacgaaacgcgaataaaccgactaataaacgccatcgtacttaccttcgacttactctaaaccccctaccacgcaatcaaccttctacaaacgatcgcaacgctaactccaccgaaaaaaaccttaacgaaactaaacgaaaccgaccaaacgacgcgaacgaaaactacgaccttaaccttcttcaattctaacgtcaacccgatactctacgtcttcaccgctaaaaatctactaccccgaacaaatccccgtttcctcacgc

SEQ ID NO: 26795 - DNA, 870 bp, Artificial Sequence
  chemically treated genomic DNA (Homo sapiens) CpG-island No: 26795
ggaagatttcgcgggttataggtatagtttttttgttgttggcggcgttgttggggttgtttggtaacggtttcgtggtgtggagtttggcgggttggcggtttgtacgggggcgatcgttggcggttacgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatcgttttcgtgttttttttcgggttgatgttcggttgttatagcgtgacgttggtacggttgcggggcgttcgttggggtttcgggcggtacggggcgcgggtgggtcggttggtgagcgttatcgtgtttgttttcggtttgttttgggttttttattacgtagttaattttttgtaggcggtcgtagcgttggttttatcggaaggggttttggcgaagttgggcggagtcggttaggcggcgcgagcgggaattacggttttggttttttttagttttagcgttaattcggtgttttacgtttttatcgttggagatttgttgtttcgggtaggttttcgtttttttacgt

SEQ ID NO: 26796 - DNA, 870 bp, Artificial Sequence
  chemically treated genomic DNA (Homo sapiens) CpG-island No: 26796
acgtaaaaaaacgaaaacctacccgaaacaacaaatctccaacgataaaaacgtaaaacaccgaattaacgctaaaactaaaaaaaaccaaaaccgtaattcccgctcgcgccgcctaaccgactccgcccaacttcgccaaaaccccttccgataaaaccaacgctacgaccgcctacaaaaaattaactacgtaataaaaaacccaaaacaaaccgaaaacaaacacgataacgctcaccaaccgacccacccgcgccccgtaccgcccgaaaccccaacgaacgccccgcaaccgtaccaacgtcacgctataacaaccgaacatcaacccgaaaaaaaacacgaaaacgatcaaaatctccaaactcaaataaacgacgacgtaaaccgacgacgaataacacaactaacatacgcgatccctccacaaataacgataaacgacgaccgaaacgacgaacaacaaaacgaccaaccaaaccgccaacaacaaacgacgaaccaaaaccgaactacgcaaccgaaacgccaaaaaaaaacgaataactacgaaacaacgctacaaactaaacaaaccgataaacaacacgctaacgtacatactaaacgcgcacacgtaatacaccgccttacaacccgcctaacccaacgaccaaacctaccgaatcaaaaaaaccacaaaaaacgacgtaaacaacaacaccgcgccgtcgaccaacgccaaatacaacacaaacgtaaccgccaacgatcgcccccgtacaaaccgccaacccgccaaactccacaccacgaaaccgttaccaaacaaccccaacaacgccgccaacaacaaaaaaactatacctataacccgcgaaatcttcc

SEQ ID NO: 26797 - DNA, 789 bp, Artificial Sequence
  chemically treated genomic DNA (Homo sapiens) CpG-island No: 26797
ggtgggcgcggggtatgattatcgtcgtcgtatttatgattgttttttttattatgtaattcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggtatttcgttaacggatttattattttaagaattggagttaattaatttttgcggagaattgtgaatgcgtaaattaatttttggtagaatatat

SEQ ID NO: 26798 - DNA, 789 bp, Artificial Sequence
  chemically treated genomic DNA (Homo sapiens) CpG-island No: 26798
atatattctaccaaaaattaatttacgcattcacaattctccgcaaaaattaattaactccaattcttaaaataataaatccgttaacgaaataccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgaattacataataaaaaaaacaatcataaatacgacgacgataatcataccccgcgcccacc

SEQ ID NO: 26799 - DNA, 789 bp, Artificial Sequence
  chemically treated genomic DNA (Homo sapiens) CpG-island No: 26799
atatgttttgttaagggttggtttgcgtatttatagtttttcgtaagaattgattggttttaatttttggagtggtgaattcgttagcgaggtgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcgagttgtatgataaagaagatagttataagtgcggcgacgatagttatgtttcgcgtttatt

SEQ ID NO: 26800 - DNA, 789 bp, Artificial Sequence
  chemically treated genomic DNA (Homo sapiens) CpG-island No: 26800
aataaacgcgaaacataactatcgtcgccgcacttataactatcttctttatcatacaactcgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgacacctcgctaacgaattcaccactccaaaaattaaaaccaatcaattcttacgaaaaactataaatacgcaaaccaacccttaacaaaacatat

SEQ ID NO: 26801 - DNA, 616 bp, Artificial Sequence
  chemically treated genomic DNA (Homo sapiens) CpG-island No: 26801
agttcgggtgtagcgggttttttttatcgcgtaggtcgttaaatgtttgggtgatcgttcgtagcggtcgttcgtcgcgtttcgagtttttgttttttggtaggcgcgggcgtattagggagggttagcgcgaggaggacggcgtagggaatgggtagggggcgcgcggtgtcggtagcggtatttgggtaggtaaggatcgcggtaatcggaataggacgggttcgggaagcggtaatcgcgacgtagttttgcgggttttaggggcgcgagttgggaatttttttttattcgaaatttcgttagatttatttgtagtagtacgcggaagatgtattagtcgatgatgagtagtttagtcgaggtcgtcgttattgtcgttatggttttaagaatggtaggtgggtggtcgagaaagagggtttgtcgagattcgttggtttcggagttcgttgttgggcgtattgtcgtagtcgcggtggtcgcgttttaagtattcgttcgttatttaagtgcgtatgcgcgttttggggggtgtttatgaggaggggtggttgggggcgttttttattcgttaggagaggaaaaaaataatttatttgttttttttatatcg

SEQ ID NO: 26802 - DNA, 616 bp, Artificial Sequence
  chemically treated genomic DNA (Homo sapiens) CpG-island No: 26802
cgatataaaaaaaacaaataaattatttttttcctctcctaacgaataaaaaacgcccccaaccacccctcctcataaacaccccccaaaacgcgcatacgcacttaaataacgaacgaatacttaaaacgcgaccaccgcgactacgacaatacgcccaacaacgaactccgaaaccaacgaatctcgacaaaccctctttctcgaccacccacctaccattcttaaaaccataacgacaataacgacgacctcgactaaactactcatcatcgactaatacatcttccgcgtactactacaaataaatctaacgaaatttcgaataaaaaaaaattcccaactcgcgcccctaaaacccgcaaaactacgtcgcgattaccgcttcccgaacccgtcctattccgattaccgcgatccttacctacccaaataccgctaccgacaccgcgcgccccctacccattccctacgccgtcctcctcgcgctaaccctccctaatacgcccgcgcctaccaaaaaacaaaaactcgaaacgcgacgaacgaccgctacgaacgatcacccaaacatttaacgacctacgcgataaaaaaaacccgctacacccgaact

SEQ ID NO: 26803 - DNA, 616 bp, Artificial Sequence
  chemically treated genomic DNA (Homo sapiens) CpG-island No: 26803
cggtatggaaagagtagatggattatttttttttttttttggcgaatgaggagcgtttttagttatttttttttataaatattttttaaggcgcgtatgcgtatttaggtggcgggcgggtatttaaggcgcggttatcgcggttgcggtagtgcgtttaatagcggatttcgagattagcggatttcggtaaattttttttttcgattatttatttattatttttggaattatggcggtagtggcggcggtttcggttgaattgtttattatcggttggtatatttttcgcgtgttgttgtaggtaagtttgacggggtttcgggtgggagagggtttttaattcgcgtttttagaattcgtaagattgcgtcgcgattgtcgtttttcggattcgttttatttcgattgtcgcgatttttgtttgtttaagtgtcgttgtcggtatcgcgcgttttttgtttattttttgcgtcgtttttttcgcgttgattttttttagtgcgttcgcgtttgttagggaataaagattcggggcgcggcgggcgatcgttgcggacgattatttaggtatttagcgatttacgcggtaagaaaaattcgttatattcggatt

SEQ ID NO: 26804 - DNA, 616 bp, Artificial Sequence
  chemically treated genomic DNA (Homo sapiens) CpG-island No: 26804
aatccgaatataacgaatttttcttaccgcgtaaatcgctaaatacctaaataatcgtccgcaacgatcgcccgccgcgccccgaatctttattccctaacaaacgcgaacgcactaaaaaaaatcaacgcgaaaaaaacgacgcaaaaaataaacaaaaaacgcgcgataccgacaacgacacttaaacaaacaaaaatcgcgacaatcgaaataaaacgaatccgaaaaacgacaatcgcgacgcaatcttacgaattctaaaaacgcgaattaaaaaccctctcccacccgaaaccccgtcaaacttacctacaacaacacgcgaaaaatataccaaccgataataaacaattcaaccgaaaccgccgccactaccgccataattccaaaaataataaataaataatcgaaaaaaaaaatttaccgaaatccgctaatctcgaaatccgctattaaacgcactaccgcaaccgcgataaccgcgccttaaatacccgcccgccacctaaatacgcatacgcgccttaaaaaatatttataaaaaaaaataactaaaaacgctcctcattcgccaaaaaaaaaaaaaaataatccatctactctttccataccg

SEQ ID NO: 26805 - DNA, 884 bp, Artificial Sequence
  chemically treated genomic DNA (Homo sapiens) CpG-island No: 26805
taggggttggcgggcgttttacgttttttttcgttcgttttttttttagtcgttttttattaggaatatagcgacgtggttagcgttcgcgaattgcggcggtagtagcgcgaggaggagggttcgggggacgaggtcgagggcgtagaggaggggtcggggtcgtcgcgggttaattttttttttagtagtttttttcgggcgtagcgttcggcgcgaggttttattttttcgttgtggtaggatattttcgacgtacgcggtagcggcgttttggttacgttgagtttgcgggattgtaagttgtaggaggtgggcgcgcgcggggattcggcggggcgggggcgggtcggggagtacgcggttcggggatttagcgggaatcgggttatagagggagggggatatataaagggggttgttggcgcgattgttcgcgcggaaggttggttttaggatttgattatacgaggtcgtttggaagcgaggatagtaagtcgttgagcgagaggcgaggggagtcgggtttgggtgcgggtagggggcggagttagcgggacgaaatttaggataggatagggtcggatgaggagcggaattattggaagagtaaacgtttggtgggcgcggaataaggcggggttaggattaggggcgggatttggggggtgggcggggttttgggaagaacgcgtcggggcggggtttaggagaggggcgggatcgaggataggaaaggtttgtataatttttcgcggcgggacgtgggtcgtcgggttcgttcggcgttagattaggagtggggttagagaaggggcgaggacgcgaggtgtggcgttttggggtttggggatgtgaggttagggttttcgaggtgaattggt

SEQ ID NO: 26806 - DNA, 884 bp, Artificial Sequence
  chemically treated genomic DNA (Homo sapiens) CpG-island No: 26806
accaattcacctcgaaaaccctaacctcacatccccaaaccccaaaacgccacacctcgcgtcctcgccccttctctaaccccactcctaatctaacgccgaacgaacccgacgacccacgtcccgccgcgaaaaattatacaaacctttcctatcctcgatcccgcccctctcctaaaccccgccccgacgcgttcttcccaaaaccccgcccaccccccaaatcccgcccctaatcctaaccccgccttattccgcgcccaccaaacgtttactcttccaataattccgctcctcatccgaccctatcctatcctaaatttcgtcccgctaactccgccccctacccgcacccaaacccgactcccctcgcctctcgctcaacgacttactatcctcgcttccaaacgacctcgtataatcaaatcctaaaaccaaccttccgcgcgaacaatcgcgccaacaaccccctttatatatccccctccctctataacccgattcccgctaaatccccgaaccgcgtactccccgacccgcccccgccccgccgaatccccgcgcgcgcccacctcctacaacttacaatcccgcaaactcaacgtaaccaaaacgccgctaccgcgtacgtcgaaaatatcctaccacaacgaaaaaataaaacctcgcgccgaacgctacgcccgaaaaaaactactaaaaaaaaaattaacccgcgacgaccccgacccctcctctacgccctcgacctcgtcccccgaaccctcctcctcgcgctactaccgccgcaattcgcgaacgctaaccacgtcgctatattcctaataaaaaacgactaaaaaaaaaacgaacgaaaaaaaacgtaaaacgcccgccaaccccta

SEQ ID NO: 26807 - DNA, 884 bp, Artificial Sequence
  chemically treated genomic DNA (Homo sapiens) CpG-island No: 26807
attagtttatttcggaggttttggttttatatttttagattttaggacgttatatttcgcgttttcgttttttttttagttttatttttaatttggcgtcgggcgggttcggcgatttacgtttcgtcgcgggaaattgtgtaagttttttttgttttcgatttcgttttttttttaagtttcgtttcgacgcgttttttttagagtttcgtttattttttaggtttcgtttttgattttggtttcgttttgtttcgcgtttattaggcgtttgtttttttaatggtttcgttttttattcggttttgttttattttaggtttcgtttcgttggtttcgttttttattcgtatttaagttcggtttttttcgtttttcgtttagcggtttgttgttttcgtttttagacggtttcgtgtagttaggttttagagttaatttttcgcgcggatagtcgcgttagtaattttttttgtgtgtttttttttttttatggttcggttttcgttaagttttcggatcgcgtatttttcggttcgttttcgtttcgtcgggttttcgcgcgcgtttattttttgtagtttgtagtttcgtaggtttagcgtggttaggacgtcgttgtcgcgtacgtcggggatattttgttatagcgagaaggtggagtttcgcgtcgagcgttgcgttcggaaggagttgttgggggagaggttggttcgcggcggtttcggttttttttttgcgttttcggtttcgtttttcgggttttttttttcgcgttgttgtcgtcgtagttcgcgggcgttggttacgtcgttgtatttttgatagaggacggttgggggaaagacgggcgggggagagcgtggggcgttcgttagtttttg

SEQ ID NO: 26808 - DNA, 884 bp, Artificial Sequence
  chemically treated genomic DNA (Homo sapiens) CpG-island No: 26808
caaaaactaacgaacgccccacgctctcccccgcccgtctttcccccaaccgtcctctatcaaaaatacaacgacgtaaccaacgcccgcgaactacgacgacaacaacgcgaaaaaaaaaacccgaaaaacgaaaccgaaaacgcaaaaaaaaaaccgaaaccgccgcgaaccaacctctcccccaacaactccttccgaacgcaacgctcgacgcgaaactccaccttctcgctataacaaaatatccccgacgtacgcgacaacgacgtcctaaccacgctaaacctacgaaactacaaactacaaaaaataaacgcgcgcgaaaacccgacgaaacgaaaacgaaccgaaaaatacgcgatccgaaaacttaacgaaaaccgaaccataaaaaaaaaaaaacacacaaaaaaaattactaacgcgactatccgcgcgaaaaattaactctaaaacctaactacacgaaaccgtctaaaaacgaaaacaacaaaccgctaaacgaaaaacgaaaaaaaccgaacttaaatacgaataaaaaacgaaaccaacgaaacgaaacctaaaataaaacaaaaccgaataaaaaacgaaaccattaaaaaaacaaacgcctaataaacgcgaaacaaaacgaaaccaaaatcaaaaacgaaacctaaaaaataaacgaaactctaaaaaaaacgcgtcgaaacgaaacttaaaaaaaaaacgaaatcgaaaacaaaaaaaacttacacaatttcccgcgacgaaacgtaaatcgccgaacccgcccgacgccaaattaaaaataaaactaaaaaaaaaacgaaaacgcgaaatataacgtcctaaaatctaaaaatataaaaccaaaacctccgaaataaactaat

SEQ ID NO: 26809 - DNA, 838 bp, Artificial Sequence
  chemically treated genomic DNA (Homo sapiens) CpG-island No: 26809
cgagcgtagtatttagcgtagtggttttaggttgtttagagcgttttttatttgcgggttcgacgcgtttcgtgtttcgttacgatcgcgggcgtatatcgcgcggaattgtaggcgcggttcgggatttgggttttgttcgggatacgtttagttagcgcggatttggaacgattcgttgtttagtattagcggtatcggtagtggttcgtgtgttatcgggtcggtttttagtattgggttcggtgcggtacgggcgtcgcggaacggaaatacgttcgtcgttattttggagcgcgcgtttagtttcgtttttcggcgtagtgttcgtttagacgtcgcgaaatcgcgttttcgacgttacgtcgcgcgatttaggtttttaagtatttcgatgtttttttttttttcgaagttcggttagcgtttttatttgattcgtttttggttgttaaggttgtttttaggatcgttgagacgtatttattttggttgcgaaattttacgttttttaattttttttttaatagtttatgagtgtttacgtttttttattttagtcgggacgttcggtttggaagtttcgttttaaagtttatcgtcgttaggtttcgtttttttttggttgttagttttagcgtcgcgttcggtggagtttcgtttttttgtttggttacgttttattgtcgggcgcgtatcgtcggtcgggcgcgtattttcgatcgtcggcggtttcgttttcgcgtggttgtttcgtttttagttttgcgttttggttagaagggttttttattttttgacgttttttttacgttaagaaattttaaattttgtcgat

SEQ ID NO: 26810 - DNA, 838 bp, Artificial Sequence
  chemically treated genomic DNA (Homo sapiens) CpG-island No: 26810
atcgacaaaatttaaaatttcttaacgtaaaaaaaacgtcaaaaaataaaaaacccttctaaccaaaacgcaaaactaaaaacgaaacaaccacgcgaaaacgaaaccgccgacgatcgaaaatacgcgcccgaccgacgatacgcgcccgacaataaaacgtaaccaaacaaaaaaacgaaactccaccgaacgcgacgctaaaactaacaaccaaaaaaaaacgaaacctaacgacgataaactttaaaacgaaacttccaaaccgaacgtcccgactaaaataaaaaaacgtaaacactcataaactattaaaaaaaaaattaaaaaacgtaaaatttcgcaaccaaaataaatacgtctcaacgatcctaaaaacaaccttaacaaccaaaaacgaatcaaataaaaacgctaaccgaacttcgaaaaaaaaaaaaacatcgaaatacttaaaaacctaaatcgcgcgacgtaacgtcgaaaacgcgatttcgcgacgtctaaacgaacactacgccgaaaaacgaaactaaacgcgcgctccaaaataacgacgaacgtatttccgttccgcgacgcccgtaccgcaccgaacccaatactaaaaaccgacccgataacacacgaaccactaccgataccgctaatactaaacaacgaatcgttccaaatccgcgctaactaaacgtatcccgaacaaaacccaaatcccgaaccgcgcctacaattccgcgcgatatacgcccgcgatcgtaacgaaacacgaaacgcgtcgaacccgcaaataaaaaacgctctaaacaacctaaaaccactacgctaaatactacgctcg

SEQ ID NO: 26811 - DNA, 838 bp, Artificial Sequence
  chemically treated genomic DNA (Homo sapiens) CpG-island No: 26811
gtcggtagagtttgagattttttaacgtaaaggaagcgttaaaagataaaggatttttttagttaggacgtaagattgagggcgagatagttacgcggaggcggggtcgtcggcggtcgaaggtgcgcgttcggtcgacggtgcgcgttcggtaatggggcgtggttaggtagagaggcggggttttatcgagcgcggcgttgaagttggtagttagaaaggggcggggtttggcgacgataggttttggggcggggtttttaaatcgggcgtttcggttagagtgaaggggcgtgggtatttataggttattgggggagaggttaagaaacgtagaatttcgtagttagaatgggtacgttttagcgattttgaaagtagttttgatagttagaggcgagttaagtggaaacgttggtcgggtttcgagaagggagggggtatcgaggtatttaaaggtttgaatcgcgcggcgtgacgtcgggggcgcggtttcgcggcgtttgggcggatattgcgtcgaggggcggggttggacgcgcgttttaagatggcggcgaacgtgttttcgtttcgcgacgttcgtgtcgtatcggatttagtgttggaggtcggttcggtggtatacgggttattgtcggtatcgttggtgttggataacgggtcgttttaagttcgcgttggttgggcgtgtttcgggtaggatttaggtttcgagtcgcgtttgtagtttcgcgcggtgtgcgttcgcggtcgtggcggggtacggggcgcgtcgggttcgtaggtggggaacgttttgggtagtttggagttattgcgttggatgttgcgttcg

SEQ ID NO: 26812 - DNA, 838 bp, Artificial Sequence
  chemically treated genomic DNA (Homo sapiens) CpG-island No: 26812
cgaacgcaacatccaacgcaataactccaaactacccaaaacgttccccacctacgaacccgacgcgccccgtaccccgccacgaccgcgaacgcacaccgcgcgaaactacaaacgcgactcgaaacctaaatcctacccgaaacacgcccaaccaacgcgaacttaaaacgacccgttatccaacaccaacgataccgacaataacccgtataccaccgaaccgacctccaacactaaatccgatacgacacgaacgtcgcgaaacgaaaacacgttcgccgccatcttaaaacgcgcgtccaaccccgcccctcgacgcaatatccgcccaaacgccgcgaaaccgcgcccccgacgtcacgccgcgcgattcaaacctttaaatacctcgataccccctcccttctcgaaacccgaccaacgtttccacttaactcgcctctaactatcaaaactactttcaaaatcgctaaaacgtacccattctaactacgaaattctacgtttcttaacctctcccccaataacctataaatacccacgccccttcactctaaccgaaacgcccgatttaaaaaccccgccccaaaacctatcgtcgccaaaccccgcccctttctaactaccaacttcaacgccgcgctcgataaaaccccgcctctctacctaaccacgccccattaccgaacgcgcaccgtcgaccgaacgcgcaccttcgaccgccgacgaccccgcctccgcgtaactatctcgccctcaatcttacgtcctaactaaaaaaatcctttatcttttaacgcttcctttacgttaaaaaatctcaaactctaccgac

SEQ ID NO: 26813 - DNA, 728 bp, Artificial Sequence
  chemically treated genomic DNA (Homo sapiens) CpG-island No: 26813
gcggttcgcgtcgcggtcgttagagggcgcggagcggcggggtttttcgtacggagggttttgcgtgaggtatcgcgtggggcggggttgcgggcgggtttttagttgttgggtttttatcggttgggtttcgtcgatcggtaagcggaacgcggtagcggggttgggtttgtgcggcggtcgtcggagcgttttggaaggcgtacggggcgaagatggcggcggagcgataggaggcgttgagggagttcgtggcggtgacgggcgtcgaggaggatcgggttcgtttttttttcgagtcggtcggttgggatttgtaggtagcgtcgcgcggcgggttgtgtcgggtgggtcggggattgttgggagcgggcgtttggtgttttaagttcgcggcggtcgaagcgtatagttattttcgttttatcgcggttcgatttaggttttatggtttcgggatcgtttgttacgcgtcgtttgttcggtttgggagtgggggaacgcgggttagttttagttagttttgtcgtgttagttttattttgtttcgttcgtttgcggcgttagcgagatttcgggcgttgcggtagtcggcgaggagagggagcgtttgggggcgtggttgtcgcgtcgagtatttgttggaggtcgggttggttcgagtgagtagtttttgggtgaagttttattcgggattaggtggtcgtttatttttattttcgaagttt

SEQ ID NO: 26814 - DNA, 728 bp, Artificial Sequence
  chemically treated genomic DNA (Homo sapiens) CpG-island No: 26814
aaacttcgaaaataaaaataaacgaccacctaatcccgaataaaacttcacccaaaaactactcactcgaaccaacccgacctccaacaaatactcgacgcgacaaccacgcccccaaacgctccctctcctcgccgactaccgcaacgcccgaaatctcgctaacgccgcaaacgaacgaaacaaaataaaactaacacgacaaaactaactaaaactaacccgcgttcccccactcccaaaccgaacaaacgacgcgtaacaaacgatcccgaaaccataaaacctaaatcgaaccgcgataaaacgaaaataactatacgcttcgaccgccgcgaacttaaaacaccaaacgcccgctcccaacaatccccgacccacccgacacaacccgccgcgcgacgctacctacaaatcccaaccgaccgactcgaaaaaaaaacgaacccgatcctcctcgacgcccgtcaccgccacgaactccctcaacgcctcctatcgctccgccgccatcttcgccccgtacgccttccaaaacgctccgacgaccgccgcacaaacccaaccccgctaccgcgttccgcttaccgatcgacgaaacccaaccgataaaaacccaacaactaaaaacccgcccgcaaccccgccccacgcgatacctcacgcaaaaccctccgtacgaaaaaccccgccgctccgcgccctctaacgaccgcgacgcgaaccgc

SEQ ID NO: 26815 - DNA, 728 bp, Artificial Sequence
  chemically treated genomic DNA (Homo sapiens) CpG-island No: 26815
ggatttcggaagtggaaatgagcggttatttagtttcgagtggggttttatttaagagttgtttattcggattagttcggtttttagtagatattcggcgcggtagttacgtttttaggcgtttttttttttcgtcggttgtcgtagcgttcgaagtttcgttgacgtcgtaagcgggcgaggtagggtgaaattggtacggtagaattggttggggttggttcgcgtttttttatttttaagtcgagtaggcgacgcgtgataagcggtttcgggattatgaggtttgggtcgggtcgcggtagagcggggatgattgtgcgtttcggtcgtcgcgggtttaaggtattaggcgttcgtttttagtagttttcggtttattcgatatagttcgtcgcgcggcgttatttgtaagttttagtcggtcgattcgagaaagaagcgggttcggtttttttcggcgttcgttatcgttacgaatttttttagcgttttttgtcgtttcgtcgttattttcgtttcgtgcgttttttaaagcgtttcggcggtcgtcgtataggtttagtttcgttgtcgcgtttcgtttgtcggtcgacgaggtttagtcgatgagggtttagtagttgggagttcgttcgtagtttcgttttacgcggtgttttacgtaaagtttttcgtgcgggaagtttcgtcgtttcgcgttttttggcgatcgcggcgcgaatcgt

SEQ ID NO: 26816 - DNA, 728 bp, Artificial Sequence
  chemically treated genomic DNA (Homo sapiens) CpG-island No: 26816
acgattcgcgccgcgatcgccaaaaaacgcgaaacgacgaaacttcccgcacgaaaaactttacgtaaaacaccgcgtaaaacgaaactacgaacgaactcccaactactaaaccctcatcgactaaacctcgtcgaccgacaaacgaaacgcgacaacgaaactaaacctatacgacgaccgccgaaacgctttaaaaaacgcacgaaacgaaaataacgacgaaacgacaaaaaacgctaaaaaaattcgtaacgataacgaacgccgaaaaaaaccgaacccgcttctttctcgaatcgaccgactaaaacttacaaataacgccgcgcgacgaactatatcgaataaaccgaaaactactaaaaacgaacgcctaataccttaaacccgcgacgaccgaaacgcacaatcatccccgctctaccgcgacccgacccaaacctcataatcccgaaaccgcttatcacgcgtcgcctactcgacttaaaaataaaaaaacgcgaaccaaccccaaccaattctaccgtaccaatttcaccctacctcgcccgcttacgacgtcaacgaaacttcgaacgctacgacaaccgacgaaaaaaaaaaacgcctaaaaacgtaactaccgcgccgaatatctactaaaaaccgaactaatccgaataaacaactcttaaataaaaccccactcgaaactaaataaccgctcatttccacttccgaaatcc

SEQ ID NO: 26817 - DNA, 667 bp, Artificial Sequence
  chemically treated genomic DNA (Homo sapiens) CpG-island No: 26817
ttttcggaggtttcggggtttttgggttttcggtttttttttcggaggtttgggttttcgggacgtcgcgcgtcgtgtggggcgcgtacgtagggttgggcgtgagggggcgtgcgcgtgcgtaggcgacgcgtcgaggtattaggtagagtcgtggaatcgtcgttaggtcgttgttggtttacgtcgttcgtcgcgtcgttcgttcgtttagcgttcgtcgtcgttatgggagtgtaggtggaaattatttttttaggagacggtgagtagtggcgcgcggcggttcggagtatttttgtcgtcgcgcgtatcggtttagtatgttcgtttttgtttttttagggcgtattttttttaagcgcggttagatttgcgtggtgtattatatcggtgagtcgggggtttagcggggagggggttcgggtcgtagttcgtagttcgggtgcggttggtcgtcgaggtttgggggttcggggtttggggttcggggcgtggcggcggcgaggttcgtatggttcgaggttgaggtttgggcggtggtttaggggtagtttggggtttgcggaattcgggcgggtttgaatcggcggttgtgagcgtcggttgcgggttaggtgttatttgattcgttagaagtatttttgtattttagatgttgttttta

SEQ ID NO: 26818 - DNA, 667 bp, Artificial Sequence
  chemically treated genomic DNA (Homo sapiens) CpG-island No: 26818
taaaaacaacatctaaaatacaaaaatacttctaacgaatcaaataacacctaacccgcaaccgacgctcacaaccgccgattcaaacccgcccgaattccgcaaaccccaaactacccctaaaccaccgcccaaacctcaacctcgaaccatacgaacctcgccgccgccacgccccgaaccccaaaccccgaacccccaaacctcgacgaccaaccgcacccgaactacgaactacgacccgaaccccctccccgctaaacccccgactcaccgatataatacaccacgcaaatctaaccgcgcttaaaaaaaatacgccctaaaaaaacaaaaacgaacatactaaaccgatacgcgcgacgacaaaaatactccgaaccgccgcgcgccactactcaccgtctcctaaaaaaataatttccacctacactcccataacgacgacgaacgctaaacgaacgaacgacgcgacgaacgacgtaaaccaacaacgacctaacgacgattccacgactctacctaatacctcgacgcgtcgcctacgcacgcgcacgccccctcacgcccaaccctacgtacgcgccccacacgacgcgcgacgtcccgaaaacccaaacctccgaaaaaaaaaccgaaaacccaaaaaccccgaaacctccgaaaa

SEQ ID NO: 26819 - DNA, 667 bp, Artificial Sequence
  chemically treated genomic DNA (Homo sapiens) CpG-island No: 26819
taagggtagtatttaaggtgtagaaatgtttttgacgggttagataatatttagttcgtagtcgacgtttatagtcgtcgatttagattcgttcgggtttcgtaagttttaggttgtttttgagttatcgtttaggttttagtttcgggttatgcggatttcgtcgtcgttacgtttcggattttaggtttcgggtttttaggtttcgacggttagtcgtattcgggttgcggattgcggttcgggtttttttttcgttgggttttcgatttatcggtgtagtgtattacgtaggtttggtcgcgtttggggaaggtgcgttttgaggagatagagacgggtatgttgagtcgatgcgcgcggcggtagaggtatttcgagtcgtcgcgcgttattatttatcgttttttggggagatggtttttatttgtatttttatggcggcggcggacgttgagcgggcgggcggcgcgacgggcggcgtggattaatagcgatttggcggcggttttacggttttgtttagtatttcggcgcgtcgtttgcgtacgcgtacgtttttttacgtttagttttgcgtgcgcgttttatacggcgcgcgacgtttcggaaatttaggttttcggaagagggatcggaagtttagaagtttcgagattttcggaag

SEQ ID NO: 26820 - DNA, 667 bp, Artificial Sequence
  chemically treated genomic DNA (Homo sapiens) CpG-island No: 26820
cttccgaaaatctcgaaacttctaaacttccgatccctcttccgaaaacctaaatttccgaaacgtcgcgcgccgtataaaacgcgcacgcaaaactaaacgtaaaaaaacgtacgcgtacgcaaacgacgcgccgaaatactaaacaaaaccgtaaaaccgccgccaaatcgctattaatccacgccgcccgtcgcgccgcccgcccgctcaacgtccgccgccgccataaaaatacaaataaaaaccatctccccaaaaaacgataaataataacgcgcgacgactcgaaatacctctaccgccgcgcgcatcgactcaacatacccgtctctatctcctcaaaacgcaccttccccaaacgcgaccaaacctacgtaatacactacaccgataaatcgaaaacccaacgaaaaaaaaacccgaaccgcaatccgcaacccgaatacgactaaccgtcgaaacctaaaaacccgaaacctaaaatccgaaacgtaacgacgacgaaatccgcataacccgaaactaaaacctaaacgataactcaaaaacaacctaaaacttacgaaacccgaacgaatctaaatcgacgactataaacgtcgactacgaactaaatattatctaacccgtcaaaaacatttctacaccttaaatactaccctta

SEQ ID NO: 26821 - DNA, 680 bp, Artificial Sequence
  chemically treated genomic DNA (Homo sapiens) CpG-island No: 26821
agggcggaggcgggaatgtgaaagttgagttttagttgcggagtttgtatcgaagtttaggaaaggcgggtcgaaaaaattggggtgaaggggttatttagtggatgggtaagacgggtcgtttttttcgaagagagagagttggatgcggggaaggttttgaggtggcggttgaggaacgtgggggaaagggggaggtgaacgcgtttagaaaaggggcgggaagcgcgcgtttagtatttttagttcgtagattcgggtttttgatcgcgcgtttagcgtcgacggtgcggacgttagaacggtagtcgcgcggtttttttcgtttcgtcgggatttgagaggttcgtagcgtgtttttcgaagtggcgggcgggtttttgttttttcggtcgggagttaggaagtcgaggaagggaatacgttgtttttttttgtttttttcgttttttttttttacgaagaatagggtaggaggttttgggcgtgtcggagcgagttcgtttcgggttttttcgtttattttaattttgtgagtttttcgatcgcgcggcgttttattttatcgggcgcgttcgagtttttcgtcggaattcgtttcgttttttttatatatttttttttaggaatggaagtgggcgtttagatttaattatttgagattttgttggttgggtcgt

SEQ ID NO: 26822 - DNA, 680 bp, Artificial Sequence
  chemically treated genomic DNA (Homo sapiens) CpG-island No: 26822
acgacccaaccaacaaaatctcaaataattaaatctaaacgcccacttccattcctaaaaaaaaatatataaaaaaaacgaaacgaattccgacgaaaaactcgaacgcgcccgataaaataaaacgccgcgcgatcgaaaaactcacaaaattaaaataaacgaaaaaacccgaaacgaactcgctccgacacgcccaaaacctcctaccctattcttcgtaaaaaaaaaaaacgaaaaaaacaaaaaaaaacaacgtattcccttcctcgacttcctaactcccgaccgaaaaaacaaaaacccgcccgccacttcgaaaaacacgctacgaacctctcaaatcccgacgaaacgaaaaaaaccgcgcgactaccgttctaacgtccgcaccgtcgacgctaaacgcgcgatcaaaaacccgaatctacgaactaaaaatactaaacgcgcgcttcccgccccttttctaaacgcgttcacctccccctttcccccacgttcctcaaccgccacctcaaaaccttccccgcatccaactctctctcttcgaaaaaaacgacccgtcttacccatccactaaataaccccttcaccccaattttttcgacccgcctttcctaaacttcgatacaaactccgcaactaaaactcaactttcacattcccgcctccgccct

SEQ ID NO: 26823 - DNA, 680 bp, Artificial Sequence
  chemically treated genomic DNA (Homo sapiens) CpG-island No: 26823
gcggtttagttagtaggattttaggtagttaggtttgagcgtttatttttatttttggagaaggatgtgtgggggaggcggaacgagtttcggcggagggttcgggcgcgttcggtggagtgaagcgtcgcgcggtcgaagggtttatagagttgaagtgggcgggaaaattcggagcggattcgtttcgatacgtttagggttttttgttttatttttcgtgggggaggggaacgaaaagagtaaaagagaataacgtgttttttttttcggttttttaattttcggtcgaggagataggagttcgttcgttatttcgagggatacgttgcgggttttttagatttcggcggggcgaggagggtcgcgcggttgtcgttttagcgttcgtatcgtcgacgttgagcgcgcggttagaaattcgggtttgcggattagaggtgttgggcgcgcgtttttcgttttttttttgagcgcgtttattttttttttttttttacgttttttagtcgttattttagagtttttttcgtatttagtttttttttttcgggagaggcggttcgttttgtttatttattgaataatttttttattttagttttttcgattcgttttttttgagtttcggtataaatttcgtagttagagtttagtttttatattttcgttttcgtttt

SEQ ID NO: 26824 - DNA, 680 bp, Artificial Sequence
  chemically treated genomic DNA (Homo sapiens) CpG-island No: 26824
aaaacgaaaacgaaaatataaaaactaaactctaactacgaaatttataccgaaactcaaaaaaaacgaatcgaaaaaactaaaataaaaaaattattcaataaataaacaaaacgaaccgcctctcccgaaaaaaaaaaactaaatacgaaaaaaactctaaaataacgactaaaaaacgtaaaaaaaaaaaaaaaataaacgcgctcaaaaaaaaaacgaaaaacgcgcgcccaacacctctaatccgcaaacccgaatttctaaccgcgcgctcaacgtcgacgatacgaacgctaaaacgacaaccgcgcgaccctcctcgccccgccgaaatctaaaaaacccgcaacgtatccctcgaaataacgaacgaactcctatctcctcgaccgaaaattaaaaaaccgaaaaaaaaaacacgttattctcttttactcttttcgttcccctcccccacgaaaaataaaacaaaaaaccctaaacgtatcgaaacgaatccgctccgaattttcccgcccacttcaactctataaacccttcgaccgcgcgacgcttcactccaccgaacgcgcccgaaccctccgccgaaactcgttccgcctcccccacacatccttctccaaaaataaaaataaacgctcaaacctaactacctaaaatcctactaactaaaccgc

SEQ ID NO: 26825 - DNA, 504 bp, Artificial Sequence
  chemically treated genomic DNA (Homo sapiens) CpG-island No: 26825
tttacggtttcggtgttcgaatttagttttagtatcgatcgtcggtttagcgcgtgggtttcgtcgttagaaaattcgggcgtttttaggtatttagaaaggataatggtagcgttttatataacgtaatttacgttatcggagttatattgttgtagtcgtagtattgtattatttcgtttttttaaaattcgtataaagtttcgtagtgggttttttagcgaggattttagcgtattcgttattgcgttcggtaatagaaagcggcgcgcgtagggacgttatattaacgcgtatcgtttcgttttgcggtttcgttttttgttcgtcgttgagttggcgacgtagcgcgcgcgagttaataaagttcggaaggtagcgttatttgggcggggtcgagcgtggggtttttgtttattcgacgcgtttggtagtttttttttattttaaattatacgtttggtttaacgaagaggtcgtttaaattatttttttagataaaat

SEQ ID NO: 26826 - DNA, 504 bp, Artificial Sequence
  chemically treated genomic DNA (Homo sapiens) CpG-island No: 26826
attttatctaaaaaaataatttaaacgacctcttcgttaaaccaaacgtataatttaaaataaaaaaaaactaccaaacgcgtcgaataaacaaaaaccccacgctcgaccccgcccaaataacgctaccttccgaactttattaactcgcgcgcgctacgtcgccaactcaacgacgaacaaaaaacgaaaccgcaaaacgaaacgatacgcgttaatataacgtccctacgcgcgccgctttctattaccgaacgcaataacgaatacgctaaaatcctcgctaaaaaacccactacgaaactttatacgaattttaaaaaaacgaaataatacaatactacgactacaacaatataactccgataacgtaaattacgttatataaaacgctaccattatcctttctaaatacctaaaaacgcccgaattttctaacgacgaaacccacgcgctaaaccgacgatcgatactaaaactaaattcgaacaccgaaaccgtaaa

SEQ ID NO: 26827 - DNA, 504 bp, Artificial Sequence
  chemically treated genomic DNA (Homo sapiens) CpG-island No: 26827
gttttgtttgggaaagtgatttaaacggttttttcgttaagttaaacgtgtgatttagggtagagggaggttgttaagcgcgtcgggtaagtaggggttttacgttcggtttcgtttaggtaacgttgtttttcgggttttgttaattcgcgcgcgttgcgtcgttaatttagcggcgggtagggggcggagtcgtagggcggggcggtgcgcgttgatgtgacgtttttgcgcgcgtcgttttttgttgtcgggcgtaatggcggatacgttggagttttcgttggaggatttattgcggagttttgtgcgagttttggagaagcgggatggtatagtgttacgattatagtagtatagtttcggtggcgtgggttgcgttgtgtgggacgttgttattgttttttttaaatatttggaaacgttcgagttttttggcgacggggtttacgcgttgagtcggcggtcggtgttggagttgggttcgggtatcggggtcgtggg

SEQ ID NO: 26828 - DNA, 504 bp, Artificial Sequence
  chemically treated genomic DNA (Homo sapiens) CpG-island No: 26828
cccacgaccccgatacccgaacccaactccaacaccgaccgccgactcaacgcgtaaaccccgtcgccaaaaaactcgaacgtttccaaatatttaaaaaaaacaataacaacgtcccacacaacgcaacccacgccaccgaaactatactactataatcgtaacactataccatcccgcttctccaaaactcgcacaaaactccgcaataaatcctccaacgaaaactccaacgtatccgccattacgcccgacaacaaaaaacgacgcgcgcaaaaacgtcacatcaacgcgcaccgccccgccctacgactccgccccctacccgccgctaaattaacgacgcaacgcgcgcgaattaacaaaacccgaaaaacaacgttacctaaacgaaaccgaacgtaaaacccctacttacccgacgcgcttaacaacctccctctaccctaaatcacacgtttaacttaacgaaaaaaccgtttaaatcactttcccaaacaaaac

SEQ ID NO: 26829 - DNA, 1030 bp, Artificial Sequence
  chemically treated genomic DNA (Homo sapiens) CpG-island No: 26829
ggttcggtttcggggattcgagttttgtgggagggacgatttgtttttcgttagaagttcggggggttacgggttattcgtcggtcgtttcgtttttagtattgatttttcgtagggtcgagattaatagttttcgttatttcggattgtttttttcgttgaagaattcgtaaggttgcggcgtttgttgtatggtttcggcgatagcgttttcgtatcgggggtagttcgcgggtcgggtcggtggtttgataggtagggcgcgggtcgtttcgtttcgtcggcggtcgtcgtttttcgttcgggtcgaggttacggtcgaggcggttcggaggcggcgtcggcgggttggcggagatttcggggtcggtttttttcgtcgaggcggttttcgtttttcgtagcgttcgtagaggaagcgcggcgattcgtaagttcgggcgatttcgggcggcgattttttttttcggcggcgttggttcgtttttggggcggtttttttttttttgtttgggttcgcggttcgttaggggtatagttggtttagtttcgtttcgattttcgttacggtcgcggcgggcggtgagtagcggcggcggcggcggcggttgttcgtttttttatcgtttttttttcgtttttttagtcgatagcgtcgttcggttttgtttattcgagttatttttatagagttttggggatcgattcggagtgcgcgtcgggcgagcgagtttcgttatggtcggtatagcgttggtcgtcgttgttgtttttttagtagtagcgtagagtgttttggggtcgtcgttgagttttgagttttagtagtcgaggttcggttcgttttttcggttcggcgtttattatttcgaatagtttaagaggtttaatacggagtatgcgcgtcgcggagtaggtataggcgttagttcggcgcggggggtgcgggtttggggtttcgggggagttcgtttttttcgagattgtgttgggggtcgttttagattttttagtttgattgttttttatt

SEQ ID NO: 26830 - DNA, 1030 bp, Artificial Sequence
  chemically treated genomic DNA (Homo sapiens) CpG-island No: 26830
aataaaaaacaatcaaactaaaaaatctaaaacgacccccaacacaatctcgaaaaaaacgaactcccccgaaaccccaaacccgcaccccccgcgccgaactaacgcctatacctactccgcgacgcgcatactccgtattaaacctcttaaactattcgaaataataaacgccgaaccgaaaaaacgaaccgaacctcgactactaaaactcaaaactcaacgacgaccccaaaacactctacgctactactaaaaaaacaacaacgacgaccaacgctataccgaccataacgaaactcgctcgcccgacgcgcactccgaatcgatccccaaaactctataaaaataactcgaataaacaaaaccgaacgacgctatcgactaaaaaaacgaaaaaaaaacgataaaaaaacgaacaaccgccgccgccgccgccgctactcaccgcccgccgcgaccgtaacgaaaatcgaaacgaaactaaaccaactatacccctaacgaaccgcgaacccaaacaaaaaaaaaaaaaccgccccaaaaacgaaccaacgccgccgaaaaaaaaaatcgccgcccgaaatcgcccgaacttacgaatcgccgcgcttcctctacgaacgctacgaaaaacgaaaaccgcctcgacgaaaaaaaccgaccccgaaatctccgccaacccgccgacgccgcctccgaaccgcctcgaccgtaacctcgacccgaacgaaaaacgacgaccgccgacgaaacgaaacgacccgcgccctacctatcaaaccaccgacccgacccgcgaactacccccgatacgaaaacgctatcgccgaaaccatacaacaaacgccgcaaccttacgaattcttcaacgaaaaaaacaatccgaaataacgaaaactattaatctcgaccctacgaaaaatcaatactaaaaacgaaacgaccgacgaataacccgtaaccccccgaacttctaacgaaaaacaaatcgtccctcccacaaaactcgaatccccgaaaccgaacc

SEQ ID NO: 26831 - DNA, 1030 bp, Artificial Sequence
  chemically treated genomic DNA (Homo sapiens) CpG-island No: 26831
ggtaaaaagtagttaaattgaagagtttggagcggtttttagtatagtttcgggaaaagcggattttttcggggttttaggttcgtatttttcgcgtcgggttggcgtttgtgtttgtttcgcggcgcgtatgtttcgtgttaggttttttgggttattcgggataatgagcgtcgggtcgagggggcgggtcgagtttcggttgttgggatttagggtttagcggcgattttaaggtattttgcgttgttgttaaaggggtagtaacggcggttagcgttgtgtcggttatagcgaggttcgttcgttcgacgcgtatttcgggtcggtttttagagttttgtggaggtgattcgagtgggtagggtcgggcggcgttgtcggttgggagggcggggaggaggcgatgaggagacgagtagtcgtcgtcgtcgtcgtcgttgtttatcgttcgtcgcggtcgtagcgggagtcggggcggggttgggttagttgtatttttgacgggtcgcgaatttagataaaggaggaggagtcgttttagaagcgggttagcgtcgtcgggaaaggaggtcgtcgttcggggtcgttcgggtttgcgggtcgtcgcgttttttttgcgggcgttgcgggaggcgagggtcgtttcggcggaggaagtcgatttcggggttttcgttagttcgtcggcgtcgttttcgagtcgtttcggtcgtagtttcggttcgggcgggaggcggcggtcgtcggcgaggcgaggcggttcgcgttttgtttgttaggttatcggttcggttcgcgggttgttttcgatgcggaggcgttgtcgtcggggttatgtagtaggcgtcgtagttttacgagttttttagcgaggagaatagttcgaaatggcggggattgttggtttcggttttgcggaaggttagtgttaggggcggggcggtcggcgggtggttcgtggtttttcgagtttttaacggggagtaggtcgttttttttatagggttcgagttttcggggtcgagtt

SEQ ID NO: 26832 - DNA, 1030 bp, Artificial Sequence
  chemically treated genomic DNA (Homo sapiens) CpG-island No: 26832
aactcgaccccgaaaactcgaaccctataaaaaaaacgacctactccccgttaaaaactcgaaaaaccacgaaccacccgccgaccgccccgcccctaacactaaccttccgcaaaaccgaaaccaacaatccccgccatttcgaactattctcctcgctaaaaaactcgtaaaactacgacgcctactacataaccccgacgacaacgcctccgcatcgaaaacaacccgcgaaccgaaccgataacctaacaaacaaaacgcgaaccgcctcgcctcgccgacgaccgccgcctcccgcccgaaccgaaactacgaccgaaacgactcgaaaacgacgccgacgaactaacgaaaaccccgaaatcgacttcctccgccgaaacgaccctcgcctcccgcaacgcccgcaaaaaaaacgcgacgacccgcaaacccgaacgaccccgaacgacgacctcctttcccgacgacgctaacccgcttctaaaacgactcctcctcctttatctaaattcgcgacccgtcaaaaatacaactaacccaaccccgccccgactcccgctacgaccgcgacgaacgataaacaacgacgacgacgacgacgactactcgtctcctcatcgcctcctccccgccctcccaaccgacaacgccgcccgaccctacccactcgaatcacctccacaaaactctaaaaaccgacccgaaatacgcgtcgaacgaacgaacctcgctataaccgacacaacgctaaccgccgttactacccctttaacaacaacgcaaaataccttaaaatcgccgctaaaccctaaatcccaacaaccgaaactcgacccgccccctcgacccgacgctcattatcccgaataacccaaaaaacctaacacgaaacatacgcgccgcgaaacaaacacaaacgccaacccgacgcgaaaaatacgaacctaaaaccccgaaaaaatccgcttttcccgaaactatactaaaaaccgctccaaactcttcaatttaactactttttacc

SEQ ID NO: 26833 - DNA, 728 bp, Artificial Sequence
  chemically treated genomic DNA (Homo sapiens) CpG-island No: 26833
atcgtgtggacggtaatttattcgttttttttttgatcgtgtggacggttatttattcgttttttttttgatcgtgtggacggtaatttattcgttttttttttgatcgtgtggacggtaatttattcgttttttttttgattttgtagacggttatttattcgttttttttttgatcgtgtagacggttatttatattttttttttttgatcgtgtagacggtaatttattcgttttttttttgatcgagtagacggtgatttattcgttttttttttgatcgtgtagacggtgatttattcgttttttttttgattttgtggatagtaatttatattttttttttttgatcgtgtagacggtgatttattcgttttttttttgatcgagtagacggtaatttattcgttttttttttgatcgtgtagacggtaatttattcgttttttttttgatcgagtagacggtaattcgttttttttttgatcgtgtagacggttatttattcgttttttttttgatcgtgtggacggttatttattcgttttttttttgatcgtgtggacggttatttatacgttttttttttgattttgtcgacggttatttatacgttttttttttgattatgtagacggttatttattttttttttttttgattttgtagacggttatttattcgttttttttttaattatgtagacggttatttatttgtttttttt

SEQ ID NO: 26834 - DNA, 728 bp, Artificial Sequence
  chemically treated genomic DNA (Homo sapiens) CpG-island No: 26834
aaaaaaaacaaataaataaccgtctacataattaaaaaaaaaacgaataaataaccgtctacaaaatcaaaaaaaaaaaaaataaataaccgtctacataatcaaaaaaaaaacgtataaataaccgtcgacaaaatcaaaaaaaaaacgtataaataaccgtccacacgatcaaaaaaaaaacgaataaataaccgtccacacgatcaaaaaaaaaacgaataaataaccgtctacacgatcaaaaaaaaaacgaattaccgtctactcgatcaaaaaaaaaacgaataaattaccgtctacacgatcaaaaaaaaaacgaataaattaccgtctactcgatcaaaaaaaaaacgaataaatcaccgtctacacgatcaaaaaaaaaaaatataaattactatccacaaaatcaaaaaaaaaacgaataaatcaccgtctacacgatcaaaaaaaaaacgaataaatcaccgtctactcgatcaaaaaaaaaacgaataaattaccgtctacacgatcaaaaaaaaaaaatataaataaccgtctacacgatcaaaaaaaaaacgaataaataaccgtctacaaaatcaaaaaaaaaacgaataaattaccgtccacacgatcaaaaaaaaaacgaataaattaccgtccacacgatcaaaaaaaaaacgaataaataaccgtccacacgatcaaaaaaaaaacgaataaattaccgtccacacgat

SEQ ID NO: 26835 - DNA, 728 bp, Artificial Sequence
  chemically treated genomic DNA (Homo sapiens) CpG-island No: 26835
ggagagggtaagtgagtgatcgtttatatggttagggggagggcgaatgagtgatcgtttatagggttagggagagggagagtgagtgatcgtttatatgattagggagagggcgtgtgagtgatcgtcgataggattagggagagggcgtgtgagtgatcgtttatacggttagggagagggcgagtgagtgatcgtttatacggttagggagagggcgagtgagtgatcgtttatacggttagggagagggcgagttatcgtttattcggttagggagagggcgagtgagttatcgtttatacggttagggagagggcgagtgagttatcgtttattcggttagggagagggcgagtgagttatcgtttatacggttagggagaaggagtgtgagttattgtttatagggttagggagagggcgagtgagttatcgtttatacggttagggagagggcgagtgagttatcgtttattcggttagggagagggcgagtgagttatcgtttatacggttagggagagggagtgtgagtgatcgtttatacggttagggagagggcgagtgagtgatcgtttatagggttagggagagggcgagtgagttatcgtttatacggttagggagagggcgagtgagttatcgtttatacggttagggagagggcgagtgagtgatcgtttatacggttagggagagggcgagtgagttatcgtttatacggt

SEQ ID NO: 26836 - DNA, 728 bp, Artificial Sequence
  chemically treated genomic DNA (Homo sapiens) CpG-island No: 26836
accgtataaacgataactcactcgccctctccctaaccgtataaacgatcactcactcgccctctccctaaccgtataaacgataactcactcgccctctccctaaccgtataaacgataactcactcgccctctccctaaccctataaacgatcactcactcgccctctccctaaccgtataaacgatcactcacactccctctccctaaccgtataaacgataactcactcgccctctccctaaccgaataaacgataactcactcgccctctccctaaccgtataaacgataactcactcgccctctccctaaccctataaacaataactcacactccttctccctaaccgtataaacgataactcactcgccctctccctaaccgaataaacgataactcactcgccctctccctaaccgtataaacgataactcactcgccctctccctaaccgaataaacgataactcgccctctccctaaccgtataaacgatcactcactcgccctctccctaaccgtataaacgatcactcactcgccctctccctaaccgtataaacgatcactcacacgccctctccctaatcctatcgacgatcactcacacgccctctccctaatcatataaacgatcactcactctccctctccctaaccctataaacgatcactcattcgccctccccctaaccatataaacgatcactcacttaccctctcc

SEQ ID NO: 26837 - DNA, 541 bp, Artificial Sequence
  chemically treated genomic DNA (Homo sapiens) CpG-island No: 26837
ttattattcgtaagtgtttgcggagtgcgcgcgaggggtcggagatggggtttcgggcgtttggggttggggatatcgagttcggaatagtcgagtttggttaggcgtcggggtcgttcgttggttggtagagtttacggcgtcggtttggagtatggcggggggcgggggttataggaaagtttttttgtagttcggggagttggggcgtcgagtagtcggacgcgtttcgggttcgggggtttgcggagcggtttcgggtcggggagggggtatgtaggttggaggagtgtgtgtgtgtgcgcgtcgagttcggttggacgttcgttttttcgagcggcgtgtgtggcggcggcggcgttggtggcggggtttggcgacgagggggagggcgttgggggagcggagggggagtgcgatgcggtgttttgtacgttggtaatagcggcgagtaaggagtggtgtacgtgtgtgtaaggagagaagtagtaggtcgttttgtttggttttttttttatgtattttggatttaggcgaagtt

SEQ ID NO: 26838 - DNA, 541 bp, Artificial Sequence
  chemically treated genomic DNA (Homo sapiens) CpG-island No: 26838
aacttcgcctaaatccaaaatacataaaaaaaaaaccaaacaaaacgacctactacttctctccttacacacacgtacaccactccttactcgccgctattaccaacgtacaaaacaccgcatcgcactccccctccgctcccccaacgccctccccctcgtcgccaaaccccgccaccaacgccgccgccgccacacacgccgctcgaaaaaacgaacgtccaaccgaactcgacgcgcacacacacacactcctccaacctacataccccctccccgacccgaaaccgctccgcaaacccccgaacccgaaacgcgtccgactactcgacgccccaactccccgaactacaaaaaaactttcctataacccccgccccccgccatactccaaaccgacgccgtaaactctaccaaccaacgaacgaccccgacgcctaaccaaactcgactattccgaactcgatatccccaaccccaaacgcccgaaaccccatctccgacccctcgcgcgcactccgcaaacacttacgaataataa

SEQ ID NO: 26839 - DNA, 541 bp, Artificial Sequence
  chemically treated genomic DNA (Homo sapiens) CpG-island No: 26839
agtttcgtttgagtttaggatgtatgagaagagagttaagtaaagcgatttattgtttttttttttatatatacgtgtattattttttgttcgtcgttgttgttagcgtgtaaggtatcgtatcgtatttttttttcgtttttttagcgttttttttttcgtcgttaaatttcgttattagcgtcgtcgtcgttatatacgtcgttcggaggggcgagcgtttagtcgggttcggcgcgtatatatatatatttttttagtttgtatgtttttttttcggttcggagtcgtttcgtaggttttcgagttcgaggcgcgttcggttgttcggcgttttaatttttcgggttgtaaagaaatttttttatggttttcgtttttcgttatgttttaggtcgacgtcgtagattttgttagttagcgggcggtttcggcgtttggttaggttcggttgtttcgggttcggtgtttttagttttagacgttcggagttttattttcggtttttcgcgcgtatttcgtagatatttacgggtgatga

SEQ ID NO: 26840 - DNA, 541 bp, Artificial Sequence
  chemically treated genomic DNA (Homo sapiens) CpG-island No: 26840
tcatcacccgtaaatatctacgaaatacgcgcgaaaaaccgaaaataaaactccgaacgtctaaaactaaaaacaccgaacccgaaacaaccgaacctaaccaaacgccgaaaccgcccgctaactaacaaaatctacgacgtcgacctaaaacataacgaaaaacgaaaaccataaaaaaatttctttacaacccgaaaaattaaaacgccgaacaaccgaacgcgcctcgaactcgaaaacctacgaaacgactccgaaccgaaaaaaaaacatacaaactaaaaaaatatatatatatacgcgccgaacccgactaaacgctcgcccctccgaacgacgtatataacgacgacgacgctaataacgaaatttaacgacgaaaaaaaaaacgctaaaaaaacgaaaaaaaaatacgatacgataccttacacgctaacaacaacgacgaacaaaaaataatacacgtatatataaaaaaaaaaacaataaatcgctttacttaactctcttctcatacatcctaaactcaaacgaaact

SEQ ID NO: 26841 - DNA, 597 bp, Artificial Sequence
  chemically treated genomic DNA (Homo sapiens) CpG-island No: 26841
gcgtgtgcgtggggtggcgggagagtgcggtcgtgcgcggcgttttgggttgttcggcgggcggtggtcggggtcggggtcgtggtcgtggtcgtggcggcggcggcggcggcggcggcggtcgtgttgttgaggtggggaggttacggaaaagtagtggggtcggagtttcgcgggcggtcggtcgttttttcgcgtcgtcggtgtttttagtcgtgggtcgtcgttttcgtcgtcgtttgcgtttttttttttcgttgttcgttcggcgtcgtcgtcgtttatgcgtcgtagagcgtttcgcggttcgggtcgtttcggttttcgaggtatgttcggcgcggagataggcgatcggcggcggcggcggaggaggaggagggggaggcggcggcggcggcggggggaggcggtcgcgcggtttcgcgggtagttcggtttagggtttcgtcgttttcgggtttttattttcgcgtcgttattcgttttcgttttcgtttttcgttatttttttttattattcggagtagttcggtggtaggtggggcgtatatttttttttgcggggggcgcggggtttaggtcgggaggagcggg

SEQ ID NO: 26842 - DNA, 597 bp, Artificial Sequence
  chemically treated genomic DNA (Homo sapiens) CpG-island No: 26842
cccgctcctcccgacctaaaccccgcgccccccgcaaaaaaaaatatacgccccacctaccaccgaactactccgaataataaaaaaaaataacgaaaaacgaaaacgaaaacgaataacgacgcgaaaataaaaacccgaaaacgacgaaaccctaaaccgaactacccgcgaaaccgcgcgaccgcctccccccgccgccgccgccgcctccccctcctcctcctccgccgccgccgccgatcgcctatctccgcgccgaacatacctcgaaaaccgaaacgacccgaaccgcgaaacgctctacgacgcataaacgacgacgacgccgaacgaacaacgaaaaaaaaaaacgcaaacgacgacgaaaacgacgacccacgactaaaaacaccgacgacgcgaaaaaacgaccgaccgcccgcgaaactccgaccccactacttttccgtaacctccccacctcaacaacacgaccgccgccgccgccgccgccgccgccacgaccacgaccacgaccccgaccccgaccaccgcccgccgaacaacccaaaacgccgcgcacgaccgcactctcccgccaccccacgcacacgc

SEQ ID NO: 26843 - DNA, 597 bp, Artificial Sequence
  chemically treated genomic DNA (Homo sapiens) CpG-island No: 26843
ttcgtttttttcggtttagatttcgcgtttttcgtaggggagggtgtgcgttttatttgttatcgggttgtttcgggtggtagaaaggggtgacgggggacgggggcgggggcgggtggcggcgcgggggtgagaattcggaggcggcggggttttgggtcgggttgttcgcgggatcgcgcggtcgttttttttcgtcgtcgtcgtcgtttttttttttttttttttcgtcgtcgtcgtcggtcgtttgttttcgcgtcgggtatgtttcgggagtcggggcggttcgggtcgcggggcgttttgcggcgtatggacggcggcggcgtcgggcgagtagcgggaggagaaggcgtaggcggcggcggaagcggcgatttacggttgggagtatcggcggcgcgaggggacggtcggtcgttcgcgaggtttcggttttattattttttcgtagtttttttattttagtagtacggtcgtcgtcgtcgtcgtcgtcgtcgttacggttacggttacggtttcggtttcggttatcgttcgtcgggtagtttagagcgtcgcgtacggtcgtattttttcgttattttacgtatacgt

SEQ ID NO: 26844 - DNA, 597 bp, Artificial Sequence
  chemically treated genomic DNA (Homo sapiens) CpG-island No: 26844
acgtatacgtaaaataacgaaaaaatacgaccgtacgcgacgctctaaactacccgacgaacgataaccgaaaccgaaaccgtaaccgtaaccgtaacgacgacgacgacgacgacgacgaccgtactactaaaataaaaaaactacgaaaaaataataaaaccgaaacctcgcgaacgaccgaccgtcccctcgcgccgccgatactcccaaccgtaaatcgccgcttccgccgccgcctacgccttctcctcccgctactcgcccgacgccgccgccgtccatacgccgcaaaacgccccgcgacccgaaccgccccgactcccgaaacatacccgacgcgaaaacaaacgaccgacgacgacgacgaaaaaaaaaaaaaaaaaaacgacgacgacgacgaaaaaaaacgaccgcgcgatcccgcgaacaacccgacccaaaaccccgccgcctccgaattctcacccccgcgccgccacccgcccccgcccccgtcccccgtcacccctttctaccacccgaaacaacccgataacaaataaaacgcacaccctcccctacgaaaaacgcgaaatctaaaccgaaaaaaacgaa

SEQ ID NO: 26845 - DNA, 631 bp, Artificial Sequence
  chemically treated genomic DNA (Homo sapiens) CpG-island No: 26845
ggttacgttttttttgtttatattttttttatttcggttacgtttttacgtcgtcgcggtttttttatttttagtttagttacgtttttttttcgtcgcgtcggcgtatcgttcgttcgaatggtttcgtgggcggagtttgcgtagtttttcggatttcggcgtatatcgtttttcgtttttcgtttttggttattaagcgttttcgtggatacgtattttttgcgaggttttcgtgcgtattttggtcgagtcgaatcgagtcgagttttgtttttttaggtcgttcgtaatggtggatgagttggtgttgttgttgtacgcgtttttgatgcggtatcgcgttttgagtatcgagaatagttagtttatggaatagttgcggttgttggtgtgcgagagggttagtttgttgcgttaggtacgttcgtcgagttgttcggtgttttttttcgaaacgtttaatggcgagagttttcggtttttcgagtttatcgtgtagacggcgttttatatgttcgtgaacgagaatcgattttgtaacgacgttatgaaggtggtatttttaattagtttttttatcggggaagtcgaggagtgggtggtgttttatatcgagatggatagtttt

SEQ ID NO: 26846 - DNA, 631 bp, Artificial Sequence
  chemically treated genomic DNA (Homo sapiens) CpG-island No: 26846
aaaactatccatctcgatataaaacaccacccactcctcgacttccccgataaaaaaactaattaaaaataccaccttcataacgtcgttacaaaatcgattctcgttcacgaacatataaaacgccgtctacacgataaactcgaaaaaccgaaaactctcgccattaaacgtttcgaaaaaaaacaccgaacaactcgacgaacgtacctaacgcaacaaactaaccctctcgcacaccaacaaccgcaactattccataaactaactattctcgatactcaaaacgcgataccgcatcaaaaacgcgtacaacaacaacaccaactcatccaccattacgaacgacctaaaaaaacaaaactcgactcgattcgactcgaccaaaatacgcacgaaaacctcgcaaaaaatacgtatccacgaaaacgcttaataaccaaaaacgaaaaacgaaaaacgatatacgccgaaatccgaaaaactacgcaaactccgcccacgaaaccattcgaacgaacgatacgccgacgcgacgaaaaaaaaacgtaactaaactaaaaataaaaaaaccgcgacgacgtaaaaacgtaaccgaaataaaaaaaatataaacaaaaaaaacgtaacc

SEQ ID NO: 26847 - DNA, 631 bp, Artificial Sequence
  chemically treated genomic DNA (Homo sapiens) CpG-island No: 26847
ggggttatttatttcgatgtagggtattatttatttttcggttttttcggtgaggaggttgattaggaatgttatttttatggcgtcgttgtagaatcggttttcgtttacgagtatgtaagacgtcgtttgtacgataaattcggggagtcgggagttttcgttattaaacgtttcggggaagggtatcgggtagttcggcggacgtatttggcgtagtaggttggttttttcgtatattagtagtcgtagttgttttatgagttggttgttttcgatgtttagggcgcggtgtcgtattaggagcgcgtgtagtagtagtattaatttatttattattgcgaacggtttggaaggataggattcggttcggttcggttcggttaaggtgcgtacggaggtttcgtaggaagtgcgtgtttacggaggcgtttggtggttaggggcggggggcggggggcggtgtgcgtcggggttcgggaggttacgtaagtttcgtttacgaggttattcggacggacggtgcgtcggcgcgacgggggaggggcgtggttaggttgggagtgggggggtcgcggcggcgtgggggcgtggtcgggatgggaagggtgtagataaagagggcgtggtt

SEQ ID NO: 26848 - DNA, 631 bp, Artificial Sequence
  chemically treated genomic DNA (Homo sapiens) CpG-island No: 26848
aaccacgccctctttatctacacccttcccatcccgaccacgcccccacgccgccgcgacccccccactcccaacctaaccacgcccctcccccgtcgcgccgacgcaccgtccgtccgaataacctcgtaaacgaaacttacgtaacctcccgaaccccgacgcacaccgccccccgccccccgcccctaaccaccaaacgcctccgtaaacacgcacttcctacgaaacctccgtacgcaccttaaccgaaccgaaccgaaccgaatcctatccttccaaaccgttcgcaataataaataaattaatactactactacacgcgctcctaatacgacaccgcgccctaaacatcgaaaacaaccaactcataaaacaactacgactactaatatacgaaaaaaccaacctactacgccaaatacgtccgccgaactacccgatacccttccccgaaacgtttaataacgaaaactcccgactccccgaatttatcgtacaaacgacgtcttacatactcgtaaacgaaaaccgattctacaacgacgccataaaaataacattcctaatcaacctcctcaccgaaaaaaccgaaaaataaataataccctacatcgaaataaataacccc

SEQ ID NO: 26849 - DNA, 511 bp, Artificial Sequence
  chemically treated genomic DNA (Homo sapiens) CpG-island No: 26849
ggtcgtaacgggttttagttttcgcgtttcgttgtgtaggttggttggggagggttgcggggtgtatcgcggcggggtgtatattggcggggcgttgattcggtttcggtcgttcggtcggtcgttcgatttattcgttttttcgggaattggcgtcgatatcgaaaaggttgggatttgcgtttttggtttgtgggtttcggacgaatcgcgcgtgggttttcgcgcggaacgtagaggcgaacgttgggttgtcggcgtttggatagtaaaagcggcgcgcgtcggttttttttcgtttcgttacgttttcgcggtcgcgttgtttagcggattggagtacgatttcgaggtagtggttcgtttatcgcgtgttgggcgggaaggttcgaaaggcgcggagcgtcgaggggagcgtcgaggggagggttgagggggacgcgattgtttagggatttcgcgaagtaagatcgaggttttaaaataagttattttggttaggcgcggtggt

SEQ ID NO: 26850 - DNA, 511 bp, Artificial Sequence
  chemically treated genomic DNA (Homo sapiens) CpG-island No: 26850
accaccgcgcctaaccaaaataacttattttaaaacctcgatcttacttcgcgaaatccctaaacaatcgcgtccccctcaaccctcccctcgacgctcccctcgacgctccgcgcctttcgaaccttcccgcccaacacgcgataaacgaaccactacctcgaaatcgtactccaatccgctaaacaacgcgaccgcgaaaacgtaacgaaacgaaaaaaaaccgacgcgcgccgcttttactatccaaacgccgacaacccaacgttcgcctctacgttccgcgcgaaaacccacgcgcgattcgtccgaaacccacaaaccaaaaacgcaaatcccaaccttttcgatatcgacgccaattcccgaaaaaacgaataaatcgaacgaccgaccgaacgaccgaaaccgaatcaacgccccgccaatatacaccccgccgcgatacaccccgcaaccctccccaaccaacctacacaacgaaacgcgaaaactaaaacccgttacgacc

SEQ ID NO: 26851 - DNA, 511 bp, Artificial Sequence
  chemically treated genomic DNA (Homo sapiens) CpG-island No: 26851
gttatcgcgtttggttaaggtaatttgttttgaagtttcggttttgtttcgcgaggtttttgagtagtcgcgttttttttagtttttttttcggcgtttttttcggcgtttcgcgtttttcgagttttttcgtttagtacgcggtgagcgggttattgtttcgaagtcgtgttttagttcgttgggtagcgcggtcgcggaggcgtggcgaggcggggaggggtcggcgcgcgtcgtttttattgtttaggcgtcggtagtttagcgttcgtttttacgtttcgcgcgggagtttacgcgcggttcgttcggaatttatagattagagacgtaggttttagttttttcggtgtcggcgttagttttcggaggagcgggtgagtcgggcggtcgatcgggcggtcgggatcgggttagcgtttcgttagtgtgtatttcgtcgcggtgtatttcgtagttttttttagttagtttgtatagcgaggcgcgaaggttgggattcgttgcgatt

SEQ ID NO: 26852 - DNA, 511 bp, Artificial Sequence
  chemically treated genomic DNA (Homo sapiens) CpG-island No: 26852
aatcgcaacgaatcccaaccttcgcgcctcgctatacaaactaactaaaaaaaactacgaaatacaccgcgacgaaatacacactaacgaaacgctaacccgatcccgaccgcccgatcgaccgcccgactcacccgctcctccgaaaactaacgccgacaccgaaaaaactaaaacctacgtctctaatctataaattccgaacgaaccgcgcgtaaactcccgcgcgaaacgtaaaaacgaacgctaaactaccgacgcctaaacaataaaaacgacgcgcgccgacccctccccgcctcgccacgcctccgcgaccgcgctacccaacgaactaaaacacgacttcgaaacaataacccgctcaccgcgtactaaacgaaaaaactcgaaaaacgcgaaacgccgaaaaaaacgccgaaaaaaaaactaaaaaaaacgcgactactcaaaaacctcgcgaaacaaaaccgaaacttcaaaacaaattaccttaaccaaacgcgataac

SEQ ID NO: 26853 - DNA, 630 bp, Artificial Sequence
  chemically treated genomic DNA (Homo sapiens) CpG-island No: 26853
acgtcggtgggcggggggaggaggcggttttagcgttattttgtgggagcgaagcggtggttgggttgcgtttgggttcgtcgttgtttcggtgtttttgtcgggttttttagtagcggtttagcgggtgagtcgcggagtttttttattgaggacgtcgtaggtgtttcggtttttgtattggggcggttcgaggtagacgtagcggtttcggattttgtttcgggaagttagtcgtgagatcgggtttagttttgttcgagcgggttcgcgcgggagcgtcgttaggttttggtacggggaggtcggtggcgtcgaaacggggggtcgggttcgcggtgtcgcgtagtttgaggcggaggttggtttcggattcggatagtgtcggagttttcggtattttgtatttcgagggacgttgttagtttgggtttggtgtttttgcgttttatttcgggtcgcgtcgagaaatttttttttcggttggtacgcgcgggtttttgggaggcgacggtcggtatcgttaggatttgtcgtcgcgggttttggggttcgggttcgtagagttttcggaagttttaaaatgaggaatagagggaaattttttttttgttttttatatttggttta

SEQ ID NO: 26854 - DNA, 630 bp, Artificial Sequence
  chemically treated genomic DNA (Homo sapiens) CpG-island No: 26854
taaaccaaatataaaaaacaaaaaaaaaatttccctctattcctcattttaaaacttccgaaaactctacgaacccgaaccccaaaacccgcgacgacaaatcctaacgataccgaccgtcgcctcccaaaaacccgcgcgtaccaaccgaaaaaaaaatttctcgacgcgacccgaaataaaacgcaaaaacaccaaacccaaactaacaacgtccctcgaaatacaaaataccgaaaactccgacactatccgaatccgaaaccaacctccgcctcaaactacgcgacaccgcgaacccgaccccccgtttcgacgccaccgacctccccgtaccaaaacctaacgacgctcccgcgcgaacccgctcgaacaaaactaaacccgatctcacgactaacttcccgaaacaaaatccgaaaccgctacgtctacctcgaaccgccccaatacaaaaaccgaaacacctacgacgtcctcaataaaaaaactccgcgactcacccgctaaaccgctactaaaaaacccgacaaaaacaccgaaacaacgacgaacccaaacgcaacccaaccaccgcttcgctcccacaaaataacgctaaaaccgcctcctccccccgcccaccgacgt

SEQ ID NO: 26855 - DNA, 630 bp, Artificial Sequence
  chemically treated genomic DNA (Homo sapiens) CpG-island No: 26855
tgaattaggtgtaaagaataggagaaaagtttttttttgttttttattttggggttttcgggggttttgcgagttcgagttttaaggttcgcggcgataggttttggcggtgtcggtcgtcgttttttagaagttcgcgcgtgttagtcgagggaggagtttttcggcgcggttcggggtggggcgtaggagtattaggtttaagttggtagcgtttttcgaagtataaagtatcgaaggtttcggtattgttcgggttcggggttaattttcgttttaggttacgcggtatcgcgggttcggtttttcgtttcggcgttatcggttttttcgtgttaggatttaacgacgttttcgcgcgagttcgttcgggtaggattaggttcggttttacggttgatttttcggggtagggttcgaagtcgttgcgtttgtttcgggtcgttttaatgtagaagtcgaggtatttacggcgtttttagtgagaaggtttcgcgatttattcgttaggtcgttgttgggaagttcgatagggatatcgaagtagcgacggatttaagcgtagtttagttatcgtttcgtttttataaaatggcgttagggtcgtttttttttttcgtttatcggcgt

SEQ ID NO: 26856 - DNA, 630 bp, Artificial Sequence
  chemically treated genomic DNA (Homo sapiens) CpG-island No: 26856
acgccgataaacgaaaaaaaaaaacgaccctaacgccattttataaaaacgaaacgataactaaactacgcttaaatccgtcgctacttcgatatccctatcgaacttcccaacaacgacctaacgaataaatcgcgaaaccttctcactaaaaacgccgtaaatacctcgacttctacattaaaacgacccgaaacaaacgcaacgacttcgaaccctaccccgaaaaatcaaccgtaaaaccgaacctaatcctacccgaacgaactcgcgcgaaaacgtcgttaaatcctaacacgaaaaaaccgataacgccgaaacgaaaaaccgaacccgcgataccgcgtaacctaaaacgaaaattaaccccgaacccgaacaataccgaaaccttcgatactttatacttcgaaaaacgctaccaacttaaacctaatactcctacgccccaccccgaaccgcgccgaaaaactcctccctcgactaacacgcgcgaacttctaaaaaacgacgaccgacaccgccaaaacctatcgccgcgaaccttaaaactcgaactcgcaaaacccccgaaaaccccaaaataaaaaacaaaaaaaaacttttctcctattctttacacctaattca

SEQ ID NO: 26857 - DNA, 893 bp, Artificial Sequence
  chemically treated genomic DNA (Homo sapiens) CpG-island No: 26857
gggttacgggaggataagcgattcgagtttgtgggggcggtatcggttttggtgacgttttaatgttatatgtaaatagaacgacgttatggtttatcgggcgtgcggtaattaatcgggagtcgggaacgcggtttcggcggtcgtcggcggagatagataaaggttcgggcgcggggggcgtagggcgtgttcgtggtaggggagtttttaggtttattcgggtcgggatttatttgggggcgggaggggggcggtacggcgttgaggtagttgtgcggcggggcgttttagggtcgtcggtcgtttataggtcgggtcgtatcgtcgggattcgcgggggaggcggcggggtcgcggtcgtttcgggttgttgagttcgttcgcggggttttgagtttgtgcggtcgttgcggcggggtttacggtataaattggaacgtttaaatagttgattgtgacgttataaaggggttcgttcgtttcgcgttatcggttggcggggcggcggttaatttcgggttgcggatttttttttgttttttttttttttttttttttcggtttgcgggtcgggcgttcgggtcgggaaacgttttcggaatcgggagggtgagtgttcggggaggtagttgcggggagttgggagttttgcgtcgcggcgagtttttcgcgaggaggatttttatttttttttatcggttttttatttttttgatttttttcggatcgtagcgtttttattttttttattgttttttaaatttttttattgtattttatatttaagtttttcgatgcggattttgttttcgatttatattacgttcgtgtatttgtattttttttattgtttttatttttgtttttttttttttttttggtttattttt

SEQ ID NO: 26858 - DNA, 893 bp, Artificial Sequence
  chemically treated genomic DNA (Homo sapiens) CpG-island No: 26858
aaaaataaaccaaaaaaaaaaaaaaaaacaaaaataaaaacaataaaaaaaatacaaatacacgaacgtaatataaatcgaaaacaaaatccgcatcgaaaaacttaaatataaaatacaataaaaaaatttaaaaaacaataaaaaaaataaaaacgctacgatccgaaaaaaatcaaaaaaataaaaaaccgataaaaaaaaataaaaatcctcctcgcgaaaaactcgccgcgacgcaaaactcccaactccccgcaactacctccccgaacactcaccctcccgattccgaaaacgtttcccgacccgaacgcccgacccgcaaaccgaaaaaaaaaaaaaaaaaaaaaacaaaaaaaaatccgcaacccgaaattaaccgccgccccgccaaccgataacgcgaaacgaacgaacccctttataacgtcacaatcaactatttaaacgttccaatttataccgtaaaccccgccgcaacgaccgcacaaactcaaaaccccgcgaacgaactcaacaacccgaaacgaccgcgaccccgccgcctcccccgcgaatcccgacgatacgacccgacctataaacgaccgacgaccctaaaacgccccgccgcacaactacctcaacgccgtaccgcccccctcccgcccccaaataaatcccgacccgaataaacctaaaaactcccctaccacgaacacgccctacgccccccgcgcccgaacctttatctatctccgccgacgaccgccgaaaccgcgttcccgactcccgattaattaccgcacgcccgataaaccataacgtcgttctatttacatataacattaaaacgtcaccaaaaccgataccgcccccacaaactcgaatcgcttatcctcccgtaaccc

SEQ ID NO: 26859 - DNA, 893 bp, Artificial Sequence
  chemically treated genomic DNA (Homo sapiens) CpG-island No: 26859
ggaggtgagttagaggggggagggagagtaggaataagggtagtggggagaatgtaggtgtacggacgtggtgtgggtcgagaatagggttcgtatcgggggatttggatataggatgtagtgaaaggatttggggagtagtgggagaggtgagggcgttgcgattcgggaagaattaggaaaataaggagtcggtaggagggagtggagatttttttcgcggagagttcgtcgcggcgtagggtttttagtttttcgtagttgttttttcgaatatttattttttcggtttcgagaacgtttttcggttcgagcgttcggttcgtaaatcgggaggggaggggaggggaggggtagggggggattcgtagttcgggattggtcgtcgtttcgttagtcggtgacgcgaggcgggcgggtttttttgtgacgttataattagttgtttgaacgttttaatttgtgtcgtgagtttcgtcgtagcggtcgtatagatttaaagtttcgcgggcgagtttagtagttcggagcgatcgcggtttcgtcgtttttttcgcgagtttcggcgatgcggttcggtttgtgagcggtcggcgattttgggacgtttcgtcgtataattattttaacgtcgtgtcgtttttttttcgtttttaggtgagtttcgattcgggtgggtttgggggtttttttgttacggatacgttttgcgtttttcgcgttcgggtttttgtttgttttcgtcggcggtcgtcggggtcgcgttttcggttttcgattggttgtcgtacgttcggtagattatgacgtcgttttatttgtatatgatattgagacgttattaaggtcggtatcgtttttataggttcgggtcgtttgttttttcgtgattt

SEQ ID NO: 26860 - DNA, 893 bp, Artificial Sequence
  chemically treated genomic DNA (Homo sapiens) CpG-island No: 26860
aaatcacgaaaaaacaaacgacccgaacctataaaaacgataccgaccttaataacgtctcaatatcatatacaaataaaacgacgtcataatctaccgaacgtacgacaaccaatcgaaaaccgaaaacgcgaccccgacgaccgccgacgaaaacaaacaaaaacccgaacgcgaaaaacgcaaaacgtatccgtaacaaaaaaacccccaaacccacccgaatcgaaactcacctaaaaacgaaaaaaaaacgacacgacgttaaaataattatacgacgaaacgtcccaaaatcgccgaccgctcacaaaccgaaccgcatcgccgaaactcgcgaaaaaaacgacgaaaccgcgatcgctccgaactactaaactcgcccgcgaaactttaaatctatacgaccgctacgacgaaactcacgacacaaattaaaacgttcaaacaactaattataacgtcacaaaaaaacccgcccgcctcgcgtcaccgactaacgaaacgacgaccaatcccgaactacgaatccccccctacccctcccctcccctcccctcccgatttacgaaccgaacgctcgaaccgaaaaacgttctcgaaaccgaaaaaataaatattcgaaaaaacaactacgaaaaactaaaaaccctacgccgcgacgaactctccgcgaaaaaaatctccactccctcctaccgactccttattttcctaattcttcccgaatcgcaacgccctcacctctcccactactccccaaatcctttcactacatcctatatccaaatcccccgatacgaaccctattctcgacccacaccacgtccgtacacctacattctccccactacccttattcctactctccctcccccctctaactcacctcc

SEQ ID NO: 26861 - DNA, 549 bp, Artificial Sequence
  chemically treated genomic DNA (Homo sapiens) CpG-island No: 26861
ggtgcgcggcgttggtaatttaaattgatatcgggttggagaggtaggaaaagcggaagagggagcgaaaattaacgtgttcggtgatagattttagcgtcgattgagtttttaaagcgattttagttttgttttattaatattatcgcgcgttcgggaatagtcgtttcgggaagaaatttgaggggattgcggggggtacgagggatagttgagggaagggaggacgcgagagaaatagcgcgagtacgttgagggtcgggggttgttaggagaggggttcgcggattcgtagagcggaggaaggttcgggagaaaaggggcgggacggaggagaattcgggatcgtttggtagaaaaagagaagggagtttttgaattttgggaagaggaggcgtgggtagggacgtttagttcgagattcgatagtagggaatcggagcgtttcgggggaggggtttaatgttggggaagggatgttttaaaagaggagaagttttaaattagacgatcggagaaggttgagggaattgttatgaaggggcggga

SEQ ID NO: 26862 - DNA, 549 bp, Artificial Sequence
  chemically treated genomic DNA (Homo sapiens) CpG-island No: 26862
tcccgccccttcataacaattccctcaaccttctccgatcgtctaatttaaaacttctcctcttttaaaacatcccttccccaacattaaacccctcccccgaaacgctccgattccctactatcgaatctcgaactaaacgtccctacccacgcctcctcttcccaaaattcaaaaactcccttctctttttctaccaaacgatcccgaattctcctccgtcccgccccttttctcccgaaccttcctccgctctacgaatccgcgaacccctctcctaacaacccccgaccctcaacgtactcgcgctatttctctcgcgtcctcccttccctcaactatccctcgtaccccccgcaatcccctcaaatttcttcccgaaacgactattcccgaacgcgcgataatattaataaaacaaaactaaaatcgctttaaaaactcaatcgacgctaaaatctatcaccgaacacgttaattttcgctccctcttccgcttttcctacctctccaacccgatatcaatttaaattaccaacgccgcgcacc

SEQ ID NO: 26863 - DNA, 549 bp, Artificial Sequence
  chemically treated genomic DNA (Homo sapiens) CpG-island No: 26863
tttcgtttttttatagtaatttttttagtttttttcgatcgtttaatttaaagtttttttttttttaagatattttttttttagtattaagtttttttttcggagcgtttcggttttttgttgtcggatttcgggttaagcgtttttatttacgttttttttttttaggatttagaaatttttttttttttttttgttaggcgatttcggattttttttcgtttcgttttttttttttcggattttttttcgttttgcgggttcgcgggttttttttttggtaattttcggtttttagcgtgttcgcgttgtttttttcgcgttttttttttttttagttgtttttcgtgtttttcgtagtttttttaggttttttttcggagcggttgttttcgggcgcgcggtggtgttggtggggtagagttgaagtcgttttagaggtttagtcggcgttggggtttgttatcgaatacgttggttttcgttttttttttcgttttttttgtttttttaattcggtattagtttgaattgttagcgtcgcgtatt

SEQ ID NO: 26864 - DNA, 549 bp, Artificial Sequence
  chemically treated genomic DNA (Homo sapiens) CpG-island No: 26864
aatacgcgacgctaacaattcaaactaataccgaattaaaaaaacaaaaaaaacgaaaaaaaaaacgaaaaccaacgtattcgataacaaaccccaacgccgactaaacctctaaaacgacttcaactctaccccaccaacaccaccgcgcgcccgaaaacaaccgctccgaaaaaaaacctaaaaaaactacgaaaaacacgaaaaacaactaaaaaaaaaaaaaacgcgaaaaaaacaacgcgaacacgctaaaaaccgaaaattaccaaaaaaaaaacccgcgaacccgcaaaacgaaaaaaaatccgaaaaaaaaaaaacgaaacgaaaaaaaatccgaaatcgcctaacaaaaaaaaaaaaaaaaatttctaaatcctaaaaaaaaaaaacgtaaataaaaacgcttaacccgaaatccgacaacaaaaaaccgaaacgctccgaaaaaaaaacttaatactaaaaaaaaaatatcttaaaaaaaaaaaaactttaaattaaacgatcgaaaaaaactaaaaaaattactataaaaaaacgaaa

SEQ ID NO: 26865 - DNA, 748 bp, Artificial Sequence
  chemically treated genomic DNA (Homo sapiens) CpG-island No: 26865
ttttggcggttagtttagaaatcgtttagaatttagtttagggtaggtattggagggcgaagtgcgtcgggcgggggcggtattgatttcgaggcggcgggagcggcgaaggcgtcggcgtttttattcgtattttgtatttgtttcgtttttaagttttttcggttttcggtttatattcgcgtcggagcgcgtcggttggggtaggaaattcgattcgcgcgggcgggttgcggtcggggattttcgcgcgttatagggagagggttcggggcgcgttttttggggtttcgatcgcggtagttagtttggtgtacgggttagggtgttttttaggttttcgggcgggcgggcgtatttcggatgtaagcgtatttgttttcgtttagttggttggaggttgagtcgtttatgatcgcgagttgtttgtgttgagcgcggaaattgttcggttcgcgttcgttgttagtttttggaggttgattcgacggcgaattcggttttgaaattaagagtaaatttttttcgagaggcgagagataggaggtaagaggcgtcgttttttggggcgttttttttaggttcgcgttttttgatgattcgtgggtcggttcgggggttgttttttcgttttcgtttagttggtgagtttcgacgggttggtaatcgaggaggtcggttagtttttttttttcgtttacggttattttttgtttttatttttttggggtatttaagaaatattttg

SEQ ID NO: 26866 - DNA, 748 bp, Artificial Sequence
  chemically treated genomic DNA (Homo sapiens) CpG-island No: 26866
caaaatatttcttaaataccccaaaaaaataaaaacaaaaaataaccgtaaacgaaaaaaaaaaactaaccgacctcctcgattaccaacccgtcgaaactcaccaactaaacgaaaacgaaaaaacaacccccgaaccgacccacgaatcatcaaaaaacgcgaacctaaaaaaaacgccccaaaaaacgacgcctcttacctcctatctctcgcctctcgaaaaaaatttactcttaatttcaaaaccgaattcgccgtcgaatcaacctccaaaaactaacaacgaacgcgaaccgaacaatttccgcgctcaacacaaacaactcgcgatcataaacgactcaacctccaaccaactaaacgaaaacaaatacgcttacatccgaaatacgcccgcccgcccgaaaacctaaaaaacaccctaacccgtacaccaaactaactaccgcgatcgaaaccccaaaaaacgcgccccgaaccctctccctataacgcgcgaaaatccccgaccgcaacccgcccgcgcgaatcgaatttcctaccccaaccgacgcgctccgacgcgaatataaaccgaaaaccgaaaaaacttaaaaacgaaacaaatacaaaatacgaataaaaacgccgacgccttcgccgctcccgccgcctcgaaatcaataccgcccccgcccgacgcacttcgccctccaatacctaccctaaactaaattctaaacgatttctaaactaaccgccaaaa

SEQ ID NO: 26867 - DNA, 748 bp, Artificial Sequence
  chemically treated genomic DNA (Homo sapiens) CpG-island No: 26867
taaggtgttttttggatgttttaaagggatgaaaataagaagtgatcgtgggcgaggaggaggagttggtcgattttttcggttgttagttcgtcggagtttattagttaggcgagggcgggaagatagttttcgggtcggtttacggattattagaaggcgcggatttggaggaggcgttttagaaggcgacgttttttgttttttgtttttcgtttttcgaaggaagtttgtttttaattttagagtcgggttcgtcgtcggattaatttttaggagttagtagcgggcgcggatcgggtagttttcgcgtttagtataggtagttcgcggttatgggcggtttagtttttagttagttggacgagggtaagtgcgtttatattcgaggtacgttcgttcgttcgggggtttggggagtattttgattcgtgtattaggttggttgtcgcggtcggggttttaaggggcgcgtttcgggttttttttttgtagcgcgcggggattttcgatcgtagttcgttcgcgcgagtcgggttttttgttttagtcggcgcgtttcggcgcgggtgtggatcggggatcgggagggtttgggagcgaggtaggtgtaggatgcgggtggggacgtcggcgttttcgtcgttttcgtcgtttcggggttagtgtcgttttcgttcggcgtatttcgttttttagtatttgttttggattgagttttgagcggtttttgaattggtcgttaaga

SEQ ID NO: 26868 - DNA, 748 bp, Artificial Sequence
  chemically treated genomic DNA (Homo sapiens) CpG-island No: 26868
tcttaacgaccaattcaaaaaccgctcaaaactcaatccaaaacaaatactaaaaaacgaaatacgccgaacgaaaacgacactaaccccgaaacgacgaaaacgacgaaaacgccgacgtccccacccgcatcctacacctacctcgctcccaaaccctcccgatccccgatccacacccgcgccgaaacgcgccgactaaaacaaaaaacccgactcgcgcgaacgaactacgatcgaaaatccccgcgcgctacaaaaaaaaaacccgaaacgcgccccttaaaaccccgaccgcgacaaccaacctaatacacgaatcaaaatactccccaaacccccgaacgaacgaacgtacctcgaatataaacgcacttaccctcgtccaactaactaaaaactaaaccgcccataaccgcgaactacctatactaaacgcgaaaactacccgatccgcgcccgctactaactcctaaaaattaatccgacgacgaacccgactctaaaattaaaaacaaacttccttcgaaaaacgaaaaacaaaaaacaaaaaacgtcgccttctaaaacgcctcctccaaatccgcgccttctaataatccgtaaaccgacccgaaaactatcttcccgccctcgcctaactaataaactccgacgaactaacaaccgaaaaaatcgaccaactcctcctcctcgcccacgatcacttcttattttcatccctttaaaacatccaaaaaacacctta

SEQ ID NO: 26869 - DNA, 900 bp, Artificial Sequence
  chemically treated genomic DNA (Homo sapiens) CpG-island No: 26869
ttcgggcgttgttcgggggttacgtcggatcgcggtgggcgtcgggggggcgtggtcggttagtttagggcggggcggtggcgcgggttttttaggttaatacgcggcggcgtattttttttcgcgtcgcgggttttttcgcgtcgtgtacgttttcgtttcgcgttttcgtttttcgttcgttcgttttttttcgtttttttcgtagcgtcggtcgagtcggtttttttttagttttttatgaatattgagcggtttttgttgtatttttcgagttttattgcggaagttgaggttcgttatattgtgcggcggcgtcggcgttcgcggtagttgatattagagttttgtttcggtcgcggttagcggagttttgggttggggtaggagtcggtgagtggggcgggcggggaggcgaaggacgcggaagtagcgggtcgggatacgcgtttattcggtagcgttgtaggcgattgacgggggtttcggagtgtggggggggtgtgtgttcgcgggggtgtgaagggatatggcgtcgtcgtcgttttcggtcgttttcgcggcggagacggcgggtgaagcgggtttttattgttttcgtgttttcgagggtcgtgggagggaagggagttggtttgcggaggatttagttagcgaagcgtcgggattttttttttcgtcgcgagtttttcgttgtttttttttttgcgcggaggtcggcgttgcggcgcggttttttcgttttcgggggcgggggttttagtttttttgtagttttatttcggaggcggacggagtggaatgcgagttttttttttgggttttcgtttcgtagttagggatgtgtgtttgtatcgtgggggtggggtagggggtattttgtgtagatatcgttttttt

SEQ ID NO: 26870 - DNA, 900 bp, Artificial Sequence
  chemically treated genomic DNA (Homo sapiens) CpG-island No: 26870
aaaaaaacgatatctacacaaaataccccctaccccacccccacgatacaaacacacatccctaactacgaaacgaaaacccaaaaaaaaaactcgcattccactccgtccgcctccgaaataaaactacaaaaaaactaaaacccccgcccccgaaaacgaaaaaaccgcgccgcaacgccgacctccgcgcaaaaaaaaaaacaacgaaaaactcgcgacgaaaaaaaaaatcccgacgcttcgctaactaaatcctccgcaaaccaactcccttccctcccacgaccctcgaaaacacgaaaacaataaaaacccgcttcacccgccgtctccgccgcgaaaacgaccgaaaacgacgacgacgccatatcccttcacacccccgcgaacacacaccccccccacactccgaaacccccgtcaatcgcctacaacgctaccgaataaacgcgtatcccgacccgctacttccgcgtccttcgcctccccgcccgccccactcaccgactcctaccccaacccaaaactccgctaaccgcgaccgaaacaaaactctaatatcaactaccgcgaacgccgacgccgccgcacaatataacgaacctcaacttccgcaataaaactcgaaaaatacaacaaaaaccgctcaatattcataaaaaactaaaaaaaaaccgactcgaccgacgctacgaaaaaaacgaaaaaaaacgaacgaacgaaaaacgaaaacgcgaaacgaaaacgtacacgacgcgaaaaaacccgcgacgcgaaaaaaaatacgccgccgcgtattaacctaaaaaacccgcgccaccgccccgccctaaactaaccgaccacgcccccccgacgcccaccgcgatccgacgtaacccccgaacaacgcccgaa

SEQ ID NO: 26871 - DNA, 900 bp, Artificial Sequence
  chemically treated genomic DNA (Homo sapiens) CpG-island No: 26871
gaaggagcgatatttgtataaagtgttttttattttatttttacgatgtagatatatatttttagttgcgaggcgaaagtttagagaaaaaattcgtattttatttcgttcgttttcggagtagggttgtagagaggttggggttttcgttttcggaggcgaggggatcgcgtcgtagcgtcggttttcgcgtagaggaaagggtagcgaaaggttcgcggcgaaggaaggaatttcggcgtttcgttgattgggtttttcgtaaattagttttttttttttttacgattttcgaagatacgggaataatgagaattcgttttattcgtcgttttcgtcgcgagagcggtcgggggcggcggcggcgttatgtttttttatattttcgcggatatatattttttttatatttcggggttttcgttagtcgtttgtaacgttgtcgagtagacgcgtgtttcggttcgttgttttcgcgtttttcgttttttcgttcgttttatttatcggtttttgttttagtttagggtttcgttggtcgcggtcggagtaagattttggtattagttgtcgcggacgtcggcgtcgtcgtataatatggcgagttttagttttcgtaatggagttcgggaaatataataggggtcgtttaatatttatgagagattgaggggaagtcggttcggtcggcgttgcggggagggcgggaaggagcgagcgagcgaggggcggaggcgcgggacgaggacgtgtacggcgcggggaggttcgcggcgcgagggagggtgcgtcgtcgcgtgttggtttggagaattcgcgttatcgtttcgttttgggttggtcggttacgttttttcggcgtttatcgcggttcgacgtagttttcgggtaacgttcgga

SEQ ID NO: 26872 - DNA, 900 bp, Artificial Sequence
  chemically treated genomic DNA (Homo sapiens) CpG-island No: 26872
tccgaacgttacccgaaaactacgtcgaaccgcgataaacgccgaaaaaacgtaaccgaccaacccaaaacgaaacgataacgcgaattctccaaaccaacacgcgacgacgcaccctccctcgcgccgcgaacctccccgcgccgtacacgtcctcgtcccgcgcctccgcccctcgctcgctcgctccttcccgccctccccgcaacgccgaccgaaccgacttcccctcaatctctcataaatattaaacgacccctattatatttcccgaactccattacgaaaactaaaactcgccatattatacgacgacgccgacgtccgcgacaactaataccaaaatcttactccgaccgcgaccaacgaaaccctaaactaaaacaaaaaccgataaataaaacgaacgaaaaaacgaaaaacgcgaaaacaacgaaccgaaacacgcgtctactcgacaacgttacaaacgactaacgaaaaccccgaaatataaaaaaaatatatatccgcgaaaatataaaaaaacataacgccgccgccgcccccgaccgctctcgcgacgaaaacgacgaataaaacgaattctcattattcccgtatcttcgaaaatcgtaaaaaaaaaaaaaactaatttacgaaaaacccaatcaacgaaacgccgaaattccttccttcgccgcgaacctttcgctaccctttcctctacgcgaaaaccgacgctacgacgcgatcccctcgcctccgaaaacgaaaaccccaacctctctacaaccctactccgaaaacgaacgaaataaaatacgaattttttctctaaactttcgcctcgcaactaaaaatatatatctacatcgtaaaaataaaataaaaaacactttatacaaatatcgctccttc

SEQ ID NO: 26873 - DNA, 690 bp, Artificial Sequence
  chemically treated genomic DNA (Homo sapiens) CpG-island No: 26873
  misc_feature (265)..(265): n is either a, c, g or t
gtaggtgcgcgtcggcgaggttcggtttagtttcgtcgcggcggttgttttattttcggtttcgttttttattcgtcgttcgttttcgttttcgtcgtcgtcgtcgtcgttttcgttcgttttttagacgtttttagttatcgggatgggcgcggcgggtttttgttcgtagtttcggaaaattttacgcgttcgcgttattacgtacgtcgcgcgtcgcgcgcgttcgttaggttcgacgggtacgcgtacgtttgtgcgcgtntaaatcgtatcgggtttcgagcgcgtgttcgagcggtttaaaggggtcgtgttgttgttttcgggtatcgttgtttcgggagaatttcggcggttcggttttgcggggaatcggcgggatggggatcggggtagtggattttcggagttgggatggggcggggggaacgcgggcgtggagtttttcggggatagggtaaggttgggtaatcgtgggcgggggtttttttaggggcgggggtggggtaacggcgggcggggggtatttaatcgatagggtaggggcgggaaggttacgggcgggggcggttttttcggggacggggcgggtgggggtatcgcggcgagatcgttttttgtagaggaggtaataggtttcgttagtaggttagggtttcgggtaggcgtaggtgtttttcggttttt

SEQ ID NO: 26874 - DNA, 690 bp, Artificial Sequence
  chemically treated genomic DNA (Homo sapiens) CpG-island No: 26874
  misc_feature (426)..(426): n is either a, c, g or t
aaaaaccgaaaaacacctacgcctacccgaaaccctaacctactaacgaaacctattacctcctctacaaaaaacgatctcgccgcgatacccccacccgccccgtccccgaaaaaaccgcccccgcccgtaaccttcccgcccctaccctatcgattaaataccccccgcccgccgttaccccacccccgcccctaaaaaaacccccgcccacgattacccaaccttaccctatccccgaaaaactccacgcccgcgttccccccgccccatcccaactccgaaaatccactaccccgatccccatcccgccgattccccgcaaaaccgaaccgccgaaattctcccgaaacaacgatacccgaaaacaacaacacgacccctttaaaccgctcgaacacgcgctcgaaacccgatacgatttanacgcgcacaaacgtacgcgtacccgtcgaacctaacgaacgcgcgcgacgcgcgacgtacgtaataacgcgaacgcgtaaaattttccgaaactacgaacaaaaacccgccgcgcccatcccgataactaaaaacgtctaaaaaacgaacgaaaacgacgacgacgacgacgaaaacgaaaacgaacgacgaataaaaaacgaaaccgaaaataaaacaaccgccgcgacgaaactaaaccgaacctcgccgacgcgcacctac

SEQ ID NO: 26875 - DNA, 690 bp, Artificial Sequence
  chemically treated genomic DNA (Homo sapiens) CpG-island No: 26875
  misc_feature (426)..(426): n is either a, c, g or t
agaggtcggggggtatttgcgtttgttcgggattttgatttgttagcggggtttgttgttttttttgtaggaagcgatttcgtcgcggtgtttttattcgtttcgttttcggagggatcgttttcgttcgtggttttttcgtttttgttttgtcgattgagtgtttttcgttcgtcgttattttattttcgtttttggaggagttttcgtttacggttatttaattttattttgttttcggagggttttacgttcgcgtttttttcgttttattttaatttcgagggtttattgtttcggtttttatttcgtcggtttttcgtagggtcgggtcgtcggggttttttcggggtagcggtattcgaaggtagtagtacggtttttttaagtcgttcggatacgcgttcggggttcgatgcggtttgnacgcgtataggcgtgcgcgtgttcgtcgggtttggcgagcgcgcgcgacgcgcggcgtgcgtggtgacgcgagcgcgtggggtttttcgaggttgcgggtaggggttcgtcgcgtttatttcgatggttggaggcgtttgaggggcggacggaggcggcggcggcggcggcgggagcgggagcgggcggcgagtggggagcggggtcgggagtggagtagtcgtcgcggcgggattggatcgagtttcgtcggcgcgtatttgt

SEQ ID NO: 26876 - DNA, 690 bp, Artificial Sequence
  chemically treated genomic DNA (Homo sapiens) CpG-island No: 26876
  misc_feature (265)..(265): n is either a, c, g or t
acaaatacgcgccgacgaaactcgatccaatcccgccgcgacgactactccactcccgaccccgctccccactcgccgcccgctcccgctcccgccgccgccgccgccgcctccgtccgcccctcaaacgcctccaaccatcgaaataaacgcgacgaacccctacccgcaacctcgaaaaaccccacgcgctcgcgtcaccacgcacgccgcgcgtcgcgcgcgctcgccaaacccgacgaacacgcgcacgcctatacgcgtncaaaccgcatcgaaccccgaacgcgtatccgaacgacttaaaaaaaccgtactactaccttcgaataccgctaccccgaaaaaaccccgacgacccgaccctacgaaaaaccgacgaaataaaaaccgaaacaataaaccctcgaaattaaaataaaacgaaaaaaacgcgaacgtaaaaccctccgaaaacaaaataaaattaaataaccgtaaacgaaaactcctccaaaaacgaaaataaaataacgacgaacgaaaaacactcaatcgacaaaacaaaaacgaaaaaaccacgaacgaaaacgatccctccgaaaacgaaacgaataaaaacaccgcgacgaaatcgcttcctacaaaaaaaacaacaaaccccgctaacaaatcaaaatcccgaacaaacgcaaataccccccgacctct

SEQ ID NO: 26877 - DNA, 1077 bp, Artificial Sequence
  chemically treated genomic DNA (Homo sapiens) CpG-island No: 26877
tcgcgggggtgtttcggtcgcgtagcggagtaggatgggttggagtgtagtcggggagcgggtattcggcgtttcggggttgttcgggtatttggtaagcgtttttcgaggttttcgtttatttgcgttttcgtcgtatttttttttattcggcggcgggttttcggggagcgatgagtcgttcgtgtttggtgcgttcggatgttcggaggtttttaggatatcgaggttatcggtgggtatcgaatgttttcgagttgtttacggttcggcgtgggttttaaaaatcgtttttggtgaaataaggcgtttttagagtcgtttcgtatcggggtgtgtttgggtttggttttcgtaggtggttttcggggtcggttttcggtgtcgtcggttttcggtgttattagttttcggtgtcgtcggttttcggtgtcgacggttttcggtgtcgacggttttcggtgtcggtttttagtgtcggttttcggtgttgtcggtttttggtgtcggttttcggtgttgtcggttttcggtgttgtcgattttcggtgttgacggttttcggtgttgtcggttttcggtgtcggttttcggtgttgtcggttttcggtgttgtcggtttttggtgtcggttttcggtgttgtcggttttcggtgtcggttttcggtgttgtcggttttcggtgttgtcgattttcggtgtcgtcggttttcggtgtcgtcggtttttggtgtcggttttcggtgtcggttttcggtgttgtcggttttcggtgttggttttcggtgttgtcggttttcggtgttgtcggttttcggtgtcgtcggttttcggtgttgtcggtttttcgtgttgacggttttcggtgtcggttttcggtgtcggttttcggtgttgtcggttttcggtgttggttttcggtgttgtcggttttcggtgtcgtcggttttcggtgtcgtcggttttcggtgttgtcggtttttcgtgttgacggttttcggtgttgttagttttcggtgttgttttcgttttttaggtaggatttattattttttttgttttgttcgtagcgattt

SEQ ID NO: 26878 - DNA, 1077 bp, Artificial Sequence
  chemically treated genomic DNA (Homo sapiens) CpG-island No: 26878
aaatcgctacgaacaaaacaaaaaaaataataaatcctacctaaaaaacgaaaacaacaccgaaaactaacaacaccgaaaaccgtcaacacgaaaaaccgacaacaccgaaaaccgacgacaccgaaaaccgacgacaccgaaaaccgacaacaccgaaaaccaacaccgaaaaccgacaacaccgaaaaccgacaccgaaaaccgacaccgaaaaccgtcaacacgaaaaaccgacaacaccgaaaaccgacgacaccgaaaaccgacaacaccgaaaaccgacaacaccgaaaaccaacaccgaaaaccgacaacaccgaaaaccgacaccgaaaaccgacaccaaaaaccgacgacaccgaaaaccgacgacaccgaaaatcgacaacaccgaaaaccgacaacaccgaaaaccgacaccgaaaaccgacaacaccgaaaaccgacaccaaaaaccgacaacaccgaaaaccgacaacaccgaaaaccgacaccgaaaaccgacaacaccgaaaaccgtcaacaccgaaaatcgacaacaccgaaaaccgacaacaccgaaaaccgacaccaaaaaccgacaacaccgaaaaccgacactaaaaaccgacaccgaaaaccgtcgacaccgaaaaccgtcgacaccgaaaaccgacgacaccgaaaactaataacaccgaaaaccgacgacaccgaaaaccgaccccgaaaaccacctacgaaaaccaaacccaaacacaccccgatacgaaacgactctaaaaacgccttatttcaccaaaaacgatttttaaaacccacgccgaaccgtaaacaactcgaaaacattcgatacccaccgataacctcgatatcctaaaaacctccgaacatccgaacgcaccaaacacgaacgactcatcgctccccgaaaacccgccgccgaataaaaaaaaatacgacgaaaacgcaaataaacgaaaacctcgaaaaacgcttaccaaatacccgaacaaccccgaaacgccgaatacccgctccccgactacactccaacccatcctactccgctacgcgaccgaaacacccccgcga

SEQ ID NO: 26879 - DNA, 1077 bp, Artificial Sequence
  chemically treated genomic DNA (Homo sapiens) CpG-island No: 26879
gggtcgttgcgggtagagtagagggggtggtgggttttgtttggggggcgggggtagtatcgagaattggtagtatcgagaatcgttagtacggaaaatcggtagtatcgagaatcggcggtatcgagaatcggcggtatcgagaatcggtagtatcgagaattagtatcgagaatcggtagtatcgagaatcggtatcgagaatcggtatcgagaatcgttagtacggaaaatcggtagtatcgagaatcggcggtatcgagaatcggtagtatcgagaatcggtagtatcgagaattagtatcgagaatcggtagtatcgagaatcggtatcgagaatcggtattaagaatcggcggtatcgagaatcggcggtatcgagaatcggtagtatcgagaatcggtagtatcgagaatcggtatcgagaatcggtagtatcgagaatcggtattaagaatcggtagtatcgagaatcggtagtatcgagaatcggtatcgagaatcggtagtatcgagaatcgttagtatcgagaatcggtagtatcgagaatcggtagtatcgagaatcggtattaagaatcggtagtatcgagaatcggtattgagaatcggtatcgagaatcgtcggtatcgagaatcgtcggtatcgagaatcggcggtatcgagaattggtggtatcgagaatcggcggtatcgagaatcggtttcgagagttatttgcggggattaggtttaggtatatttcgatgcggggcggttttgagggcgttttgttttattaaaggcggtttttggaatttacgtcggatcgtgaataattcgagggtattcgatatttatcggtagtttcggtgttttagaaattttcgggtattcgagcgtattaggtacgggcggtttatcgtttttcggggattcgtcgtcgagtgggggaaggtgcggcgggggcgtagatggacggaggtttcgaaaaacgtttgttaggtgttcgggtagtttcgagacgtcgggtattcgtttttcggttgtattttagtttattttgtttcgttgcgcggtcggggtattttcgcgg

SEQ ID NO: 26880 - DNA, 1077 bp, Artificial Sequence
  chemically treated genomic DNA (Homo sapiens) CpG-island No: 26880
ccgcgaaaataccccgaccgcgcaacgaaacaaaataaactaaaatacaaccgaaaaacgaatacccgacgtctcgaaactacccgaacacctaacaaacgtttttcgaaacctccgtccatctacgcccccgccgcaccttcccccactcgacgacgaatccccgaaaaacgataaaccgcccgtacctaatacgctcgaatacccgaaaatttctaaaacaccgaaactaccgataaatatcgaataccctcgaattattcacgatccgacgtaaattccaaaaaccgcctttaataaaacaaaacgccctcaaaaccgccccgcatcgaaatatacctaaacctaatccccgcaaataactctcgaaaccgattctcgataccgccgattctcgataccaccaattctcgataccgccgattctcgataccgacgattctcgataccgacgattctcgataccgattctcaataccgattctcgatactaccgattcttaataccgattctcgatactaccgattctcgatactaccgattctcgatactaacgattctcgatactaccgattctcgataccgattctcgatactaccgattctcgatactaccgattcttaataccgattctcgatactaccgattctcgataccgattctcgatactaccgattctcgatactaccgattctcgataccgccgattctcgataccgccgattcttaataccgattctcgataccgattctcgatactaccgattctcgatactaattctcgatactaccgattctcgatactaccgattctcgataccgccgattctcgatactaccgattttccgtactaacgattctcgataccgattctcgataccgattctcgatactaccgattctcgatactaattctcgatactaccgattctcgataccgccgattctcgataccgccgattctcgatactaccgattttccgtactaacgattctcgatactaccaattctcgatactacccccgccccccaaacaaaacccaccaccccctctactctacccgcaacgaccc

SEQ ID NO: 26881 - DNA, 732 bp, Artificial Sequence
  chemically treated genomic DNA (Homo sapiens) CpG-island No: 26881
cggtcgttttttcgttagttaagttcgtcgttttgattttcggtagtaagtcgttattatggtgaagatcgtgatagttaagatttaggcgtattaggattagaagtcgggtacgagcgggttgcggaagcgggtgaaggtgttttagagtagcgttaattacgcggagaattttatttagagtattatttttatcgtggagtcggcgtagcggtaggaggttacgttggtggtgggcggggacggtcggttttatatgaaggaggttatttagtttatcgttcgtatcgttgtcgttaacggggtaagggatgcgcggtttcgcgtcgttgtgtattttggcgcgtgtgcgacgtgcggttcgcggcgttttttttcgttcggggtcggtcgttttcgcgcgttgtcgtttcggtttttatttttcgtttttttttttttttcgcgttcgtttttttggtttggaggttcgacggaggtcgtcgggttggggaaagtggttacgggattcggtagatttgttcgtttgattttcggggcgtcgggaggtgcgggcgcggagttttttaaggttacgttcgatttttcgtttttagtcgttgtttttttttttttcgtttttcgtttttttcgaggcgtttgatatttgttttaattttgtagttttggaagatacgattacggcgtagagtgttgtcgttttaagtaggaaaggttagattgtcgtcgttt

SEQ ID NO: 26882 - DNA, 732 bp, Artificial Sequence
  chemically treated genomic DNA (Homo sapiens) CpG-island No: 26882
aaacgacgacaatctaacctttcctacttaaaacgacaacactctacgccgtaatcgtatcttccaaaactacaaaattaaaacaaatatcaaacgcctcgaaaaaaacgaaaaacgaaaaaaaaaaaaacaacgactaaaaacgaaaaatcgaacgtaaccttaaaaaactccgcgcccgcacctcccgacgccccgaaaatcaaacgaacaaatctaccgaatcccgtaaccactttccccaacccgacgacctccgtcgaacctccaaaccaaaaaaacgaacgcgaaaaaaaaaaaaaaacgaaaaataaaaaccgaaacgacaacgcgcgaaaacgaccgaccccgaacgaaaaaaaacgccgcgaaccgcacgtcgcacacgcgccaaaatacacaacgacgcgaaaccgcgcatcccttaccccgttaacgacaacgatacgaacgataaactaaataacctccttcatataaaaccgaccgtccccgcccaccaccaacgtaacctcctaccgctacgccgactccacgataaaaataatactctaaataaaattctccgcgtaattaacgctactctaaaacaccttcacccgcttccgcaacccgctcgtacccgacttctaatcctaatacgcctaaatcttaactatcacgatcttcaccataataacgacttactaccgaaaatcaaaacgacgaacttaactaacgaaaaaacgaccg

SEQ ID NO: 26883 - DNA, 732 bp, Artificial Sequence
  chemically treated genomic DNA (Homo sapiens) CpG-island No: 26883
aggcggcggtagtttaattttttttgtttaaggcgatagtattttgcgtcgtaatcgtattttttaaggttgtaaggttagggtaaatgttagacgtttcgggaggggcgggggacggggagagggaaggtagcggttagagacggagagtcgggcgtgattttgggaggtttcgcgttcgtatttttcggcgtttcgggagttaggcgagtaggtttgtcgggtttcgtggttattttttttagttcggcgattttcgtcgggtttttaggttagaagagcgagcgcgaaggagagggaggagcgggaggtggaaatcgaggcggtagcgcgcggaagcggtcggtttcgagcgagggagggcgtcgcgggtcgtacgtcgtatacgcgttagggtgtatagcggcgcggggtcgcgtattttttatttcgttggcggtagcgatgcgagcgatgagttggatggttttttttatgtagaatcggtcgttttcgtttattattagcgtggttttttgtcgttgcgtcggttttacggtggagatgatattttggatgaagtttttcgcgtagttggcgttgttttggaatatttttattcgttttcgtagttcgttcgtgttcggtttttggttttggtacgtttgggttttaattgttacgatttttattatggtggcgatttgttgtcgggggttagagcggcggatttggttggcggaggggcggtcg

SEQ ID NO: 26884 - DNA, 732 bp, Artificial Sequence
  chemically treated genomic DNA (Homo sapiens) CpG-island No: 26884
cgaccgcccctccgccaaccaaatccgccgctctaacccccgacaacaaatcgccaccataataaaaatcgtaacaattaaaacccaaacgtaccaaaaccaaaaaccgaacacgaacgaactacgaaaacgaataaaaatattccaaaacaacgccaactacgcgaaaaacttcatccaaaatatcatctccaccgtaaaaccgacgcaacgacaaaaaaccacgctaataataaacgaaaacgaccgattctacataaaaaaaaccatccaactcatcgctcgcatcgctaccgccaacgaaataaaaaatacgcgaccccgcgccgctatacaccctaacgcgtatacgacgtacgacccgcgacgccctccctcgctcgaaaccgaccgcttccgcgcgctaccgcctcgatttccacctcccgctcctccctctccttcgcgctcgctcttctaacctaaaaacccgacgaaaatcgccgaactaaaaaaaataaccacgaaacccgacaaacctactcgcctaactcccgaaacgccgaaaaatacgaacgcgaaacctcccaaaatcacgcccgactctccgtctctaaccgctaccttccctctccccgtcccccgcccctcccgaaacgtctaacatttaccctaaccttacaaccttaaaaaatacgattacgacgcaaaatactatcgccttaaacaaaaaaaattaaactaccgccgcct

SEQ ID NO: 26885 - DNA, 978 bp, Artificial Sequence
  chemically treated genomic DNA (Homo sapiens) CpG-island No: 26885
agtcgtcggttttttcgtatgaggagttgttatagttttcgaatttatttgttttgaataataggattagtgtttgtgttacgttttacgttttcgagaaattcgtaggttttcggaggtttcgtttttttaaatattgatcgagtttttttaatttttttcgtcgtttttttgcgggtgatttttaaacgttttagtttcgttttcgttttttttttttcgttattatacgtttttcggattttaggttcgtttttttgttaaaattttttgcgatttttttttttttttatttcgtatttttattattattgttttatattttggttacgatttttcgtaaagaggtcgagaaggtgcgggtttgggggaatagcggaaaattatagaacgcggtcgttattgcgtcgttttggttatttttttttggtattataaacgttttttcgcgaatggcggagttagttagttttcggggtgttcgttttagttaatcggtgtttacggatgttacgtttgtttttgttttttttgtttatgttttagaaaacgcgtattgcgtttttagttggttttaaaagttttcgcggttatttttacgaagggtaaaatttttcgtattagcggaagtaaggggttggtagagcggtatcgtaagaaattaattaattagaataatattatcgcgacgtagcgtcgtgtgattttattttcgttaagtgcgcgatttttgtcgttattttttttgttcggcgtgtttaggttcgcgttaaattattattaattagacgacgtttttatttaaagggttgtagcggagttttggtttcggtgttttttatttacggtcgtgcgggaattgcgtattttagggattcgtagtattagttttatagtatcgcgtggagttgtttgtttttttatataggaggttatatttttttcgtgtaatgttattaatggtgtcgatttttttta

SEQ ID NO: 26886 - DNA, 978 bp, Artificial Sequence
  chemically treated genomic DNA (Homo sapiens) CpG-island No: 26886
taaaaaaaatcgacaccattaataacattacacgaaaaaaatataacctcctatataaaaaaacaaacaactccacgcgatactataaaactaatactacgaatccctaaaatacgcaattcccgcacgaccgtaaataaaaaacaccgaaaccaaaactccgctacaaccctttaaataaaaacgtcgtctaattaataataatttaacgcgaacctaaacacgccgaacaaaaaaaataacgacaaaaatcgcgcacttaacgaaaataaaatcacacgacgctacgtcgcgataatattattctaattaattaatttcttacgataccgctctaccaaccccttacttccgctaatacgaaaaattttacccttcgtaaaaataaccgcgaaaacttttaaaaccaactaaaaacgcaatacgcgttttctaaaacataaacaaaaaaaacaaaaacaaacgtaacatccgtaaacaccgattaactaaaacgaacaccccgaaaactaactaactccgccattcgcgaaaaaacgtttataataccaaaaaaaaataaccaaaacgacgcaataacgaccgcgttctataattttccgctattcccccaaacccgcaccttctcgacctctttacgaaaaatcgtaaccaaaatataaaacaataataataaaaatacgaaataaaaaaaaaaaaaaatcgcaaaaaattttaacaaaaaaacgaacctaaaatccgaaaaacgtataataacgaaaaaaaaaaaacgaaaacgaaactaaaacgtttaaaaatcacccgcaaaaaaacgacgaaaaaaattaaaaaaactcgatcaatatttaaaaaaacgaaacctccgaaaacctacgaatttctcgaaaacgtaaaacgtaacacaaacactaatcctattattcaaaacaaataaattcgaaaactataacaactcctcatacgaaaaaaccgacgact

SEQ ID NO: 26887 - DNA, 978 bp, Artificial Sequence
  chemically treated genomic DNA (Homo sapiens) CpG-island No: 26887
tggggagaatcggtattattggtggtattatacgaagagaatgtgattttttatgtaaaagaataagtaattttacgcggtgttgtgaggttagtgttgcgagtttttgaggtgcgtaattttcgtacgatcgtgggtgggaaatatcgaagttaaaatttcgttatagttttttagatgaaggcgtcgtttgattggtgatagtttggcgcgaatttgagtacgtcgaataaaggaagtgacggtagaagtcgcgtatttgacgagggtgggattatacggcgttgcgtcgcggtagtattgttttgattggttgattttttgcgatatcgttttgttagttttttgttttcgttagtgcggagggttttgtttttcgtaaagatggtcgcggaggtttttggagttaattgggagcgtagtacgcgttttttggagtatgggtagaggagataggaataagcgtagtattcgtgagtatcgattggttgaagcgagtatttcgggagttgattggtttcgttattcgcgggaaggcgtttgtggtgttagagaaaagtagttagagcggcgtagtggcggtcgcgttttgtggtttttcgttatttttttagattcgtattttttcggtttttttgcggagaatcgtgattaagatgtggaatagtaatgatgggggtgcggggtggaggaggaagagaatcgtaggaggttttagtaagagggcgagtttagggttcgagaggcgtgtggtagcgggagaggaagggcgggagcggagttggggcgtttgggggttattcgtaggaaggcggcgaggaaggttagggagattcggttagtgtttgaaggggcgaagttttcgggagtttgcgggtttttcggaggcgtgggacgtggtataggtattaattttgttgtttaaaataggtggattcgaaagttatggtagttttttatacgggggagtcggcggtt

SEQ ID NO: 26888 - DNA, 978 bp, Artificial Sequence
  chemically treated genomic DNA (Homo sapiens) CpG-island No: 26888
aaccgccgactcccccgtataaaaaactaccataactttcgaatccacctattttaaacaacaaaattaatacctataccacgtcccacgcctccgaaaaacccgcaaactcccgaaaacttcgccccttcaaacactaaccgaatctccctaaccttcctcgccgccttcctacgaataacccccaaacgccccaactccgctcccgcccttcctctcccgctaccacacgcctctcgaaccctaaactcgccctcttactaaaacctcctacgattctcttcctcctccaccccgcacccccatcattactattccacatcttaatcacgattctccgcaaaaaaaccgaaaaaatacgaatctaaaaaaataacgaaaaaccacaaaacgcgaccgccactacgccgctctaactacttttctctaacaccacaaacgccttcccgcgaataacgaaaccaatcaactcccgaaatactcgcttcaaccaatcgatactcacgaatactacgcttattcctatctcctctacccatactccaaaaaacgcgtactacgctcccaattaactccaaaaacctccgcgaccatctttacgaaaaacaaaaccctccgcactaacgaaaacaaaaaactaacaaaacgatatcgcaaaaaatcaaccaatcaaaacaatactaccgcgacgcaacgccgtataatcccaccctcgtcaaatacgcgacttctaccgtcacttcctttattcgacgtactcaaattcgcgccaaactatcaccaatcaaacgacgccttcatctaaaaaactataacgaaattttaacttcgatatttcccacccacgatcgtacgaaaattacgcacctcaaaaactcgcaacactaacctcacaacaccgcgtaaaattacttattcttttacataaaaaatcacattctcttcgtataataccaccaataataccgattctcccca

SEQ ID NO: 26889 - DNA, 685 bp, Artificial Sequence
  chemically treated genomic DNA (Homo sapiens) CpG-island No: 26889
cgtcggggtcggttgagaagggtagcggggatacgggggatgttcggtcgttttcggtcgcgtacgttagttttttttaggaacgcgcgggttcgtatttttcgtacgcggttgtcgattggttgggacggcgtcgggcgtgacgttagggttcgttttatcgtttttcggtttcgtttcgcggggtggtttggtagtttggtttggagtagttgaaatcggtttgagcgtggttgttttttgtcgttcgacgtcgcggtaggtcgtttggggggagcgttggcgaggtacggacggcgggcgttcggtatttttgttcgcggttttcgttttcgggcggggcggcggcgacgcggatttgcggattagcgaattcggaggtgaggtagcgagtcgggtgcgggggtcgggcggttatttacgtggcgggttgagttgttagggcggttcgggacgcggcgggtttggggcgtcggggtcgaggcgcgggcggggttttcgggtcgggtcgggtcggttattgttcgtaggggaacggcggtcgggcgttcgttgcgttaaatcggtggttgggacgtatttttcgatttttattgtttattgtcgcgtttttgttgggttgtttggggtttagtttttttttaaaaaatacgtggagtatttgaggagtagtagggtgcgtgga

SEQ ID NO: 26890 - DNA, 685 bp, Artificial Sequence
  chemically treated genomic DNA (Homo sapiens) CpG-island No: 26890
tccacgcaccctactactcctcaaatactccacgtattttttaaaaaaaaactaaaccccaaacaacccaacaaaaacgcgacaataaacaataaaaatcgaaaaatacgtcccaaccaccgatttaacgcaacgaacgcccgaccgccgttcccctacgaacaataaccgacccgacccgacccgaaaaccccgcccgcgcctcgaccccgacgccccaaacccgccgcgtcccgaaccgccctaacaactcaacccgccacgtaaataaccgcccgacccccgcacccgactcgctacctcacctccgaattcgctaatccgcaaatccgcgtcgccgccgccccgcccgaaaacgaaaaccgcgaacaaaaataccgaacgcccgccgtccgtacctcgccaacgctccccccaaacgacctaccgcgacgtcgaacgacaaaaaacaaccacgctcaaaccgatttcaactactccaaaccaaactaccaaaccaccccgcgaaacgaaaccgaaaaacgataaaacgaaccctaacgtcacgcccgacgccgtcccaaccaatcgacaaccgcgtacgaaaaatacgaacccgcgcgttcctaaaaaaaactaacgtacgcgaccgaaaacgaccgaacatcccccgtatccccgctacccttctcaaccgaccccgacg

SEQ ID NO: 26891 - DNA, 685 bp, Artificial Sequence
  chemically treated genomic DNA (Homo sapiens) CpG-island No: 26891
tttacgtattttgttattttttaaatgttttacgtattttttagaagggaattaagttttaggtagtttagtagaagcgcggtagtgaataataaaagtcgaagagtgcgttttagttatcgatttagcgtagcgaacgttcggtcgtcgtttttttgcgggtagtggtcggttcggttcggttcgaggatttcgttcgcgtttcggtttcgacgttttaggttcgtcgcgtttcgggtcgttttgatagtttagttcgttacgtgagtggtcgttcggttttcgtattcggttcgttgttttattttcgggttcgttagttcgtaggttcgcgtcgtcgtcgtttcgttcgagagcgaggatcgcgggtagaggtatcgggcgttcgtcgttcgtgtttcgttagcgttttttttaggcggtttgtcgcggcgtcgagcggtaggaagtagttacgtttaaatcggttttagttgttttagattaaattgttaggttatttcgcggggcggggtcggagggcggtggggcgggttttgacgttacgttcggcgtcgttttagttaatcggtagtcgcgtgcggggggtgcgggttcgcgcgtttttggaaagggttgacgtacgcggtcgagggcggtcgggtatttttcgtgttttcgttgttttttttagtcgatttcggcg

SEQ ID NO: 26892 - DNA, 685 bp, Artificial Sequence
  chemically treated genomic DNA (Homo sapiens) CpG-island No: 26892
cgccgaaatcgactaaaaaaaacaacgaaaacacgaaaaatacccgaccgccctcgaccgcgtacgtcaaccctttccaaaaacgcgcgaacccgcaccccccgcacgcgactaccgattaactaaaacgacgccgaacgtaacgtcaaaacccgccccaccgccctccgaccccgccccgcgaaataacctaacaatttaatctaaaacaactaaaaccgatttaaacgtaactacttcctaccgctcgacgccgcgacaaaccgcctaaaaaaaacgctaacgaaacacgaacgacgaacgcccgatacctctacccgcgatcctcgctctcgaacgaaacgacgacgacgcgaacctacgaactaacgaacccgaaaataaaacaacgaaccgaatacgaaaaccgaacgaccactcacgtaacgaactaaactatcaaaacgacccgaaacgcgacgaacctaaaacgtcgaaaccgaaacgcgaacgaaatcctcgaaccgaaccgaaccgaccactacccgcaaaaaaacgacgaccgaacgttcgctacgctaaatcgataactaaaacgcactcttcgacttttattattcactaccgcgcttctactaaactacctaaaacttaattcccttctaaaaaatacgtaaaacatttaaaaaataacaaaatacgtaaa

SEQ ID NO: 26893 - DNA, 799 bp, Artificial Sequence
  chemically treated genomic DNA (Homo sapiens) CpG-island No: 26893
  misc_feature (402)..(402): n is either a, c, g or t
ttcgagtcgttcggcgtggttcgttttgtttggatattattggtcgtttgagttgtttgttaggtcgtttcgttaagcgattgtttcgtagttcggagtttttggaagtagtttcgggaaatttcgcgtgttgtcgggatcgcgttttagtttattaggggggggagggggtggcgcgcgcgttatttttagtcgtttttaaagcgtttcgcgttgatttttacgggttcggttgtcggttttcgttttgttttggtgagtttcgcgtcggttcgtggggggaggggtcgggagtttcgatgcgattcgatttagttcgggtttcgtgtttggtttcgtttcgtttgcgtttcgaggtttcggggtgggggtggggacgggttgggggcggtttcggtttantttagacgttcggttgtgggtttatttcggtcgaaacgtttttcgttttcgtttttttttttttcgtttatatagttcgcggttcggttcgttgggcgtttttcgcgcggtttgatggggtcggtcgtgtttttttcgttttcgttcgttgttttatgcggtcggatttcgcgaagggtttgaggcgttcgcggttttgtcgttttttttcgtcggagtcgtttcgttttcgtcgcggtcggtttagttcgagagggatgtgttgatgattcggacgggtttgaggggatgggggtggggggcggaaggcggggtgtagattttagggttatttgagtcgggagaaaagttttgtgtgagtagaaatcgaaaggtcgatttgtgtgggaagtttttt

SEQ ID NO: 26894 - DNA, 799 bp, Artificial Sequence
  chemically treated genomic DNA (Homo sapiens) CpG-island No: 26894
  misc_feature (398)..(398): n is either a, c, g or t
aaaaaacttcccacacaaatcgacctttcgatttctactcacacaaaacttttctcccgactcaaataaccctaaaatctacaccccgccttccgccccccacccccatcccctcaaacccgtccgaatcatcaacacatccctctcgaactaaaccgaccgcgacgaaaacgaaacgactccgacgaaaaaaaacgacaaaaccgcgaacgcctcaaacccttcgcgaaatccgaccgcataaaacaacgaacgaaaacgaaaaaaacacgaccgaccccatcaaaccgcgcgaaaaacgcccaacgaaccgaaccgcgaactatataaacgaaaaaaaaaaaaacgaaaacgaaaaacgtttcgaccgaaataaacccacaaccgaacgtctaaantaaaccgaaaccgcccccaacccgtccccacccccaccccgaaacctcgaaacgcaaacgaaacgaaaccaaacacgaaacccgaactaaatcgaatcgcatcgaaactcccgacccctccccccacgaaccgacgcgaaactcaccaaaacaaaacgaaaaccgacaaccgaacccgtaaaaatcaacgcgaaacgctttaaaaacgactaaaaataacgcgcgcgccaccccctcccccccctaataaactaaaacgcgatcccgacaacacgcgaaatttcccgaaactacttccaaaaactccgaactacgaaacaatcgcttaacgaaacgacctaacaaacaactcaaacgaccaataatatccaaacaaaacgaaccacgccgaacgactcgaa

SEQ ID NO: 26895 - DNA, 799 bp, Artificial Sequence
  chemically treated genomic DNA (Homo sapiens) CpG-island No: 26895
  misc_feature (398)..(398): n is either a, c, g or t
gggaggttttttatataaatcggtttttcggtttttgtttatataaaatttttttttcggtttagataattttgggatttgtatttcgtttttcgttttttatttttatttttttaggttcgttcggattattagtatatttttttcgggttaggtcggtcgcggcgggagcgaagcggtttcggcggggagaagcggtagggtcgcgggcgttttaggtttttcgcgggattcggtcgtatggagtagcgagcggaggcgggaaaagtacggtcggttttattaggtcgcgcggagagcgtttaacgggtcggatcgcgggttatatgggcggggggaggaagagcgagggcgagaagcgtttcggtcgggataggtttatagtcgagcgtttggantagatcgaagtcgtttttagttcgtttttatttttatttcggggtttcggagcgtaaacgaaacgggattaggtacggagttcgggttgagtcgggtcgtatcggggttttcggtttttttttttacgggtcggcgcgagatttattagggtagagcgggggtcggtagtcgggttcgtgagaattagcgcgaggcgttttgaaaacgattagaaatggcgcgcgcgttatttttttttttttttgatggattgagacgcgatttcggtagtacgcggggtttttcggaattgtttttagggatttcgagttacggggtaatcgtttggcgaggcggtttgataggtagtttagacgattagtagtatttaggtaaaacggattacgtcggacgattcgag

SEQ ID NO: 26896 - DNA, 799 bp, Artificial Sequence
  chemically treated genomic DNA (Homo sapiens) CpG-island No: 26896
  misc_feature (402)..(402): n is either a, c, g or t
ctcgaatcgtccgacgtaatccgttttacctaaatactactaatcgtctaaactacctatcaaaccgcctcgccaaacgattaccccgtaactcgaaatccctaaaaacaattccgaaaaaccccgcgtactaccgaaatcgcgtctcaatccatcaaaaaaaaaaaaaaataacgcgcgcgccatttctaatcgttttcaaaacgcctcgcgctaattctcacgaacccgactaccgacccccgctctaccctaataaatctcgcgccgacccgtaaaaaaaaaaaccgaaaaccccgatacgacccgactcaacccgaactccgtacctaatcccgtttcgtttacgctccgaaaccccgaaataaaaataaaaacgaactaaaaacgacttcgatctantccaaacgctcgactataaacctatcccgaccgaaacgcttctcgccctcgctcttcctccccccgcccatataacccgcgatccgacccgttaaacgctctccgcgcgacctaataaaaccgaccgtacttttcccgcctccgctcgctactccatacgaccgaatcccgcgaaaaacctaaaacgcccgcgaccctaccgcttctccccgccgaaaccgcttcgctcccgccgcgaccgacctaacccgaaaaaaatatactaataatccgaacgaacctaaaaaaataaaaataaaaaacgaaaaacgaaatacaaatcccaaaattatctaaaccgaaaaaaaaattttatataaacaaaaaccgaaaaaccgatttatataaaaaacctccc

SEQ ID NO: 26897 - DNA, 611 bp, Artificial Sequence
  chemically treated genomic DNA (Homo sapiens) CpG-island No: 26897
tgttcgttacgattggcgtcggttcgagtttcggggcggttaagttggagtggcgcggttcgggttggggtttggtggggaagttcgcgggggcggcgatcgaatttatcgtggtcggagacgtggttgttttagggcgcgtggtcggcgggtcgcgtggcgtcgtcgagttgtaggaaaagtgttaggtagtggagggcgtttagcgttacggcgagcggggtttttatcgtgcgttttcgggtcgggggcgtcgtcgttttatatttgggtttcggagatcgtagaatcggcgttagttgttttttgttttgagcggtttggttgttcggtttcggtagttgtttttcgttcgttgttttcggattcggtttagtttttagttttcgttcggtttcggtttagtttcggttttggggagcgagcgtacgtttagtcggtcgttttcgattgcgggatttttttttttcgcggaaggttacgtcgggtcgtcgtcgtattttttttttttttttcgttttttttttttttttttttttttttttttttttttcgttcggagtaggcggcggagggatttgtcgtttgatttattattaaagttttgttta

SEQ ID NO: 26898 - DNA, 611 bp, Artificial Sequence
  chemically treated genomic DNA (Homo sapiens) CpG-island No: 26898
taaacaaaactttaataataaatcaaacgacaaatccctccgccgcctactccgaacgaaaaaaaaaaaaaaaaaaaaaaaaaaaaaaaaaaaacgaaaaaaaaaaaaaaaatacgacgacgacccgacgtaaccttccgcgaaaaaaaaaaatcccgcaatcgaaaacgaccgactaaacgtacgctcgctccccaaaaccgaaactaaaccgaaaccgaacgaaaactaaaaactaaaccgaatccgaaaacaacgaacgaaaaacaactaccgaaaccgaacaaccaaaccgctcaaaacaaaaaacaactaacgccgattctacgatctccgaaacccaaatataaaacgacgacgcccccgacccgaaaacgcacgataaaaaccccgctcgccgtaacgctaaacgccctccactacctaacacttttcctacaactcgacgacgccacgcgacccgccgaccacgcgccctaaaacaaccacgtctccgaccacgataaattcgatcgccgcccccgcgaacttccccaccaaaccccaacccgaaccgcgccactccaacttaaccgccccgaaactcgaaccgacgccaatcgtaacgaaca

SEQ ID NO: 26899 - DNA, 611 bp, Artificial Sequence
  chemically treated genomic DNA (Homo sapiens) CpG-island No: 26899
tgggtaaaattttgatgataaattaagcggtagattttttcgtcgtttgtttcgagcgggaggagggaggggaggagggaggggaggagggaggcggaaggaggaaggagggtgcggcggcggttcggcgtggtttttcgcggaagggaagagtttcgtagtcgaaggcggtcggttgggcgtgcgttcgttttttaaagtcggggttgggtcgaagtcgggcgagggttgggagttgggtcgggttcggggatagcgggcgaggggtagttgtcggagtcgggtagttaggtcgtttagggtaggggatagttggcgtcggttttgcggttttcggggtttagatgtgaggcggcggcgttttcggttcgagagcgtacgatgggggtttcgttcgtcgtagcgttgggcgttttttattatttggtattttttttgtaattcggcggcgttacgcggttcgtcggttacgcgttttgggataattacgttttcggttacggtgagttcggtcgtcgttttcgcggatttttttattaaattttaattcgggtcgcgttattttaatttggtcgtttcggggttcgaatcggcgttagtcgtggcgggta

SEQ ID NO: 26900 - DNA, 611 bp, Artificial Sequence
  chemically treated genomic DNA (Homo sapiens) CpG-island No: 26900
tacccgccacgactaacgccgattcgaaccccgaaacgaccaaattaaaataacgcgacccgaattaaaatttaataaaaaaatccgcgaaaacgacgaccgaactcaccgtaaccgaaaacgtaattatcccaaaacgcgtaaccgacgaaccgcgtaacgccgccgaattacaaaaaaaataccaaataataaaaaacgcccaacgctacgacgaacgaaacccccatcgtacgctctcgaaccgaaaacgccgccgcctcacatctaaaccccgaaaaccgcaaaaccgacgccaactatcccctaccctaaacgacctaactacccgactccgacaactacccctcgcccgctatccccgaacccgacccaactcccaaccctcgcccgacttcgacccaaccccgactttaaaaaacgaacgcacgcccaaccgaccgccttcgactacgaaactcttcccttccgcgaaaaaccacgccgaaccgccgccgcaccctccttcctccttccgcctccctcctcccctccctcctcccctccctcctcccgctcgaaacaaacgacgaaaaaatctaccgcttaatttatcatcaaaattttaccca

SEQ ID NO: 26901 - DNA, 913 bp, Artificial Sequence
  chemically treated genomic DNA (Homo sapiens) CpG-island No: 26901
gagtgcgcgcgtgtgtacgagcgtgtgcgcgttttttaggggttttatgtttagatacggggaggtgtgtacgagggagatgtgagacgtttgtggggataggttgtgtgtgtgagattttcgttacgcgatgtattcggttcgggttattaggaggttcgggtgggcgtgggttaggtgtgcgtagtttttcgtggagcgtgtggacgcgtgtgttagttttcggtggttagtgttattcggggggaagtgtatatgtaggttggcgtgtatgtgagtataaagcggtcgaggagtgtgtgtttattacggtttttcgtcggggttttttttcgaggaaggagtgagtatgtgaggaggatttcgttgtgatcggcggggacgtcgacggttaagttttttagcggcgtgtgtgtgagaaggtcgggttcgttgaggaacgtcgcgcggggtcgatcggcgcgcgtttgtgcgcgtgcgtgtgcgcgtggggcgcggcgcgcgtcgcgtcggagggagggaggttgttagttcggattcggtcgtagcgttcggggcggttttttttcgagtttgggatcgtcgcgttttcgtcgtcgtcgcgtgttggcgtgattttcggttcgtgtcgcgttttttcgcgttcgtagtcggttcggttttttgtttatttagacgtcgtttttttcgggttttcggtgtcggtttcgcgcggagggagaggaaatgagtgcggcggtttcgtcggcgtcggagcggggttggaagagcgagaaattagatgaggtttaggttttggcgcggagttgcgtcgttcgtagattcgatttttagtcgtgcgacgggttgtttatttgtgttacgtatagttatggtaagtgttttaagttgtattggtgttgttatttaggat

SEQ ID NO: 26902 - DNA, 913 bp, Artificial Sequence
  chemically treated genomic DNA (Homo sapiens) CpG-island No: 26902
atcctaaataacaacaccaatacaacttaaaacacttaccataactatacgtaacacaaataaacaacccgtcgcacgactaaaaatcgaatctacgaacgacgcaactccgcgccaaaacctaaacctcatctaatttctcgctcttccaaccccgctccgacgccgacgaaaccgccgcactcatttcctctccctccgcgcgaaaccgacaccgaaaacccgaaaaaaacgacgtctaaataaacaaaaaaccgaaccgactacgaacgcgaaaaaacgcgacacgaaccgaaaatcacgccaacacgcgacgacgacgaaaacgcgacgatcccaaactcgaaaaaaaaccgccccgaacgctacgaccgaatccgaactaacaacctccctccctccgacgcgacgcgcgccgcgccccacgcgcacacgcacgcgcacaaacgcgcgccgatcgaccccgcgcgacgttcctcaacgaacccgaccttctcacacacacgccgctaaaaaacttaaccgtcgacgtccccgccgatcacaacgaaatcctcctcacatactcactccttcctcgaaaaaaaaccccgacgaaaaaccgtaataaacacacactcctcgaccgctttatactcacatacacgccaacctacatatacacttccccccgaataacactaaccaccgaaaactaacacacgcgtccacacgctccacgaaaaactacgcacacctaacccacgcccacccgaacctcctaataacccgaaccgaatacatcgcgtaacgaaaatctcacacacacaacctatccccacaaacgtctcacatctccctcgtacacacctccccgtatctaaacataaaacccctaaaaaacgcgcacacgctcgtacacacgcgcgcactc

SEQ ID NO: 26903 - DNA, 913 bp, Artificial Sequence
  chemically treated genomic DNA (Homo sapiens) CpG-island No: 26903
attttaggtgatagtattagtgtagtttgaagtatttgttatggttgtgcgtggtatagatagatagttcgtcgtacggttggaagtcgggtttgcgggcggcgtaatttcgcgttagggtttgagttttatttagtttttcgtttttttaatttcgtttcgacgtcggcgaggtcgtcgtatttatttttttttttttcgcgcggagtcgatatcgggagttcgggagaagcgacgtttgggtgggtaggaagtcgagtcggttgcggacgcgggagggcgcggtacgggtcgggagttacgttagtacgcggcggcggcgggagcgcggcggttttaggttcgaggaggagtcgtttcgggcgttgcgatcgggttcgggttggtagttttttttttttcggcgcggcgcgcgtcgcgttttacgcgtatacgtacgcgtataggcgcgcgtcggtcggtttcgcgcgacgttttttagcgagttcggtttttttatatatacgtcgttggggagtttggtcgtcggcgttttcgtcggttatagcgaggttttttttatatatttatttttttttcggagaaagatttcgacggagggtcgtggtgaatatatatttttcggtcgttttgtatttatatgtacgttagtttatatatgtattttttttcgagtgatattggttatcgagaattgatatacgcgtttatacgttttacggagggttgcgtatatttggtttacgtttattcgaattttttagtggttcgggtcgggtgtatcgcgtagcgaggattttatatatatagtttgtttttataggcgttttatatttttttcgtatatattttttcgtgtttgggtatggagtttttgggaggcgcgtatacgttcgtgtatacgcgcgtattt

SEQ ID NO: 26904 - DNA, 913 bp, Artificial Sequence
  chemically treated genomic DNA (Homo sapiens) CpG-island No: 26904
aaatacgcgcgtatacacgaacgtatacgcgcctcccaaaaactccatacccaaacacgaaaaaatatatacgaaaaaaatataaaacgcctataaaaacaaactatatatataaaatcctcgctacgcgatacacccgacccgaaccactaaaaaattcgaataaacgtaaaccaaatatacgcaaccctccgtaaaacgtataaacgcgtatatcaattctcgataaccaatatcactcgaaaaaaaatacatatataaactaacgtacatataaatacaaaacgaccgaaaaatatatattcaccacgaccctccgtcgaaatctttctccgaaaaaaaaataaatatataaaaaaaacctcgctataaccgacgaaaacgccgacgaccaaactccccaacgacgtatatataaaaaaaccgaactcgctaaaaaacgtcgcgcgaaaccgaccgacgcgcgcctatacgcgtacgtatacgcgtaaaacgcgacgcgcgccgcgccgaaaaaaaaaaaactaccaacccgaacccgatcgcaacgcccgaaacgactcctcctcgaacctaaaaccgccgcgctcccgccgccgccgcgtactaacgtaactcccgacccgtaccgcgccctcccgcgtccgcaaccgactcgacttcctacccacccaaacgtcgcttctcccgaactcccgatatcgactccgcgcgaaaaaaaaaaaaataaatacgacgacctcgccgacgtcgaaacgaaattaaaaaaacgaaaaactaaataaaactcaaaccctaacgcgaaattacgccgcccgcaaacccgacttccaaccgtacgacgaactatctatctataccacgcacaaccataacaaatacttcaaactacactaatactatcacctaaaat

SEQ ID NO: 26905 - DNA, 518 bp, Artificial Sequence
  chemically treated genomic DNA (Homo sapiens) CpG-island No: 26905
tcgtttatttttggttttcgttttcgcggggtttcgatttttgttttaggattcggtttttcgcgtttcgtttcgttcggtggtcgcgcgttcgtttatttggtatagtaggtttttcgcgtagtcggcgtacgcggtttattcggcggcgtttacgcggttcgttagggtttagaagcggcgggttagttcggcgtcgcgttttttatcgtagtagtcgaagttcgagtattgcgcgtagaggcgtagcggttgcgtcggtcggaagggcggtttgaagtttaggtattgcggatgcgcggcggtttcgagtatttaaagcgttagtagcgtttcggttttggttcgggttatcgttacgtttcgcgggggaagaggcggagggacggtagtttcggttttttttcggggcgttcgcggcggtagggaaggggcgggcgttttttttttttatacgtagggtttcgagtttggggatttttttttttaggaggttatttttggtcggggatattcgg

SEQ ID NO: 26906 - DNA, 518 bp, Artificial Sequence
  chemically treated genomic DNA (Homo sapiens) CpG-island No: 26906
ccgaatatccccgaccaaaaataacctcctaaaaaaaaaaatccccaaactcgaaaccctacgtataaaaaaaaaaaacgcccgccccttccctaccgccgcgaacgccccgaaaaaaaaccgaaactaccgtccctccgcctcttcccccgcgaaacgtaacgataacccgaaccaaaaccgaaacgctactaacgctttaaatactcgaaaccgccgcgcatccgcaatacctaaacttcaaaccgcccttccgaccgacgcaaccgctacgcctctacgcgcaatactcgaacttcgactactacgataaaaaacgcgacgccgaactaacccgccgcttctaaaccctaacgaaccgcgtaaacgccgccgaataaaccgcgtacgccgactacgcgaaaaacctactataccaaataaacgaacgcgcgaccaccgaacgaaacgaaacgcgaaaaaccgaatcctaaaacaaaaatcgaaaccccgcgaaaacgaaaaccaaaaataaacga

SEQ ID NO: 26907 - DNA, 518 bp, Artificial Sequence
  chemically treated genomic DNA (Homo sapiens) CpG-island No: 26907
tcgagtgttttcgattagaggtgattttttagaaggggaggtttttaaattcgaggttttgcgtgtagggaaggggagcgttcgttttttttttgtcgtcgcgagcgtttcgggaggggatcggggttgtcgttttttcgttttttttttcgcggggcgtagcgatggttcgggttagggtcggggcgttgttggcgttttgggtgttcggggtcgtcgcgtattcgtagtgtttggattttaggtcgttttttcggtcgacgtagtcgttgcgtttttgcgcgtagtattcggatttcggttgttgcgatgaggggcgcgacgtcgagttgattcgtcgtttttgggttttggcgagtcgcgtggacgtcgtcgagtgggtcgcgtgcgtcggttacgcgagggatttgttgtgttaggtgagcgggcgcgcggttatcgggcggggcggggcgcgggaggtcgagttttggagtagagatcggaatttcgcgggggcgagggttaagagtgggcgg

SEQ ID NO: 26908 - DNA, 518 bp, Artificial Sequence
  chemically treated genomic DNA (Homo sapiens) CpG-island No: 26908
ccgcccactcttaaccctcgcccccgcgaaattccgatctctactccaaaactcgacctcccgcgccccgccccgcccgataaccgcgcgcccgctcacctaacacaacaaatccctcgcgtaaccgacgcacgcgacccactcgacgacgtccacgcgactcgccaaaacccaaaaacgacgaatcaactcgacgtcgcgcccctcatcgcaacaaccgaaatccgaatactacgcgcaaaaacgcaacgactacgtcgaccgaaaaaacgacctaaaatccaaacactacgaatacgcgacgaccccgaacacccaaaacgccaacaacgccccgaccctaacccgaaccatcgctacgccccgcgaaaaaaaaaacgaaaaaacgacaaccccgatcccctcccgaaacgctcgcgacgacaaaaaaaaaacgaacgctccccttccctacacgcaaaacctcgaatttaaaaacctccccttctaaaaaatcacctctaatcgaaaacactcga

SEQ ID NO: 26909 - DNA, 555 bp, Artificial Sequence
  chemically treated genomic DNA (Homo sapiens) CpG-island No: 26909
tcgcgtgcgcggatttgatttcgttgtaggtttcgggggagggattttttttcgtttcgtttcgtttcgtttgttggcggtagacgcgtcgtaaatgcgttttggggatcggaggataacgagatagatttataggtagtgggaagttcgggggtttcgcgaggtcgtcggtggggagttttgtggtcggttcggcgttttcggatttcggcgtttaggttttagtgggagatttttttattttttttagtggtttttatttcgcgaattgtagattatttttcgaattttagggatttagcggtcgagtgagcggaggtggagcggggtttcgagcgtcgtttcgggtagggggtaggttttcggagttttcgttttatcggggtagagagtattgatcgcgttgcgggacgcggttggtaaggttttggttttgtaggggcgcggacgttagcgtttagtttagttttgggttaggagtggagacgtagtttcgtcgcgtgtttcggtaggggattcgggtggggacgggggcggaggagtttgggggtaggg

SEQ ID NO: 26910 - DNA, 555 bp, Artificial Sequence
  chemically treated genomic DNA (Homo sapiens) CpG-island No: 26910
ccctacccccaaactcctccgcccccgtccccacccgaatcccctaccgaaacacgcgacgaaactacgtctccactcctaacccaaaactaaactaaacgctaacgtccgcgcccctacaaaaccaaaaccttaccaaccgcgtcccgcaacgcgatcaatactctctaccccgataaaacgaaaactccgaaaacctaccccctacccgaaacgacgctcgaaaccccgctccacctccgctcactcgaccgctaaatccctaaaattcgaaaaataatctacaattcgcgaaataaaaaccactaaaaaaaataaaaaaatctcccactaaaacctaaacgccgaaatccgaaaacgccgaaccgaccacaaaactccccaccgacgacctcgcgaaacccccgaacttcccactacctataaatctatctcgttatcctccgatccccaaaacgcatttacgacgcgtctaccgccaacaaacgaaacgaaacgaaacgaaaaaaaatccctcccccgaaacctacaacgaaatcaaatccgcgcacgcga

SEQ ID NO: 26911 - DNA, 555 bp, Artificial Sequence
  chemically treated genomic DNA (Homo sapiens) CpG-island No: 26911
ttttgtttttaggttttttcgttttcgtttttattcgggttttttgtcggagtacgcggcggggttgcgtttttatttttagtttagggttgagttaaacgttggcgttcgcgtttttgtagggttagggttttgttagtcgcgtttcgtagcgcggttagtattttttgtttcgatggggcgagagtttcgggaatttgttttttgttcggagcggcgttcggagtttcgttttattttcgtttattcgatcgttaaatttttgggattcgggagataatttgtaattcgcggggtggaaattattgggaagggtgggaaggttttttattggggtttgaacgtcggggttcgggggcgtcgagtcggttatagaattttttatcggcggtttcgcgggattttcgggttttttattgtttgtaagtttgtttcgttatttttcggtttttaaagcgtatttacggcgcgtttatcgttagtaggcggggcggggcggggcgggggggggtttttttttcggaatttgtaacgagattaaattcgcgtacgcga

SEQ ID NO: 26912 - DNA, 555 bp, Artificial Sequence
  chemically treated genomic DNA (Homo sapiens) CpG-island No: 26912
tcgcgtacgcgaatttaatctcgttacaaattccgaaaaaaaaacccccccccgccccgccccgccccgcctactaacgataaacgcgccgtaaatacgctttaaaaaccgaaaaataacgaaacaaacttacaaacaataaaaaacccgaaaatcccgcgaaaccgccgataaaaaattctataaccgactcgacgcccccgaaccccgacgttcaaaccccaataaaaaaccttcccacccttcccaataatttccaccccgcgaattacaaattatctcccgaatcccaaaaatttaacgatcgaataaacgaaaataaaacgaaactccgaacgccgctccgaacaaaaaacaaattcccgaaactctcgccccatcgaaacaaaaaatactaaccgcgctacgaaacgcgactaacaaaaccctaaccctacaaaaacgcgaacgccaacgtttaactcaaccctaaactaaaaataaaaacgcaaccccgccgcgtactccgacaaaaaacccgaataaaaacgaaaacgaaaaaacctaaaaacaaaa

SEQ ID NO: 26913 - DNA, 1695 bp, Artificial Sequence
  chemically treated genomic DNA (Homo sapiens) CpG-island No: 26913
ggcgtcgtcgttcggatcgtgggtatttgtttatttggggagagggaagaggatcggggacgcgggtcggggagggggttcgattgttattttcgcgcgtcgtttttaagggaagttcggttttattttttttatcgttttttttttcgtagtcgtatttgtattttaaaagcgttttgtagttttgggattggttaaggtcgcgtttttcgggcgtagaaatttgaatcgtcgggagtcggtcgcgggcgggggtcggaaatttcgcggatggatcgtattatcgtcgtagtttttttcgcgcgcgtttcgtttttttcgtatattttcggagcggtttaatcgttcggtcgggagggcgggatcgcggtcggaacgcgtttttgagagggtattggacgggcgggcgtatcgcgtagggggacggcgggggtcgcgtttttgttttttagtcgttttcgggggcggggtcgggtttcggagattcgtttatttttcgttcggggtgggcggggcggcgggggtttcgggagttgggtcgggggcgggttttcgtttgtttttttagaattttgagagcgttcggtatcgcggtcgtcgacgtagtagtcgttttcgttcgttaatttcgaggcgcgcgggttttcgggcggtttcggcgggcgcggcgagagggacgcgttaggcggcgcggggcgggtcgtacgcgttttcggtcgtttttcgttcgcgcgcggatcggtttagcggagtttcggcgcggggaagcgtcggtcgggcgagggcgagggcgatgtcgcggtgacggtttcgttatggttaagttcgcggcgacggcggcggcggcgtcggaggagttgagttaggtgtcggacgaggagttgttgcgttggagtaaggaggagttggcgcggcggttgcggcgcgtcgagggcgagaaggtgggttttatgttggagtacggcggtttgatgcgcgacgtgaatcggcggttgtagtagtatttgttggagattcgcggttttaaggacgtgaattagcggttgtaggacgataattaggagttgcgcgagttttgttgttttttcgacgacgatcggtagaaggggcgtaagttggcgcgcgagtggtagcgtttcgggcgttacgcggtcggcgtcgtgtggtacgaggtggttcgttcgtagtagaagttgcgcgagttcgaggcgcgttaggaggttttgttgcgcgagaatttggagtttaaggagttggtgttgttgttggacgaggagcgcgcggtattggcggcgacgggggtcgtaagcggtggcggcggcggcgggggcggcgtcggttttcgtagttttatcgatagttaggttagtttgagcgggtcgttgtcgggtggcgcgttcggcgcgggggttcgcgacgtgggcgacggtagtagtacgtttagcgcgggtagcggcggtagtttcgattattattattacgttttattttcgttgttgtttttcgggtcgtataaggttttcgacggtaaggtaggagttatacgtcggtttttggacgatttgtcggcgtcgtcgtattatcgtagtatttttaacggtttgtacggtaaggattatacgggtcgggtagcgcgggtttttttggttgtagttttttttttaggttgcggcgagaggaggtggtttttggttg

SEQ ID NO: 26914 - DNA, 1695 bp, Artificial Sequence
  chemically treated genomic DNA (Homo sapiens) CpG-island No: 26914
caaccaaaaaccacctcctctcgccgcaacctaaaaaaaaaactacaaccaaaaaaacccgcgctacccgacccgtataatccttaccgtacaaaccgttaaaaatactacgataatacgacgacgccgacaaatcgtccaaaaaccgacgtataactcctaccttaccgtcgaaaaccttatacgacccgaaaaacaacaacgaaaataaaacgtaataataataatcgaaactaccgccgctacccgcgctaaacgtactactaccgtcgcccacgtcgcgaacccccgcgccgaacgcgccacccgacaacgacccgctcaaactaacctaactatcgataaaactacgaaaaccgacgccgcccccgccgccgccgccaccgcttacgacccccgtcgccgccaataccgcgcgctcctcgtccaacaacaacaccaactccttaaactccaaattctcgcgcaacaaaacctcctaacgcgcctcgaactcgcgcaacttctactacgaacgaaccacctcgtaccacacgacgccgaccgcgtaacgcccgaaacgctaccactcgcgcgccaacttacgccccttctaccgatcgtcgtcgaaaaaacaacaaaactcgcgcaactcctaattatcgtcctacaaccgctaattcacgtccttaaaaccgcgaatctccaacaaatactactacaaccgccgattcacgtcgcgcatcaaaccgccgtactccaacataaaacccaccttctcgccctcgacgcgccgcaaccgccgcgccaactcctccttactccaacgcaacaactcctcgtccgacacctaactcaactcctccgacgccgccgccgccgtcgccgcgaacttaaccataacgaaaccgtcaccgcgacatcgccctcgccctcgcccgaccgacgcttccccgcgccgaaactccgctaaaccgatccgcgcgcgaacgaaaaacgaccgaaaacgcgtacgacccgccccgcgccgcctaacgcgtccctctcgccgcgcccgccgaaaccgcccgaaaacccgcgcgcctcgaaattaacgaacgaaaacgactactacgtcgacgaccgcgataccgaacgctctcaaaattctaaaaaaacaaacgaaaacccgcccccgacccaactcccgaaacccccgccgccccgcccaccccgaacgaaaaataaacgaatctccgaaacccgaccccgcccccgaaaacgactaaaaaacaaaaacgcgacccccgccgtccccctacgcgatacgcccgcccgtccaataccctctcaaaaacgcgttccgaccgcgatcccgccctcccgaccgaacgattaaaccgctccgaaaatatacgaaaaaaacgaaacgcgcgcgaaaaaaactacgacgataatacgatccatccgcgaaatttccgacccccgcccgcgaccgactcccgacgattcaaatttctacgcccgaaaaacgcgaccttaaccaatcccaaaactacaaaacgcttttaaaatacaaatacgactacgaaaaaaaaaacgataaaaaaaataaaaccgaacttcccttaaaaacgacgcgcgaaaataacaatcgaaccccctccccgacccgcgtccccgatcctcttccctctccccaaataaacaaatacccacgatccgaacgacgacgcc

SEQ ID NO: 26915 - DNA, 1695 bp, Artificial Sequence
  chemically treated genomic DNA (Homo sapiens) CpG-island No: 26915
tagttagggattattttttttcgtcgtagtttgggaaaagggttgtagttagggagattcgcgttgttcggttcgtgtagtttttatcgtgtaggtcgttggggatgttgcggtggtgcggcggcgtcgataagtcgtttagggatcgacgtgtggtttttgttttgtcgtcgggggttttgtgcggttcggggggtagtagcgggggtgggacgtggtggtggtggtcggggttgtcgtcgttgttcgcgttggacgtattgttgtcgtcgtttacgtcgcgggttttcgcgtcgggcgcgttattcgatagcggttcgtttaggttggtttggttgtcgatggagttgcgggagtcggcgtcgttttcgtcgtcgtcgttatcgtttgcggttttcgtcgtcgttagtgtcgcgcgtttttcgtttagtagtagtattagttttttgagttttaggttttcgcgtagtagggttttttggcgcgtttcgagttcgcgtagtttttgttgcgagcgggttatttcgtgttatacggcgtcggtcgcgtggcgttcgaagcgttgttattcgcgcgttagtttgcgttttttttgtcggtcgtcgtcgaggaagtagtagagttcgcgtagtttttggttgtcgttttgtagtcgttggtttacgtttttgaggtcgcggatttttagtaggtgttgttgtagtcgtcggtttacgtcgcgtattaggtcgtcgtgttttagtatgaggtttattttttcgttttcggcgcgtcgtagtcgtcgcgttagtttttttttgttttagcgtagtagtttttcgttcggtatttggtttagttttttcgacgtcgtcgtcgtcgtcgtcgcgggtttagttatggcggggtcgttatcgcggtatcgttttcgttttcgttcggtcggcgttttttcgcgtcggggtttcgttgggtcggttcgcgcgcgggcggggggcggtcgggggcgcgtgcggttcgtttcgcgtcgtttggcgcgtttttttcgtcgcgttcgtcggggtcgttcgggagttcgcgcgtttcggggttgacgagcggaggcggttgttgcgtcggcggtcgcggtgtcgggcgtttttagggttttggagaagtaggcggaggttcgttttcggtttagttttcggagttttcgtcgtttcgtttatttcgggcggagagtgggcgggttttcgaggttcggtttcgttttcgagggcgattggggagtagaggcgcggttttcgtcgtttttttgcgcggtgcgttcgttcgtttagtgtttttttagaggcgcgtttcggtcgcggtttcgttttttcggtcgggcgattgggtcgtttcgggggtgtgcgggaggggcggggcgcgcgcgggggaagttgcggcggtggtacggtttattcgcggggttttcgattttcgttcgcggtcggttttcggcggtttaagtttttgcgttcggaggacgcggttttagttaattttagggttatagggcgtttttaaaatgtaggtacggttgcggggagggggacggtgggaaaggtagggtcgggttttttttaaaggcgacgcgcgaaaatagtagtcgagtttttttttcggttcgcgttttcggtttttttttttttttttagataaataaatatttacgattcgggcgacggcgtt

SEQ ID NO: 26916 - DNA, 1695 bp, Artificial Sequence
  chemically treated genomic DNA (Homo sapiens) CpG-island No: 26916
aacgccgtcgcccgaatcgtaaatatttatttatctaaaaaaaaaaaaaaaaaccgaaaacgcgaaccgaaaaaaaaactcgactactattttcgcgcgtcgcctttaaaaaaaacccgaccctacctttcccaccgtccccctccccgcaaccgtacctacattttaaaaacgccctataaccctaaaattaactaaaaccgcgtcctccgaacgcaaaaacttaaaccgccgaaaaccgaccgcgaacgaaaatcgaaaaccccgcgaataaaccgtaccaccgccgcaacttcccccgcgcgcgccccgcccctcccgcacacccccgaaacgacccaatcgcccgaccgaaaaaacgaaaccgcgaccgaaacgcgcctctaaaaaaacactaaacgaacgaacgcaccgcgcaaaaaaacgacgaaaaccgcgcctctactccccaatcgccctcgaaaacgaaaccgaacctcgaaaacccgcccactctccgcccgaaataaacgaaacgacgaaaactccgaaaactaaaccgaaaacgaacctccgcctacttctccaaaaccctaaaaacgcccgacaccgcgaccgccgacgcaacaaccgcctccgctcgtcaaccccgaaacgcgcgaactcccgaacgaccccgacgaacgcgacgaaaaaaacgcgccaaacgacgcgaaacgaaccgcacgcgcccccgaccgccccccgcccgcgcgcgaaccgacccaacgaaaccccgacgcgaaaaaacgccgaccgaacgaaaacgaaaacgataccgcgataacgaccccgccataactaaacccgcgacgacgacgacgacgacgtcgaaaaaactaaaccaaataccgaacgaaaaactactacgctaaaacaaaaaaaaactaacgcgacgactacgacgcgccgaaaacgaaaaaataaacctcatactaaaacacgacgacctaatacgcgacgtaaaccgacgactacaacaacacctactaaaaatccgcgacctcaaaaacgtaaaccaacgactacaaaacgacaaccaaaaactacgcgaactctactacttcctcgacgacgaccgacaaaaaaaacgcaaactaacgcgcgaataacaacgcttcgaacgccacgcgaccgacgccgtataacacgaaataacccgctcgcaacaaaaactacgcgaactcgaaacgcgccaaaaaaccctactacgcgaaaacctaaaactcaaaaaactaatactactactaaacgaaaaacgcgcgacactaacgacgacgaaaaccgcaaacgataacgacgacgacgaaaacgacgccgactcccgcaactccatcgacaaccaaaccaacctaaacgaaccgctatcgaataacgcgcccgacgcgaaaacccgcgacgtaaacgacgacaacaatacgtccaacgcgaacaacgacgacaaccccgaccaccaccaccacgtcccacccccgctactaccccccgaaccgcacaaaacccccgacgacaaaacaaaaaccacacgtcgatccctaaacgacttatcgacgccgccgcaccaccgcaacatccccaacgacctacacgataaaaactacacgaaccgaacaacgcgaatctccctaactacaacccttttcccaaactacgacgaaaaaaaataatccctaacta

SEQ ID NO: 26917 - DNA, 1299 bp, Artificial Sequence
  chemically treated genomic DNA (Homo sapiens) CpG-island No: 26917
ttaacggaatttgggcgcgtaggcggggttcgggtcgagattcgtttaattaaagttttggcgggggcgaacgtagttagttgcgatatcgtggttggcggcggttgagtcggtcgtttttgttttcgggagttgttagtttattggttggggaggatttcgaacggaacgtcggttgggtggcggggcggggtcgcgtttatgcgttcgaagcgtgggttaatgaacggcggcggttgcggttcgggggcggggttcggggcgggaggagaagcgttgggtcgcggtcgcggggtcgttttaggttgtcgtttcgtttttttcgttcggtcgtcgtcgtcgttatcgtcgttatcgtttgggggttggttgaggcggacggcggggttcgggtcggagtacgtcgttttcgttgcgttaggggaagcgggtaggtgagtgttggcggcggtttttgcgttcgcgcggttcgcggggggaaattcgcgtcgcgttttcgagttttgcgaggtcgtttttcgttttggttagcgtttttcggtcgaagttcggttcgcgttttcgttagggttttcgtcggtcgttgtggtttcggggtttgaaggggtaggtgtgcgttcgggggttagggcgaggagggttcggcggggtcggagggcgtcggtcggtttttgttcgggcgttttgcggggcgagaggcgcgcgttcgtcgttgttttgttttttttggcgtttacgttttcgggtttcgcgttattcggtttcgaggtggtgttaggtgtaggtagcgtttttttcgagtttgtttcgttgttttcggttttcgcgtttgttttcgggtggggttcgggtttttcgcgttagtcggttcggttttgcgcgcggtcgggtcgcgtttttattttttttttttttttcgttatttcgttgttcggggaaggttgtgcggttttatgtttttttttgcgagttttcggtgtttattagggtgttcggggattagttttcgttttttttcgcgtcgtttagttaggaagacggacgtaggaaataggtcgtttttttttttacgcgtttttggtcgtgttttatacgcgtagtgttttattagggagaggtaattcggtgttttagagtttgttatttcggcgttaatttttttttttcgtggttttagttcggcgatgtaatttttgttttttttcggtttttatttgggaaaaggagttgatagtgacgcgcgtttttggttgcggggtttatttttgttcggtcggtgttgggaggagggtattttag

SEQ ID NO: 26918 - DNA, 1299 bp, Artificial Sequence
  chemically treated genomic DNA (Homo sapiens) CpG-island No: 26918
ctaaaataccctcctcccaacaccgaccgaacaaaaataaaccccgcaaccaaaaacgcgcgtcactatcaactccttttcccaaataaaaaccgaaaaaaaacaaaaattacatcgccgaactaaaaccacgaaaaaaaaaaattaacgccgaaataacaaactctaaaacaccgaattacctctccctaataaaacactacgcgtataaaacacgaccaaaaacgcgtaaaaaaaaaaacgacctatttcctacgtccgtcttcctaactaaacgacgcgaaaaaaaacgaaaactaatccccgaacaccctaataaacaccgaaaactcgcaaaaaaaaacataaaaccgcacaaccttccccgaacaacgaaataacgaaaaaaaaaaaaaaaataaaaacgcgacccgaccgcgcgcaaaaccgaaccgactaacgcgaaaaacccgaaccccacccgaaaacaaacgcgaaaaccgaaaacaacgaaacaaactcgaaaaaaacgctacctacacctaacaccacctcgaaaccgaataacgcgaaacccgaaaacgtaaacgccaaaaaaaacaaaacaacgacgaacgcgcgcctctcgccccgcaaaacgcccgaacaaaaaccgaccgacgccctccgaccccgccgaaccctcctcgccctaacccccgaacgcacacctaccccttcaaaccccgaaaccacaacgaccgacgaaaaccctaacgaaaacgcgaaccgaacttcgaccgaaaaacgctaaccaaaacgaaaaacgacctcgcaaaactcgaaaacgcgacgcgaatttccccccgcgaaccgcgcgaacgcaaaaaccgccgccaacactcacctacccgcttcccctaacgcaacgaaaacgacgtactccgacccgaaccccgccgtccgcctcaaccaacccccaaacgataacgacgataacgacgacgacgaccgaacgaaaaaaacgaaacgacaacctaaaacgaccccgcgaccgcgacccaacgcttctcctcccgccccgaaccccgcccccgaaccgcaaccgccgccgttcattaacccacgcttcgaacgcataaacgcgaccccgccccgccacccaaccgacgttccgttcgaaatcctccccaaccaataaactaacaactcccgaaaacaaaaacgaccgactcaaccgccgccaaccacgatatcgcaactaactacgttcgcccccgccaaaactttaattaaacgaatctcgacccgaaccccgcctacgcgcccaaattccgttaa

SEQ ID NO: 26919 - DNA, 1299 bp, Artificial Sequence
  chemically treated genomic DNA (Homo sapiens) CpG-island No: 26919
ttgaaatgttttttttttaatatcggtcgggtaggggtgagtttcgtagttaggggcgcgcgttattgttagtttttttttttaagtggagatcgggaaaagataagagttgtatcgtcgggttggagttacgaggaggaagagttaacgtcggaatgataaattttaaagtatcgaattgtttttttttagtagggtattgcgcgtgtggagtacggttaggggcgcgtgggaagaaagacgatttattttttacgttcgtttttttaattggacggcgcgggaggaggcgggggttggttttcgggtattttggtgggtatcgagaattcgtagagaggaatataaaatcgtatagtttttttcgagtagcggggtgacgggaggaaggaaggaaatgggagcgcgattcggtcgcgcgtagagtcgagtcgattagcgcgaggggttcgggttttattcgagagtaggcgcgagggtcggggatagcggggtaagttcggggagagcgttgtttgtatttggtattatttcgagatcgggtggcgcggggttcgggagcgtgggcgttagaggggatagggtagcggcgagcgcgcgtttttcgtttcgtagggcgttcgggtagaggtcgatcggcgtttttcgatttcgtcgggtttttttcgttttggttttcgagcgtatatttgtttttttaagtttcggggttatagcggtcggcggggattttggcgggggcgcgggtcggatttcggtcgaggggcgttggttagggcgagggacggtttcgtagagttcggagacgcggcgcgagttttttttcgcgggtcgcgcgggcgtagagatcgtcgttagtatttatttgttcgttttttttagcgtagcgggaacgacgtatttcggttcggatttcgtcgttcgttttaattaatttttaggcggtggcggcggtggcggcggcggcggtcggacgggaggggcgggacggtagtttgagacggtttcgcgatcgcggtttaacgttttttttttcgtttcggatttcgttttcgggtcgtagtcgtcgtcgtttattggtttacgtttcggacgtatgggcgcggtttcgtttcgttatttagtcggcgtttcgttcggggttttttttagttagtgggttggtagttttcgggggtaagagcggtcggtttagtcgtcgttaattacgatgtcgtaattggttgcgttcgttttcgttagagttttgattggacgaatttcgattcgggtttcgtttacgcgtttaagtttcgttag

SEQ ID NO: 26920 - DNA, 1299 bp, Artificial Sequence
  chemically treated genomic DNA (Homo sapiens) CpG-island No: 26920
ctaacgaaacttaaacgcgtaaacgaaacccgaatcgaaattcgtccaatcaaaactctaacgaaaacgaacgcaaccaattacgacatcgtaattaacgacgactaaaccgaccgctcttacccccgaaaactaccaacccactaactaaaaaaaaccccgaacgaaacgccgactaaataacgaaacgaaaccgcgcccatacgtccgaaacgtaaaccaataaacgacgacgactacgacccgaaaacgaaatccgaaacgaaaaaaaaaacgttaaaccgcgatcgcgaaaccgtctcaaactaccgtcccgcccctcccgtccgaccgccgccgccgccaccgccgccaccgcctaaaaattaattaaaacgaacgacgaaatccgaaccgaaatacgtcgttcccgctacgctaaaaaaaacgaacaaataaatactaacgacgatctctacgcccgcgcgacccgcgaaaaaaaactcgcgccgcgtctccgaactctacgaaaccgtccctcgccctaaccaacgcccctcgaccgaaatccgacccgcgcccccgccaaaatccccgccgaccgctataaccccgaaacttaaaaaaacaaatatacgctcgaaaaccaaaacgaaaaaaacccgacgaaatcgaaaaacgccgatcgacctctacccgaacgccctacgaaacgaaaaacgcgcgctcgccgctaccctatcccctctaacgcccacgctcccgaaccccgcgccacccgatctcgaaataataccaaatacaaacaacgctctccccgaacttaccccgctatccccgaccctcgcgcctactctcgaataaaacccgaacccctcgcgctaatcgactcgactctacgcgcgaccgaatcgcgctcccatttccttccttcctcccgtcaccccgctactcgaaaaaaactatacgattttatattcctctctacgaattctcgatacccaccaaaatacccgaaaaccaacccccgcctcctcccgcgccgtccaattaaaaaaacgaacgtaaaaaataaatcgtctttcttcccacgcgcccctaaccgtactccacacgcgcaataccctactaaaaaaaaacaattcgatactttaaaatttatcattccgacgttaactcttcctcctcgtaactccaacccgacgatacaactcttatcttttcccgatctccacttaaaaaaaaaaactaacaataacgcgcgcccctaactacgaaactcacccctacccgaccgatattaaaaaaaaaacatttcaa

SEQ ID NO: 26921 - DNA, 691 bp, Artificial Sequence
  chemically treated genomic DNA (Homo sapiens) CpG-island No: 26921
tatagtcggtttgtaattaaataatttaatttataaatatttcggaaagaaaaaaaatataagttggtttgatttagtttttcgtttttgtttcgtttcgtttcgtttttcgtttttcgtttttcgttttttagggttttcgttttcgtacgggggagtgagagcgagttcgtcgtttcgtattcgtcgtttcgcgttcgttcgcgttagttcgcggcgggggcggtttcgatcgcgtcgttcgttttttttcgtttcgtttcgtttcgttcgcgttcgcgtttcgttcgcgttcgtcgcgattttagtttcgcggcgttttcgtcgggtgcgtgcgttcgcgcgttcgttagttaggtttttcgcgttcgtcgttcgcgtcgcgttggttcgggttttttcgttcgcgttttatggttgtatacgagtgggattggttttaacgcgaggagtttatcgggtagattagcgatattcgagtgtagaatttgtaaggtaacgtagtttaggttcgtttcgggatggttgggcgttcggggggttcggggcgtcgtttcgatatttggtaattttttcgcgtcgttttcgttcgtcggtcgttcgttgtttttgttatttgtttcgaggtgggaggttggggttggatattcgtttttaagttttagggcggttagtcgcggttaggtttata

SEQ ID NO: 26922 - DNA, 691 bp, Artificial Sequence
  chemically treated genomic DNA (Homo sapiens) CpG-island No: 26922
tataaacctaaccgcgactaaccgccctaaaacttaaaaacgaatatccaaccccaacctcccacctcgaaacaaataacaaaaacaacgaacgaccgacgaacgaaaacgacgcgaaaaaattaccaaatatcgaaacgacgccccgaaccccccgaacgcccaaccatcccgaaacgaacctaaactacgttaccttacaaattctacactcgaatatcgctaatctacccgataaactcctcgcgttaaaaccaatcccactcgtatacaaccataaaacgcgaacgaaaaaacccgaaccaacgcgacgcgaacgacgaacgcgaaaaacctaactaacgaacgcgcgaacgcacgcacccgacgaaaacgccgcgaaactaaaatcgcgacgaacgcgaacgaaacgcgaacgcgaacgaaacgaaacgaaacgaaaaaaaacgaacgacgcgatcgaaaccgcccccgccgcgaactaacgcgaacgaacgcgaaacgacgaatacgaaacgacgaactcgctctcactcccccgtacgaaaacgaaaaccctaaaaaacgaaaaacgaaaaacgaaaaacgaaacgaaacgaaacaaaaacgaaaaactaaatcaaaccaacttatattttttttctttccgaaatatttataaattaaattatttaattacaaaccgactata

SEQ ID NO: 26923 - DNA, 691 bp, Artificial Sequence
  chemically treated genomic DNA (Homo sapiens) CpG-island No: 26923
tgtaaatttggtcgcggttggtcgttttggggtttgggggcgggtatttaattttagttttttatttcgaggtaagtgataggaataacgagcggtcggcgagcgggggcggcgcgggggagttgttaagtgtcggagcggcgtttcgggtttttcgagcgtttagttatttcggggcgagtttgggttgcgttattttgtaggttttgtattcggatgtcgttaatttgttcgatgagtttttcgcgttggaattagttttattcgtgtgtagttatgaagcgcgggcgggagagttcgggttagcgcggcgcgggcggcgggcgcggagagtttggttggcgggcgcgcgagcgtacgtattcggcgagggcgtcgcggagttggagtcgcggcgggcgcgggcggggcgcgggcgcgggcggggcggggcggggcggggaggggcgggcggcgcggtcggggtcgttttcgtcgcgggttggcgcgagcgagcgcggggcggcgggtgcggggcggcgggttcgtttttattttttcgtgcgggggcgggggttttgaggagcgaggggcgaggggcgaggggcggggcggggcggggtaggggcgggaggttgggttaggttagtttgtgtttttttttttttcggggtgtttgtaggttggattgtttggttataaatcggttgtg

SEQ ID NO: 26924 - DNA, 691 bp, Artificial Sequence
  chemically treated genomic DNA (Homo sapiens) CpG-island No: 26924
cacaaccgatttataaccaaacaatccaacctacaaacaccccgaaaaaaaaaaaaacacaaactaacctaacccaacctcccgcccctaccccgccccgccccgcccctcgcccctcgcccctcgctcctcaaaacccccgcccccgcacgaaaaaataaaaacgaacccgccgccccgcacccgccgccccgcgctcgctcgcgccaacccgcgacgaaaacgaccccgaccgcgccgcccgcccctccccgccccgccccgccccgcccgcgcccgcgccccgcccgcgcccgccgcgactccaactccgcgacgccctcgccgaatacgtacgctcgcgcgcccgccaaccaaactctccgcgcccgccgcccgcgccgcgctaacccgaactctcccgcccgcgcttcataactacacacgaataaaactaattccaacgcgaaaaactcatcgaacaaattaacgacatccgaatacaaaacctacaaaataacgcaacccaaactcgccccgaaataactaaacgctcgaaaaacccgaaacgccgctccgacacttaacaactcccccgcgccgcccccgctcgccgaccgctcgttattcctatcacttacctcgaaataaaaaactaaaattaaatacccgcccccaaaccccaaaacgaccaaccgcgaccaaatttaca

SEQ ID NO: 26925 - DNA, 1083 bp, Artificial Sequence
  chemically treated genomic DNA (Homo sapiens) CpG-island No: 26925
ggtagtcgaatttcgagagtttagagagtttgttaaatttagtcggtttcggcgcgcgggttttcgggggttttaaaaatttcgggtaattgcggtttaacgttaaggtttagtttaggcgttgggtcgtaaacgttttttcggttttcgcgcgcgcgttcgttgtttttttgtttttgagtggttggggggtcgggattaattttttatcgttaggttttgtttaattataggttcgtttttatgtcgttacggggcgagcggagcgtggggcgcggaggggcggtgcgggattagtgggatttttaagcggttgtgcgtcgttgtcgcgggtcgtgcgttggttgtcggttagtcgggcgtgcgtagttttcgtaggcgtcggcgggaggggtcgaggcggaggcgcggcgtaggttgttgtaggtttaggtgaatggagtaatttgatagcggggacgaggcgacggcgagcgcgaggaaatggcggcgggggcggcggcgtcgggcggtttcgggaggtttgggttgtgacgcgcgcgtcggagcggggttcgatggttttcgaaggttcgcggcgtttcgtgttgtaggtgaggcgggttttcgcggagtagttttgtgttcggggcggggagcgggtcgtttggtcgcgttttcgttttcgcgcggaggttcgcgtgtcggttatggtttcgagtcgcgcgttcgggtttggcgggcgttgacgaagggcgcggtttcgtttgtttcgtcgtttcgtatagcgcggtttgtggattcggcgtttgttcgtttcggttttgtttttgggttcggatttcggcgttttttcgcgaggtagttttgggagatttttcgggtcgtcgtggcgtggtgggggatgtcggcgtttgtttatttttcggtttggcgaggtttggggtttttgataggtttcgttacgcgcgttaaggtggcgcgggagtagcggaggtggagacgcgcgtttgatttgtcggagtattttggggtttttttttgatggggtcgttgtgtcgcgttcggaggggacgaagttgggttttcggtttttttcgggag

SEQ ID NO: 26926 - DNA, 1083 bp, Artificial Sequence
  chemically treated genomic DNA (Homo sapiens) CpG-island No: 26926
ctcccgaaaaaaaccgaaaacccaacttcgtcccctccgaacgcgacacaacgaccccatcaaaaaaaaaccccaaaatactccgacaaatcaaacgcgcgtctccacctccgctactcccgcgccaccttaacgcgcgtaacgaaacctatcaaaaaccccaaacctcgccaaaccgaaaaataaacaaacgccgacatcccccaccacgccacgacgacccgaaaaatctcccaaaactacctcgcgaaaaaacgccgaaatccgaacccaaaaacaaaaccgaaacgaacaaacgccgaatccacaaaccgcgctatacgaaacgacgaaacaaacgaaaccgcgcccttcgtcaacgcccgccaaacccgaacgcgcgactcgaaaccataaccgacacgcgaacctccgcgcgaaaacgaaaacgcgaccaaacgacccgctccccgccccgaacacaaaactactccgcgaaaacccgcctcacctacaacacgaaacgccgcgaaccttcgaaaaccatcgaaccccgctccgacgcgcgcgtcacaacccaaacctcccgaaaccgcccgacgccgccgcccccgccgccatttcctcgcgctcgccgtcgcctcgtccccgctatcaaattactccattcacctaaacctacaacaacctacgccgcgcctccgcctcgacccctcccgccgacgcctacgaaaactacgcacgcccgactaaccgacaaccaacgcacgacccgcgacaacgacgcacaaccgcttaaaaatcccactaatcccgcaccgcccctccgcgccccacgctccgctcgccccgtaacgacataaaaacgaacctataattaaacaaaacctaacgataaaaaattaatcccgaccccccaaccactcaaaaacaaaaaaacaacgaacgcgcgcgcgaaaaccgaaaaaacgtttacgacccaacgcctaaactaaaccttaacgttaaaccgcaattacccgaaatttttaaaacccccgaaaacccgcgcgccgaaaccgactaaatttaacaaactctctaaactctcgaaattcgactacc

SEQ ID NO: 26927 - DNA, 1083 bp, Artificial Sequence
  chemically treated genomic DNA (Homo sapiens) CpG-island No: 26927
ttttcgggagggatcgagagtttagtttcgtttttttcgggcgcggtatagcggttttattagaggagggttttagggtgtttcggtaggttaggcgcgcgtttttattttcgttgttttcgcgttattttagcgcgcgtgacgggatttgttaagagttttaggtttcgttaggtcggggagtggataggcgtcggtattttttattacgttacggcggttcggaaagttttttagggttgtttcgcggggaggcgtcggggttcgggtttaggagtagagtcgaggcgggtagacgtcgggtttataggtcgcgttgtgcgggacgacgaggtaggcgaggtcgcgtttttcgttagcgttcgttaggttcggacgcgcggttcggggttatggtcggtacgcgggttttcgcgcggaggcgggagcgcggttaggcgattcgtttttcgtttcggatataaagttgtttcgcgggagttcgttttatttgtagtacggggcgtcgcgggttttcgagaattatcggatttcgtttcggcgcgcgcgttatagtttaggtttttcggagtcgttcggcgtcgtcgttttcgtcgttattttttcgcgttcgtcgtcgtttcgttttcgttgttaggttattttatttatttgggtttgtagtagtttgcgtcgcgttttcgtttcgatttttttcgtcggcgtttgcggagattgcgtacgttcggttggtcggtagttagcgtacggttcgcggtaacggcgtatagtcgtttggagattttattggtttcgtatcgttttttcgcgttttacgtttcgttcgtttcgtggcggtatgagagcgagtttgtgattggatagggtttggcggtgaaaggttaatttcggttttttagttatttaggagtagggagatagcgggcgcgcgcgcggaggtcggagaggcgtttgcggtttagcgtttggattggattttggcgttgggtcgtagttgttcggagtttttggggttttcgggaattcgcgcgtcgaggtcggttaagtttggtagattttttgagttttcggaattcgattgtt

SEQ ID NO: 26928 - DNA, 1083 bp, Artificial Sequence
  chemically treated genomic DNA (Homo sapiens) CpG-island No: 26928
aacaatcgaattccgaaaactcaaaaaatctaccaaacttaaccgacctcgacgcgcgaattcccgaaaaccccaaaaactccgaacaactacgacccaacgccaaaatccaatccaaacgctaaaccgcaaacgcctctccgacctccgcgcgcgcgcccgctatctccctactcctaaataactaaaaaaccgaaattaacctttcaccgccaaaccctatccaatcacaaactcgctctcataccgccacgaaacgaacgaaacgtaaaacgcgaaaaaacgatacgaaaccaataaaatctccaaacgactatacgccgttaccgcgaaccgtacgctaactaccgaccaaccgaacgtacgcaatctccgcaaacgccgacgaaaaaaatcgaaacgaaaacgcgacgcaaactactacaaacccaaataaataaaataacctaacaacgaaaacgaaacgacgacgaacgcgaaaaaataacgacgaaaacgacgacgccgaacgactccgaaaaacctaaactataacgcgcgcgccgaaacgaaatccgataattctcgaaaacccgcgacgccccgtactacaaataaaacgaactcccgcgaaacaactttatatccgaaacgaaaaacgaatcgcctaaccgcgctcccgcctccgcgcgaaaacccgcgtaccgaccataaccccgaaccgcgcgtccgaacctaacgaacgctaacgaaaaacgcgacctcgcctacctcgtcgtcccgcacaacgcgacctataaacccgacgtctacccgcctcgactctactcctaaacccgaaccccgacgcctccccgcgaaacaaccctaaaaaactttccgaaccgccgtaacgtaataaaaaataccgacgcctatccactccccgacctaacgaaacctaaaactcttaacaaatcccgtcacgcgcgctaaaataacgcgaaaacaacgaaaataaaaacgcgcgcctaacctaccgaaacaccctaaaaccctcctctaataaaaccgctataccgcgcccgaaaaaaacgaaactaaactctcgatccctcccgaaaa

SEQ ID NO: 26929 - DNA, 588 bp, Artificial Sequence
  chemically treated genomic DNA (Homo sapiens) CpG-island No: 26929
gtaacgatgtggagacggaaatattcgaggatattcggaggaattcggggagttttgagtggtaatcgaggggtagagtatggtagtgggcggggttatttcggtacgttcgaagggcgttggcggaaattatcgaagatgttcgaagtcgtcgggacggattcgagtattttacgtaagatggcggagttggaggaggtgattttggacgggaagtttttttaggcgttgcgggtgatcgatttgaaggtcgtattggagtagcgaggtttagttaagagcgggtagaagagtgttttggttaagcggtttaaaggggtgaggagtcggcgttgttggggtgtcggaggagagcggattcggtagagacgagtttttgtcgcggcgtaggcgtagtattcgggttcggcgcgagttcgtttaggtcgttagcgcgagtttttggattcgcgcgtacggtggttgatgaggttcgcgttggaatggagatcgcgtcggttttcgttttaacggtagtagcgcgagtttaaatgggagggtgtgtattattttttaggagtgttttaagttttttttttttttttttat

SEQ ID NO: 26930 - DNA, 588 bp, Artificial Sequence
  chemically treated genomic DNA (Homo sapiens) CpG-island No: 26930
ataaaaaaaaaaaaaaaaaacttaaaacactcctaaaaaataatacacaccctcccatttaaactcgcgctactaccgttaaaacgaaaaccgacgcgatctccattccaacgcgaacctcatcaaccaccgtacgcgcgaatccaaaaactcgcgctaacgacctaaacgaactcgcgccgaacccgaatactacgcctacgccgcgacaaaaactcgtctctaccgaatccgctctcctccgacaccccaacaacgccgactcctcacccctttaaaccgcttaaccaaaacactcttctacccgctcttaactaaacctcgctactccaatacgaccttcaaatcgatcacccgcaacgcctaaaaaaacttcccgtccaaaatcacctcctccaactccgccatcttacgtaaaatactcgaatccgtcccgacgacttcgaacatcttcgataatttccgccaacgcccttcgaacgtaccgaaataaccccgcccactaccatactctacccctcgattaccactcaaaactccccgaattcctccgaatatcctcgaatatttccgtctccacatcgttac

SEQ ID NO: 26931 - DNA, 588 bp, Artificial Sequence
  chemically treated genomic DNA (Homo sapiens) CpG-island No: 26931
gtgggggaaggaggaaggagtttaagatatttttggagagtagtgtatatttttttatttgggttcgcgttgttgtcgttaaggcgggaatcggcgcgatttttattttagcgcgaattttattaattatcgtgcgcgcggatttagaggttcgcgttggcggtttgagcgagttcgcgtcgagttcggatattgcgtttgcgtcgcggtagaggttcgtttttatcgggttcgttttttttcgatattttagtaacgtcgattttttatttttttgagtcgtttgattagggtatttttttgttcgtttttggttaggtttcgttgttttagtgcggtttttaggtcggttattcgtagcgtttgaagaggtttttcgtttagagttattttttttagtttcgttattttgcgtgaggtattcgggttcgtttcgacggtttcgggtattttcggtaattttcgttaacgtttttcgaacgtatcgagatgatttcgtttattgttatattttatttttcgattattatttagaatttttcgggttttttcggatgttttcggatgttttcgtttttatatcgttat

SEQ ID NO: 26932 - DNA, 588 bp, Artificial Sequence
  chemically treated genomic DNA (Homo sapiens) CpG-island No: 26932
ataacgatataaaaacgaaaacatccgaaaacatccgaaaaaacccgaaaaattctaaataataatcgaaaaataaaatataacaataaacgaaatcatctcgatacgttcgaaaaacgttaacgaaaattaccgaaaatacccgaaaccgtcgaaacgaacccgaatacctcacgcaaaataacgaaactaaaaaaaataactctaaacgaaaaacctcttcaaacgctacgaataaccgacctaaaaaccgcactaaaacaacgaaacctaaccaaaaacgaacaaaaaaataccctaatcaaacgactcaaaaaaataaaaaatcgacgttactaaaatatcgaaaaaaaacgaacccgataaaaacgaacctctaccgcgacgcaaacgcaatatccgaactcgacgcgaactcgctcaaaccgccaacgcgaacctctaaatccgcgcgcacgataattaataaaattcgcgctaaaataaaaatcgcgccgattcccgccttaacgacaacaacgcgaacccaaataaaaaaatatacactactctccaaaaatatcttaaactccttcctccttcccccac

SEQ ID NO: 26933 - DNA, 526 bp, Artificial Sequence
  chemically treated genomic DNA (Homo sapiens) CpG-island No: 26933
ttattttcggtcgtcgtttggatagaggcgcgtaattcggagggcgtaggtttcggttcggagaagggggtgtcgtcggcgtttcgattttttaggaatggggaaatagaggtacggtggattcggcggcggggttgggtttggggttggacgttgatttaggatttcgtttttgttcgttttgcgtcgcgtttttttcgggtcggttttgatcgagtagttttacgcgggttcggggttcgtttattcgataggagcggggggttgtagtttacgagtttacgagttcgtagcgacgtattcggagtgtaatttcgtagagttacggagatattttttcggtgtgggcgtttcgtcgcgtttttttttcgcgggttgcggttattttagggtaggatagagtcgagatgttcgggtgggagcgatgttcgcgtgggggcgatgtaacgggggagatgtttggggggagggtggtaaggtgaaatttggtggagaataatgggggtgggtgggcgatttttgggga

SEQ ID NO: 26934 - DNA, 526 bp, Artificial Sequence
  chemically treated genomic DNA (Homo sapiens) CpG-island No: 26934
tccccaaaaatcgcccacccacccccattattctccaccaaatttcaccttaccaccctccccccaaacatctcccccgttacatcgcccccacgcgaacatcgctcccacccgaacatctcgactctatcctaccctaaaataaccgcaacccgcgaaaaaaaaacgcgacgaaacgcccacaccgaaaaaatatctccgtaactctacgaaattacactccgaatacgtcgctacgaactcgtaaactcgtaaactacaaccccccgctcctatcgaataaacgaaccccgaacccgcgtaaaactactcgatcaaaaccgacccgaaaaaaacgcgacgcaaaacgaacaaaaacgaaatcctaaatcaacgtccaaccccaaacccaaccccgccgccgaatccaccgtacctctatttccccattcctaaaaaatcgaaacgccgacgacacccccttctccgaaccgaaacctacgccctccgaattacgcgcctctatccaaacgacgaccgaaaataa

SEQ ID NO: 26935 - DNA, 526 bp, Artificial Sequence
  chemically treated genomic DNA (Homo sapiens) CpG-island No: 26935
tttttaggaatcgtttatttatttttattgttttttattaggttttattttattattttttttttaggtatttttttcgttgtatcgtttttacgcgggtatcgtttttattcgggtatttcggttttgttttgttttggggtggtcgtagttcgcggggaggaagcgcggcgaggcgtttatatcgggaaagtgttttcgtgattttgcgaggttatatttcgggtgcgtcgttgcgggttcgtgggttcgtgggttgtagtttttcgtttttgtcgggtggacgagtttcgggttcgcgtggagttgttcggttaaggtcggttcgggaggggcgcggcgtagggcgggtaggggcggggttttaggttaacgtttagttttagatttagtttcgtcgtcggatttatcgtgtttttgtttttttatttttgagaaatcggaacgtcggcggtattttttttttcgggtcggagtttgcgtttttcggattgcgcgtttttgtttaggcggcggtcgggggtgg

SEQ ID NO: 26936 - DNA, 526 bp, Artificial Sequence
  chemically treated genomic DNA (Homo sapiens) CpG-island No: 26936
ccacccccgaccgccgcctaaacaaaaacgcgcaatccgaaaaacgcaaactccgacccgaaaaaaaaaataccgccgacgttccgatttctcaaaaataaaaaaacaaaaacacgataaatccgacgacgaaactaaatctaaaactaaacgttaacctaaaaccccgcccctacccgccctacgccgcgcccctcccgaaccgaccttaaccgaacaactccacgcgaacccgaaactcgtccacccgacaaaaacgaaaaactacaacccacgaacccacgaacccgcaacgacgcacccgaaatataacctcgcaaaatcacgaaaacactttcccgatataaacgcctcgccgcgcttcctccccgcgaactacgaccaccccaaaacaaaacaaaaccgaaatacccgaataaaaacgatacccgcgtaaaaacgatacaacgaaaaaaatacctaaaaaaaaaataataaaataaaacctaataaaaaacaataaaaataaataaacgattcctaaaaa

SEQ ID NO: 26937 - DNA, 1211 bp, Artificial Sequence
  chemically treated genomic DNA (Homo sapiens) CpG-island No: 26937
cgttagtttcggtttcgcgttcgtttagagggtcgtttttttttcgtcgattcggtttggggtttaggcgttaatttcgtttttcgggggggtcgcgcggggagtttcgatcgttttagggttaacggtttaggttttagtttacgaggtttgatcgtatcgtattgagcggtttttgcgttaggtaagggggttcggggcgggatcgggaatcgcgttgttagtcgtttcggaaattcgcggtgggtcgttgggtgcgcgtcgagtcgttgttaattgttaagttacgggacgaaattaaggcgttcgcgtttcgtttagttagagcgtttaagtttttttcgtcgttcgttagcgtcggagcgtttattgcgtttgcgtagtttgtttttttggattcgggggcggagtcgaagcgcgtattgcgtttgcgtttttcgttcgatttcgttttagcggtcgggttttcggcgtttcgttttttcgttcggttagggacgaggcggggcgggtacgcggatattgcgtttgcgagagtaggtttcgttttcgatcggtttcgttttcggttagtttcgtttcgcgtcgcgcggggttttgggaggggcgtagcgttcggcggcgtcgcgggcggcgggcggcggggtcgcgggaggggcgcgggggtagataaagtcgcggtaatgaatggagcgttcgttcgcgtcgtcgtcgttcgtagtcggtcgggagtcgttttagaggtcgggtcgaggtgagtgcgcgggcgtcgtcgtttcgtcgtttgtcgcgagtttcgtttttcgcggatcgcgtcggggtcgggtcgggtcgcgttattgtttgcgtcgcgtcggggttagggtcggggttaggcgggcgggggcgcggtttcgtggtttcggggttttcgttcggcgtcgtttcggattcgttttcgcgcggatttcggttttgatagttggcgcgggggcggcgtcgattgagcggtcgagtgtcgggggtcggcgttcggtttggtttacgtgttcgcgtcgttgttttcgggcggacgggacggggttcgggttcggggcgtcgttcgggttcgtcgggagcgcgttgtttcggttacgtcgagttaatttcgcgagtttcgtttttgggatttttttggacgtgttattttcgttttatttttaggaagggttatttgggttttgttttatgtt

SEQ ID NO: 26938 - DNA, 1211 bp, Artificial Sequence
  chemically treated genomic DNA (Homo sapiens) CpG-island No: 26938
aacataaaacaaaacccaaataacccttcctaaaaataaaacgaaaataacacgtccaaaaaaatcccaaaaacgaaactcgcgaaattaactcgacgtaaccgaaacaacgcgctcccgacgaacccgaacgacgccccgaacccgaaccccgtcccgtccgcccgaaaacaacgacgcgaacacgtaaaccaaaccgaacgccgacccccgacactcgaccgctcaatcgacgccgcccccgcgccaactatcaaaaccgaaatccgcgcgaaaacgaatccgaaacgacgccgaacgaaaaccccgaaaccacgaaaccgcgcccccgcccgcctaaccccgaccctaaccccgacgcgacgcaaacaataacgcgacccgacccgaccccgacgcgatccgcgaaaaacgaaactcgcgacaaacgacgaaacgacgacgcccgcgcactcacctcgacccgacctctaaaacgactcccgaccgactacgaacgacgacgacgcgaacgaacgctccattcattaccgcgactttatctacccccgcgcccctcccgcgaccccgccgcccgccgcccgcgacgccgccgaacgctacgcccctcccaaaaccccgcgcgacgcgaaacgaaactaaccgaaaacgaaaccgatcgaaaacgaaacctactctcgcaaacgcaatatccgcgtacccgccccgcctcgtccctaaccgaacgaaaaaacgaaacgccgaaaacccgaccgctaaaacgaaatcgaacgaaaaacgcaaacgcaatacgcgcttcgactccgcccccgaatccaaaaaaacaaactacgcaaacgcaataaacgctccgacgctaacgaacgacgaaaaaaacttaaacgctctaactaaacgaaacgcgaacgccttaatttcgtcccgtaacttaacaattaacaacgactcgacgcgcacccaacgacccaccgcgaatttccgaaacgactaacaacgcgattcccgatcccgccccgaacccccttacctaacgcaaaaaccgctcaatacgatacgatcaaacctcgtaaactaaaacctaaaccgttaaccctaaaacgatcgaaactccccgcgcgacccccccgaaaaacgaaattaacgcctaaaccccaaaccgaatcgacgaaaaaaaaacgaccctctaaacgaacgcgaaaccgaaactaacg

SEQ ID NO: 26939 - DNA, 1211 bp, Artificial Sequence
  chemically treated genomic DNA (Homo sapiens) CpG-island No: 26939
gatatgaagtagggtttaggtggttttttttggaggtgggacgggaatgatacgtttagagaagttttagggacggggttcgcggggttaattcgacgtggtcgggatagcgcgttttcggcggattcgggcggcgtttcgagttcgagtttcgtttcgttcgttcggaagtaacggcgcgggtacgtgggttaggtcgggcgtcgattttcggtattcggtcgtttagtcggcgtcgttttcgcgttagttgttagggtcggggttcgcgcgggggcgggttcggggcggcgtcgggcggggatttcgaggttacggaatcgcgttttcgttcgtttggtttcggttttggtttcggcgcggcgtagataatggcgcggttcggttcggtttcggcgcggttcgcgggggacggggttcgcggtaggcggcggggcggcggcgttcgcgtatttatttcggttcggtttttggggcggttttcggtcggttgcggacgacggcggcgcgggcggacgttttatttattatcgcggttttgtttgttttcgcgtttttttcgcggtttcgtcgttcgtcgttcgcgacgtcgtcggacgttgcgttttttttagggtttcgcgcggcgcggggcggggttggtcgggggcggggtcgatcgggggcggggtttattttcgtaggcgtagtgttcgcgtattcgtttcgtttcgtttttggtcgggcgggaggacggagcgtcggaggttcggtcgttggggcggggtcgggcggaagacgtaggcgtaatgcgcgtttcggtttcgttttcgggtttaggagggtaaattacgtaggcgtagtgggcgtttcggcgttggcgggcgacgggaagggtttaggcgttttggttgggcggggcgcgggcgttttggtttcgtttcgtggtttggtagttggtagcggttcggcgcgtatttaacggtttatcgcgggttttcgggacggttagtagcgcggttttcggtttcgtttcgaatttttttatttggcgtagaggtcgtttagtgcggtgcggttaggtttcgtgggttgggatttaagtcgttgattttaaggcgatcggggtttttcgcgcggttttttcgggggacgggattaacgtttaagttttaagtcgggtcggcgggaggagggcggttttttgggcgagcgcggggtcggggttggcg

SEQ ID NO: 26940 - DNA, 1211 bp, Artificial Sequence
  chemically treated genomic DNA (Homo sapiens) CpG-island No: 26940
cgccaaccccgaccccgcgctcgcccaaaaaaccgccctcctcccgccgacccgacttaaaacttaaacgttaatcccgtcccccgaaaaaaccgcgcgaaaaaccccgatcgccttaaaatcaacgacttaaatcccaacccacgaaacctaaccgcaccgcactaaacgacctctacgccaaataaaaaaattcgaaacgaaaccgaaaaccgcgctactaaccgtcccgaaaacccgcgataaaccgttaaatacgcgccgaaccgctaccaactaccaaaccacgaaacgaaaccaaaacgcccgcgccccgcccaaccaaaacgcctaaacccttcccgtcgcccgccaacgccgaaacgcccactacgcctacgtaatttaccctcctaaacccgaaaacgaaaccgaaacgcgcattacgcctacgtcttccgcccgaccccgccccaacgaccgaacctccgacgctccgtcctcccgcccgaccaaaaacgaaacgaaacgaatacgcgaacactacgcctacgaaaataaaccccgcccccgatcgaccccgcccccgaccaaccccgccccgcgccgcgcgaaaccctaaaaaaaacgcaacgtccgacgacgtcgcgaacgacgaacgacgaaaccgcgaaaaaaacgcgaaaacaaacaaaaccgcgataataaataaaacgtccgcccgcgccgccgtcgtccgcaaccgaccgaaaaccgccccaaaaaccgaaccgaaataaatacgcgaacgccgccgccccgccgcctaccgcgaaccccgtcccccgcgaaccgcgccgaaaccgaaccgaaccgcgccattatctacgccgcgccgaaaccaaaaccgaaaccaaacgaacgaaaacgcgattccgtaacctcgaaatccccgcccgacgccgccccgaacccgcccccgcgcgaaccccgaccctaacaactaacgcgaaaacgacgccgactaaacgaccgaataccgaaaatcgacgcccgacctaacccacgtacccgcgccgttacttccgaacgaacgaaacgaaactcgaactcgaaacgccgcccgaatccgccgaaaacgcgctatcccgaccacgtcgaattaaccccgcgaaccccgtccctaaaacttctctaaacgtatcattcccgtcccacctccaaaaaaaaccacctaaaccctacttcatatc

SEQ ID NO: 26941 - DNA, 764 bp, Artificial Sequence
  chemically treated genomic DNA (Homo sapiens) CpG-island No: 26941
gtcgttcgtgagttttcgtaatttagacgcgttcggtttcgcgtttcggggttgggattatcgagggcgagttgtagttttcgttattcggttcgtcgtcggatttcgttttttataaatagttcggtaaggttttttttcgtcgtttttttatttagcgaagttttttttttagttttttcggcggcggcgtcgtgacgttattttcgttttttagcgcgtacgtgggaggaagtgttggtgttttttgtcgttgttttcgtttttttggttacgttcgttagtcggtcggtcgtcgtttttagtcgtgtgtcgttatgggagtttcggcgttttttcgttggtttagtcgtaagtattcgtttattatagttaattgcgtggaagagaaggtgaggaggcgttaggcggtcgttatattcgagttcgggttttcggtacgtttaggtcgcggtttatgggtttcgtcgtttgttttcggggagttttgtcggagttcgcgttttgttgttagtttcgcgagtagtcgtagttttatacgcgatgggacgcgggttgtgggatttagtatttcgggggcgaggaatttaggattttcggcggggtaagggtttatagggtttcgaattcgtaggagggtcgttttttttttattcgttttttttcggtatcggaaggtttcgtttattgttttgttttttttttagatcgcgtattttgggtttcggaagaggtttagaggttgttgttgagtaatgtatgtt

SEQ ID NO: 26942 - DNA, 764 bp, Artificial Sequence
  chemically treated genomic DNA (Homo sapiens) CpG-island No: 26942
aacatacattactcaacaacaacctctaaacctcttccgaaacccaaaatacgcgatctaaaaaaaaaacaaaacaataaacgaaaccttccgataccgaaaaaaaacgaataaaaaaaaaacgaccctcctacgaattcgaaaccctataaacccttaccccgccgaaaatcctaaattcctcgcccccgaaatactaaatcccacaacccgcgtcccatcgcgtataaaactacgactactcgcgaaactaacaacaaaacgcgaactccgacaaaactccccgaaaacaaacgacgaaacccataaaccgcgacctaaacgtaccgaaaacccgaactcgaatataacgaccgcctaacgcctcctcaccttctcttccacgcaattaactataataaacgaatacttacgactaaaccaacgaaaaaacgccgaaactcccataacgacacacgactaaaaacgacgaccgaccgactaacgaacgtaaccaaaaaaacgaaaacaacgacaaaaaacaccaacacttcctcccacgtacgcgctaaaaaacgaaaataacgtcacgacgccgccgccgaaaaaactaaaaaaaaaacttcgctaaataaaaaaacgacgaaaaaaaaccttaccgaactatttataaaaaacgaaatccgacgacgaaccgaataacgaaaactacaactcgccctcgataatcccaaccccgaaacgcgaaaccgaacgcgtctaaattacgaaaactcacgaacgac

SEQ ID NO: 26943 - DNA, 764 bp, Artificial Sequence
  chemically treated genomic DNA (Homo sapiens) CpG-island No: 26943
ggtatgtattgtttaataatagtttttgaatttttttcgagatttaaaatgcgcggtttggagaggaaataaagtagtgggcggggtttttcggtgtcgggaaaaagcgagtaggggaggagcgatttttttgcgagttcggaattttataggtttttgtttcgtcgagggttttgaatttttcgttttcggggtgttgaattttatagttcgcgttttatcgcgtgtggggttgcgattgttcgcgaggttggtagtagggcgcgagtttcggtaaggtttttcgggggtaggcggcggagtttatgggtcgcggtttagacgtgtcgggggttcgggttcgagtgtggcggtcgtttggcgtttttttatttttttttttacgtagttgattatgatggacgggtatttgcggttgagttagcggaagaacgtcgggatttttatagcggtatacggttggaggcggcggtcgatcggttgacgagcgtaattaaagagacgggagtagcggtagagggtattagtatttttttttacgtgcgcgttggagaacggaagtgacgttacggcgtcgtcgtcggggaagttgggaaggaggtttcgttggatgagggagcggcggaaaagggttttgtcgggttgtttgtgggaggcggagttcggcggcggatcgggtggcgaaggttgtagttcgttttcggtggttttagtttcggagcgcgaggtcgagcgcgtttgagttgcgggggtttacgggcgat

SEQ ID NO: 26944 - DNA, 764 bp, Artificial Sequence
  chemically treated genomic DNA (Homo sapiens) CpG-island No: 26944
atcgcccgtaaacccccgcaactcaaacgcgctcgacctcgcgctccgaaactaaaaccaccgaaaacgaactacaaccttcgccacccgatccgccgccgaactccgcctcccacaaacaacccgacaaaacccttttccgccgctccctcatccaacgaaacctccttcccaacttccccgacgacgacgccgtaacgtcacttccgttctccaacgcgcacgtaaaaaaaaatactaataccctctaccgctactcccgtctctttaattacgctcgtcaaccgatcgaccgccgcctccaaccgtataccgctataaaaatcccgacgttcttccgctaactcaaccgcaaatacccgtccatcataatcaactacgtaaaaaaaaaaataaaaaaacgccaaacgaccgccacactcgaacccgaacccccgacacgtctaaaccgcgacccataaactccgccgcctacccccgaaaaaccttaccgaaactcgcgccctactaccaacctcgcgaacaatcgcaaccccacacgcgataaaacgcgaactataaaattcaacaccccgaaaacgaaaaattcaaaaccctcgacgaaacaaaaacctataaaattccgaactcgcaaaaaaatcgctcctcccctactcgctttttcccgacaccgaaaaaccccgcccactactttatttcctctccaaaccgcgcattttaaatctcgaaaaaaattcaaaaactattattaaacaatacatacc

SEQ ID NO: 26945 - DNA, 932 bp, Artificial Sequence
  chemically treated genomic DNA (Homo sapiens) CpG-island No: 26945
cgtattgttgcgttaattcgaggtcggttaggaatttattggatgtttgaagggtgggtgcggaattgatgattaggaagcgggaagatatcgtttcggagaatagggaagcgagtcgggtattggggaggtgcgttgggtattggggaggtgcgttggattttgacgtcggagcggaagatttcgttggaggtcggggttggtcgggcggggcggggcgggtagaggcggaggggcggggtcgggttgggagaggtttcgttttcgggcgcgttcgtgtgcgtggtcggggggcgtcgcgtagagtttcgttttatgatgtcgggtttgaggacgaggtcgggcggcgttgtggtaatttttattttgcggatacgcgtttttaatattcggttcggcggtttcgtagtttaagaagtggggtttttgtggtcgtgcgtcgatttttaattttagtcgtttttaacgtttttattcgttttcggtgcgcgcgttttttttacgttttcgttttcgttttcgtcgggttcgcgcgtcgcgtttttttttattcggtacgttttgtcgtttcgttcggtcgtagttagcgtggagtcgttttgcgggtaattgagattttcgtagttgtatcgttttttttcgtcgttagtcgttcgtcgttatggacgtgtatttttcgcgtcggtaggggttgtttcgcgttcggttttttggcggttttagtcgcgggttatttttcgttaggtacgcggggtagaggtagtcgaggggcggtcgggcgggggatgcgggttgtcggggttcggcgacgtttttcgtcgtagggcgtggttcgatatggttttttcgggacggttttttgttgaacggtttagggaggaattttttttaggaacggcgttttttgtagaggttttataatggtttttttt

SEQ ID NO: 26946 - DNA, 932 bp, Artificial Sequence
  chemically treated genomic DNA (Homo sapiens) CpG-island No: 26946
aaaaaaaaccattataaaacctctacaaaaaacgccgttcctaaaaaaaattcctccctaaaccgttcaacaaaaaaccgtcccgaaaaaaccatatcgaaccacgccctacgacgaaaaacgtcgccgaaccccgacaacccgcatcccccgcccgaccgcccctcgactacctctaccccgcgtacctaacgaaaaataacccgcgactaaaaccgccaaaaaaccgaacgcgaaacaacccctaccgacgcgaaaaatacacgtccataacgacgaacgactaacgacgaaaaaaaacgatacaactacgaaaatctcaattacccgcaaaacgactccacgctaactacgaccgaacgaaacgacaaaacgtaccgaataaaaaaaaacgcgacgcgcgaacccgacgaaaacgaaaacgaaaacgtaaaaaaaacgcgcgcaccgaaaacgaataaaaacgttaaaaacgactaaaattaaaaatcgacgcacgaccacaaaaaccccacttcttaaactacgaaaccgccgaaccgaatattaaaaacgcgtatccgcaaaataaaaattaccacaacgccgcccgacctcgtcctcaaacccgacatcataaaacgaaactctacgcgacgccccccgaccacgcacacgaacgcgcccgaaaacgaaacctctcccaacccgaccccgcccctccgcctctacccgccccgccccgcccgaccaaccccgacctccaacgaaatcttccgctccgacgtcaaaatccaacgcacctccccaatacccaacgcacctccccaatacccgactcgcttccctattctccgaaacgatatcttcccgcttcctaatcatcaattccgcacccacccttcaaacatccaataaattcctaaccgacctcgaattaacgcaacaatacg

SEQ ID NO: 26947 - DNA, 932 bp, Artificial Sequence
  chemically treated genomic DNA (Homo sapiens) CpG-island No: 26947
aaggggagttattgtggggtttttatagagggcgtcgtttttgggaaaaatttttttttgagtcgtttagtaaagaatcgtttcgaggaagttatgtcggattacgttttgcggcgggaggcgtcgtcggatttcgatagttcgtatttttcgttcggtcgtttttcggttgtttttgtttcgcgtatttgacggagggtgattcgcggttggagtcgttaggggatcgagcgcggggtagtttttgtcggcgcggggggtatacgtttatggcggcggacgattggcggcggaggaggacggtgtagttgcgagggttttagttgttcgtagggcggttttacgttagttgcggtcgggcggggcggtagggcgtgtcgggtgggagggggcgcggcgcgcgggttcggcgggggcgggggcgggggcgtggagggggcgcgcgtatcgagagcggatgggggcgttgggagcggttggagttgggggtcggcgtacggttatagggattttattttttaagttgcgaggtcgtcggatcggatgttgggagcgcgtgttcgtagggtgagggttgttatagcgtcgttcggtttcgtttttaagttcggtattatagagcggggttttgcgcggcgtttttcggttacgtatacggacgcgttcgggggcggagttttttttagttcggtttcgttttttcgtttttgttcgtttcgtttcgttcgattagtttcggtttttagcgaagtttttcgtttcggcgttaggatttagcgtatttttttagtatttagcgtatttttttagtattcggttcgtttttttgtttttcggaacggtgttttttcgttttttggttattaatttcgtatttattttttaaatatttaatagatttttagtcggtttcgggttagcgtagtagtgcg

SEQ ID NO: 26948 - DNA, 932 bp, Artificial Sequence
  chemically treated genomic DNA (Homo sapiens) CpG-island No: 26948
cgcactactacgctaacccgaaaccgactaaaaatctattaaatatttaaaaaataaatacgaaattaataaccaaaaaacgaaaaaacaccgttccgaaaaacaaaaaaacgaaccgaatactaaaaaaatacgctaaatactaaaaaaatacgctaaatcctaacgccgaaacgaaaaacttcgctaaaaaccgaaactaatcgaacgaaacgaaacgaacaaaaacgaaaaaacgaaaccgaactaaaaaaaactccgcccccgaacgcgtccgtatacgtaaccgaaaaacgccgcgcaaaaccccgctctataataccgaacttaaaaacgaaaccgaacgacgctataacaaccctcaccctacgaacacgcgctcccaacatccgatccgacgacctcgcaacttaaaaaataaaatccctataaccgtacgccgacccccaactccaaccgctcccaacgcccccatccgctctcgatacgcgcgccccctccacgcccccgcccccgcccccgccgaacccgcgcgccgcgccccctcccacccgacacgccctaccgccccgcccgaccgcaactaacgtaaaaccgccctacgaacaactaaaaccctcgcaactacaccgtcctcctccgccgccaatcgtccgccgccataaacgtataccccccgcgccgacaaaaactaccccgcgctcgatcccctaacgactccaaccgcgaatcaccctccgtcaaatacgcgaaacaaaaacaaccgaaaaacgaccgaacgaaaaatacgaactatcgaaatccgacgacgcctcccgccgcaaaacgtaatccgacataacttcctcgaaacgattctttactaaacgactcaaaaaaaaatttttcccaaaaacgacgccctctataaaaaccccacaataactcccctt

SEQ ID NO: 26949 - DNA, 587 bp, Artificial Sequence
  chemically treated genomic DNA (Homo sapiens) CpG-island No: 26949
tttgcgcgtttcgggggagggagcgagggttgcgagttgcgcgttcggtcggggagggtagcgttttttttcgcgtcggcgttcgggtttcggttgttgtttcgggaaggcggtttcgcgagtcgtcgcggttcgttggggttcgggattagacgagttttcggtttcgatagcgtgttcgtttaaaagttcgttcggttggtttttagtttcgatcggtttcgttttgttttttttcgtttttgtcgggttcggatttgcgtcgttcgcgagggttggaaggtattggaagcgtcgtcggggttgtttagaggtcgggttttcgttttattttgcgtaaatttgtttttttaaggttagcgttgcgagttggttatatcgtttttttaaggtggatcggggaagttgcggtcgattttttttcgttttcggatttcggtcgcgcggttgtttttcgttttttattggcgagaggttggaggcggcgaaggagtcggggcgcgggggcgcggggggcgggggggcgtttgttttttaattttttttaggaggtcgtgtttttgagttttaaagttgaaggttttttt

SEQ ID NO: 26950 - DNA, 587 bp, Artificial Sequence
  chemically treated genomic DNA (Homo sapiens) CpG-island No: 26950
aaaaaaaccttcaactttaaaactcaaaaacacgacctcctaaaaaaaattaaaaaacaaacgcccccccgccccccgcgcccccgcgccccgactccttcgccgcctccaacctctcgccaataaaaaacgaaaaacaaccgcgcgaccgaaatccgaaaacgaaaaaaaatcgaccgcaacttccccgatccaccttaaaaaaacgatataaccaactcgcaacgctaaccttaaaaaaacaaatttacgcaaaataaaacgaaaacccgacctctaaacaaccccgacgacgcttccaataccttccaaccctcgcgaacgacgcaaatccgaacccgacaaaaacgaaaaaaaacaaaacgaaaccgatcgaaactaaaaaccaaccgaacgaacttttaaacgaacacgctatcgaaaccgaaaactcgtctaatcccgaaccccaacgaaccgcgacgactcgcgaaaccgccttcccgaaacaacaaccgaaacccgaacgccgacgcgaaaaaaaacgctaccctccccgaccgaacgcgcaactcgcaaccctcgctccctcccccgaaacgcgcaaa

SEQ ID NO: 26951 - DNA, 587 bp, Artificial Sequence
  chemically treated genomic DNA (Homo sapiens) CpG-island No: 26951
agaggggtttttagttttggggtttagaggtacgattttttggggagggttaaaaggtagacgttttttcgtttttcgcgttttcgcgtttcgattttttcgtcgtttttagtttttcgttagtgggaagcggggagtagtcgcgcggtcggagttcggaggcgaggggaggtcggtcgtaattttttcggtttattttaagaggacgatgtagttagttcgtagcgttgattttagaaaaataagtttgcgtaaagtggagcggggattcggtttttgggtagtttcggcggcgtttttagtgttttttagttttcgcgggcggcgtaggttcgggttcggtagggacggggaggggtagagcgggatcggtcggggttggggattagtcgggcgggtttttgaacgggtacgttgtcggagtcggaggttcgtttagtttcgagttttagcgggtcgcggcggttcgcggggtcgttttttcgggatagtagtcggggttcgggcgtcggcgcgggggaggacgttgtttttttcggtcgggcgcgtagttcgtagttttcgttttttttttcggggcgcgtagg

SEQ ID NO: 26952 - DNA, 587 bp, Artificial Sequence
  chemically treated genomic DNA (Homo sapiens) CpG-island No: 26952
cctacgcgccccgaaaaaaaaaacgaaaactacgaactacgcgcccgaccgaaaaaaacaacgtcctcccccgcgccgacgcccgaaccccgactactatcccgaaaaaacgaccccgcgaaccgccgcgacccgctaaaactcgaaactaaacgaacctccgactccgacaacgtacccgttcaaaaacccgcccgactaatccccaaccccgaccgatcccgctctacccctccccgtccctaccgaacccgaacctacgccgcccgcgaaaactaaaaaacactaaaaacgccgccgaaactacccaaaaaccgaatccccgctccactttacgcaaacttatttttctaaaatcaacgctacgaactaactacatcgtcctcttaaaataaaccgaaaaaattacgaccgacctcccctcgcctccgaactccgaccgcgcgactactccccgcttcccactaacgaaaaactaaaaacgacgaaaaaatcgaaacgcgaaaacgcgaaaaacgaaaaaacgtctaccttttaaccctccccaaaaaatcgtacctctaaaccccaaaactaaaaacccctct

SEQ ID NO: 26953 - DNA, 673 bp, Artificial Sequence
  chemically treated genomic DNA (Homo sapiens) CpG-island No: 26953
ttcgttttcggggattgggagaataggatagtagtaggagtcggggggtcgtcgaagatggggaatattatttcgtgttgcgtgtcgtttagttttaagtttcggaggaatgtttattttcggttggagttttatcggttagatacggatttgagtcgcgaggatacgggttgtaatttgtagtatattagcgatcgggagaatatagacggtgagtgcggttcgtcgagttttttattcgttttcgcggtaatagtcgtatagttaacgtcggggcggttcggttgtttttgtttgtttagtcggtttcggcgattcgtgtataatcggggtttcgttcgcgtagtttaggcgttcggggtttcgtagtttttgggcgtatttttcgttggttatttttaagtgagcggtcgcggaaattttgtaggttcgcggtatcgagtacggcgggtttagggcgggtgtgtgcgcgtgggtcgcgaggtgataggagtcggttttcgtttttaatggagcggttagagttgggtgggggcggttcgggagttcggggttttcggtattatttgaatgtagttcgaagttaagttgtgtacgcgtttgttttataaaagcgaagtgagtggatttttattttggaatttcggtgtttttaatttcgagttggagaatt

SEQ ID NO: 26954 - DNA, 673 bp, Artificial Sequence
  chemically treated genomic DNA (Homo sapiens) CpG-island No: 26954
aattctccaactcgaaattaaaaacaccgaaattccaaaataaaaatccactcacttcgcttttataaaacaaacgcgtacacaacttaacttcgaactacattcaaataataccgaaaaccccgaactcccgaaccgcccccacccaactctaaccgctccattaaaaacgaaaaccgactcctatcacctcgcgacccacgcgcacacacccgccctaaacccgccgtactcgataccgcgaacctacaaaatttccgcgaccgctcacttaaaaataaccaacgaaaaatacgcccaaaaactacgaaaccccgaacgcctaaactacgcgaacgaaaccccgattatacacgaatcgccgaaaccgactaaacaaacaaaaacaaccgaaccgccccgacgttaactatacgactattaccgcgaaaacgaataaaaaactcgacgaaccgcactcaccgtctatattctcccgatcgctaatatactacaaattacaacccgtatcctcgcgactcaaatccgtatctaaccgataaaactccaaccgaaaataaacattcctccgaaacttaaaactaaacgacacgcaacacgaaataatattccccatcttcgacgaccccccgactcctactactatcctattctcccaatccccgaaaacgaa

SEQ ID NO: 26955 - DNA, 673 bp, Artificial Sequence
  chemically treated genomic DNA (Homo sapiens) CpG-island No: 26955
ggttttttaattcgaggttggagatatcgggattttaaaatgggaatttatttatttcgtttttataggataaacgcgtgtataatttggtttcgggttgtatttaggtagtgtcgggaatttcgagttttcgggtcgtttttatttagttttggtcgttttattaaggacgagggtcggtttttgttatttcgcgatttacgcgtatatattcgttttaggttcgtcgtgttcgatgtcgcgggtttgtaaagttttcgcggtcgtttatttgggggtaattagcgaggggtacgtttagaggttgcggggtttcgggcgtttaggttgcgcgggcgaagtttcggttatgtacgggtcgtcgagatcggttgggtaagtaagagtagtcgggtcgtttcgacgttggttgtgcgattgttgtcgcgggggcgggtagggggttcggcgggtcgtatttatcgtttatgttttttcggtcgttgatgtgttgtaggttgtagttcgtgttttcgcggtttaggttcgtgtttggtcggtaggattttagtcgggagtgggtattttttcggagtttgggattggacgatacgtagtacgaggtagtgttttttattttcggcggtttttcgatttttgttgttattttgtttttttagttttcgggagcggg

SEQ ID NO: 26956 - DNA, 673 bp, Artificial Sequence
  chemically treated genomic DNA (Homo sapiens) CpG-island No: 26956
cccgctcccgaaaactaaaaaaacaaaataacaacaaaaatcgaaaaaccgccgaaaataaaaaacactacctcgtactacgtatcgtccaatcccaaactccgaaaaaatacccactcccgactaaaatcctaccgaccaaacacgaacctaaaccgcgaaaacacgaactacaacctacaacacatcaacgaccgaaaaaacataaacgataaatacgacccgccgaaccccctacccgcccccgcgacaacaatcgcacaaccaacgtcgaaacgacccgactactcttacttacccaaccgatctcgacgacccgtacataaccgaaacttcgcccgcgcaacctaaacgcccgaaaccccgcaacctctaaacgtacccctcgctaattacccccaaataaacgaccgcgaaaactttacaaacccgcgacatcgaacacgacgaacctaaaacgaatatatacgcgtaaatcgcgaaataacaaaaaccgaccctcgtccttaataaaacgaccaaaactaaataaaaacgacccgaaaactcgaaattcccgacactacctaaatacaacccgaaaccaaattatacacgcgtttatcctataaaaacgaaataaataaattcccattttaaaatcccgatatctccaacctcgaattaaaaaacc

SEQ ID NO: 26957 - DNA, 517 bp, Artificial Sequence
  chemically treated genomic DNA (Homo sapiens) CpG-island No: 26957
acggcgggattagtcgacgagcgggcgggtagcgggcgtgggcgtagttttcggatttttcgcggcgcggtgcggcgcggttagggaggatgttggcggttttttttcgttagcggcgttcgttttcgtcgtagttttcgtttcgtttcgttatcgttttttttttttgttttggaagtagatcggcggtcgcggggaggttcggggcggcgtagtttcgcgcggttgtgggatcgttttcgggggtcgtttttttttcgggtattggggtcgcgggagacgtcgtcgggagttcggtttttggaggtttttttttattcggtttttgttttttttattttttcgggttggacggaacggggtttagcgcgggatgcgaggtgcgttttcggggttcgtagcgggcgggagcgtagttagggttcggtcggggacgtaggtttagggcgttgaggttgtatttgttttttcgaaatcgggttggttttttttgtttttttatttttttaatttattt

SEQ ID NO: 26958 - DNA, 517 bp, Artificial Sequence
  chemically treated genomic DNA (Homo sapiens) CpG-island No: 26958
aaataaattaaaaaaataaaaaaacaaaaaaaaccaacccgatttcgaaaaaacaaatacaacctcaacgccctaaacctacgtccccgaccgaaccctaactacgctcccgcccgctacgaaccccgaaaacgcacctcgcatcccgcgctaaaccccgttccgtccaacccgaaaaaataaaaaaaacaaaaaccgaataaaaaaaaacctccaaaaaccgaactcccgacgacgtctcccgcgaccccaatacccgaaaaaaaaacgacccccgaaaacgatcccacaaccgcgcgaaactacgccgccccgaacctccccgcgaccgccgatctacttccaaaacaaaaaaaaaaaacgataacgaaacgaaacgaaaactacgacgaaaacgaacgccgctaacgaaaaaaaaccgccaacatcctccctaaccgcgccgcaccgcgccgcgaaaaatccgaaaactacgcccacgcccgctacccgcccgctcgtcgactaatcccgccgt

SEQ ID NO: 26959 - DNA, 517 bp, Artificial Sequence
  chemically treated genomic DNA (Homo sapiens) CpG-island No: 26959
aaataaattagaaaaataaaaagataaaaagagttagttcggtttcggagaggtaggtgtagttttagcgttttgggtttgcgttttcgatcgggttttggttgcgttttcgttcgttgcgggtttcggggacgtatttcgtatttcgcgttgggtttcgtttcgtttagttcgggggagtggaggaggtagaggtcgggtggggaagggtttttagaaatcgagttttcgacgacgtttttcgcgattttagtgttcgagagaggagcggttttcgggagcgattttataatcgcgcggggttgcgtcgtttcgaattttttcgcggtcgtcgatttgtttttagggtagagggaaggggcggtgacggggcggggcgggggttgcggcgagggcgggcgtcgttggcgagggagggtcgttagtattttttttggtcgcgtcgtatcgcgtcgcgaggagttcgggggttgcgtttacgttcgttgttcgttcgttcgtcggttagtttcgtcgt

SEQ ID NO: 26960 - DNA, 517 bp, Artificial Sequence
  chemically treated genomic DNA (Homo sapiens) CpG-island No: 26960
acgacgaaactaaccgacgaacgaacgaacaacgaacgtaaacgcaacccccgaactcctcgcgacgcgatacgacgcgaccaaaaaaaatactaacgaccctccctcgccaacgacgcccgccctcgccgcaacccccgccccgccccgtcaccgccccttccctctaccctaaaaacaaatcgacgaccgcgaaaaaattcgaaacgacgcaaccccgcgcgattataaaatcgctcccgaaaaccgctcctctctcgaacactaaaatcgcgaaaaacgtcgtcgaaaactcgatttctaaaaacccttccccacccgacctctacctcctccactcccccgaactaaacgaaacgaaacccaacgcgaaatacgaaatacgtccccgaaacccgcaacgaacgaaaacgcaaccaaaacccgatcgaaaacgcaaacccaaaacgctaaaactacacctacctctccgaaaccgaactaactctttttatctttttatttttctaatttattt

SEQ ID NO: 26961 - DNA, 1182 bp, Artificial Sequence
  chemically treated genomic DNA (Homo sapiens) CpG-island No: 26961
cgtgtaggtttttcgcgttttttttcgggtcgggtatttggtagagtcgcgtttttcgcgttttcggttttcgcgttttcggttttcgcgttttgttttttcggggtttcgcgcgttcgtcgtttcgtttttttttgggtcgtcggttttacgggcggcgggggcgagggcggggcgtatcggggtgcggggttttcggcgttcgacgattttgacgacgtcgagtttttcgaggagtcggtcgggttttagtcgttttagagttagggcgcgtgcgtttgttttagtagtcggcggtttaggcggtagtgtagtagttcgcggtagtacggttcgtattttttttagcgcggtttttggtagcgttttatgtattcgttttttatttcgtttttcggggatatggtgtcgttcgtcgtttcgagcgttagtcgtttttcgttgttcgtagtttacgggattcggtatacgatatagaggtcgtttcgttttttcgtcggttttgttcgtcgcgacgtttaaattcggagtttcgttcggacgggagtagggggcgggtttcggcgagggcggggagggggcggggcgggggcggttttattcggcggtcgggattaagagtagaggcggggatcggggttgttggggtcgaggggcgcgtcgtcgaggagggttgtttagtgggcggaaggtagggaggttgcgggttggggcgaggggatcgtaggagattggggttgagcgggaggaggagcgagggaggggagcggcggggttcgtgatcgggtggttttggggttttcggaggcgttttttgagttaggcgtgcggtttcgcggggttgttttatttttttttcgtcgcgttcggtcgattttttgcgtttaggttcgaggcgcgcgtggcgtagtagttaaagcgtagttcgttttttcgcgcgttttttttttgagtaagatgtcgtcgcggcggttcgcgttttagttgtaggcgggaggcggtggcgtcgttttagtttcggagtttttacgcgcgttttcggttttcgggttttcgttcgtttcgtgggggcggttgttttcgtagagagcgcgaggcgcgggggtgcgggcgtgtttgttagttcgaggggtttaggtttaggtttttggtttatttatttgaggtgttcgtttattttgg

SEQ ID NO: 26962 - DNA, 1182 bp, Artificial Sequence
  chemically treated genomic DNA (Homo sapiens) CpG-island No: 26962
ccaaaataaacgaacacctcaaataaataaaccaaaaacctaaacctaaacccctcgaactaacaaacacgcccgcacccccgcgcctcgcgctctctacgaaaacaaccgcccccacgaaacgaacgaaaacccgaaaaccgaaaacgcgcgtaaaaactccgaaactaaaacgacgccaccgcctcccgcctacaactaaaacgcgaaccgccgcgacgacatcttactcaaaaaaaaaacgcgcgaaaaaacgaactacgctttaactactacgccacgcgcgcctcgaacctaaacgcaaaaaatcgaccgaacgcgacgaaaaaaaaataaaacaaccccgcgaaaccgcacgcctaactcaaaaaacgcctccgaaaaccccaaaaccacccgatcacgaaccccgccgctcccctccctcgctcctcctcccgctcaaccccaatctcctacgatcccctcgccccaacccgcaacctccctaccttccgcccactaaacaaccctcctcgacgacgcgcccctcgaccccaacaaccccgatccccgcctctactcttaatcccgaccgccgaataaaaccgcccccgccccgccccctccccgccctcgccgaaacccgccccctactcccgtccgaacgaaactccgaatttaaacgtcgcgacgaacaaaaccgacgaaaaaacgaaacgacctctatatcgtataccgaatcccgtaaactacgaacaacgaaaaacgactaacgctcgaaacgacgaacgacaccatatccccgaaaaacgaaataaaaaacgaatacataaaacgctaccaaaaaccgcgctaaaaaaaatacgaaccgtactaccgcgaactactacactaccgcctaaaccgccgactactaaaacaaacgcacgcgccctaactctaaaacgactaaaacccgaccgactcctcgaaaaactcgacgtcgtcaaaatcgtcgaacgccgaaaaccccgcaccccgatacgccccgccctcgcccccgccgcccgtaaaaccgacgacccaaaaaaaaacgaaacgacgaacgcgcgaaaccccgaaaaaacaaaacgcgaaaaccgaaaacgcgaaaaccgaaaacgcgaaaaacgcgactctaccaaatacccgacccgaaaaaaaacgcgaaaaacctacacg

SEQ ID NO: 26963 - DNA, 1182 bp, Artificial Sequence
  chemically treated genomic DNA (Homo sapiens) CpG-island No: 26963
ttagggtggacgggtattttaaataagtgggttagggatttgggtttgggtttttcggattggtaggtacgttcgtattttcgcgtttcgcgttttttacggaagtagtcgtttttacggagcgggcggaggttcgggggtcgggagcgcgcgtggaggtttcgggattgaggcggcgttatcgtttttcgtttgtagttggagcgcgggtcgtcgcggcgatattttgtttaggaggaaagcgcgcgggagagcgagttgcgttttagttgttgcgttacgcgcgtttcgggtttgggcgtagaggatcggtcgggcgcggcgggaaggaggtaaggtagtttcgcgggatcgtacgtttagtttaggggacgttttcggagattttaggattattcgattacgggtttcgtcgtttttttttttcgttttttttttcgtttagttttagttttttgcggttttttcgttttagttcgtagtttttttgtttttcgtttattgagtagtttttttcggcggcgcgtttttcgattttagtagtttcggttttcgtttttgtttttggtttcggtcgtcgggtgaggtcgttttcgtttcgtttttttttcgttttcgtcgggattcgttttttgttttcgttcgggcggggtttcgggtttaaacgtcgcggcgggtagggtcggcggaggggcggggcggtttttgtgtcgtgtatcgggtttcgtaggttgcgggtagcgaggagcggttggcgttcgaggcggcggacggtattatgttttcggggagcggggtgaagagcgagtatatgaagcgttattaggagtcgcgttgggaggagtacgggtcgtgttatcgcgagttgttgtattatcgtttaggtcgtcggttgttggagtaggcgtacgcgttttggttttgggacgattggggttcggtcggtttttcggaggattcggcgtcgttagagtcgtcgggcgtcgggggtttcgtatttcggtgcgtttcgttttcgttttcgtcgttcgtagagtcggcgatttaggaggaggcggaacggcgggcgcgcggggtttcggaggagtaggacgcggaggtcggggacgcggaggtcgaggacgcggaggacgcggttttgttaggtattcggttcggaggggagcgcgaggggtttgtacg

SEQ ID NO: 26964 - DNA, 1182 bp, Artificial Sequence
  chemically treated genomic DNA (Homo sapiens) CpG-island No: 26964
cgtacaaacccctcgcgctcccctccgaaccgaatacctaacaaaaccgcgtcctccgcgtcctcgacctccgcgtccccgacctccgcgtcctactcctccgaaaccccgcgcgcccgccgttccgcctcctcctaaatcgccgactctacgaacgacgaaaacgaaaacgaaacgcaccgaaatacgaaacccccgacgcccgacgactctaacgacgccgaatcctccgaaaaaccgaccgaaccccaatcgtcccaaaaccaaaacgcgtacgcctactccaacaaccgacgacctaaacgataatacaacaactcgcgataacacgacccgtactcctcccaacgcgactcctaataacgcttcatatactcgctcttcaccccgctccccgaaaacataataccgtccgccgcctcgaacgccaaccgctcctcgctacccgcaacctacgaaacccgatacacgacacaaaaaccgccccgcccctccgccgaccctacccgccgcgacgtttaaacccgaaaccccgcccgaacgaaaacaaaaaacgaatcccgacgaaaacgaaaaaaaaacgaaacgaaaacgacctcacccgacgaccgaaaccaaaaacaaaaacgaaaaccgaaactactaaaatcgaaaaacgcgccgccgaaaaaaactactcaataaacgaaaaacaaaaaaactacgaactaaaacgaaaaaaccgcaaaaaactaaaactaaacgaaaaaaaaaacgaaaaaaaaaaacgacgaaacccgtaatcgaataatcctaaaatctccgaaaacgtcccctaaactaaacgtacgatcccgcgaaactaccttacctccttcccgccgcgcccgaccgatcctctacgcccaaacccgaaacgcgcgtaacgcaacaactaaaacgcaactcgctctcccgcgcgctttcctcctaaacaaaatatcgccgcgacgacccgcgctccaactacaaacgaaaaacgataacgccgcctcaatcccgaaacctccacgcgcgctcccgacccccgaacctccgcccgctccgtaaaaacgactacttccgtaaaaaacgcgaaacgcgaaaatacgaacgtacctaccaatccgaaaaacccaaacccaaatccctaacccacttatttaaaatacccgtccaccctaa

SEQ ID NO: 26965 - DNA, 662 bp, Artificial Sequence
  chemically treated genomic DNA (Homo sapiens) CpG-island No: 26965
gttgcggtcgtagtagtcggagtcggagtcgtagttatcggtgtttttttttttcgtcgtcgtttagtcgtcgttcggtttttttcgggttcgagcgtagattaggttttagtcgcgcggcgtcggtagtttcgcgttttttttcgggtttttttcgggtttcgggtatcgcgttttgtggggcggtcgtttgtttgttcgttcgttcgtagttttttcgttgcgcggtttttgggcggtcgttgttatgggtatcgatagtcgcgcggttaaggcgtttttggcgcgggttcgtattttgtatttgtagacggggaatttgttgaattggggtcgtttgcggaagaagtgttcgtttacgtatagcgaggaggtgagcgtggcgatattcgtcgcggggttttcggggtaggtttcgggcggggtcgggcggtttcggtaagggagaagcgttcgcgggcgagggagggtggtagggtttcgcgcgtatttgggtttcgttcgcggttagatgttgaggttagtgtcgacgcgattttgggtttaaattcgttgtcgagggtaacgcgtttaaaaaatttagtcggtgtagttgcgtattgagtgatatttttttcggtgtttaaggttggtagtaaaatttttaaatattttgggttttt

SEQ ID NO: 26966 - DNA, 662 bp, Artificial Sequence
  chemically treated genomic DNA (Homo sapiens) CpG-island No: 26966
aaaaacccaaaatatttaaaaattttactaccaaccttaaacaccgaaaaaaatatcactcaatacgcaactacaccgactaaattttttaaacgcgttaccctcgacaacgaatttaaacccaaaatcgcgtcgacactaacctcaacatctaaccgcgaacgaaacccaaatacgcgcgaaaccctaccaccctccctcgcccgcgaacgcttctcccttaccgaaaccgcccgaccccgcccgaaacctaccccgaaaaccccgcgacgaatatcgccacgctcacctcctcgctatacgtaaacgaacacttcttccgcaaacgaccccaattcaacaaattccccgtctacaaatacaaaatacgaacccgcgccaaaaacgccttaaccgcgcgactatcgatacccataacaacgaccgcccaaaaaccgcgcaacgaaaaaactacgaacgaacgaacaaacaaacgaccgccccacaaaacgcgatacccgaaacccgaaaaaaacccgaaaaaaaacgcgaaactaccgacgccgcgcgactaaaacctaatctacgctcgaacccgaaaaaaaccgaacgacgactaaacgacgacgaaaaaaaaaaacaccgataactacgactccgactccgactactacgaccgcaac

SEQ ID NO: 26967 - DNA, 662 bp, Artificial Sequence
  chemically treated genomic DNA (Homo sapiens) CpG-island No: 26967
agggatttaggatgtttgagagttttgttattagttttaagtatcgagagaggtgttatttagtgcgtagttgtatcggttaagttttttagacgcgttgttttcggtagcgggtttggatttaaggtcgcgtcgatattggttttagtatttgatcgcgggcggagtttaggtgcgcgcgaggttttgttattttttttcgttcgcgggcgttttttttttgtcggaatcgttcggtttcgttcgaggtttgtttcgggagtttcgcggcgagtgtcgttacgtttattttttcgttgtgcgtggacgggtatttttttcgtaggcggttttagtttagtaggtttttcgtttgtaggtgtagggtgcgggttcgcgttaggagcgttttggtcgcgcggttgtcggtgtttatggtagcggtcgtttaggggtcgcgtagcgaaggggttgcgggcgggcgggtaggtaggcggtcgttttataggacgcggtgttcgaggttcgagagagattcgagagggagcgcgaggttgtcggcgtcgcgcggttggagtttggtttgcgttcgggttcgagggaggtcggacggcggttgggcggcggcgggaaaggaaggtatcggtggttgcggtttcggtttcggttattgcggtcgtagt

SEQ ID NO: 26968 - DNA, 662 bp, Artificial Sequence
  chemically treated genomic DNA (Homo sapiens) CpG-island No: 26968
actacgaccgcaataaccgaaaccgaaaccgcaaccaccgataccttcctttcccgccgccgcccaaccgccgtccgacctccctcgaacccgaacgcaaaccaaactccaaccgcgcgacgccgacaacctcgcgctccctctcgaatctctctcgaacctcgaacaccgcgtcctataaaacgaccgcctacctacccgcccgcccgcaaccccttcgctacgcgacccctaaacgaccgctaccataaacaccgacaaccgcgcgaccaaaacgctcctaacgcgaacccgcaccctacacctacaaacgaaaaacctactaaactaaaaccgcctacgaaaaaaatacccgtccacgcacaacgaaaaaataaacgtaacgacactcgccgcgaaactcccgaaacaaacctcgaacgaaaccgaacgattccgacaaaaaaaaaacgcccgcgaacgaaaaaaaataacaaaacctcgcgcgcacctaaactccgcccgcgatcaaatactaaaaccaatatcgacgcgaccttaaatccaaacccgctaccgaaaacaacgcgtctaaaaaacttaaccgatacaactacgcactaaataacacctctctcgatacttaaaactaataacaaaactctcaaacatcctaaatccct

SEQ ID NO: 26969 - DNA, 578 bp, Artificial Sequence
  chemically treated genomic DNA (Homo sapiens) CpG-island No: 26969
agatttcgcgggtcgtttttatgaattgtcggtagttttggtagacgttgcgttttaggttttgcgtcgtttttttcgttagcgtttggatgcgttgtcggtgtttttggaggtttcggtttttattcgattgttgcgagagttgttttacgtatagtcgcgttttaaaattttttgattttagttgtcgacgtaggcggttcgttttattgttcgatatcgttatcgttattttttttcgggttttacgtatttattgttattatcggcgtcgtagtcgtcgcggttgtttagatttatttaaggttaatcgagtttttgggttgaggaagtaggaatgggaacgagacgagtacgtttgcgtcgggtttgagcgttagatattgcgtttgcgtaagtgggtcgagcgtagatattgcgtttgcgtagtaatgttatcggttaaagcgtatgcgtaagatgagttattgcggaagtgaggggagggagaggtcgagagaaatttcggtattgcgtatgaatcgagcgtgacgttgaggtttgaaataatcggtaaagagtaaaggttgaaattagtt

SEQ ID NO: 26970 - DNA, 578 bp, Artificial Sequence
  chemically treated genomic DNA (Homo sapiens) CpG-island No: 26970
aactaatttcaacctttactctttaccgattatttcaaacctcaacgtcacgctcgattcatacgcaataccgaaatttctctcgacctctccctcccctcacttccgcaataactcatcttacgcatacgctttaaccgataacattactacgcaaacgcaatatctacgctcgacccacttacgcaaacgcaatatctaacgctcaaacccgacgcaaacgtactcgtctcgttcccattcctacttcctcaacccaaaaactcgattaaccttaaataaatctaaacaaccgcgacgactacgacgccgataataacaataaatacgtaaaacccgaaaaaaaataacgataacgatatcgaacaataaaacgaaccgcctacgtcgacaactaaaatcaaaaaattttaaaacgcgactatacgtaaaacaactctcgcaacaatcgaataaaaaccgaaacctccaaaaacaccgacaacgcatccaaacgctaacgaaaaaaacgacgcaaaacctaaaacgcaacgtctaccaaaactaccgacaattcataaaaacgacccgcgaaatct

SEQ ID NO: 26971 - DNA, 578 bp, Artificial Sequence
  chemically treated genomic DNA (Homo sapiens) CpG-island No: 26971
agttagttttagtttttattttttgtcggttattttaaattttaacgttacgttcggtttatgcgtagtatcgaaatttttttcggtttttttttttttttattttcgtaatagtttattttgcgtatgcgttttaatcgatggtattgttgcgtaggcgtaatgtttgcgttcggtttatttgcgtaggcgtagtgtttgacgtttagattcggcgtaggcgtattcgtttcgtttttatttttgtttttttagtttaggagttcggttggttttgggtgggtttagatagtcgcggcggttgcggcgtcgatagtgatagtgagtgcgtgagattcggagagaaatggcgatggcgatgtcggatagtggggcgagtcgtttgcgtcggtagttggagttagggggttttgaggcgcggttgtacgtgaagtagttttcgtagtagtcggatggggatcgggatttttaggagtatcggtagcgtatttaggcgttggcggaggagacggcgtagaatttgaagcgtaacgtttattagaattatcggtagtttatagagacggttcgcgagattt

SEQ ID NO: 26972 - DNA, 578 bp, Artificial Sequence
  chemically treated genomic DNA (Homo sapiens) CpG-island No: 26972
aaatctcgcgaaccgtctctataaactaccgataattctaataaacgttacgcttcaaattctacgccgtctcctccgccaacgcctaaatacgctaccgatactcctaaaaatcccgatccccatccgactactacgaaaactacttcacgtacaaccgcgcctcaaaaccccctaactccaactaccgacgcaaacgactcgccccactatccgacatcgccatcgccatttctctccgaatctcacgcactcactatcactatcgacgccgcaaccgccgcgactatctaaacccacccaaaaccaaccgaactcctaaactaaaaaaacaaaaataaaaacgaaacgaatacgcctacgccgaatctaaacgtcaaacactacgcctacgcaaataaaccgaacgcaaacattacgcctacgcaacaataccatcgattaaaacgcatacgcaaaataaactattacgaaaataaaaaaaaaaaaaaaccgaaaaaaatttcgatactacgcataaaccgaacgtaacgttaaaatttaaaataaccgacaaaaaataaaaactaaaactaact

SEQ ID NO: 26973 - DNA, 674 bp, Artificial Sequence
  chemically treated genomic DNA (Homo sapiens) CpG-island No: 26973
agcgcgagacggtttgatttttgttattaagataagaagaggtttggaaaaaatgtaaaattatcgtttttttggttgtatcgggagacgggcggttgtttatcgtttcgtatacgcgggtgcgttcggagttcgttcgcgtagatacgtttgtgcgcggggcgggggttttcggcgcggttcggagcgggtttatttgttcggcgagggttttcgtttcgttagtcgttgatttttaatttgttattttttcggttgaaaggcggtcgcgggaaaggacgtttttcgtttcgtttatttaaagcgtgaatgtaaagtggtttaagttgattcgtcgttagtttttgcggtttcgagtcggcgaggtattttatagtttatatagttcggttttaatgtagtttttaggcgttttatttaggcgggtttgtatgtaaaagagtcggttattagattatcgtaattattttattgatatcgtttagggttttcgtggggtacgggagcgtattaaacgcgtttttaatgaggcgtttcgggtttattgtgcgcgtcgtcgtttttcgcgttcgtcgtcgtttcggtcgtagataggcggttttttttaggcgtatttattttttttgattttcgatttttagggttatgatattagtagttttgatttgtgatta

SEQ ID NO: 26974 - DNA, 674 bp, Artificial Sequence
  chemically treated genomic DNA (Homo sapiens) CpG-island No: 26974
taatcacaaatcaaaactactaatatcataaccctaaaaatcgaaaatcaaaaaaaataaatacgcctaaaaaaaaccgcctatctacgaccgaaacgacgacgaacgcgaaaaacgacgacgcgcacaataaacccgaaacgcctcattaaaaacgcgtttaatacgctcccgtaccccacgaaaaccctaaacgatatcaataaaataattacgataatctaataaccgactcttttacatacaaacccgcctaaataaaacgcctaaaaactacattaaaaccgaactatataaactataaaatacctcgccgactcgaaaccgcaaaaactaacgacgaatcaacttaaaccactttacattcacgctttaaataaacgaaacgaaaaacgtcctttcccgcgaccgcctttcaaccgaaaaaataacaaattaaaaatcaacgactaacgaaacgaaaaccctcgccgaacaaataaacccgctccgaaccgcgccgaaaacccccgccccgcgcacaaacgtatctacgcgaacgaactccgaacgcacccgcgtatacgaaacgataaacaaccgcccgtctcccgatacaaccaaaaaaacgataattttacattttttccaaacctcttcttatcttaataacaaaaatcaaaccgtctcgcgct

SEQ ID NO: 26975 - DNA, 674 bp, Artificial Sequence
  chemically treated genomic DNA (Homo sapiens) CpG-island No: 26975
tggttataaattagggttgttgatgttataattttgggggtcgggggttagggggagtgaatgcgtttgaaagggatcgtttgtttgcggtcggagcggcggcgggcgcggggggcgacggcgcgtataatgggttcggagcgttttattagagacgcgtttgatgcgttttcgtgttttacgggggttttgggcgatgttaatgggataattacgatgatttaatggtcggtttttttgtatgtaggttcgtttgaatggggcgtttggaggttgtattgaggtcgggttgtgtaaattgtagggtgtttcgtcgattcggagtcgtagagattggcggcgggttaatttggattattttgtatttacgttttgaataggcggagcgggaggcgttttttttcgcggtcgttttttagtcgagagagtgatagattggaggttagcggttggcgggacggaagttttcgtcgggtagatggattcgtttcgggtcgcgtcggggattttcgtttcgcgtataggcgtgtttacgcggacgggtttcgagcgtattcgcgtgtgcgaggcgatgggtagtcgttcgtttttcgatgtagttaagagaacggtggttttgtattttttttaaatttttttttgttttaatgataagagttaaatcgtttcgcgtt

SEQ ID NO: 26976 - DNA, 674 bp, Artificial Sequence
  chemically treated genomic DNA (Homo sapiens) CpG-island No: 26976
aacgcgaaacgatttaactcttatcattaaaacaaaaaaaaatttaaaaaaaatacaaaaccaccgttctcttaactacatcgaaaaacgaacgactacccatcgcctcgcacacgcgaatacgctcgaaacccgtccgcgtaaacacgcctatacgcgaaacgaaaatccccgacgcgacccgaaacgaatccatctacccgacgaaaacttccgtcccgccaaccgctaacctccaatctatcactctctcgactaaaaaacgaccgcgaaaaaaaacgcctcccgctccgcctattcaaaacgtaaatacaaaataatccaaattaacccgccgccaatctctacgactccgaatcgacgaaacaccctacaatttacacaacccgacctcaatacaacctccaaacgccccattcaaacgaacctacatacaaaaaaaccgaccattaaatcatcgtaattatcccattaacatcgcccaaaacccccgtaaaacacgaaaacgcatcaaacgcgtctctaataaaacgctccgaacccattatacgcgccgtcgccccccgcgcccgccgccgctccgaccgcaaacaaacgatccctttcaaacgcattcactccccctaacccccgacccccaaaattataacatcaacaaccctaatttataacca

SEQ ID NO: 26977 - DNA, 674 bp, Artificial Sequence
  chemically treated genomic DNA (Homo sapiens) CpG-island No: 26977
cggagcggcggcgggcgcggggggcgacggcgcgtataatgggttcggagcgttttattagagacgcgtttgatgcgttttcgtgttttacgggggttttgggcgatgttaatgggataattacgatgatttaatggtcggtttttttgtatgtaggttcgtttgaatggggcgtttggaggttgtattgaggtcgggttgtgtaaattgtagggtgtttcgtcgattcggagtcgtagagattggcggcgggttaatttggattattttgtatttacgttttgaataggcggagcgggaggcgttttttttcgcggtcgttttttagtcgagagagtgatagattggaggttagcggttggcgggacggaagttttcgtcgggtagatggattcgtttcgggtcgcgtcggggattttcgtttcgcgtataggcgtgtttacgcggacgggtttcgagcgtattcgcgtgtgcgaggcgatgggtagtcgttcgtttttcgatgtagttaagagaacggtggttttgtattttttttaaatttttttttgttttaatgataagagttaaatcgtttcgcgtttggtttttttttcggtatttgtgcgtttttttagaagtcgatttggtttcggttaagggtattcgtagagtagtttttattttttaatatt

SEQ ID NO: 26978 - DNA, 674 bp, Artificial Sequence
  chemically treated genomic DNA (Homo sapiens) CpG-island No: 26978
aatattaaaaaataaaaactactctacgaatacccttaaccgaaaccaaatcgacttctaaaaaaacgcacaaataccgaaaaaaaaaccaaacgcgaaacgatttaactcttatcattaaaacaaaaaaaaatttaaaaaaaatacaaaaccaccgttctcttaactacatcgaaaaacgaacgactacccatcgcctcgcacacgcgaatacgctcgaaacccgtccgcgtaaacacgcctatacgcgaaacgaaaatccccgacgcgacccgaaacgaatccatctacccgacgaaaacttccgtcccgccaaccgctaacctccaatctatcactctctcgactaaaaaacgaccgcgaaaaaaaacgcctcccgctccgcctattcaaaacgtaaatacaaaataatccaaattaacccgccgccaatctctacgactccgaatcgacgaaacaccctacaatttacacaacccgacctcaatacaacctccaaacgccccattcaaacgaacctacatacaaaaaaaccgaccattaaatcatcgtaattatcccattaacatcgcccaaaacccccgtaaaacacgaaaacgcatcaaacgcgtctctaataaaacgctccgaacccattatacgcgccgtcgccccccgcgcccgccgccgctccg

SEQ ID NO: 26979 - DNA, 674 bp, Artificial Sequence
  chemically treated genomic DNA (Homo sapiens) CpG-island No: 26979
aatattggagggtaggggttgttttgcgggtgtttttggtcggggttaagtcggtttttggggaaacgtataggtgtcgggaggggagttaagcgcgagacggtttgatttttgttattaagataagaagaggtttggaaaaaatgtaaaattatcgtttttttggttgtatcgggagacgggcggttgtttatcgtttcgtatacgcgggtgcgttcggagttcgttcgcgtagatacgtttgtgcgcggggcgggggttttcggcgcggttcggagcgggtttatttgttcggcgagggttttcgtttcgttagtcgttgatttttaatttgttattttttcggttgaaaggcggtcgcgggaaaggacgtttttcgtttcgtttatttaaagcgtgaatgtaaagtggtttaagttgattcgtcgttagtttttgcggtttcgagtcggcgaggtattttatagtttatatagttcggttttaatgtagtttttaggcgttttatttaggcgggtttgtatgtaaaagagtcggttattagattatcgtaattattttattgatatcgtttagggttttcgtggggtacgggagcgtattaaacgcgtttttaatgaggcgtttcgggtttattgtgcgcgtcgtcgtttttcgcgttcgtcgtcgtttcg

SEQ ID NO: 26980 - DNA, 674 bp, Artificial Sequence
  chemically treated genomic DNA (Homo sapiens) CpG-island No: 26980
cgaaacgacgacgaacgcgaaaaacgacgacgcgcacaataaacccgaaacgcctcattaaaaacgcgtttaatacgctcccgtaccccacgaaaaccctaaacgatatcaataaaataattacgataatctaataaccgactcttttacatacaaacccgcctaaataaaacgcctaaaaactacattaaaaccgaactatataaactataaaatacctcgccgactcgaaaccgcaaaaactaacgacgaatcaacttaaaccactttacattcacgctttaaataaacgaaacgaaaaacgtcctttcccgcgaccgcctttcaaccgaaaaaataacaaattaaaaatcaacgactaacgaaacgaaaaccctcgccgaacaaataaacccgctccgaaccgcgccgaaaacccccgccccgcgcacaaacgtatctacgcgaacgaactccgaacgcacccgcgtatacgaaacgataaacaaccgcccgtctcccgatacaaccaaaaaaacgataattttacattttttccaaacctcttcttatcttaataacaaaaatcaaaccgtctcgcgcttaactcccctcccgacacctatacgtttccccaaaaaccgacttaaccccgaccaaaaacacccgcaaaacaacccctaccctccaatatt

SEQ ID NO: 26981 - DNA, 556 bp, Artificial Sequence
  chemically treated genomic DNA (Homo sapiens) CpG-island No: 26981
agattcggcgaggcgcgttgggggagatttatagagtacgtaattttttttgttttttggatggttggggttcgtcggtttttgggggaggcgttttagcgatataagatgcgatcgttcgtaggaacgtatgtcgtttgtgaaaacgagaagaaatgagatcggcgggttggaagggacgtcgtttcgagcgtagcgaacgtttttttttttaggaagtacgacgggggagcgttttttttaggttttttaggtattttcgtatagttaggtattcgtaaggatgggacggaagtggtgtaagcgtttacgttttttttggttttcgttttttcgtcggtataaggatgatttagtggtcggatttggattttatttcggtcgttagggcgttgatttcgtcgttgagggtgttgagcggagttcggatcggtagttttcggttttcgggggttttaatttcggatttcgagtttagttttaattgaaggtttttgatgtagtcgatgacgtgttggagaatttttattttgtttattttgcggttttggggtag

SEQ ID NO: 26982 - DNA, 556 bp, Artificial Sequence
  chemically treated genomic DNA (Homo sapiens) CpG-island No: 26982
ctaccccaaaaccgcaaaataaacaaaataaaaattctccaacacgtcatcgactacatcaaaaaccttcaattaaaactaaactcgaaatccgaaattaaaacccccgaaaaccgaaaactaccgatccgaactccgctcaacaccctcaacgacgaaatcaacgccctaacgaccgaaataaaatccaaatccgaccactaaatcatccttataccgacgaaaaaacgaaaaccaaaaaaaacgtaaacgcttacaccacttccgtcccatccttacgaatacctaactatacgaaaatacctaaaaaacctaaaaaaaacgctcccccgtcgtacttcctaaaaaaaaaaacgttcgctacgctcgaaacgacgtcccttccaacccgccgatctcatttcttctcgttttcacaaacgacatacgttcctacgaacgatcgcatcttatatcgctaaaacgcctcccccaaaaaccgacgaaccccaaccatccaaaaaacaaaaaaaattacgtactctataaatctcccccaacgcgcctcgccgaatct

SEQ ID NO: 26983 - DNA, 556 bp, Artificial Sequence
  chemically treated genomic DNA (Homo sapiens) CpG-island No: 26983
ttgttttagaatcgtaaggtgagtaaggtggagattttttagtacgttatcgattatattagggatttttagttggagttgaattcggaattcgaagttggaattttcgggggtcgagggttgtcggttcgggtttcgtttagtatttttaacggcgagattagcgttttgacggtcgaggtgagatttagattcgattattagattatttttatatcgacggggaaacggaggttagagagggcgtgggcgtttgtattattttcgttttatttttgcgggtatttggttatgcgggggtgtttaaggagtttggaaaaagcgttttttcgtcgtgttttttggggaagggggcgttcgttgcgttcggagcggcgttttttttaattcgtcggttttattttttttcgtttttataggcggtatgcgtttttgcggacgatcgtattttgtgtcgttgaagcgttttttttagggatcggcggattttagttatttagggggtaagaggaattacgtgttttgtgggttttttttaacgcgtttcgtcggattt

SEQ ID NO: 26984 - DNA, 556 bp, Artificial Sequence
  chemically treated genomic DNA (Homo sapiens) CpG-island No: 26984
aaatccgacgaaacgcgttaaaaaaaacccacaaaacacgtaattcctcttaccccctaaataactaaaatccgccgatccctaaaaaaaacgcttcaacgacacaaaatacgatcgtccgcaaaaacgcataccgcctataaaaacgaaaaaaaataaaaccgacgaattaaaaaaaacgccgctccgaacgcaacgaacgcccccttccccaaaaaacacgacgaaaaaacgctttttccaaactccttaaacacccccgcataaccaaatacccgcaaaaataaaacgaaaataatacaaacgcccacgccctctctaacctccgtttccccgtcgatataaaaataatctaataatcgaatctaaatctcacctcgaccgtcaaaacgctaatctcgccgttaaaaatactaaacgaaacccgaaccgacaaccctcgacccccgaaaattccaacttcgaattccgaattcaactccaactaaaaatccctaatataatcgataacgtactaaaaaatctccaccttactcaccttacgattctaaaacaa

SEQ ID NO: 26985 - DNA, 588 bp, Artificial Sequence
  chemically treated genomic DNA (Homo sapiens) CpG-island No: 26985
ttatttaaggcgcgtattttttttgcgtttcgggttcgcgcgcgttgtcgcggtatcggaagtgattgagtttgtaagtttttttgtttttttaggggaaattgaggtcggtttgttcgggagagacggcgcgagtagttagttaggtaggtcggtagttaggtaggtcggttcgggttcgcggcgcggaattcggtcgcgaagagtttttgcgtttggaagttatcgggtcgatgaagggggatgtggttttttacggttcgcggggttcgtaggtgagagcgtcgttttttttgtgcgtgatagtcgttgcgtttaataggagttttcgtcgtttcgttttcgtgtcggttgggttcgttgattggttgcgttggggcggatcgtcgggggcgaggtttttttttttaggaaggtttagggggcgttttcgggggagggcggttgtttagtaacggggcggtggttcggcgggtattcggtttagtgagttcgagaagtcgttaggtcgtagtcggtttattttgggtttcggagaggtgtagttttcggtttcggagttttttcgggggcgttagaaagttattt

SEQ ID NO: 26986 - DNA, 588 bp, Artificial Sequence
  chemically treated genomic DNA (Homo sapiens) CpG-island No: 26986
aaataactttctaacgcccccgaaaaaactccgaaaccgaaaactacacctctccgaaacccaaaataaaccgactacgacctaacgacttctcgaactcactaaaccgaatacccgccgaaccaccgccccgttactaaacaaccgccctcccccgaaaacgccccctaaaccttcctaaaaaaaaaaacctcgcccccgacgatccgccccaacgcaaccaatcaacgaacccaaccgacacgaaaacgaaacgacgaaaactcctattaaacgcaacgactatcacgcacaaaaaaaacgacgctctcacctacgaaccccgcgaaccgtaaaaaaccacatcccccttcatcgacccgataacttccaaacgcaaaaactcttcgcgaccgaattccgcgccgcgaacccgaaccgacctacctaactaccgacctacctaactaactactcgcgccgtctctcccgaacaaaccgacctcaatttcccctaaaaaaacaaaaaaacttacaaactcaatcacttccgataccgcgacaacgcgcgcgaacccgaaacgcaaaaaaaatacgcgccttaaataa

SEQ ID NO: 26987 - DNA, 588 bp, Artificial Sequence
  chemically treated genomic DNA (Homo sapiens) CpG-island No: 26987
aagtggttttttggcgttttcgggagggtttcggggtcgggggttgtattttttcggagtttagggtgggtcggttgcggtttagcggtttttcgagtttattaggtcgggtattcgtcgagttatcgtttcgttgttaggtaatcgttttttttcgggggcgttttttagatttttttgagaggaggggtttcgttttcggcggttcgttttagcgtagttaattagcgagtttagtcggtacggaagcgggacggcgaaggtttttattgggcgtaacggttgttacgtataggggaggcggcgtttttatttgcgagtttcgcgagtcgtggggggttatatttttttttatcggttcggtagtttttagacgtaagagtttttcgcggtcgagtttcgcgtcgcggattcgggtcggtttatttggttgtcggtttatttggttgattgttcgcgtcgtttttttcgaataagtcggttttagttttttttgaagagataggggaatttgtaagtttagttattttcggtgtcgcggtaacgcgcgcgagttcgagacgtaaagggagtgcgcgttttgagtga

SEQ ID NO: 26988 - DNA, 588 bp, Artificial Sequence
  chemically treated genomic DNA (Homo sapiens) CpG-island No: 26988
tcactcaaaacgcgcactccctttacgtctcgaactcgcgcgcgttaccgcgacaccgaaaataactaaacttacaaattcccctatctcttcaaaaaaaactaaaaccgacttattcgaaaaaaacgacgcgaacaatcaaccaaataaaccgacaaccaaataaaccgacccgaatccgcgacgcgaaactcgaccgcgaaaaactcttacgtctaaaaactaccgaaccgataaaaaaaaatataaccccccacgactcgcgaaactcgcaaataaaaacgccgcctcccctatacgtaacaaccgttacgcccaataaaaaccttcgccgtcccgcttccgtaccgactaaactcgctaattaactacgctaaaacgaaccgccgaaaacgaaacccctcctctcaaaaaaatctaaaaaacgcccccgaaaaaaaacgattacctaacaacgaaacgataactcgacgaatacccgacctaataaactcgaaaaaccgctaaaccgcaaccgacccaccctaaactccgaaaaaatacaacccccgaccccgaaaccctcccgaaaacgccaaaaaaccactt

SEQ ID NO: 26989 - DNA, 1035 bp, Artificial Sequence
  chemically treated genomic DNA (Homo sapiens) CpG-island No: 26989
ggatttcggtcgttttttttttaagaggtaataataaaagtatttttttttcgttttaatatttcgtaggaaagtggttttattttcgggatttagtcgatcgtaggaaaaaagtacggttagttttatttattttatagacgttttcgtaggtgtcgttgtcgattttttggacgagttcgtagttttgttgcgggtttcgttttaggatgttcgcggtaggtcgtagcggggtttttatttttatttagggttcggttttcgttagtttatttcgcggttttcggattttcgttaataagtacgaacggcgtcgttttttaatatggagttttcgttcgtagtttcgtttgtacgagggacgagtaaaggttggttggcgtcgtaggttacgatttttagcggttcgcgttttcgcggttcggttttttttttttcgtttcgttaggggtcgtggaagagaaaggggtttggaagggttttcggcgtttcgtattttcgttcggtttgcggttttttttttttttcggtcgttcgcgaattgttcgacgaggttttttcgttagtcggggtttagggtcggtttcgtatttaatgggggcggtttcgtttttgttgagcgcggagttcgggatttattttttagatcgtattcgcgtttttttttcgcgcgtcggtcggtagtttcgggtttgtcgtcgtcgtcgtcgttatttagtcgttgtacggcgcgttttttcgggggcggcggaggcgcgtatagtcgtcgtcgtcgtcgtcgtcgtattacgttttttattcggggttgcgttatcgggagatacgtttttagttagtatgggtcggcgtttagcggttcgttcgagtatttcggtcgtagaattagagtgtcgttttgaggtttgttgagaatataatattttttcgatcgcgttatcgcgtttttttagtcgggcgcgtttttgtagggtttgggttgttttttttttatttttagaaataaggtatacgtttgggtattcgtgggttaacggg

SEQ ID NO: 26990 - DNA, 1035 bp, Artificial Sequence
  chemically treated genomic DNA (Homo sapiens) CpG-island No: 26990
cccgttaacccacgaatacccaaacgtataccttatttctaaaaataaaaaaaaaacaacccaaaccctacaaaaacgcgcccgactaaaaaaacgcgataacgcgatcgaaaaaatattatattctcaacaaacctcaaaacgacactctaattctacgaccgaaatactcgaacgaaccgctaaacgccgacccatactaactaaaaacgtatctcccgataacgcaaccccgaataaaaaacgtaatacgacgacgacgacgacgacgactatacgcgcctccgccgcccccgaaaaaacgcgccgtacaacgactaaataacgacgacgacgacgacaaacccgaaactaccgaccgacgcgcgaaaaaaaaacgcgaatacgatctaaaaaataaatcccgaactccgcgctcaacaaaaacgaaaccgcccccattaaatacgaaaccgaccctaaaccccgactaacgaaaaaacctcgtcgaacaattcgcgaacgaccgaaaaaaaaaaaaaaccgcaaaccgaacgaaaatacgaaacgccgaaaacccttccaaacccctttctcttccacgacccctaacgaaacgaaaaaaaaaaaaccgaaccgcgaaaacgcgaaccgctaaaaatcgtaacctacgacgccaaccaacctttactcgtccctcgtacaaacgaaactacgaacgaaaactccatattaaaaaacgacgccgttcgtacttattaacgaaaatccgaaaaccgcgaaataaactaacgaaaaccgaaccctaaataaaaataaaaaccccgctacgacctaccgcgaacatcctaaaacgaaacccgcaacaaaactacgaactcgtccaaaaaatcgacaacgacacctacgaaaacgtctataaaataaataaaactaaccgtacttttttcctacgatcgactaaatcccgaaaataaaaccactttcctacgaaatattaaaacgaaaaaaaaatacttttattattacctcttaaaaaaaaaacgaccgaaatcc

SEQ ID NO: 26991 - DNA, 1035 bp, Artificial Sequence
  chemically treated genomic DNA (Homo sapiens) CpG-island No: 26991
ttcgttggtttacgaatgtttaggcgtgtgttttatttttgagagtgggagggagatagtttaggttttgtaaggacgcgttcggttaggggggcgcggtggcgcggtcgggagggtgttgtgtttttagtaggttttagggcggtattttggttttgcggtcggagtgttcgggcgggtcgttgggcgtcgatttatgttggttgggaacgtgtttttcggtgacgtagtttcgggtggggaacgtggtgcggcggcggcggcggcggcgattgtacgcgttttcgtcgttttcgagaggacgcgtcgtgtagcggttgagtggcggcggcggcgacggtaaattcggagttgtcggtcggcgcgcgggaggaggacgcgggtgcggtttaggaagtaggtttcgggtttcgcgtttaataaagacggggtcgtttttattaggtacggagtcggttttgggtttcggttggcggggaggtttcgtcgggtagttcgcgggcggtcggggagggggaagggtcgtagatcgaacggggatacggggcgtcgggggtttttttaggttttttttttttttacggtttttggcgggacggaagggaaggggtcgggtcgcgagggcgcgggtcgttgggggtcgtagtttgcgacgttaattagtttttgttcgtttttcgtgtagacggagttgcgggcggaggttttatgttgggaagcggcgtcgttcgtgtttgttagcgggaattcgggagtcgcggggtgagttggcgggggtcgggttttaagtgaagatggaggtttcgttgcggtttgtcgcggatattttgaggcggaattcgtagtaggattacgaattcgtttagagggtcggtagcggtatttacggggacgtttataaggtaagtgaggttggtcgtgttttttttttgcggtcgattgggtttcgggaatggggttatttttttgcgaagtattggggcgagaggaggatgtttttattgttgttttttggggagaaagcggtcggggttt

SEQ ID NO: 26992 - DNA, 1035 bp, Artificial Sequence
  chemically treated genomic DNA (Homo sapiens) CpG-island No: 26992
aaaccccgaccgctttctccccaaaaaacaacaataaaaacatcctcctctcgccccaatacttcgcaaaaaaataaccccattcccgaaacccaatcgaccgcaaaaaaaaaacacgaccaacctcacttaccttataaacgtccccgtaaataccgctaccgaccctctaaacgaattcgtaatcctactacgaattccgcctcaaaatatccgcgacaaaccgcaacgaaacctccatcttcacttaaaacccgacccccgccaactcaccccgcgactcccgaattcccgctaacaaacacgaacgacgccgcttcccaacataaaacctccgcccgcaactccgtctacacgaaaaacgaacaaaaactaattaacgtcgcaaactacgacccccaacgacccgcgccctcgcgacccgaccccttcccttccgtcccgccaaaaaccgtaaaaaaaaaaaaaacctaaaaaaacccccgacgccccgtatccccgttcgatctacgacccttccccctccccgaccgcccgcgaactacccgacgaaacctccccgccaaccgaaacccaaaaccgactccgtacctaataaaaacgaccccgtctttattaaacgcgaaacccgaaacctacttcctaaaccgcacccgcgtcctcctcccgcgcgccgaccgacaactccgaatttaccgtcgccgccgccgccactcaaccgctacacgacgcgtcctctcgaaaacgacgaaaacgcgtacaatcgccgccgccgccgccgccgcaccacgttccccacccgaaactacgtcaccgaaaaacacgttcccaaccaacataaatcgacgcccaacgacccgcccgaacactccgaccgcaaaaccaaaataccgccctaaaacctactaaaaacacaacaccctcccgaccgcgccaccgcgcccccctaaccgaacgcgtccttacaaaacctaaactatctccctcccactctcaaaaataaaacacacgcctaaacattcgtaaaccaacgaa

SEQ ID NO: 26993 - DNA, 679 bp, Artificial Sequence
  chemically treated genomic DNA (Homo sapiens) CpG-island No: 26993
tttcgcggtttcgtatttttgagcgtggagcgttttattagtatcgtgtggatttgcgggttcgaaaggaatttgcgtatttgttttagggcgttttttttttttagcgtcgtttttagcgcggtcggcgtttcgtcgtcgttttttagtagtagcggtattagtttgcgtaggtgtttttgtagtatcgatacgttcgttatattttgtacggtcgatatttttaattcggtcgagtcgttttcgtcgtcgtcgttttcgggtttcgatatggtgtcgcgttcgggattttttaggagcgatgagaaggcggtcgcgatttagcgagatagttagtaagagatagaaacggtcgtcggaagtcggatcgttcgttagtttatcgtagattgaggagagcgggagtcggtttcgttttaaaggtagttattgttaggtggtttcgtttcgtttcgtcggtcgtagtcgtcgtagttattcgcgttcgttcgcggttttagcgttacggcgtcgcgcgtgcgcggggggcgggttcggcgatgtcgtcgcgcgtttttttgggatttgtagtttcggcgttggtcggggttcgtagttttcgtattgcgagttttaggagatggggatttggtttaacgttttggttcggcgttcgggtttggcgaggttggttaggggt

SEQ ID NO: 26994 - DNA, 679 bp, Artificial Sequence
  chemically treated genomic DNA (Homo sapiens) CpG-island No: 26994
acccctaaccaacctcgccaaacccgaacgccgaaccaaaacgttaaaccaaatccccatctcctaaaactcgcaatacgaaaactacgaaccccgaccaacgccgaaactacaaatcccaaaaaaacgcgcgacgacatcgccgaacccgccccccgcgcacgcgcgacgccgtaacgctaaaaccgcgaacgaacgcgaataactacgacgactacgaccgacgaaacgaaacgaaaccacctaacaataactacctttaaaacgaaaccgactcccgctctcctcaatctacgataaactaacgaacgatccgacttccgacgaccgtttctatctcttactaactatctcgctaaatcgcgaccgccttctcatcgctcctaaaaaatcccgaacgcgacaccatatcgaaacccgaaaacgacgacgacgaaaacgactcgaccgaattaaaaatatcgaccgtacaaaatataacgaacgtatcgatactacaaaaacacctacgcaaactaataccgctactactaaaaaacgacgacgaaacgccgaccgcgctaaaaacgacgctaaaaaaaaaaaacgccctaaaacaaatacgcaaattcctttcgaacccgcaaatccacacgatactaataaaacgctccacgctcaaaaatacgaaaccgcgaaa

SEQ ID NO: 26995 - DNA, 679 bp, Artificial Sequence
  chemically treated genomic DNA (Homo sapiens) CpG-island No: 26995
gtttttgattaatttcgttaagttcgggcgtcgagttaggacgttgagttaagtttttattttttaggattcgtagtgcggaggttgcgggtttcgattagcgtcgagattataagttttagaagggcgcgcggcgatatcgtcgggttcgtttttcgcgtacgcgcggcgtcgtgacgttaaggtcgcgagcgagcgcgggtggttgcggcggttgcggtcggcggggcggggcggggttatttggtagtggttgtttttagggcggagtcggttttcgttttttttagtttgcggtgggttagcggacggttcggttttcggcggtcgtttttgttttttgttggttgtttcgttgagtcgcggtcgtttttttatcgtttttggaaggtttcgagcgcgatattatgtcggagttcgggggcggcggcggcgaggacggttcggtcggattggaagtgtcggtcgtgtagaatgtggcggacgtgtcggtgttgtagaagtatttgcgtaagttggtgtcgttgttgttggaggacggcggcgaggcgtcggtcgcgttggaggcggcgttggaggagaagagcgttttggagtagatgcgtaagtttttttcggattcgtaggtttatacggtgttggtggagcgttttacgtttaaaggtgcggggtcgcggag

SEQ ID NO: 26996 - DNA, 679 bp, Artificial Sequence
  chemically treated genomic DNA (Homo sapiens) CpG-island No: 26996
ctccgcgaccccgcacctttaaacgtaaaacgctccaccaacaccgtataaacctacgaatccgaaaaaaacttacgcatctactccaaaacgctcttctcctccaacgccgcctccaacgcgaccgacgcctcgccgccgtcctccaacaacaacgacaccaacttacgcaaatacttctacaacaccgacacgtccgccacattctacacgaccgacacttccaatccgaccgaaccgtcctcgccgccgccgcccccgaactccgacataatatcgcgctcgaaaccttccaaaaacgataaaaaaacgaccgcgactcaacgaaacaaccaacaaaaaacaaaaacgaccgccgaaaaccgaaccgtccgctaacccaccgcaaactaaaaaaaacgaaaaccgactccgccctaaaaacaaccactaccaaataaccccgccccgccccgccgaccgcaaccgccgcaaccacccgcgctcgctcgcgaccttaacgtcacgacgccgcgcgtacgcgaaaaacgaacccgacgatatcgccgcgcgcccttctaaaacttataatctcgacgctaatcgaaacccgcaacctccgcactacgaatcctaaaaaataaaaacttaactcaacgtcctaactcgacgcccgaacttaacgaaattaatcaaaaac

SEQ ID NO: 26997 - DNA, 935 bp, Artificial Sequence
  chemically treated genomic DNA (Homo sapiens) CpG-island No: 26997
tacgaagtcgatttgttgcggtagtatttttcgttttttgcgaattttgagcggtcggagggtttcgcggagcgttatttcggagcgtttgggtgtcgtttttgggagaggatggggagttttagcggttagagtgtaattagtggtcgagcggcgttggggttggagtaggcggtgcgcgatttagaggcgaggagtttcgggttaaagttttatggttcgagggcgaggtcggcgggggagttttttgggaaggtgggaacgcgcgacgcggtcggagtttagagtttcgcgcgtcgcgtgtcgtgcgcgtattatggtttcgtggcgaggaggcgacgtcggtacggtggcgttggcggttcgggttcgtagggtggcgtagtttcggcgttagagtcgttatttgttcgtttcgtttcggtcggttcgttcggttatagttttggtagtagcgtcgtagggagtatttagtgcgttttcgcgtttcgcgtcgtcgcgtttattcgtagtattttttttttttaagtttggcggcggtcgtttcggttgttagtcggcgatgtttttttgtttttcgacgagtcgagttcgggcggtcgagtgcgcgtcgcgggaaggttggttggacgcgcggtatttgagattttcgcggcgagtaggttcgacgtcggtttttttaggggcgagtttttttcgggaattttttttttggtttttcggttgcgggcgttagcgtttgagaggtcgtggcgtttttcgttcgttgttttcgtttttttatttttttttttttgttcgttttttatttttcgttttttttagtacgtgtattcgtttcgtagggcgtattttttcgtgtatttttttttttagtagttggatttttattgattaatataatttttttttttttttttttttttttttttttt

SEQ ID NO: 26998 - DNA, 935 bp, Artificial Sequence
  chemically treated genomic DNA (Homo sapiens) CpG-island No: 26998
aaaaaaaaaaaaaaaaaaaaaaaaaaaaaaaattatattaatcaataaaaatccaactactaaaaaaaaaaatacacgaaaaaatacgccctacgaaacgaatacacgtactaaaaaaaacgaaaaataaaaaacgaacaaaaaaaaaaaaataaaaaaacgaaaacaacgaacgaaaaacgccacgacctctcaaacgctaacgcccgcaaccgaaaaaccaaaaaaaaaattcccgaaaaaaactcgcccctaaaaaaaccgacgtcgaacctactcgccgcgaaaatctcaaataccgcgcgtccaaccaaccttcccgcgacgcgcactcgaccgcccgaactcgactcgtcgaaaaacaaaaaaacatcgccgactaacaaccgaaacgaccgccgccaaacttaaaaaaaaaaaatactacgaataaacgcgacgacgcgaaacgcgaaaacgcactaaatactccctacgacgctactaccaaaactataaccgaacgaaccgaccgaaacgaaacgaacaaataacgactctaacgccgaaactacgccaccctacgaacccgaaccgccaacgccaccgtaccgacgtcgcctcctcgccacgaaaccataatacgcgcacgacacgcgacgcgcgaaactctaaactccgaccgcgtcgcgcgttcccaccttcccaaaaaactcccccgccgacctcgccctcgaaccataaaactttaacccgaaactcctcgcctctaaatcgcgcaccgcctactccaaccccaacgccgctcgaccactaattacactctaaccgctaaaactccccatcctctcccaaaaacgacacccaaacgctccgaaataacgctccgcgaaaccctccgaccgctcaaaattcgcaaaaaacgaaaaatactaccgcaacaaatcgacttcgta

SEQ ID NO: 26999 - DNA, 935 bp, Artificial Sequence
  chemically treated genomic DNA (Homo sapiens) CpG-island No: 26999
agaaaggagagaaaaagggagaaggaaggggattatattggttagtagaggtttaattattgaagagaagagtgtacgggggagtgcgttttacgggacgagtatacgtgttgggaagggcggggggtgagaggcgggtaggaggggaggagtagggaggcgagagtagcgggcgggaggcgttacggttttttagacgttggcgttcgtagtcgagaagttagagagaaagttttcggggagagttcgtttttgggagggtcgacgtcgagtttgttcgtcgcgagggttttaggtatcgcgcgtttagttagttttttcgcggcgcgtattcggtcgttcgggttcggttcgtcgggaagtaggggaatatcgtcggttggtagtcggggcggtcgtcgttaaatttggaggaggaggatgttgcgagtgggcgcggcggcgcggggcgcgggggcgtattgagtgttttttacggcgttgttgttagggttgtggtcgggcgagtcggtcgaagcggagcgggtaggtagcggttttagcgtcgggattgcgttattttgcgagttcgggtcgttagcgttatcgtgtcggcgtcgttttttcgttacggagttatggtgcgcgtacggtacgcggcgcgcgggattttgagtttcggtcgcgtcgcgcgtttttatttttttaaggggttttttcgtcgatttcgttttcgggttatgaggttttggttcggagtttttcgtttttgagtcgcgtatcgtttgttttagttttagcgtcgttcggttattgattgtattttggtcgttgaagttttttatttttttttagagacggtatttaggcgtttcgggatggcgtttcgcgggatttttcggtcgtttaaagttcgtaggaggcgagagatgttgtcgtagtaagtcggtttcgtg

SEQ ID NO: 27000 - DNA, 935 bp, Artificial Sequence
  chemically treated genomic DNA (Homo sapiens) CpG-island No: 27000
cacgaaaccgacttactacgacaacatctctcgcctcctacgaactttaaacgaccgaaaaatcccgcgaaacgccatcccgaaacgcctaaataccgtctctaaaaaaaaataaaaaacttcaacgaccaaaatacaatcaataaccgaacgacgctaaaactaaaacaaacgatacgcgactcaaaaacgaaaaactccgaaccaaaacctcataacccgaaaacgaaatcgacgaaaaaaccccttaaaaaaataaaaacgcgcgacgcgaccgaaactcaaaatcccgcgcgccgcgtaccgtacgcgcaccataactccgtaacgaaaaaacgacgccgacacgataacgctaacgacccgaactcgcaaaataacgcaatcccgacgctaaaaccgctacctacccgctccgcttcgaccgactcgcccgaccacaaccctaacaacaacgccgtaaaaaacactcaatacgcccccgcgccccgcgccgccgcgcccactcgcaacatcctcctcctccaaatttaacgacgaccgccccgactaccaaccgacgatattcccctacttcccgacgaaccgaacccgaacgaccgaatacgcgccgcgaaaaaactaactaaacgcgcgatacctaaaaccctcgcgacgaacaaactcgacgtcgaccctcccaaaaacgaactctccccgaaaactttctctctaacttctcgactacgaacgccaacgtctaaaaaaccgtaacgcctcccgcccgctactctcgcctccctactcctcccctcctacccgcctctcaccccccgcccttcccaacacgtatactcgtcccgtaaaacgcactcccccgtacactcttctcttcaataattaaacctctactaaccaatataatccccttccttctccctttttctctcctttct

SEQ ID NO: 27001 - DNA, 693 bp, Artificial Sequence
  chemically treated genomic DNA (Homo sapiens) CpG-island No: 27001
tatcgattttttagttcggttttgcgtagtttgtttttttttcgtttttttttattttttttaatattagttaatggttgaggtaaatgtgtcggtttttacggtatcggcgcggagcggaggttgtatattttcgttttttttcgtcgttggaggtcgcgttttgcggtaagattcggtcgtcgtaggtttcgggtagcgttcgtcgttgtttaaatttggaggaaatttaagttttagtcgttatggaggttgcgcgtagtgcgtttcggagttcgcgttatttatcggggcgttttcgggtaggttgtagcgatatagagtgtggtttaggtcgaattcgattacgtcgtaggcggttaggaagaagtgttgagttatggttgcgcggggagtattagggagcgtttcggtcgcgaagggtgtaaggagttggttggcgggacgttgcgggataggatcgggtcggacgcggcggggcggggttgcggttgttagggtatacggcgcggtagtttttttcgtttttcgcgttttcgagtatcgtttttcgatacgtttagttttcgtttttcgcgcggcgggcgttttgcgtcgttcggagttaggtagttagttcgcgtttttttggtattttaatgtcggcgatttttgatttgtttcgtaagtttaggagtttagaaggtagtaggg

SEQ ID NO: 27002 - DNA, 693 bp, Artificial Sequence
  chemically treated genomic DNA (Homo sapiens) CpG-island No: 27002
ccctactaccttctaaactcctaaacttacgaaacaaatcaaaaatcgccgacattaaaataccaaaaaaacgcgaactaactacctaactccgaacgacgcaaaacgcccgccgcgcgaaaaacgaaaactaaacgtatcgaaaaacgatactcgaaaacgcgaaaaacgaaaaaaactaccgcgccgtataccctaacaaccgcaaccccgccccgccgcgtccgacccgatcctatcccgcaacgtcccgccaaccaactccttacacccttcgcgaccgaaacgctccctaatactccccgcgcaaccataactcaacacttcttcctaaccgcctacgacgtaatcgaattcgacctaaaccacactctatatcgctacaacctacccgaaaacgccccgataaataacgcgaactccgaaacgcactacgcgcaacctccataacgactaaaacttaaatttcctccaaatttaaacaacgacgaacgctacccgaaacctacgacgaccgaatcttaccgcaaaacgcgacctccaacgacgaaaaaaaacgaaaatatacaacctccgctccgcgccgataccgtaaaaaccgacacatttacctcaaccattaactaatattaaaaaaaataaaaaaaaacgaaaaaaaaacaaactacgcaaaaccgaactaaaaaatcgata

SEQ ID NO: 27003 - DNA, 693 bp, Artificial Sequence
  chemically treated genomic DNA (Homo sapiens) CpG-island No: 27003
ttttattgttttttgggtttttaggtttgcggaatagattaggagtcgtcggtattggggtattaggaggacgcgagttgattatttgatttcgggcggcgtaggacgttcgtcgcgcgaggggcgggggttaagcgtatcgaggggcggtgttcgagggcgcgggaggcgggagaggttgtcgcgtcgtgtgttttggtagtcgtagtttcgtttcgtcgcgttcggttcggttttgtttcgtagcgtttcgttagttagttttttgtatttttcgcggtcgaggcgttttttggtgtttttcgcgtagttatggtttagtatttttttttggtcgtttgcgacgtggtcggattcgatttggattatattttgtgtcgttataatttgttcgagagcgtttcggtgagtggcgcgggtttcggggcgtattgcgcgtaatttttatggcggttggggtttgagttttttttaggtttgggtaacggcggacgttgttcggggtttgcggcggtcgagttttgtcgtaaagcgcggtttttagcggcgagaaggggcggaagtgtgtagttttcgtttcgcgtcggtgtcgtggggatcggtatatttattttagttattagttaatgttgagagggatagggaagaacgaaggaggggtaaattgcgtaagatcgggttggggaatcggtg

SEQ ID NO: 27004 - DNA, 693 bp, Artificial Sequence
  chemically treated genomic DNA (Homo sapiens) CpG-island No: 27004
caccgattccccaacccgatcttacgcaatttacccctccttcgttcttccctatccctctcaacattaactaataactaaaataaatataccgatccccacgacaccgacgcgaaacgaaaactacacacttccgccccttctcgccgctaaaaaccgcgctttacgacaaaactcgaccgccgcaaaccccgaacaacgtccgccgttacccaaacctaaaaaaaactcaaaccccaaccgccataaaaattacgcgcaatacgccccgaaacccgcgccactcaccgaaacgctctcgaacaaattataacgacacaaaatataatccaaatcgaatccgaccacgtcgcaaacgaccaaaaaaaaatactaaaccataactacgcgaaaaacaccaaaaaacgcctcgaccgcgaaaaatacaaaaaactaactaacgaaacgctacgaaacaaaaccgaaccgaacgcgacgaaacgaaactacgactaccaaaacacacgacgcgacaacctctcccgcctcccgcgccctcgaacaccgcccctcgatacgcttaacccccgcccctcgcgcgacgaacgtcctacgccgcccgaaatcaaataatcaactcgcgtcctcctaataccccaataccgacgactcctaatctattccgcaaacctaaaaacccaaaaaacaataaaa

SEQ ID NO: 27005 - DNA, 705 bp, Artificial Sequence
  chemically treated genomic DNA (Homo sapiens) CpG-island No: 27005
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcggtatttatttgtttggatagtatggtttgtaacgcgggtatttcgatgtcgtcggaagcgagaagattaataatggggaaggttatttagtttcgcgtttcgaacgttagtaagacgtagattagcgcgtcggtcggtatgtcggcgataatgggttggtttttcgtcgaacgtttggggggcggattagtgacgaaaggtttgagcgaggggcgtgtaagatttcgaattcgtaagcgataaggcgattatcggcgcgttttaagcgaagcggtttttcgttgaaaatgatttagagcgttgttcggattttgttttcgagttgtttgataaagaaataagtataagtgtcggcgacgatagttatgttttcggtttaatcggaggagttgttggtgttgaaggtttttaagggtattcggcgggtttgttattgtgggatattttggttttaattaaattcgcggtcgttaatttatatttattt

SEQ ID NO: 27006 - DNA, 705 bp, Artificial Sequence
  chemically treated genomic DNA (Homo sapiens) CpG-island No: 27006
aaataaatataaattaacgaccgcgaatttaattaaaaccaaaatatcccacaataacaaacccgccgaatacccttaaaaaccttcaacaccaacaactcctccgattaaaccgaaaacataactatcgtcgccgacacttatacttatttctttatcaaacaactcgaaaacaaaatccgaacaacgctctaaatcattttcaacgaaaaaccgcttcgcttaaaacgcgccgataatcgccttatcgcttacgaattcgaaatcttacacgcccctcgctcaaacctttcgtcactaatccgccccccaaacgttcgacgaaaaaccaacccattatcgccgacataccgaccgacgcgctaatctacgtcttactaacgttcgaaacgcgaaactaaataaccttccccattattaatcttctcgcttccgacgacatcgaaatacccgcgttacaaaccatactatccaaacaaataaataccgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 27007 - DNA, 705 bp, Artificial Sequence
  chemically treated genomic DNA (Homo sapiens) CpG-island No: 27007
aagtggatgtggattagcggtcgcgaatttaattagaattaaaatgttttataatggtaggttcgtcgaatgtttttaagaatttttaatattagtagttttttcggttgggtcgggggtatgattatcgtcgtcggtatttatgtttgtttttttattaagtaattcgagggtaaggttcgggtagcgttttgggttatttttagcgaaggatcgtttcgtttgaagcgcgtcgataatcgttttgtcgtttgcggattcggaattttgtacgtttttcgtttaagtttttcgttattggttcgttttttaaacgttcggcgaagaattagtttattatcgtcggtatgtcggtcgacgcgttggtttacgttttgttggcgttcggaacgcgaggttggatggttttttttattattaattttttcgttttcggcggtatcgggatgttcgcgttgtaggttatgttgtttaggtaggtagatgtcgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 27008 - DNA, 705 bp, Artificial Sequence
  chemically treated genomic DNA (Homo sapiens) CpG-island No: 27008
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgacatctacctacctaaacaacataacctacaacgcgaacatcccgataccgccgaaaacgaaaaaattaataataaaaaaaaccatccaacctcgcgttccgaacgccaacaaaacgtaaaccaacgcgtcgaccgacataccgacgataataaactaattcttcgccgaacgtttaaaaaacgaaccaataacgaaaaacttaaacgaaaaacgtacaaaattccgaatccgcaaacgacaaaacgattatcgacgcgcttcaaacgaaacgatccttcgctaaaaataacccaaaacgctacccgaaccttaccctcgaattacttaataaaaaaacaaacataaataccgacgacgataatcatacccccgacccaaccgaaaaaactactaatattaaaaattcttaaaaacattcgacgaacctaccattataaaacattttaattctaattaaattcgcgaccgctaatccacatccactt

SEQ ID NO: 27009 - DNA, 847 bp, Artificial Sequence
  chemically treated genomic DNA (Homo sapiens) CpG-island No: 27009
gtcgggtatttatttttagaagtcgtagggatagcgaggcggtaggttgggcgttttgttgcgttcgtttttagcgttttttatggtgttcggcggcggcggagttcggcggcggtagcggtggcggcggttgggttcgggtttcgttttgaggaggcggtggcggcggcgtcggggggttcggggcggggggagggggaaggagcgggcgcgcgggcgggcgcgagttcggggttcggagtcgggattttaggtcggttagttggaggcgggtcgtattattcggtttgcggagacggggagggggcggagaggcgcggagagaagaaggagggagtcgaggaggaggggcgtgcggacgtatcgaggatcgcgggggaggagggatatagacgttttcggcgggttttatcgtcgttttttagttagagagatgttttgtgcggtggcgtagggaaggatcggagtttttcgtcggtttcggagtcgtagcggtcgttttgaagtttcgggttttgttgttttcgtaatatcgttttttttttcggaggttgcgttgatcggataatggtcgtttcgtttttttttcggcgtgcgtttttttcgaggagttataatggtttcgttcgggggagttaacgttaaagtttagtcgttgattagttgggattcgggcgtgttatttcgtttcgcgttttaaaggcggagtgcggggttgtgggagaaaacgagagtttcgggttgtcgttcggcgacgggcggttgaggttttcgtatttttagaatttttagaatttgaagtaaatttattttttttttgtttgaagaaggggagtaggtttttgag

SEQ ID NO: 27010 - DNA, 847 bp, Artificial Sequence
  chemically treated genomic DNA (Homo sapiens) CpG-island No: 27010
ctcaaaaacctactccccttcttcaaacaaaaaaaaaataaatttacttcaaattctaaaaattctaaaaatacgaaaacctcaaccgcccgtcgccgaacgacaacccgaaactctcgttttctcccacaaccccgcactccgcctttaaaacgcgaaacgaaataacacgcccgaatcccaactaatcaacgactaaactttaacgttaactcccccgaacgaaaccattataactcctcgaaaaaaacgcacgccgaaaaaaaaacgaaacgaccattatccgatcaacgcaacctccgaaaaaaaaaacgatattacgaaaacaacaaaacccgaaacttcaaaacgaccgctacgactccgaaaccgacgaaaaactccgatccttccctacgccaccgcacaaaacatctctctaactaaaaaacgacgataaaacccgccgaaaacgtctatatccctcctcccccgcgatcctcgatacgtccgcacgcccctcctcctcgactccctccttcttctctccgcgcctctccgccccctccccgtctccgcaaaccgaataatacgacccgcctccaactaaccgacctaaaatcccgactccgaaccccgaactcgcgcccgcccgcgcgcccgctccttccccctccccccgccccgaaccccccgacgccgccgccaccgcctcctcaaaacgaaacccgaacccaaccgccgccaccgctaccgccgccgaactccgccgccgccgaacaccataaaaaacgctaaaaacgaacgcaacaaaacgcccaacctaccgcctcgctatccctacgacttctaaaaataaatacccgac

SEQ ID NO: 27011 - DNA, 847 bp, Artificial Sequence
  chemically treated genomic DNA (Homo sapiens) CpG-island No: 27011
tttagaaatttgttttttttttttagatagggggaagataagtttgttttagattttaaaagttttaagaatacgaaggttttagtcgttcgtcgtcgggcgatagttcgaggttttcgtttttttttatagtttcgtatttcgtttttgaggcgcggaacgaagtggtacgttcggattttagttgattagcggttgggttttggcgttggttttttcgggcgagattattgtgatttttcgggaggggcgtacgtcggggagggggcggagcggttattgttcggttagcgtagttttcgggggaggggacggtgttacggagatagtagggttcggggttttagagcggtcgttgcgatttcggagtcggcggggggtttcggtttttttttgcgttatcgtataggatatttttttggttggggagcggcggtgagattcgtcgagggcgtttgtgttttttttttttcgcggttttcggtgcgttcgtacgtttttttttttcggttttttttttttttttttcgcgttttttcgtttttttttcgttttcgtaggtcgagtggtgcggttcgtttttagttgatcggtttggaatttcggtttcgagtttcggattcgcgttcgttcgcgcgttcgtttttttttttttttttcgtttcgagtttttcgacgtcgtcgttatcgtttttttagagcggggttcgggtttagtcgtcgttatcgttgtcgtcgtcgagtttcgtcgtcgtcgagtattatgggagacgttgggagcgagcgtagtaaagcgtttagtttgtcgtttcgttgtttttgcggtttttgggggtaagtgttcggt

SEQ ID NO: 27012 - DNA, 847 bp, Artificial Sequence
  chemically treated genomic DNA (Homo sapiens) CpG-island No: 27012
accgaacacttacccccaaaaaccgcaaaaacaacgaaacgacaaactaaacgctttactacgctcgctcccaacgtctcccataatactcgacgacgacgaaactcgacgacgacaacgataacgacgactaaacccgaaccccgctctaaaaaaacgataacgacgacgtcgaaaaactcgaaacgaaaaaaaaaaaaaaaaacgaacgcgcgaacgaacgcgaatccgaaactcgaaaccgaaattccaaaccgatcaactaaaaacgaaccgcaccactcgacctacgaaaacgaaaaaaaaacgaaaaaacgcgaaaaaaaaaaaaaaaaaaccgaaaaaaaaaaacgtacgaacgcaccgaaaaccgcgaaaaaaaaaaaacacaaacgccctcgacgaatctcaccgccgctccccaaccaaaaaaatatcctatacgataacgcaaaaaaaaaccgaaaccccccgccgactccgaaatcgcaacgaccgctctaaaaccccgaaccctactatctccgtaacaccgtcccctcccccgaaaactacgctaaccgaacaataaccgctccgccccctccccgacgtacgcccctcccgaaaaatcacaataatctcgcccgaaaaaaccaacgccaaaacccaaccgctaatcaactaaaatccgaacgtaccacttcgttccgcgcctcaaaaacgaaatacgaaactataaaaaaaaacgaaaacctcgaactatcgcccgacgacgaacgactaaaaccttcgtattcttaaaacttttaaaatctaaaacaaacttatcttccccctatctaaaaaaaaaaaacaaatttctaaa

SEQ ID NO: 27013 - DNA, 977 bp, Artificial Sequence
  chemically treated genomic DNA (Homo sapiens) CpG-island No: 27013
gtttttagcgttcggttagcgtagaggtgttttggtcggtcgtattaattttcggagtcgaaagtagagtttaggtatcgttatttgtaagagagggagaatgttaggtaaatattcgattcgtatatacgtttacgcgtgtttatcggtattgcgcgcgtttttttcgttttcgcgtcgttttcgttaggtggagggggtggggacggtcgggataggcgggagtttagaggagggagtcgtagaaggggtttttcgtttgagttaacgtagtggtggtatttagaggtgaacgcgggagcggtcgtttgcggagggtattcggttgcgtggcgttcgttcgggtcgttgttgcggtagaggtgttttggttgggcggttgggcgtttggggttcgacgtcggtcgggatttttgggtgtgcgcggagatgcgcgtcgcggaggcgaatggagggaggaggagaaggagaaagaggagaaagaggggaggggggggggggggggggtgggcgaagcggtaagcgcggggcgtaggcggatcggcggtcgggttgttgggttgttgggttgtcggggaggaaggttgtgtgtggttacgttgtgcgttacgtgttgagagcgcgagttgttagtcgtagtcgggcgacgttaaagtcgggtgcgcggttttgtcgtttgttttcgcgttttttttgttttttttttgttttgtttttttgtgttagtcgagtttattagtatggataacgtcgaaaggtttcgcgaggtcggcggtatttggtttttaatttttttcgttaaagcgttttttcgtttttcggggagtttcgcggtggcgaatgttcgttatgtatttttgatgtcgtcgtttgcgtttgtacgttgaagggttagttattattttagatttagggtaattatatgatacgttatttttttttcgtcgtttaaggttttttaggattcgttatgtttg

SEQ ID NO: 27014 - DNA, 977 bp, Artificial Sequence
  chemically treated genomic DNA (Homo sapiens) CpG-island No: 27014
caaacataacgaatcctaaaaaaccttaaacgacgaaaaaaaaataacgtatcatataattaccctaaatctaaaataataactaacccttcaacgtacaaacgcaaacgacgacatcaaaaatacataacgaacattcgccaccgcgaaactccccgaaaaacgaaaaaacgctttaacgaaaaaaattaaaaaccaaataccgccgacctcgcgaaacctttcgacgttatccatactaataaactcgactaacacaaaaaaacaaaacaaaaaaaaaacaaaaaaaacgcgaaaacaaacgacaaaaccgcgcacccgactttaacgtcgcccgactacgactaacaactcgcgctctcaacacgtaacgcacaacgtaaccacacacaaccttcctccccgacaacccaacaacccaacaacccgaccgccgatccgcctacgccccgcgcttaccgcttcgcccacccccccccccccccccctcccctctttctcctctttctccttctcctcctccctccattcgcctccgcgacgcgcatctccgcgcacacccaaaaatcccgaccgacgtcgaaccccaaacgcccaaccgcccaaccaaaacacctctaccgcaacaacgacccgaacgaacgccacgcaaccgaataccctccgcaaacgaccgctcccgcgttcacctctaaataccaccactacgttaactcaaacgaaaaaccccttctacgactccctcctctaaactcccgcctatcccgaccgtccccaccccctccacctaacgaaaacgacgcgaaaacgaaaaaaacgcgcgcaataccgataaacacgcgtaaacgtatatacgaatcgaatatttacctaacattctccctctcttacaaataacgatacctaaactctactttcgactccgaaaattaatacgaccgaccaaaacacctctacgctaaccgaacgctaaaaac

SEQ ID NO: 27015 - DNA, 977 bp, Artificial Sequence
  chemically treated genomic DNA (Homo sapiens) CpG-island No: 27015
taagtataacggattttggaagattttgggcggcggagaggagatagcgtgttatgtaattattttgggtttaaggtggtagttggttttttagcgtgtaaacgtagacggcggtattagaaatatataacgggtattcgttatcgcggagtttttcgagaggcgagggagcgttttggcgggggaggttggaggttagatgtcgtcggtttcgcggagtttttcggcgttgtttatattgatgagttcggttgatataggaaggtagagtaaaggaggggtagaggaggcgcggaggtaggcggtagagtcgcgtattcggttttgacgtcgttcggttgcggttagtagttcgcgtttttagtacgtagcgtataacgtgattatatatagttttttttttcggtagtttagtagtttagtagttcggtcgtcggttcgtttgcgtttcgcgtttgtcgtttcgtttatttttttttttttttttttttttttttttttttttttttttttttttttttttttttattcgttttcgcggcgcgtattttcgcgtatatttagggatttcggtcggcgtcgaattttaggcgtttagtcgtttaattagggtatttttgtcgtagtagcggttcgagcggacgttacgtagtcgggtgtttttcgtaggcggtcgttttcgcgtttatttttggatgttattattacgttagtttaagcggggaattttttttgcggtttttttttttaaattttcgtttgtttcgatcgtttttattttttttatttggcgggggcggcgcggaagcgaagaggacgcgcgtagtgtcggtgggtacgcgtagacgtgtgtgcggatcgggtatttgtttggtatttttttttttttgtaagtggcggtgtttggattttgttttcggtttcgggaattggtgcggtcggttagagtatttttacgttggtcgggcgttaaaggt

SEQ ID NO: 27016 - DNA, 977 bp, Artificial Sequence
  chemically treated genomic DNA (Homo sapiens) CpG-island No: 27016
acctttaacgcccgaccaacgtaaaaatactctaaccgaccgcaccaattcccgaaaccgaaaacaaaatccaaacaccgccacttacaaaaaaaaaaaaataccaaacaaatacccgatccgcacacacgtctacgcgtacccaccgacactacgcgcgtcctcttcgcttccgcgccgcccccgccaaataaaaaaaataaaaacgatcgaaacaaacgaaaatttaaaaaaaaaaaccgcaaaaaaaattccccgcttaaactaacgtaataataacatccaaaaataaacgcgaaaacgaccgcctacgaaaaacacccgactacgtaacgtccgctcgaaccgctactacgacaaaaataccctaattaaacgactaaacgcctaaaattcgacgccgaccgaaatccctaaatatacgcgaaaatacgcgccgcgaaaacgaataaaaaaaaaaaaaaaaaaaaaaaaaaaaaaaaaaaaaaaaaaaaaaaaaaaaaaaaataaacgaaacgacaaacgcgaaacgcaaacgaaccgacgaccgaactactaaactactaaactaccgaaaaaaaaaactatatataatcacgttatacgctacgtactaaaaacgcgaactactaaccgcaaccgaacgacgtcaaaaccgaatacgcgactctaccgcctacctccgcgcctcctctacccctcctttactctaccttcctatatcaaccgaactcatcaatataaacaacgccgaaaaactccgcgaaaccgacgacatctaacctccaacctcccccgccaaaacgctccctcgcctctcgaaaaactccgcgataacgaatacccgttatatatttctaataccgccgtctacgtttacacgctaaaaaaccaactaccaccttaaacccaaaataattacataacacgctatctcctctccgccgcccaaaatcttccaaaatccgttatactta

SEQ ID NO: 27017 - DNA, 696 bp, Artificial Sequence
  chemically treated genomic DNA (Homo sapiens) CpG-island No: 27017
gcgcgacgttcgtagggcgaattgtatttttttgagttttcgttttatggtttgagtcgtcgtagggcgcgggttcgcggttcgttaggggacggttattatagagacgtagtcggtattggcgagcgagcgagtaggcggcgtacggagcgcgtgggcgtgtttcggcggggttgcgtagttcgttttattttattttattttagttaggtcggtcgtttttattaggtttagttttagagtttaggtcggtcggtcgggttcgcgtgttttcggcgggttgcgtagagcgcgggagcggtttggggttgggtatgttgggagtttttcgggtaacggtcgtcgtcgttatagttatatagtcgtcgttattgcgttcgttttcggtgagcgtcgttgacgcgcggagatgaaattttcggtttcggtgttggcgttcgtgtttttgttcgtggtcgagataacggcggcgtttagtttgagtagtatttatcgttcgggcggggatcgtatgtggtaggcgttgacgttgtttttttcgttattgttttgcgcgttcgtgtagtttacgttttttttcgtatatcgcgattttagtcgcgatcgttcgttcgtattgttgttgtatttgttgtaatttgggtttttttttaggtgcgtgtagaagtttagagttagttttaggtcgtagtttcg

SEQ ID NO: 27018 - DNA, 696 bp, Artificial Sequence
  chemically treated genomic DNA (Homo sapiens) CpG-island No: 27018
cgaaactacgacctaaaactaactctaaacttctacacgcacctaaaaaaaaacccaaattacaacaaatacaacaacaatacgaacgaacgatcgcgactaaaatcgcgatatacgaaaaaaaacgtaaactacacgaacgcgcaaaacaataacgaaaaaaacaacgtcaacgcctaccacatacgatccccgcccgaacgataaatactactcaaactaaacgccgccgttatctcgaccacgaacaaaaacacgaacgccaacaccgaaaccgaaaatttcatctccgcgcgtcaacgacgctcaccgaaaacgaacgcaataacgacgactatataactataacgacgacgaccgttacccgaaaaactcccaacatacccaaccccaaaccgctcccgcgctctacgcaacccgccgaaaacacgcgaacccgaccgaccgacctaaactctaaaactaaacctaataaaaacgaccgacctaactaaaataaaataaaataaaacgaactacgcaaccccgccgaaacacgcccacgcgctccgtacgccgcctactcgctcgctcgccaataccgactacgtctctataataaccgtcccctaacgaaccgcgaacccgcgccctacgacgactcaaaccataaaacgaaaactcaaaaaaatacaattcgccctacgaacgtcgcgc

SEQ ID NO: 27019 - DNA, 696 bp, Artificial Sequence
  chemically treated genomic DNA (Homo sapiens) CpG-island No: 27019
cgaggttgcggtttggggttggttttgggtttttgtacgtatttgaaaaggggtttaagttgtagtaggtgtagtagtagtacgagcgggcggtcgcggttgaggtcgcggtgtacgaagagaagcgtgagttgtacgagcgcgtaaggtagtagcgagaaaagtaacgttagcgtttgttatatgcggttttcgttcgagcggtaggtgttgtttaggttgagcgtcgtcgttgtttcggttacgaataggaatacggacgttagtatcgaggtcgggaattttattttcgcgcgttagcggcgtttatcggggacggacgtagtggcggcggttgtgtggttgtggcggcggcggtcgttgttcgaggggtttttagtatgtttagttttaaatcgttttcgcgttttgcgtagttcgtcgagggtacgcgggttcggtcgatcggtttgggttttggaattggatttggtgggggcggtcgatttggttggggtggggtggggtggggcgagttgcgtagtttcgtcgggatacgtttacgcgtttcgtgcgtcgtttgttcgttcgttcgttagtgtcggttgcgtttttgtggtgatcgttttttggcgggtcgcgaattcgcgttttacgacggtttaggttatggagcgggagtttaaaaggatgtagttcgttttgcgggcgtcgcgt

SEQ ID NO: 27020 - DNA, 696 bp, Artificial Sequence
  chemically treated genomic DNA (Homo sapiens) CpG-island No: 27020
acgcgacgcccgcaaaacgaactacatccttttaaactcccgctccataacctaaaccgtcgtaaaacgcgaattcgcgacccgccaaaaaacgatcaccacaaaaacgcaaccgacactaacgaacgaacgaacaaacgacgcacgaaacgcgtaaacgtatcccgacgaaactacgcaactcgccccaccccaccccaccccaaccaaatcgaccgcccccaccaaatccaattccaaaacccaaaccgatcgaccgaacccgcgtaccctcgacgaactacgcaaaacgcgaaaacgatttaaaactaaacatactaaaaacccctcgaacaacgaccgccgccgccacaaccacacaaccgccgccactacgtccgtccccgataaacgccgctaacgcgcgaaaataaaattcccgacctcgatactaacgtccgtattcctattcgtaaccgaaacaacgacgacgctcaacctaaacaacacctaccgctcgaacgaaaaccgcatataacaaacgctaacgttacttttctcgctactaccttacgcgctcgtacaactcacgcttctcttcgtacaccgcgacctcaaccgcgaccgcccgctcgtactactactacacctactacaacttaaaccccttttcaaatacgtacaaaaacccaaaaccaaccccaaaccgcaacctcg

SEQ ID NO: 27021 - DNA, 712 bp, Artificial Sequence
  chemically treated genomic DNA (Homo sapiens) CpG-island No: 27021
gcgtcgcgtttagcgcgtttagagttgttttcgcgtattttatatttgggtatcgcgtttcggaggaggatcggggcgtacgtttggcgtatttagggttgtaacgttttcgggattgttacgttcgcggagcgattttacgttattgaggtttcggtttcgtttttgtttcggcgttacgtttgtagtcgcggtcgtttaagtggtcggagtcgggttcgtttttatttgtgcgtttttagttgagtagcgcgcggaggatagaggtagcggcggcgcgggcgttcggtattttagcggcgggttttgcggcggcggcggcggtagcggcggcgatttttttcgttgtttgggacgttagggggagggcgtttcgttttgttgtttatttataaggtcgcggttacggtcggggattgggcggtgagtaggtgtgttcgttttggttttgttggtattgatagtcgacgtcgtcgtttacgtttttttgcgtttattttttcgttttcgttttttcgcgggggcggtttttgttggagtttcggtatttgggatttttcggagatttcgtgtttcgttttttttttttaagcgggagtttttgcggtagttcgtttttttatttacgcggaagagattagggtatcgtttatacgagaaaaattttaattttgttgtttttggtttaggtaaggagcgtaaatttgagatt

SEQ ID NO: 27022 - DNA, 712 bp, Artificial Sequence
  chemically treated genomic DNA (Homo sapiens) CpG-island No: 27022
aatctcaaatttacgctccttacctaaaccaaaaacaacaaaattaaaatttttctcgtataaacgataccctaatctcttccgcgtaaataaaaaaacgaactaccgcaaaaactcccgcttaaaaaaaaaaaacgaaacacgaaatctccgaaaaatcccaaataccgaaactccaacaaaaaccgcccccgcgaaaaaacgaaaacgaaaaaataaacgcaaaaaaacgtaaacgacgacgtcgactatcaataccaacaaaaccaaaacgaacacacctactcaccgcccaatccccgaccgtaaccgcgaccttataaataaacaacaaaacgaaacgccctccccctaacgtcccaaacaacgaaaaaaatcgccgccgctaccgccgccgccgccgcaaaacccgccgctaaaataccgaacgcccgcgccgccgctacctctatcctccgcgcgctactcaactaaaaacgcacaaataaaaacgaacccgactccgaccacttaaacgaccgcgactacaaacgtaacgccgaaacaaaaacgaaaccgaaacctcaataacgtaaaatcgctccgcgaacgtaacaatcccgaaaacgttacaaccctaaatacgccaaacgtacgccccgatcctcctccgaaacgcgatacccaaatataaaatacgcgaaaacaactctaaacgcgctaaacgcgacgc

SEQ ID NO: 27023 - DNA, 712 bp, Artificial Sequence
  chemically treated genomic DNA (Homo sapiens) CpG-island No: 27023
agttttagatttgcgttttttgtttgaattaaagatagtaaaattgaggtttttttcgtgtaaacggtgttttggtttttttcgcgtagatagggaggcgagttgtcgtagaagttttcgtttaaagaggggaagcggagtacgggattttcgaggggttttaggtgtcgggattttagtagaagtcgttttcgcgggagagcggaggcggggaagtgggcgtaggggggcgtgggcgacggcgtcggttgttagtgttagtagagttagggcgggtatatttatttatcgtttaattttcggtcgtagtcgcggttttatgaataagtaataaagcgaagcgttttttttttagcgttttagatagcggagggagtcgtcgtcgttatcgtcgtcgtcgtcgtagggttcgtcgttgggatgtcgagcgttcgcgtcgtcgttgtttttgtttttcgcgcgttgtttagttgaaggcgtataggtgaggacgggttcggtttcggttatttgggcggtcgcggttgtagacgtggcgtcggggtagggacggaatcggagttttagtggcgtggggtcgtttcgcgagcgtaatagtttcgggagcgttgtagttttgggtgcgttaggcgtgcgtttcgattttttttcggagcgcggtgtttaggtgtggggtgcgcgggggtagttttgggcgcgttgggcgcggcgt

SEQ ID NO: 27024 - DNA, 712 bp, Artificial Sequence
  chemically treated genomic DNA (Homo sapiens) CpG-island No: 27024
acgccgcgcccaacgcgcccaaaactacccccgcgcaccccacacctaaacaccgcgctccgaaaaaaaatcgaaacgcacgcctaacgcacccaaaactacaacgctcccgaaactattacgctcgcgaaacgaccccacgccactaaaactccgattccgtccctaccccgacgccacgtctacaaccgcgaccgcccaaataaccgaaaccgaacccgtcctcacctatacgccttcaactaaacaacgcgcgaaaaacaaaaacaacgacgacgcgaacgctcgacatcccaacgacgaaccctacgacgacgacgacgataacgacgacgactccctccgctatctaaaacgctaaaaaaaaaacgcttcgctttattacttattcataaaaccgcgactacgaccgaaaattaaacgataaataaatatacccgccctaactctactaacactaacaaccgacgccgtcgcccacgcccccctacgcccacttccccgcctccgctctcccgcgaaaacgacttctactaaaatcccgacacctaaaacccctcgaaaatcccgtactccgcttcccctctttaaacgaaaacttctacgacaactcgcctccctatctacgcgaaaaaaaccaaaacaccgtttacacgaaaaaaacctcaattttactatctttaattcaaacaaaaaacgcaaatctaaaact

SEQ ID NO: 27025 - DNA, 926 bp, Artificial Sequence
  chemically treated genomic DNA (Homo sapiens) CpG-island No: 27025
gtacgttcgtatttataagattttatatcgtgtacgtcggaatttacgattgtatattatgtacgttcgtatttatacgagtttatattgtgtatatacgtagttatatgatatattacgtgtgtttatatttattttatatcgtgtaggttcgtatttatacgattttatatattgtatgtttgaatttacgacgttatatcgtgtacgtttatataatttattgtgtatttatacgattttatattgtgtatattcgtatttatatgattttatattatacgtgtttatatttatacgattttatatcgtgtatttatatgatttcgtattacgtacgttcgtatttacgattttatatcgtgtatatttatacgattttataacgtgtatgttcgtattgacgattttatattatgtatttatacgattttatatcgtgtacgtttgaatttaagattttatatcgtgtacgttcgtatttataagattttacgttatgtatttatataattttatatcgtgtacgtttgaatttacgattttatatcgtgtatattcgtatttataggattttatatcgtgtacgtttttatttacgggattttatatcgtgtaggattatatttatattatatattatgtatgttcgtatttatacgattttatacgatgtacgtttatattttttatacgttagtatttatgattttatattacgcgtgtttatatttatatgattttatatcgcgtatatttatatatatattattttatattgtaaatgtttatatatgattttatattgcgtatgtgcgtatttttacgattttatattatatacgtttatatttattttgattttatattgtgtaggtttaaatttatatattttatattacgtatttatatttatatgattttat

SEQ ID NO: 27026 - DNA, 926 bp, Artificial Sequence
  chemically treated genomic DNA (Homo sapiens) CpG-island No: 27026
ataaaatcatataaatataaatacgtaatataaaatatataaatttaaacctacacaatataaaatcaaaataaatataaacgtatataatataaaatcgtaaaaatacgcacatacgcaatataaaatcatatataaacatttacaatataaaataatatatatataaatatacgcgatataaaatcatataaatataaacacgcgtaatataaaatcataaatactaacgtataaaaaatataaacgtacatcgtataaaatcgtataaatacgaacatacataatatataatataaatataatcctacacgatataaaatcccgtaaataaaaacgtacacgatataaaatcctataaatacgaatatacacgatataaaatcgtaaattcaaacgtacacgatataaaattatataaatacataacgtaaaatcttataaatacgaacgtacacgatataaaatcttaaattcaaacgtacacgatataaaatcgtataaatacataatataaaatcgtcaatacgaacatacacgttataaaatcgtataaatatacacgatataaaatcgtaaatacgaacgtacgtaatacgaaatcatataaatacacgatataaaatcgtataaatataaacacgtataatataaaatcatataaatacgaatatacacaatataaaatcgtataaatacacaataaattatataaacgtacacgatataacgtcgtaaattcaaacatacaatatataaaatcgtataaatacgaacctacacgatataaaataaatataaacacacgtaatatatcatataactacgtatatacacaatataaactcgtataaatacgaacgtacataatatacaatcgtaaattccgacgtacacgatataaaatcttataaatacgaacgtac

SEQ ID NO: 27027 - DNA, 926 bp, Artificial Sequence
  chemically treated genomic DNA (Homo sapiens) CpG-island No: 27027
atggggttatgtgagtgtagatgcgtggtgtggggtgtgtaagtttagatttgtataatatggggttaaagtgagtgtagacgtgtgtggtgtggggtcgtgagagtgcgtatatgcgtaatgtggggttatgtgtgaatatttgtagtgtggggtaatgtgtgtgtgggtgtgcgcggtgtggggttatgtgaatgtgggtacgcgtggtgtggggttatgggtgttggcgtgtggggggtgtgggcgtgtatcgtgtggggtcgtgtgagtgcgggtatgtatggtgtgtggtgtgagtgtggttttgtacggtgtggggtttcgtgagtgagggcgtgtacggtgtggggttttgtgagtgcgggtgtgtacggtgtggggtcgtaagtttaggcgtgtacggtatggggttgtgtgagtgtatggcgtggggttttgtgagtgcgggcgtgtacggtgtggggttttgagtttaggcgtgtacggtatggggtcgtgtgagtgtatggtgtggggtcgttagtgcgggtatgtacgttgtggggtcgtgtgggtgtgtacggtgtggggtcgtgagtgcgggcgtgcgtggtgcggggttatgtgagtgtacggtgtggggtcgtgtgagtgtgggtacgtgtgatgtggggttatgtgagtgcggatgtgtatagtgtgggatcgtgtgagtgtatagtgggttgtgtgaacgtgtacggtgtggcgtcgtgagtttaggtatgtagtgtgtggggtcgtgtgaatacgggtttgtacggtgtggggtgagtgtgggtatacgtgatgtgttatgtgattgcgtatgtgtatagtgtgagttcgtgtgaatgcgggcgtgtatggtgtgtagtcgtgagtttcggcgtgtacgatgtggggttttgtgagtgcgggcgtgt

SEQ ID NO: 27028 - DNA, 926 bp, Artificial Sequence
  chemically treated genomic DNA (Homo sapiens) CpG-island No: 27028
acacgcccgcactcacaaaaccccacatcgtacacgccgaaactcacgactacacaccatacacgcccgcattcacacgaactcacactatacacatacgcaatcacataacacatcacgtatacccacactcaccccacaccgtacaaacccgtattcacacgaccccacacactacatacctaaactcacgacgccacaccgtacacgttcacacaacccactatacactcacacgatcccacactatacacatccgcactcacataaccccacatcacacgtacccacactcacacgaccccacaccgtacactcacataaccccgcaccacgcacgcccgcactcacgaccccacaccgtacacacccacacgaccccacaacgtacatacccgcactaacgaccccacaccatacactcacacgaccccataccgtacacgcctaaactcaaaaccccacaccgtacacgcccgcactcacaaaaccccacgccatacactcacacaaccccataccgtacacgcctaaacttacgaccccacaccgtacacacccgcactcacaaaaccccacaccgtacacgccctcactcacgaaaccccacaccgtacaaaaccacactcacaccacacaccatacatacccgcactcacacgaccccacacgatacacgcccacaccccccacacgccaacacccataaccccacaccacgcgtacccacattcacataaccccacaccgcgcacacccacacacacattaccccacactacaaatattcacacataaccccacattacgcatatacgcactctcacgaccccacaccacacacgtctacactcactttaaccccatattatacaaatctaaacttacacaccccacaccacgcatctacactcacataaccccat

SEQ ID NO: 27029 - DNA, 789 bp, Artificial Sequence
  chemically treated genomic DNA (Homo sapiens) CpG-island No: 27029
cggtatttacgttttcgtggagattttttttgtagtttgtggtttcggtatttacgttttcgtggagagttttttgtagtacgtggtttcggtatttacgttttcgtggagattttttttgtagttcgtggtttcggtatttatgttttcgtggagagtttttttgtagtacgtggtttcggtatttacgttttcgtggagagtttttttgtagtttgtggtttcggtatttacgttttcgtggagagattttttgtagttcgtggtttcggtatttacgttttcgtggagattttttttgtagttcgtggtttcggtatttatgttttcgtggagagtttttttgtggtacgtggtttcggtatttacgttttcgtggagagtttttttgtagtttatggtttcggtatttacgttttcgtggagattttttttgtagttcgtggtttcggtatttacgtttttatggagattttttttgtagtttgtggtttcggtatttatgttttcgtggagagtttttttgtagtacgtggtttcggtatttacgttttcgtggagagtttttttgtagtttgtggtttcggtatttacgttttcgtggagagtttttttgtggtacgtggtttcggtatttacgtttttgtggagagtttttttgtggtacgtggtttcggtatttacgttttcgtggagattttttttgtagtttgtggtttcggtatttacgttttcgtggagagtttttttgtggtacgtggtttcggtatgttgtttgggtgtatgggg

SEQ ID NO: 27030 - DNA, 789 bp, Artificial Sequence
  chemically treated genomic DNA (Homo sapiens) CpG-island No: 27030
ccccatacacccaaacaacataccgaaaccacgtaccacaaaaaaactctccacgaaaacgtaaataccgaaaccacaaactacaaaaaaaatctccacgaaaacgtaaataccgaaaccacgtaccacaaaaaaactctccacaaaaacgtaaataccgaaaccacgtaccacaaaaaaactctccacgaaaacgtaaataccgaaaccacaaactacaaaaaaactctccacgaaaacgtaaataccgaaaccacgtactacaaaaaaactctccacgaaaacataaataccgaaaccacaaactacaaaaaaaatctccataaaaacgtaaataccgaaaccacgaactacaaaaaaaatctccacgaaaacgtaaataccgaaaccataaactacaaaaaaactctccacgaaaacgtaaataccgaaaccacgtaccacaaaaaaactctccacgaaaacataaataccgaaaccacgaactacaaaaaaaatctccacgaaaacgtaaataccgaaaccacgaactacaaaaaatctctccacgaaaacgtaaataccgaaaccacaaactacaaaaaaactctccacgaaaacgtaaataccgaaaccacgtactacaaaaaaactctccacgaaaacataaataccgaaaccacgaactacaaaaaaaatctccacgaaaacgtaaataccgaaaccacgtactacaaaaaactctccacgaaaacgtaaataccgaaaccacaaactacaaaaaaaatctccacgaaaacgtaaataccg

SEQ ID NO: 27031 - DNA, 789 bp, Artificial Sequence
  chemically treated genomic DNA (Homo sapiens) CpG-island No: 27031
ttttatgtatttaaataatatgtcggggttacgtgttataggaaaattttttacggaaacgtggatgtcggggttataggttataggaaaagtttttacggaaacgtggatgtcggggttacgtgttataggaaaattttttatagaaacgtggatgtcggggttacgtgttataggaaaattttttacggaaacgtggatgtcggggttataggttataggaaaattttttacggaaacgtggatgtcggagttacgtgttataggaaaattttttacggaaatatggatgtcggggttataggttataggaaaagtttttatggaaacgtggatgtcggggttacgggttataggaaaagtttttacggaaacgtggatgtcggggttatgggttataggaaaattttttacggaaacgtggatgtcggggttacgtgttataggaaaattttttacggaaatatggatgtcggggttacgggttataggaaaagtttttacggaaacgtggatgtcggggttacgggttataggaaatttttttacggaaacgtggatgtcggggttataggttataggaaaattttttacggaaacgtggatgtcggagttacgtgttataggaaaattttttacggaaatatggatgtcggggttacgggttataggaaaagtttttacggaaacgtggatgtcggagttacgtgttataggaaattttttacggaaacgtggatgtcggggttataggttataggaaaagtttttacggaaacgtggatgtcg

SEQ ID NO: 27032 - DNA, 789 bp, Artificial Sequence
  chemically treated genomic DNA (Homo sapiens) CpG-island No: 27032
cgacatccacgtttccgtaaaaacttttcctataacctataaccccgacatccacgtttccgtaaaaaatttcctataacacgtaactccgacatccacgtttccgtaaaaacttttcctataacccgtaaccccgacatccatatttccgtaaaaaattttcctataacacgtaactccgacatccacgtttccgtaaaaaattttcctataacctataaccccgacatccacgtttccgtaaaaaaatttcctataacccgtaaccccgacatccacgtttccgtaaaaacttttcctataacccgtaaccccgacatccatatttccgtaaaaaattttcctataacacgtaaccccgacatccacgtttccgtaaaaaattttcctataacccataaccccgacatccacgtttccgtaaaaacttttcctataacccgtaaccccgacatccacgtttccataaaaacttttcctataacctataaccccgacatccatatttccgtaaaaaattttcctataacacgtaactccgacatccacgtttccgtaaaaaattttcctataacctataaccccgacatccacgtttccgtaaaaaattttcctataacacgtaaccccgacatccacgtttctataaaaaattttcctataacacgtaaccccgacatccacgtttccgtaaaaacttttcctataacctataaccccgacatccacgtttccgtaaaaaattttcctataacacgtaaccccgacatattatttaaatacataaaa

SEQ ID NO: 27033 - DNA, 548 bp, Artificial Sequence
  chemically treated genomic DNA (Homo sapiens) CpG-island No: 27033
gcgttttcgtagtcggattttgagcgcggcgttttttttttttttttgttgttttattattattttcgtttttgttttcgtcgtcgttaatatcgtttttttttaggttttttataacgcgtagtttgtagttagttgtttcgcggcggaattttattttattttattttatttcgtttttgttttcgttcgtttttttagggggtttttttcgttttttttattatttagcgcgtcgaagttttttgtttagagttcggttttgttatttggattcgttttttgtgttttttgcgtttcgttatgttggtcgtttcgttcggttttttttgacgtggagcgaggagggggcggtggaaatttcgcgagaacgcgtttcgaggttcgttatgtaattcgtcggttggcgtttttggaatggggaggtcggtcgtttggcggggttagcggtttttagcggtgtttttttttttttttttttttcgtttttgttgtgcgggaattggagaatcgttaggacgtggaggaagtagagaagtggattagag

SEQ ID NO: 27034 - DNA, 548 bp, Artificial Sequence
  chemically treated genomic DNA (Homo sapiens) CpG-island No: 27034
ctctaatccacttctctacttcctccacgtcctaacgattctccaattcccgcacaacaaaaacgaaaaaaaaaaaaaaaaaaaaacaccgctaaaaaccgctaaccccgccaaacgaccgacctccccattccaaaaacgccaaccgacgaattacataacgaacctcgaaacgcgttctcgcgaaatttccaccgccccctcctcgctccacgtcaaaaaaaaccgaacgaaacgaccaacataacgaaacgcaaaaaacacaaaaaacgaatccaaataacaaaaccgaactctaaacaaaaaacttcgacgcgctaaataataaaaaaaacgaaaaaaaccccctaaaaaaacgaacgaaaacaaaaacgaaataaaataaaataaaataaaattccgccgcgaaacaactaactacaaactacgcgttataaaaaacctaaaaaaaaacgatattaacgacgacgaaaacaaaaacgaaaataataataaaacaacaaaaaaaaaaaaaaaacgccgcgctcaaaatccgactacgaaaacgc

SEQ ID NO: 27035 - DNA, 548 bp, Artificial Sequence
  chemically treated genomic DNA (Homo sapiens) CpG-island No: 27035
ttttgatttatttttttgttttttttacgttttaacgattttttagttttcgtatagtaggagcggagggaagaggggagagaaggtatcgttaaggatcgttggtttcgttaggcggtcgatttttttattttaggggcgttagtcggcggattatataacgggtttcggggcgcgttttcgcgaggtttttatcgtttttttttcgttttacgttagagggaatcgggcggagcggttaatatggcggaacgtaggagatataagaagcggatttaggtagtaaagtcgagttttgggtagggggtttcggcgcgttggatagtggaaggggcggggaaagttttttaaaagggcgagcgaaagtaagggcgaggtggggtggggtggggtggggtttcgtcgcgaggtagttggttgtaggttgcgcgttgtgaggggtttgagggggggcggtgttggcgacggcggagatagagacggaggtggtggtggagtagtaggggaaggaaggaggcgtcgcgtttagaattcggttgcggaggcgt

SEQ ID NO: 27036 - DNA, 548 bp, Artificial Sequence
  chemically treated genomic DNA (Homo sapiens) CpG-island No: 27036
acgcctccgcaaccgaattctaaacgcgacgcctccttccttcccctactactccaccaccacctccgtctctatctccgccgtcgccaacaccgccccccctcaaacccctcacaacgcgcaacctacaaccaactacctcgcgacgaaaccccaccccaccccaccccacctcgcccttactttcgctcgcccttttaaaaaactttccccgccccttccactatccaacgcgccgaaaccccctacccaaaactcgactttactacctaaatccgcttcttatatctcctacgttccgccatattaaccgctccgcccgattccctctaacgtaaaacgaaaaaaaaacgataaaaacctcgcgaaaacgcgccccgaaacccgttatataatccgccgactaacgcccctaaaataaaaaaatcgaccgcctaacgaaaccaacgatccttaacgataccttctctcccctcttccctccgctcctactatacgaaaactaaaaaatcgttaaaacgtaaaaaaaacaaaaaaataaatcaaaa

SEQ ID NO: 27037 - DNA, 625 bp, Artificial Sequence
  chemically treated genomic DNA (Homo sapiens) CpG-island No: 27037
aatcgcggagtaattagtcgggcgtttgcgggagtcgagcgtggtgaggtggggttttaggggtaggtgggaggtgttcgggttaatcgttcgaggttcggagattcgttcgtttagggcgtttgagggaatttcgttcgggtagcggttttttgttattcgggaggaattcgaggtttagagaggggttgggacgcgtcgttagggttcggggttcgtttgttttagttttttgttgtcgttagtacgttaagttttagtcggcgtcgaaggagagtttttcgattttcgtgtttagtagtcgtaattttaggttgggagggtgaggcgtcgcgttttgtcgttttttcgtttttcgttttttgtgttttggcggatttgtacgtaatttattcgaaagtttagttttattcgttattcgattttggagtttttattttttaggattttgttgaagtatcgttttttagtcgttttttttaggcgtagttgtattcgtttttcggtttttgtattcgttgtgtatcgagttattttttcggtttttcgttgatatcgtaagttcgttcgttagatgttatgttttgttttttttatttttagattttagggtttagtacgtgat

SEQ ID NO: 27038 - DNA, 625 bp, Artificial Sequence
  chemically treated genomic DNA (Homo sapiens) CpG-island No: 27038
atcacgtactaaaccctaaaatctaaaaataaaaaaaacaaaacataacatctaacgaacgaacttacgatatcaacgaaaaaccgaaaaaataactcgatacacaacgaatacaaaaaccgaaaaacgaatacaactacgcctaaaaaaaacgactaaaaaacgatacttcaacaaaatcctaaaaaataaaaactccaaaatcgaataacgaataaaactaaactttcgaataaattacgtacaaatccgccaaaacacaaaaaacgaaaaacgaaaaaacgacaaaacgcgacgcctcaccctcccaacctaaaattacgactactaaacacgaaaatcgaaaaactctccttcgacgccgactaaaacttaacgtactaacgacaacaaaaaactaaaacaaacgaaccccgaaccctaacgacgcgtcccaacccctctctaaacctcgaattcctcccgaataacaaaaaaccgctacccgaacgaaattccctcaaacgccctaaacgaacgaatctccgaacctcgaacgattaacccgaacacctcccacctacccctaaaaccccacctcaccacgctcgactcccgcaaacgcccgactaattactccgcgatt

SEQ ID NO: 27039 - DNA, 625 bp, Artificial Sequence
  chemically treated genomic DNA (Homo sapiens) CpG-island No: 27039
attacgtgttaggttttgggatttagagatgaaaaaggtaaggtataatatttaacgaacgagtttacggtgttaacgaggggtcgggaaagtaattcggtgtatagcgagtgtaaaaatcgagaagcgaatgtagttgcgtttggagaaggcggttgagaagcgatattttagtagggttttgaagaatgggagttttagagtcgggtggcgggtgggattgggttttcggatagattacgtgtaaattcgttaggatatagggagcgaggggcgggggggcggtagagcgcggcgttttatttttttagtttgggattgcggttattggatacgagggtcgggaagttttttttcggcgtcgattggagtttagcgtgttggcggtagtaagaagttgaggtaagcgggtttcgggttttaacgacgcgttttagtttttttttgggtttcgggtttttttcgggtaataagaggtcgttgttcgaacgggatttttttaggcgttttagacgggcgggttttcgggtttcggacggttaattcgagtattttttatttgtttttgaggttttattttattacgttcggttttcgtagacgttcggttagttgtttcgcgatt

SEQ ID NO: 27040 - DNA, 625 bp, Artificial Sequence
  chemically treated genomic DNA (Homo sapiens) CpG-island No: 27040
aatcgcgaaacaactaaccgaacgtctacgaaaaccgaacgtaataaaataaaacctcaaaaacaaataaaaaatactcgaattaaccgtccgaaacccgaaaacccgcccgtctaaaacgcctaaaaaaatcccgttcgaacaacgacctcttattacccgaaaaaaacccgaaacccaaaaaaaaactaaaacgcgtcgttaaaacccgaaacccgcttacctcaacttcttactaccgccaacacgctaaactccaatcgacgccgaaaaaaaacttcccgaccctcgtatccaataaccgcaatcccaaactaaaaaaataaaacgccgcgctctaccgcccccccgcccctcgctccctatatcctaacgaatttacacgtaatctatccgaaaacccaatcccacccgccacccgactctaaaactcccattcttcaaaaccctactaaaatatcgcttctcaaccgccttctccaaacgcaactacattcgcttctcgatttttacactcgctatacaccgaattactttcccgacccctcgttaacaccgtaaactcgttcgttaaatattataccttacctttttcatctctaaatcccaaaacctaacacgtaat

SEQ ID NO: 27041 - DNA, 1331 bp, Artificial Sequence
  chemically treated genomic DNA (Homo sapiens) CpG-island No: 27041
ttttttcggtttagggattgcggttttacgtcgttgattttagcggggattttttcggtcgtcgggaggggatttcggaattggtttcggagtgcgcgtgtggtcgcggcggggaggggcgaggcggggagttttcgtcgtttcgcgttaagagggcgggagggcgatatagcggttaggagcggttttcgaggtcggttagggatttagtttttttcgttattattaattcgcgttttttacgcgcgtcgtcgttagttggtttcgcgcgttttttaggtggaggttaggaggtagagaatcgcgggttcgggggttattcgttatttttaagtcgtttcgttagaagtttagggcgaggaaaaggagagagataaaagagcgttgcggggggagtttttatatttttcgcggtttcgtatacggttcggtttttattcgtagtggcggaagatttcgttggtgattttatagtagaaaattttttcgtcgggtcgtaggttcgcgggcggtttttgttttataaacggttttcggtgtagtagcggtatttttcgttcgttcgcgggttcgtttggattttcggtcgttcgcgtcggtttcgtttttttattaaaattggagggaaaggaaagtcggtaaggtggggagttttcggcggtagcgtgggtcggttcgcgcgttgggagaagttcggttgttttttgtgtgattgacgcgtcgcggtcgttatcggagtcgagttcgtttttgtcgttgttcgggtgtcgagcgagcggagtcgtcgtcgtttttgtttttcgagcgcgttttattttttttcgttttgtcgtcgttttataatggggtaggacgtttcgtcgcggggggtagtgcgggagcggcggcggtttttttttttagcgtcggtttttcgttcgtcgtcgtcgttaggtttataacgtgttcggcgcgtagttggtcggtcggttagtttaacgtcgttagagcgttcgtcgcgggcggatttcggagttgtttcgttttgttttcggttcgtttttattttttcgtcggcgtcggtcggttttcgagcgatttttatttgcgattacgtcgattgttatttgtttattttttttattataaaggtaacgaggggagatttcgtttttttaggggatcgttttttttcggtttcgtcgcgtttttggttgtcgtttttttcgttgttattgttcgatttcgcgcggggaattgcgttttatcgttattttttcgtttttcggagtttttgggaagtttttgatttattttcggttttgaaggaggaagagttgttgggaggagtt

SEQ ID NO: 27042 - DNA, 1331 bp, Artificial Sequence
  chemically treated genomic DNA (Homo sapiens) CpG-island No: 27042
aactcctcccaacaactcttcctccttcaaaaccgaaaataaatcaaaaacttcccaaaaactccgaaaaacgaaaaaataacgataaaacgcaattccccgcgcgaaatcgaacaataacaacgaaaaaaacgacaaccaaaaacgcgacgaaaccgaaaaaaaacgatcccctaaaaaaacgaaatctcccctcgttacctttataataaaaaaaataaacaaataacaatcgacgtaatcgcaaataaaaatcgctcgaaaaccgaccgacgccgacgaaaaaataaaaacgaaccgaaaacaaaacgaaacaactccgaaatccgcccgcgacgaacgctctaacgacgttaaactaaccgaccgaccaactacgcgccgaacacgttataaacctaacgacgacgacgaacgaaaaaccgacgctaaaaaaaaaaaccgccgccgctcccgcactaccccccgcgacgaaacgtcctaccccattataaaacgacgacaaaacgaaaaaaaataaaacgcgctcgaaaaacaaaaacgacgacgactccgctcgctcgacacccgaacaacgacaaaaacgaactcgactccgataacgaccgcgacgcgtcaatcacacaaaaaacaaccgaacttctcccaacgcgcgaaccgacccacgctaccgccgaaaactccccaccttaccgactttcctttccctccaattttaataaaaaaacgaaaccgacgcgaacgaccgaaaatccaaacgaacccgcgaacgaacgaaaaataccgctactacaccgaaaaccgtttataaaacaaaaaccgcccgcgaacctacgacccgacgaaaaaattttctactataaaatcaccaacgaaatcttccgccactacgaataaaaaccgaaccgtatacgaaaccgcgaaaaatataaaaactccccccgcaacgctcttttatctctctccttttcctcgccctaaacttctaacgaaacgacttaaaaataacgaataacccccgaacccgcgattctctacctcctaacctccacctaaaaaacgcgcgaaaccaactaacgacgacgcgcgtaaaaaacgcgaattaataataacgaaaaaaactaaatccctaaccgacctcgaaaaccgctcctaaccgctatatcgccctcccgccctcttaacgcgaaacgacgaaaactccccgcctcgcccctccccgccgcgaccacacgcgcactccgaaaccaattccgaaatcccctcccgacgaccgaaaaaatccccgctaaaatcaacgacgtaaaaccgcaatccctaaaccgaaaaaa

SEQ ID NO: 27043 - DNA, 1331 bp, Artificial Sequence
  chemically treated genomic DNA (Homo sapiens) CpG-island No: 27043
agttttttttaatagtttttttttttttagagtcgaaagtagattagaaattttttaggagtttcgagaggcggggaagtggcggtgggacgtaatttttcgcgcggagtcgggtagtggtagcgggagaagcggtagttaggggcgcggcggggtcggagagaggcggttttttgggaggacggggttttttttcgttgtttttgtagtggagaaggtggataagtggtagtcggcgtgatcgtaggtgagggtcgttcgggagtcggtcggcgtcggcggggaagtggaggcgagtcgggaataaagcggagtagtttcggggttcgttcgcggcgagcgttttggcggcgttgggttggtcggtcggttagttgcgcgtcgagtacgttgtgagtttggcggcggcggcgggcgaggagtcggcgttgggggagggggtcgtcgtcgttttcgtattgtttttcgcggcggggcgttttgttttattgtgaggcggcggtaggacgagaggaggtagggcgcgttcggggggtaggggcggcggcggtttcgttcgttcgatattcgggtagcggtaggaacgaattcggtttcggtagcggtcgcggcgcgttagttatataaaaggtagtcgagttttttttagcgcgcggatcggtttacgttgtcgtcgagggttttttattttatcggtttttttttttttttaattttgatagggaagcggggtcggcgcgggcggtcgagggtttaggcgagttcgcgggcggacgggagatgtcgttgttatatcgaaagtcgtttgtgagatagaagtcgttcgcggatttgcggttcgacgaggaagttttttattgtaaagttattaacgagatttttcgttattacgagtaagagtcgggtcgtgtgcggggtcgcggggggtgtggggatttttttcgtagcgtttttttgttttttttttttttttcgttttgggtttttggcggggcgatttgaaagtgacgggtggttttcgggttcgcggttttttgttttttggtttttatttggagaacgcgcggggttaattggcggcggcgcgcgtggggaacgcgggttggtagtggcggaggaggttgggtttttggtcggtttcggggatcgtttttagtcgttgtgtcgttttttcgtttttttggcgcggggcggcggaaatttttcgtttcgttttttttcgtcgcggttatacgcgtatttcggggttagtttcgggattttttttcggcggtcgaggggattttcgttagggttagcgacgtggggtcgtagtttttgggtcggggaag

SEQ ID NO: 27044 - DNA, 1331 bp, Artificial Sequence
  chemically treated genomic DNA (Homo sapiens) CpG-island No: 27044
cttccccgacccaaaaactacgaccccacgtcgctaaccctaacgaaaatcccctcgaccgccgaaaaaaaatcccgaaactaaccccgaaatacgcgtataaccgcgacgaaaaaaaacgaaacgaaaaatttccgccgccccgcgccaaaaaaacgaaaaaacgacacaacgactaaaaacgatccccgaaaccgaccaaaaacccaacctcctccgccactaccaacccgcgttccccacgcgcgccgccgccaattaaccccgcgcgttctccaaataaaaaccaaaaaacaaaaaaccgcgaacccgaaaaccacccgtcactttcaaatcgccccgccaaaaacccaaaacgaaaaaaaaaaaaaaaacaaaaaaacgctacgaaaaaaatccccacaccccccgcgaccccgcacacgacccgactcttactcgtaataacgaaaaatctcgttaataactttacaataaaaaacttcctcgtcgaaccgcaaatccgcgaacgacttctatctcacaaacgactttcgatataacaacgacatctcccgtccgcccgcgaactcgcctaaaccctcgaccgcccgcgccgaccccgcttccctatcaaaattaaaaaaaaaaaaaaaccgataaaataaaaaaccctcgacgacaacgtaaaccgatccgcgcgctaaaaaaaactcgactaccttttatataactaacgcgccgcgaccgctaccgaaaccgaattcgttcctaccgctacccgaatatcgaacgaacgaaaccgccgccgcccctaccccccgaacgcgccctacctcctctcgtcctaccgccgcctcacaataaaacaaaacgccccgccgcgaaaaacaatacgaaaacgacgacgaccccctcccccaacgccgactcctcgcccgccgccgccgccaaactcacaacgtactcgacgcgcaactaaccgaccgaccaacccaacgccgccaaaacgctcgccgcgaacgaaccccgaaactactccgctttattcccgactcgcctccacttccccgccgacgccgaccgactcccgaacgaccctcacctacgatcacgccgactaccacttatccaccttctccactacaaaaacaacgaaaaaaaaccccgtcctcccaaaaaaccgcctctctccgaccccgccgcgcccctaactaccgcttctcccgctaccactacccgactccgcgcgaaaaattacgtcccaccgccacttccccgcctctcgaaactcctaaaaaatttctaatctactttcgactctaaaaaaaaaaaaactattaaaaaaaact

SEQ ID NO: 27045 - DNA, 770 bp, Artificial Sequence
  chemically treated genomic DNA (Homo sapiens) CpG-island No: 27045
ttagcgaacgttgcggttaggggagggcgggaggagggagagcggacgtagggggcggggaggggcgtagggttgcgcgttcgtcggcgttttttttcggtttggtcggcggttggaggagagtggatttttttattttaaggttttgttttcggcgcgttttcgtcgtttttcggtttcgacgcggggttcggggatgttcgttagtatgtttagtatcgataatattttagtcgttcggtcgcgttgtaaggattcggtgttgtcggtggcgtatagcgcggcggttttcgtcgttttttcggttttgtacggggattcgttttacggcgttagcggcggcgttttttcggattatggcgttttttattcgcgtttcgtggttttcggcggcgcgggtttttcggtcgcggttagcggttttcgtttcggttataataattatttttacgggtagttgtacgtgtaggcggcgttcgtgggttcggtttgttgcggggtcgtgtcgtcgttgggcgtttagtagtgtttttgcgtttcgacgtttttaggtagggtcgcgttcgtttcggtttttgtcgtttattgcggtttttagtttatggagtcggttggttaatttattttttttaaattttgttttttttgtaattttttttttcgtttttgtcgatcgggcgtaggagtttgtaaattttttgttgtaaatttttggttagagttcgcgaaaattggaatttagtgtttgttcggggaaattgggttttgtt

SEQ ID NO: 27046 - DNA, 770 bp, Artificial Sequence
  chemically treated genomic DNA (Homo sapiens) CpG-island No: 27046
aacaaaacccaatttccccgaacaaacactaaattccaattttcgcgaactctaaccaaaaatttacaacaaaaaatttacaaactcctacgcccgatcgacaaaaacgaaaaaaaaaattacaaaaaaaacaaaatttaaaaaaaataaattaaccaaccgactccataaactaaaaaccgcaataaacgacaaaaaccgaaacgaacgcgaccctacctaaaaacgtcgaaacgcaaaaacactactaaacgcccaacgacgacacgaccccgcaacaaaccgaacccacgaacgccgcctacacgtacaactacccgtaaaaataattattataaccgaaacgaaaaccgctaaccgcgaccgaaaaacccgcgccgccgaaaaccacgaaacgcgaataaaaaacgccataatccgaaaaaacgccgccgctaacgccgtaaaacgaatccccgtacaaaaccgaaaaaacgacgaaaaccgccgcgctatacgccaccgacaacaccgaatccttacaacgcgaccgaacgactaaaatattatcgatactaaacatactaacgaacatccccgaaccccgcgtcgaaaccgaaaaacgacgaaaacgcgccgaaaacaaaaccttaaaataaaaaaatccactctcctccaaccgccgaccaaaccgaaaaaaaacgccgacgaacgcgcaaccctacgcccctccccgccccctacgtccgctctccctcctcccgccctcccctaaccgcaacgttcgctaa

SEQ ID NO: 27047 - DNA, 770 bp, Artificial Sequence
  chemically treated genomic DNA (Homo sapiens) CpG-island No: 27047
aataaaatttagttttttcgggtaggtattgaattttagttttcgcgaattttggttaaaagtttgtagtaagaagtttgtaaatttttgcgttcgatcggtaaaagcggaggggggagttgtaagaggagtaaagtttgaggaaggtgaattaattaatcggttttatgggttaaggatcgtagtgggcggtagaggtcggagcgagcgcgattttatttgggggcgtcgggacgtaggagtattgttgggcgtttagcggcggtacggtttcgtagtaggtcgggtttacgggcgtcgtttgtacgtgtagttgttcgtagaagtagttgttgtagtcgaggcgggagtcgttgatcgcggtcgggaggttcgcgtcgtcgggggttacggggcgcgggtagaaggcgttatagttcgaggaggcgtcgtcgttggcgtcgtagagcgagttttcgtgtagggtcgggaagacgacgggagtcgtcgcgttgtgcgttatcggtaatatcgagtttttgtagcgcggtcgggcggttaggatgttgtcgatgttgaatatgttggcgggtattttcgagtttcgcgtcgggatcggggggcggcgggaacgcgtcgaggatagagttttaaagtgggggggtttatttttttttagtcgtcgattaaatcgaaagagagcgtcggcgagcgcgtagttttgcgttttttttcgttttttgcgttcgtttttttttttttcgtttttttttagtcgtagcgttcgttga

SEQ ID NO: 27048 - DNA, 770 bp, Artificial Sequence
  chemically treated genomic DNA (Homo sapiens) CpG-island No: 27048
tcaacgaacgctacgactaaaaaaaaacgaaaaaaaaaaaaacgaacgcaaaaaacgaaaaaaaacgcaaaactacgcgctcgccgacgctctctttcgatttaatcgacgactaaaaaaaaataaacccccccactttaaaactctatcctcgacgcgttcccgccgccccccgatcccgacgcgaaactcgaaaatacccgccaacatattcaacatcgacaacatcctaaccgcccgaccgcgctacaaaaactcgatattaccgataacgcacaacgcgacgactcccgtcgtcttcccgaccctacacgaaaactcgctctacgacgccaacgacgacgcctcctcgaactataacgccttctacccgcgccccgtaacccccgacgacgcgaacctcccgaccgcgatcaacgactcccgcctcgactacaacaactacttctacgaacaactacacgtacaaacgacgcccgtaaacccgacctactacgaaaccgtaccgccgctaaacgcccaacaatactcctacgtcccgacgcccccaaataaaatcgcgctcgctccgacctctaccgcccactacgatccttaacccataaaaccgattaattaattcaccttcctcaaactttactcctcttacaactcccccctccgcttttaccgatcgaacgcaaaaatttacaaacttcttactacaaacttttaaccaaaattcgcgaaaactaaaattcaatacctacccgaaaaaactaaattttatt

SEQ ID NO: 27049 - DNA, 588 bp, Artificial Sequence
  chemically treated genomic DNA (Homo sapiens) CpG-island No: 27049
tgaaaacgcggaagcgggagcgagcggtttttttttttttgttggtttgcgcggggtgtttcgtcgttatattaagtttttcgggtgtttcgggattgggggaagcgcgtttttgatttgaattgttttgtttttcgttgcgtaataggtttggtttaagaatcgtcgcgttaaatggaggcggtagaagcggtttttattagaggagtcggagaacgcggagaagtggaataagacgtcgtcgtcgaaggcgttatcggagaagagggaagaggaaggtaaaagcgatttggattcggatagttgacggtcgcgggatatttgttcgtattatttatttaattcgaaggatttgtatagatagacgatgttatttttttgtatacgcgttgttttgcgggagggggtcgagaaagaggaacgaggagttgtaaatagtgtatagagtcgggagggtcggcgtttggggttagggcgcgtatagtttagtagttcgaggtcgttcgcgattagtttttatcgtagtatttatagttaaattaagggtgatagtataataaagtgatggcgatgtagacgggttatatt

SEQ ID NO: 27050 - DNA, 588 bp, Artificial Sequence
  chemically treated genomic DNA (Homo sapiens) CpG-island No: 27050
aatataacccgtctacatcgccatcactttattatactatcacccttaatttaactataaatactacgataaaaactaatcgcgaacgacctcgaactactaaactatacgcgccctaaccccaaacgccgaccctcccgactctatacactatttacaactcctcgttcctctttctcgaccccctcccgcaaaacaacgcgtatacaaaaaaataacatcgtctatctatacaaatccttcgaattaaataaataatacgaacaaatatcccgcgaccgtcaactatccgaatccaaatcgcttttaccttcctcttccctcttctccgataacgccttcgacgacgacgtcttattccacttctccgcgttctccgactcctctaataaaaaccgcttctaccgcctccatttaacgcgacgattcttaaaccaaacctattacgcaacgaaaaacaaaacaattcaaatcaaaaacgcgcttcccccaatcccgaaacacccgaaaaacttaatataacgacgaaacaccccgcgcaaaccaacaaaaaaaaaaaaaccgctcgctcccgcttccgcgttttca

SEQ ID NO: 27051 - DNA, 588 bp, Artificial Sequence
  chemically treated genomic DNA (Homo sapiens) CpG-island No: 27051
aatgtggttcgtttatatcgttattattttattgtattgttatttttaatttaattataaatattacggtgggggttagtcgcgggcggtttcgggttgttgggttgtgcgcgttttgattttagacgtcgattttttcggttttgtatattatttatagtttttcgtttttttttttcgattttttttcgtaaggtagcgcgtgtgtaagaaagtagtatcgtttgtttgtgtaagtttttcgagttaggtaagtaatacgggtaagtgtttcgcggtcgttagttgttcgagtttaaatcgtttttattttttttttttttttttttcggtgacgttttcgacgacgacgttttgttttattttttcgcgtttttcgatttttttgatgaggatcgtttttgtcgtttttatttggcgcggcggtttttaaattagatttgttgcgtaacggaggataaaatagtttagattaaaggcgcgttttttttagtttcggggtattcggggagtttggtgtggcggcgggatatttcgcgtaggttaataaaaggaggggagtcgttcgttttcgttttcgcgttttta

SEQ ID NO: 27052 - DNA, 588 bp, Artificial Sequence
  chemically treated genomic DNA (Homo sapiens) CpG-island No: 27052
taaaaacgcgaaaacgaaaacgaacgactcccctccttttattaacctacgcgaaatatcccgccgccacaccaaactccccgaataccccgaaactaaaaaaaacgcgcctttaatctaaactattttatcctccgttacgcaacaaatctaatttaaaaaccgccgcgccaaataaaaacgacaaaaacgatcctcatcaaaaaaatcgaaaaacgcgaaaaaataaaacaaaacgtcgtcgtcgaaaacgtcaccgaaaaaaaaaaaaaaaaaaaataaaaacgatttaaactcgaacaactaacgaccgcgaaacacttacccgtattacttacctaactcgaaaaacttacacaaacaaacgatactactttcttacacacgcgctaccttacgaaaaaaaatcgaaaaaaaaaaacgaaaaactataaataatatacaaaaccgaaaaaatcgacgtctaaaatcaaaacgcgcacaacccaacaacccgaaaccgcccgcgactaacccccaccgtaatatttataattaaattaaaaataacaatacaataaaataataacgatataaacgaaccacatt

SEQ ID NO: 27053 - DNA, 524 bp, Artificial Sequence
  chemically treated genomic DNA (Homo sapiens) CpG-island No: 27053
tcgcggtggttcgttcgttttcgtagaggggtcgtcgggaagagggtttattttcgtagttcggtcgtttttcgtcgaatttcggtttcggcgttagaagttgcggtttagcgtagagtttaaacgaaagcgcgatttagggaagtgttgtttcgttttattttttttcgggtttcgtatttttttcgcgtttcggggtgcggtcgtattttttcggcgatttttcgggattttggtttgtttcgacgttggttcggggattcgatttcgtttagagcggaattgattttttttatttgtaggtttaacggggcgggaaaattgaaaattcgtagggattcggggttcgacggaacggtcgttgggttttgggatttcggggtggttttttttagtttcgtatttcgggttcgaaacgcgttaggatcggaaataaatattcggaattttataggatttcgtttttataattttgagaaattggattttcgcgatttttcgaatattgacgttagatgtttacg

SEQ ID NO: 27054 - DNA, 524 bp, Artificial Sequence
  chemically treated genomic DNA (Homo sapiens) CpG-island No: 27054
cgtaaacatctaacgtcaatattcgaaaaatcgcgaaaatccaatttctcaaaattataaaaacgaaatcctataaaattccgaatatttatttccgatcctaacgcgtttcgaacccgaaatacgaaactaaaaaaaaccaccccgaaatcccaaaacccaacgaccgttccgtcgaaccccgaatccctacgaattttcaattttcccgccccgttaaacctacaaataaaaaaaatcaattccgctctaaacgaaatcgaatccccgaaccaacgtcgaaacaaaccaaaatcccgaaaaatcgccgaaaaaatacgaccgcaccccgaaacgcgaaaaaaatacgaaacccgaaaaaaaataaaacgaaacaacacttccctaaatcgcgctttcgtttaaactctacgctaaaccgcaacttctaacgccgaaaccgaaattcgacgaaaaacgaccgaactacgaaaataaaccctcttcccgacgacccctctacgaaaacgaacgaaccaccgcga

SEQ ID NO: 27055 - DNA, 524 bp, Artificial Sequence
  chemically treated genomic DNA (Homo sapiens) CpG-island No: 27055
cgtaggtatttaacgttagtattcgggaagtcgcgggggtttagttttttagagttataggggcggagttttataaggtttcgagtgtttattttcggttttagcgcgtttcggattcgagatacggagttaaaggagattatttcggagttttaagatttaacgatcgtttcgtcgggtttcggatttttacgaatttttagttttttcgtttcgttaagtttataggtagaagggattagtttcgttttagacgagatcggattttcgagttaacgtcgaaataagttaagatttcggggaatcgtcgagaaggtacgatcgtatttcgaaacgcgagaaggatacgagattcggaaggagatagggcggaataatatttttttggatcgcgttttcgtttaaattttacgttaaatcgtaatttttaacgtcggagtcggagttcggcggaaggcgatcggattacggaggtaaatttttttttcggcgatttttttacgagagcgagcgagttatcgcga

SEQ ID NO: 27056 - DNA, 524 bp, Artificial Sequence
  chemically treated genomic DNA (Homo sapiens) CpG-island No: 27056
tcgcgataactcgctcgctctcgtaaaaaaatcgccgaaaaaaaaatttacctccgtaatccgatcgccttccgccgaactccgactccgacgttaaaaattacgatttaacgtaaaatttaaacgaaaacgcgatccaaaaaaatattattccgccctatctccttccgaatctcgtatccttctcgcgtttcgaaatacgatcgtaccttctcgacgattccccgaaatcttaacttatttcgacgttaactcgaaaatccgatctcgtctaaaacgaaactaatcccttctacctataaacttaacgaaacgaaaaaactaaaaattcgtaaaaatccgaaacccgacgaaacgatcgttaaatcttaaaactccgaaataatctcctttaactccgtatctcgaatccgaaacgcgctaaaaccgaaaataaacactcgaaaccttataaaactccgcccctataactctaaaaaactaaacccccgcgacttcccgaatactaacgttaaatacctacg

SEQ ID NO: 27057 - DNA, 524 bp, Artificial Sequence
  chemically treated genomic DNA (Homo sapiens) CpG-island No: 27057
gcggtggcggcggtagtaataattattataaatttcggcgatcgtcggaagatggggtttacggcggttttatcgaagttcggaaagttttggtttcggttttcggcgttttcgttgttgtttagtcggggttggtttcgtcgagtcgtttttacggttttttttttttttagttggttttttcgagttatcgcgagtgattttattttcgtgatttcgcgttcgttttcgttttttatttttcgcggggtttttcgtatttatttttattttcggtagggttttttagttcggtcgttcgtcgtcggtttcgtttcgttttttttttcggtcgcgcggcgaggttaacggcggaaatcggataggtttgacggtatttggggtcgggtagtttcgcgaggaggtagtggcggttgtagttacgcgtatataaaagtttagggtcggggtttgaatcggggaaggtagattcggagaagagttaacgtttttttattcgttattttaacgggttttgtttattg

SEQ ID NO: 27058 - DNA, 524 bp, Artificial Sequence
  chemically treated genomic DNA (Homo sapiens) CpG-island No: 27058
caataaacaaaacccgttaaaataacgaataaaaaaacgttaactcttctccgaatctaccttccccgattcaaaccccgaccctaaacttttatatacgcgtaactacaaccgccactacctcctcgcgaaactacccgaccccaaataccgtcaaacctatccgatttccgccgttaacctcgccgcgcgaccgaaaaaaaaaacgaaacgaaaccgacgacgaacgaccgaactaaaaaaccctaccgaaaataaaaataaatacgaaaaaccccgcgaaaaataaaaaacgaaaacgaacgcgaaatcacgaaaataaaatcactcgcgataactcgaaaaaaccaactaaaaaaaaaaaaaaccgtaaaaacgactcgacgaaaccaaccccgactaaacaacaacgaaaacgccgaaaaccgaaaccaaaactttccgaacttcgataaaaccgccgtaaaccccatcttccgacgatcgccgaaatttataataattattactaccgccgccaccgc

SEQ ID NO: 27059 - DNA, 524 bp, Artificial Sequence
  chemically treated genomic DNA (Homo sapiens) CpG-island No: 27059
tagtgggtaggattcgttagagtggcgagtaaggaagcgttggttttttttcgggtttgtttttttcggtttaggtttcggttttgggtttttgtgtgcgcgtagttgtagtcgttattgttttttcgcggggttgttcgattttagatgtcgttaggtttgttcggttttcgtcgttaatttcgtcgcgcggtcgggaggaggagcggggcggggtcggcggcgggcggtcgggttggagggttttgtcgggggtgggggtgggtgcggggagtttcgcggggggtggggggcgggggcgggcgcggagttacgggggtggggttattcgcggtggttcggggaggttagttgggaggggagggggtcgtgggggcggttcggcggaattagtttcggttgggtagtagcggggacgtcgggggtcggggttagggtttttcgggtttcggtgaggtcgtcgtgggttttatttttcggcggtcgtcggagtttgtggtgattgttgttgtcgtcgttatcgt

SEQ ID NO: 27060 - DNA, 524 bp, Artificial Sequence
  chemically treated genomic DNA (Homo sapiens) CpG-island No: 27060
acgataacgacgacaacaacaatcaccacaaactccgacgaccgccgaaaaataaaacccacgacgacctcaccgaaacccgaaaaaccctaaccccgacccccgacgtccccgctactacccaaccgaaactaattccgccgaaccgcccccacgaccccctcccctcccaactaacctccccgaaccaccgcgaataaccccacccccgtaactccgcgcccgcccccgccccccaccccccgcgaaactccccgcacccacccccacccccgacaaaaccctccaacccgaccgcccgccgccgaccccgccccgctcctcctcccgaccgcgcgacgaaattaacgacgaaaaccgaacaaacctaacgacatctaaaatcgaacaaccccgcgaaaaaacaataacgactacaactacgcgcacacaaaaacccaaaaccgaaacctaaaccgaaaaaaacaaacccgaaaaaaaaccaacgcttccttactcgccactctaacgaatcctacccacta

SEQ ID NO: 27061 - DNA, 522 bp, Artificial Sequence
  chemically treated genomic DNA (Homo sapiens) CpG-island No: 27061
ttcggttattttaatagttgcgtgaattcgtttatttatttttgttttagtcgcgagtttaagcgcgttttttttcgttttttgcgttgttagtgtcgtcgtcgtcggcgtcgtcgttttttttggcgtgtttacggttattattggcgggtttttattagcggtttgcgttaggattgcgtttcgagttcgggcgacgcgtttttcggagcgtcgttggtttttatcgcgtttttcgatttcgatttcgaatttttaggtacgttcgagatgtaggtttcggtcgttagtcgtcgaaagttatttagcgtttttcgcgagtggaggttgttggggtcgttacggagatttacgatttagttgcgcgttaaagtttttagtttgtcgtataagattcgcgtcgggggcgcgtagcgcgtagaggtagcgtgcgtttagcgtttagaggtggaggttgtgtttttaggcgttttatacgaggtgggggagggcgagatttgttaggtttacgaattggtagat

SEQ ID NO: 27062 - DNA, 522 bp, Artificial Sequence
  chemically treated genomic DNA (Homo sapiens) CpG-island No: 27062
atctaccaattcgtaaacctaacaaatctcgccctcccccacctcgtataaaacgcctaaaaacacaacctccacctctaaacgctaaacgcacgctacctctacgcgctacgcgcccccgacgcgaatcttatacgacaaactaaaaactttaacgcgcaactaaatcgtaaatctccgtaacgaccccaacaacctccactcgcgaaaaacgctaaataactttcgacgactaacgaccgaaacctacatctcgaacgtacctaaaaattcgaaatcgaaatcgaaaaacgcgataaaaaccaacgacgctccgaaaaacgcgtcgcccgaactcgaaacgcaatcctaacgcaaaccgctaataaaaacccgccaataataaccgtaaacacgccaaaaaaaacgacgacgccgacgacgacgacactaacaacgcaaaaaacgaaaaaaaacgcgcttaaactcgcgactaaaacaaaaataaataaacgaattcacgcaactattaaaataaccgaa

SEQ ID NO: 27063 - DNA, 522 bp, Artificial Sequence
  chemically treated genomic DNA (Homo sapiens) CpG-island No: 27063
gtttgttaattcgtaggtttggtaggtttcgtttttttttatttcgtgtgggacgtttagggatatagtttttatttttgagcgttgggcgtacgttgtttttgcgcgttgcgcgttttcggcgcggattttgtgcgataggttggagattttggcgcgtagttgggtcgtgggttttcgtaacggttttagtagtttttattcgcggaaggcgttgggtggttttcgacggttggcgatcggagtttgtatttcgggcgtgtttgggggttcggggtcggggtcggggagcgcggtgagggttagcggcgtttcggggggcgcgtcgttcgaattcggggcgtagttttggcgtaggtcgttggtggaggttcgttagtggtggtcgtagatacgttagagagggcggcggcgtcggcgacgacggtattggtagcgtaggagacggaggaaggcgcgtttgaattcgcggttggaataggggtagatgagcgggtttacgtagttgttgaagtagtcgag

SEQ ID NO: 27064 - DNA, 522 bp, Artificial Sequence
  chemically treated genomic DNA (Homo sapiens) CpG-island No: 27064
ctcgactacttcaacaactacgtaaacccgctcatctacccctattccaaccgcgaattcaaacgcgccttcctccgtctcctacgctaccaataccgtcgtcgccgacgccgccgccctctctaacgtatctacgaccaccactaacgaacctccaccaacgacctacgccaaaactacgccccgaattcgaacgacgcgccccccgaaacgccgctaaccctcaccgcgctccccgaccccgaccccgaacccccaaacacgcccgaaatacaaactccgatcgccaaccgtcgaaaaccacccaacgccttccgcgaataaaaactactaaaaccgttacgaaaacccacgacccaactacgcgccaaaatctccaacctatcgcacaaaatccgcgccgaaaacgcgcaacgcgcaaaaacaacgtacgcccaacgctcaaaaataaaaactatatccctaaacgtcccacacgaaataaaaaaaaacgaaacctaccaaacctacgaattaacaaac

SEQ ID NO: 27065 - DNA, 570 bp, Artificial Sequence
  chemically treated genomic DNA (Homo sapiens) CpG-island No: 27065
ggcggcggtgaggtttagggggtttatttagaacgaggtagagatattagcgaaaagcgtcgtatggcgaagttaatttaggtttgataaaatatttattttattttatcgttttttcggttaaggttgacgttacgggttagagggcggagtcgttatattttttcgcgagattagttacgcgattttttagaaggtcgtaggtaatattttaatagtagttaggaagtcggatcggagcggaagggtgggcggggtttgttcgtatatttagcggtattcgaggttacgttttagatcggaagtgacggagacgtgttagcgcgtcgaaggtagttttatggtttttttcgcgtttttgagtcgggaaatggtcgttgtgtggttgtaacggagataaattttcggaatcgcgattcggcgtgttaggtaggtttcgtaatgtatttaagttattttaggggtagtgaagatcgaggataggttatatttttgatttttttgtgggtggtgtcgggttggcggcgaaaggagaattaaggagacgttgcgtcgttatttatgcgtttt

SEQ ID NO: 27066 - DNA, 570 bp, Artificial Sequence
  chemically treated genomic DNA (Homo sapiens) CpG-island No: 27066
aaaacgcataaataacgacgcaacgtctccttaattctcctttcgccgccaacccgacaccacccacaaaaaaatcaaaaatataacctatcctcgatcttcactacccctaaaataacttaaatacattacgaaacctacctaacacgccgaatcgcgattccgaaaatttatctccgttacaaccacacaacgaccatttcccgactcaaaaacgcgaaaaaaaccataaaactaccttcgacgcgctaacacgtctccgtcacttccgatctaaaacgtaacctcgaataccgctaaatatacgaacaaaccccgcccacccttccgctccgatccgacttcctaactactattaaaatattacctacgaccttctaaaaaatcgcgtaactaatctcgcgaaaaaatataacgactccgccctctaacccgtaacgtcaaccttaaccgaaaaaacgataaaataaaataaatattttatcaaacctaaattaacttcgccatacgacgcttttcgctaatatctctacctcgttctaaataaaccccctaaacctcaccgccgcc

SEQ ID NO: 27067 - DNA, 570 bp, Artificial Sequence
  chemically treated genomic DNA (Homo sapiens) CpG-island No: 27067
aaaacgtataaataacggcgtaacgtttttttggtttttttttcgtcgttaattcgatattatttataaaagagttaaaaatatggtttgttttcggtttttattgtttttggagtaatttgaatatattgcgaggtttatttgatacgtcgaatcgcggtttcgggaatttattttcgttgtaattatatagcggttatttttcgatttaagaacgcgaggaaaattatagagttattttcgacgcgttagtacgttttcgttattttcgatttggggcgtggtttcgggtgtcgttaaatatgcgggtaagtttcgtttattttttcgtttcggttcggttttttggttgttattaagatgttgtttgcggttttttgggaagtcgcgtggttggtttcgcgggaagatgtgacggtttcgttttttggttcgtagcgttagttttggtcggagaggcggtagagtagggtgggtgttttgttaggtttgagttagtttcgttatacggcgtttttcgttggtgtttttgtttcgttttgagtagattttttagattttatcgtcgtt

SEQ ID NO: 27068 - DNA, 570 bp, Artificial Sequence
  chemically treated genomic DNA (Homo sapiens) CpG-island No: 27068
aacgacgataaaatctaaaaaatctactcaaaacgaaacaaaaacaccaacgaaaaacgccgtataacgaaactaactcaaacctaacaaaacacccaccctactctaccgcctctccgaccaaaactaacgctacgaaccaaaaaacgaaaccgtcacatcttcccgcgaaaccaaccacgcgacttcccaaaaaaccgcaaacaacatcttaataacaaccaaaaaaccgaaccgaaacgaaaaaataaacgaaacttacccgcatatttaacgacacccgaaaccacgccccaaatcgaaaataacgaaaacgtactaacgcgtcgaaaataactctataattttcctcgcgttcttaaatcgaaaaataaccgctatataattacaacgaaaataaattcccgaaaccgcgattcgacgtatcaaataaacctcgcaatatattcaaattactccaaaaacaataaaaaccgaaaacaaaccatatttttaactcttttataaataatatcgaattaacgacgaaaaaaaaaccaaaaaaacgttacgccgttatttatacgtttt

SEQ ID NO: 27069 - DNA, 700 bp, Artificial Sequence
  chemically treated genomic DNA (Homo sapiens) CpG-island No: 27069
ttatcgtataagggtgattttcggtattttattttgaggttttcgtttaggtttacgtattagagtttcggtaggagattcgcggttcgtttcgattagttcgttcgcggggcgtaggggtttgtaggtgtgtttcgcgcgtttcgtcgttcggttagtcgttcgttagattattagttttttcgtcgggtcgagaatttgatttgtttcgtttttatcgagtttttgtcgatcggtagtttttttttttaatttcgagtttcggggttcggtttatttcggttaggaagttttttttatttatacgtagcggagaagcgtttaagtaataacgtttgtatttaaatttagtttttagaatcgtagacgtggttttgcgtggttttcggttcgtcgttacgttttttggttaattacggtagaggattattcgttagtttcgttttcgtttcgtcgtaggtcgcgcgtagttggcgtttgaggaattgcggttgcggtttcgagcggggtttggggttgttattattgagtgattagaaagggtgaggttttcgcggtggttcgggggttggggtcgagggtcgcgggtttttagagtattgcggtcgcggaggtatagttttcgtttttaaattcgggtttttgggggcggtaggttttgcgtttttgggaagtcggggtttttagtggttttggttag

SEQ ID NO: 27070 - DNA, 700 bp, Artificial Sequence
  chemically treated genomic DNA (Homo sapiens) CpG-island No: 27070
ctaaccaaaaccactaaaaaccccgacttcccaaaaacgcaaaacctaccgcccccaaaaacccgaatttaaaaacgaaaactatacctccgcgaccgcaatactctaaaaacccgcgaccctcgaccccaacccccgaaccaccgcgaaaacctcaccctttctaatcactcaataataacaaccccaaaccccgctcgaaaccgcaaccgcaattcctcaaacgccaactacgcgcgacctacgacgaaacgaaaacgaaactaacgaataatcctctaccgtaattaaccaaaaaacgtaacgacgaaccgaaaaccacgcaaaaccacgtctacgattctaaaaactaaatttaaatacaaacgttattacttaaacgcttctccgctacgtataaataaaaaaaacttcctaaccgaaataaaccgaaccccgaaactcgaaattaaaaaaaaaaactaccgatcgacaaaaactcgataaaaacgaaacaaatcaaattctcgacccgacgaaaaaactaataatctaacgaacgactaaccgaacgacgaaacgcgcgaaacacacctacaaacccctacgccccgcgaacgaactaatcgaaacgaaccgcgaatctcctaccgaaactctaatacgtaaacctaaacgaaaacctcaaaataaaataccgaaaatcacccttatacgataa

SEQ ID NO: 27071 - DNA, 700 bp, Artificial Sequence
  chemically treated genomic DNA (Homo sapiens) CpG-island No: 27071
ttagttaagattattaggaatttcggttttttaggaacgtagggtttgtcgtttttagaggttcggatttggaggcggaggttgtgttttcgcggtcgtagtgttttgagggttcgcgattttcggttttaattttcgggttatcgcgggggttttattttttttggttatttaatggtaatagttttagatttcgttcggaatcgtagtcgtagttttttaggcgttagttgcgcgcgatttgcggcgaggcgggggcggggttggcggatagttttttgtcgtgattggttagggggcgtggcgacgagtcggaagttacgtagggttacgtttgcggttttgaggattgggtttgggtgtagacgttgttgtttgggcgttttttcgttgcgtgtaggtgaagggggttttttgatcgaggtaagtcgggtttcgaggttcggagttgagaagggagattatcggtcggtaagggttcggtgggagcgggataggttagattttcggttcgacggaggggttagtggtttggcgggcgattgatcgagcggcggagcgcgcgggatatatttataggtttttgcgtttcgcgggcgggttggtcgggacgggtcgcgggttttttgtcggggttttggtacgtggatttaggcggggattttagggtggagtgtcgggaattatttttgtgcggtga

SEQ ID NO: 27072 - DNA, 700 bp, Artificial Sequence
  chemically treated genomic DNA (Homo sapiens) CpG-island No: 27072
tcaccgcacaaaaataattcccgacactccaccctaaaatccccgcctaaatccacgtaccaaaaccccgacaaaaaacccgcgacccgtcccgaccaacccgcccgcgaaacgcaaaaacctataaatatatcccgcgcgctccgccgctcgatcaatcgcccgccaaaccactaacccctccgtcgaaccgaaaatctaacctatcccgctcccaccgaacccttaccgaccgataatctcccttctcaactccgaacctcgaaacccgacttacctcgatcaaaaaacccccttcacctacacgcaacgaaaaaacgcccaaacaacaacgtctacacccaaacccaatcctcaaaaccgcaaacgtaaccctacgtaacttccgactcgtcgccacgccccctaaccaatcacgacaaaaaactatccgccaaccccgcccccgcctcgccgcaaatcgcgcgcaactaacgcctaaaaaactacgactacgattccgaacgaaatctaaaactattaccattaaataaccaaaaaaaataaaacccccgcgataacccgaaaattaaaaccgaaaatcgcgaaccctcaaaacactacgaccgcgaaaacacaacctccgcctccaaatccgaacctctaaaaacgacaaaccctacgttcctaaaaaaccgaaattcctaataatcttaactaa

SEQ ID NO: 27073 - DNA, 500 bp, Artificial Sequence
  chemically treated genomic DNA (Homo sapiens) CpG-island No: 27073
tcgattatgattttttttgaatgaaatagattcggagttcggagattgggttatcggggacgaaagggtttttcggaggttttttcggacgcggaggtttgggcggtgggtgggaggtttgggtattttttagtcgcggtgttaacgttgtcgtttttttttcggggttttgttcgtagggttattttttcgtgagtaatatgaacgtcggtttggggatgaacggtatgaatacgtatatgagtatgtcggcggtcgttatgggtagcggttcgggtaatatgagcgcgggttttatgaatatgtcgtcgtacgtgggcgttggtatgagttcgtttttggcggggatgtttttcggcgcgggcgttatggcgggtatgggcggttcggtcggggcggtcggcgtggcgggtatggggtcgtatttgagttttagtttgagttcgttcggggggtaggcggtcggggttatgggcggtttggttttttacgttaatatg

SEQ ID NO: 27074 - DNA, 500 bp, Artificial Sequence
  chemically treated genomic DNA (Homo sapiens) CpG-island No: 27074
catattaacgtaaaaaaccaaaccgcccataaccccgaccgcctaccccccgaacgaactcaaactaaaactcaaatacgaccccatacccgccacgccgaccgccccgaccgaaccgcccatacccgccataacgcccgcgccgaaaaacatccccgccaaaaacgaactcataccaacgcccacgtacgacgacatattcataaaacccgcgctcatattacccgaaccgctacccataacgaccgccgacatactcatatacgtattcataccgttcatccccaaaccgacgttcatattactcacgaaaaaataaccctacgaacaaaaccccgaaaaaaaaacgacaacgttaacaccgcgactaaaaaatacccaaacctcccacccaccgcccaaacctccgcgtccgaaaaaacctccgaaaaaccctttcgtccccgataacccaatctccgaactccgaatctatttcattcaaaaaaaatcataatcga

SEQ ID NO: 27075 - DNA, 500 bp, Artificial Sequence
  chemically treated genomic DNA (Homo sapiens) CpG-island No: 27075
tatgttggcgtagggggttaggtcgtttatggtttcggtcgtttgtttttcgagcgggtttaggttgggatttaagtgcggttttatgttcgttacgtcggtcgtttcggtcgagtcgtttatgttcgttatggcgttcgcgtcgggggatattttcgttagggacgggtttatgttagcgtttacgtacgacgatatgtttatggagttcgcgtttatgttgttcgagtcgttgtttatggcggtcgtcgatatgtttatgtacgtgtttatgtcgtttatttttaggtcggcgtttatgttgtttacggaggagtagttttgcggatagagtttcgggagggaggcgatagcgttagtatcgcggttggagggtgtttagattttttatttatcgtttaggttttcgcgttcggggaggttttcggggagttttttcgttttcgatggtttagttttcggatttcgagtttgttttatttagggagagttatgatcga

SEQ ID NO: 27076 - DNA, 500 bp, Artificial Sequence
  chemically treated genomic DNA (Homo sapiens) CpG-island No: 27076
tcgatcataactctccctaaataaaacaaactcgaaatccgaaaactaaaccatcgaaaacgaaaaaactccccgaaaacctccccgaacgcgaaaacctaaacgataaataaaaaatctaaacaccctccaaccgcgatactaacgctatcgcctccctcccgaaactctatccgcaaaactactcctccgtaaacaacataaacgccgacctaaaaataaacgacataaacacgtacataaacatatcgacgaccgccataaacaacgactcgaacaacataaacgcgaactccataaacatatcgtcgtacgtaaacgctaacataaacccgtccctaacgaaaatatcccccgacgcgaacgccataacgaacataaacgactcgaccgaaacgaccgacgtaacgaacataaaaccgcacttaaatcccaacctaaacccgctcgaaaaacaaacgaccgaaaccataaacgacctaaccccctacgccaacata

SEQ ID NO: 27077 - DNA, 566 bp, Artificial Sequence
  chemically treated genomic DNA (Homo sapiens) CpG-island No: 27077
ttttagtttttgggcgaattttatatttgttttaatttttcgtcgagggcgagtaggagcgagagtgtgtcgagtgagtgtgcgtttgtgtgtttcggcgagggtgcgcgttcggcgtcgggagcgcggttagtcgagttcggaggtatcgggaggtcgagagtcgtcgggattttagttttgcgtttattgtttcgttcggagttggatttcggggtcggggtcggggtcgtgcgtcggggataggtagggtcgggtcgcggttcgcgcgtttcgtttaggtgagtcggggttggttcggatcgttcggttttagttttagcgttgtttgcggaggtgggttcgggcgggcgggagggaggtttcggcgtcggtcgttcgtagagggatgatttgtttgatttcgttggttggcgggcgggcgaggatttttcgtcgcgtttttgattcgcggatacggtatatcgagtataggcggtttcgggtaggggagcgcgtttgggtcggttattcgtaggggtatggttttgttgatttttagggtttagatttaagggatcggtaga

SEQ ID NO: 27078 - DNA, 566 bp, Artificial Sequence
  chemically treated genomic DNA (Homo sapiens) CpG-island No: 27078
tctaccgatcccttaaatctaaaccctaaaaatcaacaaaaccatacccctacgaataaccgacccaaacgcgctcccctacccgaaaccgcctatactcgatataccgtatccgcgaatcaaaaacgcgacgaaaaatcctcgcccgcccgccaaccaacgaaatcaaacaaatcatccctctacgaacgaccgacgccgaaacctccctcccgcccgcccgaacccacctccgcaaacaacgctaaaactaaaaccgaacgatccgaaccaaccccgactcacctaaacgaaacgcgcgaaccgcgacccgaccctacctatccccgacgcacgaccccgaccccgaccccgaaatccaactccgaacgaaacaataaacgcaaaactaaaatcccgacgactctcgacctcccgatacctccgaactcgactaaccgcgctcccgacgccgaacgcgcaccctcgccgaaacacacaaacgcacactcactcgacacactctcgctcctactcgccctcgacgaaaaattaaaacaaatataaaattcgcccaaaaactaaaa

SEQ ID NO: 27079 - DNA, 566 bp, Artificial Sequence
  chemically treated genomic DNA (Homo sapiens) CpG-island No: 27079
tttatcggttttttgggtttaaattttaagggttaataaggttatgtttttgcggatggtcggtttaggcgcgtttttttattcggggtcgtttgtgttcggtgtgtcgtgttcgcgggttaggggcgcggcgggaagttttcgttcgttcgttagttagcggggttaaataggttatttttttgcggacggtcggcgtcggagtttttttttcgttcgttcggatttattttcgtaagtagcgttggggttggagtcgggcggttcggattagtttcggtttatttgggcgggacgcgcgggtcgcgattcggttttgtttgttttcggcgtacggtttcggtttcggtttcgaagtttagtttcggacggggtagtgaacgtagagttggggtttcggcggttttcgatttttcgatgttttcggattcggttggtcgcgttttcggcgtcgagcgcgtattttcgtcgggatatatagacgtatatttattcgatatattttcgtttttgttcgttttcggcggagagttgaaatagatgtgggattcgtttaggagttggaa

SEQ ID NO: 27080 - DNA, 566 bp, Artificial Sequence
  chemically treated genomic DNA (Homo sapiens) CpG-island No: 27080
ttccaactcctaaacgaatcccacatctatttcaactctccgccgaaaacgaacaaaaacgaaaatatatcgaataaatatacgtctatatatcccgacgaaaatacgcgctcgacgccgaaaacgcgaccaaccgaatccgaaaacatcgaaaaatcgaaaaccgccgaaaccccaactctacgttcactaccccgtccgaaactaaacttcgaaaccgaaaccgaaaccgtacgccgaaaacaaacaaaaccgaatcgcgacccgcgcgtcccgcccaaataaaccgaaactaatccgaaccgcccgactccaaccccaacgctacttacgaaaataaatccgaacgaacgaaaaaaaaactccgacgccgaccgtccgcaaaaaaataacctatttaaccccgctaactaacgaacgaacgaaaacttcccgccgcgcccctaacccgcgaacacgacacaccgaacacaaacgaccccgaataaaaaaacgcgcctaaaccgaccatccgcaaaaacataaccttattaacccttaaaatttaaacccaaaaaaccgataaa

SEQ ID NO: 27081 - DNA, 983 bp, Artificial Sequence
  chemically treated genomic DNA (Homo sapiens) CpG-island No: 27081
tgttttttcgttaagtaataataattcgaggagcgaggcggggaggttcgtgaaacgttatagcgtattgtttaatgggaatcggcgttggtagacgcgcgcgttttgtgtttaattagcgaaggcggttcgaatggtttttttattttgttggttgtgggcggacggtttgaggaggcggcggtggagtagggggcggtttggttgcgcggtattagcggtgttcgtcgaagggggaggaggcgaggagcgagtcgtgcggttagagcgggaaagagattcgtttttgcgttcgagttttggagtcgtcgtatttcgatttttggggtcgcggtaggtatgcgaggggacgggcgttcgttgttttttgggtttttttcgtagcgattcgcgggatcggaaaaaaaggagaagatggaggaggagggtggtagtagcggcggcgtcgggggtgattagcgcggacggcggcgacggaggagagtagttttttattgttaagtacgagttgcggattggtgagcgatttcgttttttgtcggtcgggttcggcgcgggggcgcgtttgagggtacgcgggtgttcgcgcggggttgggggcgcggggtcgtagtcgtgggcgcggaggggcgggtttggggcggggcgtcgcggtcggggcgcgtgtttcgggggtttcgggaggtgggggcgcgttttgggggaggcggtcgaaagttttttttagttcgggaatgagcggcgggtattaggtatcggggttagcgtacgcgtcgatcgttgttcgtggtacgtattttcgaggatgtcgttgtttttttttttcgtataggtgatatacgtgtgtttgcgttttgttagggcgaaaggtgcgtttgttttcgcgtggggcgagcggcgttttgttttggagagtgtttttttttttcgtttttttggttttcgcgatggggggtttcggtggggttttgtggagttatttt

SEQ ID NO: 27082 - DNA, 983 bp, Artificial Sequence
  chemically treated genomic DNA (Homo sapiens) CpG-island No: 27082
aaaataactccacaaaaccccaccgaaaccccccatcgcgaaaaccaaaaaaacgaaaaaaaaaaacactctccaaaacaaaacgccgctcgccccacgcgaaaacaaacgcacctttcgccctaacaaaacgcaaacacacgtatatcacctatacgaaaaaaaaaaacaacgacatcctcgaaaatacgtaccacgaacaacgatcgacgcgtacgctaaccccgatacctaatacccgccgctcattcccgaactaaaaaaaactttcgaccgcctcccccaaaacgcgcccccacctcccgaaacccccgaaacacgcgccccgaccgcgacgccccgccccaaacccgcccctccgcgcccacgactacgaccccgcgcccccaaccccgcgcgaacacccgcgtaccctcaaacgcgcccccgcgccgaacccgaccgacaaaaaacgaaatcgctcaccaatccgcaactcgtacttaacaataaaaaactactctcctccgtcgccgccgtccgcgctaatcacccccgacgccgccgctactaccaccctcctcctccatcttctcctttttttccgatcccgcgaatcgctacgaaaaaaacccaaaaaacaacgaacgcccgtcccctcgcatacctaccgcgaccccaaaaatcgaaatacgacgactccaaaactcgaacgcaaaaacgaatctctttcccgctctaaccgcacgactcgctcctcgcctcctcccccttcgacgaacaccgctaataccgcgcaaccaaaccgccccctactccaccgccgcctcctcaaaccgtccgcccacaaccaacaaaataaaaaaaccattcgaaccgccttcgctaattaaacacaaaacgcgcgcgtctaccaacgccgattcccattaaacaatacgctataacgtttcacgaacctccccgcctcgctcctcgaattattattacttaacgaaaaaaca

SEQ ID NO: 27083 - DNA, 983 bp, Artificial Sequence
  chemically treated genomic DNA (Homo sapiens) CpG-island No: 27083
gggatggttttatagagttttatcgggattttttatcgcggggattagaggggcggaggagggagatattttttaaaataaagcgtcgttcgttttacgcggaggtaggcgtatttttcgttttgataggacgtagatatacgtgtgttatttgtgcgggaagggggagtagcgatattttcggaggtgcgtgttacgggtagcggtcggcgcgtgcgttggtttcgatgtttggtgttcgtcgtttattttcgggttggggaaaattttcggtcgttttttttaaggcgcgtttttatttttcgggattttcggggtacgcgtttcgatcgcgacgtttcgttttaggttcgttttttcgcgtttacggttgcggtttcgcgtttttagtttcgcgcgggtattcgcgtgtttttaggcgcgttttcgcgtcgggttcggtcggtagagggcggggtcgtttattagttcgtagttcgtgtttgatagtgaggagttgttttttttcgtcgtcgtcgttcgcgttggttattttcggcgtcgtcgttgttgttattttttttttttattttttttttttttttcgatttcgcgggtcgttacgaggggaatttaggagatagcggacgttcgttttttcgtatgtttgtcgcggttttaggagtcggggtgcggcggttttagaattcggacgtaaagacgagtttttttttcgttttggtcgtacggttcgtttttcgtttttttttttttcggcgggtatcgttagtatcgcgtaattaaatcgttttttgttttatcgtcgtttttttaggtcgttcgtttatagttagtaaggtaagggagttattcgagtcgttttcgttgattggatatagggcgcgcgcgtttgttaacgtcggtttttattgggtagtacgttgtgacgttttacgagttttttcgtttcgtttttcgaattgttgttgtttggcggggaggta

SEQ ID NO: 27084 - DNA, 983 bp, Artificial Sequence
  chemically treated genomic DNA (Homo sapiens) CpG-island No: 27084
tacctccccgccaaacaacaacaattcgaaaaacgaaacgaaaaaactcgtaaaacgtcacaacgtactacccaataaaaaccgacgttaacaaacgcgcgcgccctatatccaatcaacgaaaacgactcgaataactcccttaccttactaactataaacgaacgacctaaaaaaacgacgataaaacaaaaaacgatttaattacgcgatactaacgatacccgccgaaaaaaaaaaaaacgaaaaacgaaccgtacgaccaaaacgaaaaaaaaactcgtctttacgtccgaattctaaaaccgccgcaccccgactcctaaaaccgcgacaaacatacgaaaaaacgaacgtccgctatctcctaaattcccctcgtaacgacccgcgaaatcgaaaaaaaaaaaaaaaataaaaaaaaaaaataacaacaacgacgacgccgaaaataaccaacgcgaacgacgacgacgaaaaaaaacaactcctcactatcaaacacgaactacgaactaataaacgaccccgccctctaccgaccgaacccgacgcgaaaacgcgcctaaaaacacgcgaatacccgcgcgaaactaaaaacgcgaaaccgcaaccgtaaacgcgaaaaaacgaacctaaaacgaaacgtcgcgatcgaaacgcgtaccccgaaaatcccgaaaaataaaaacgcgccttaaaaaaaacgaccgaaaattttccccaacccgaaaataaacgacgaacaccaaacatcgaaaccaacgcacgcgccgaccgctacccgtaacacgcacctccgaaaatatcgctactcccccttcccgcacaaataacacacgtatatctacgtcctatcaaaacgaaaaatacgcctacctccgcgtaaaacgaacgacgctttattttaaaaaatatctccctcctccgcccctctaatccccgcgataaaaaatcccgataaaactctataaaaccatccc

SEQ ID NO: 27085 - DNA, 757 bp, Artificial Sequence
  chemically treated genomic DNA (Homo sapiens) CpG-island No: 27085
aaggttttcgtacgcgttgtggggtggggtatatttggttgggggcggacgggggattaggagaacggcgaggagcgggcgtagaagggtggcggggtcgtcgggtcgttgcgcggtagttgcgttcggttttttggcgcggcgttcgggaaggggcggggtcgaggcgggtaaggtggcgggttttcgtttttggtttcgttttcgtagttcgttcgcgagtttcgtttcgttttttcgtcgggttcgtttcgttttttcgtcgggtcgtgtttttgttttcgtcgtttggtagttttacgttcggttttagcggttaagagtcggagaaagttttgttggtgggcggtcgcggggttgagggcgttcggtatttcggggtcgtttcggttcgggcggcgagagtgttcggcggtttatgtattcgtcgtcgttcgtcgtcgcgatggattttagttagaatagtttgttcggttatatggaggatttgtaggagtttattattatcgagaggtcggttcgtcggagttttaaggtgcgtttcggggagaggatttgtttttacggcgttcggtcgtttgtttcgcgcggtttcgcgttgatttttgttttacgttattatttttttttttttcgggtcgtcgggatttttttagtcgggtcggtttttttttttttattttttttgtcgtgtcgttttaagttagttttttttcggatttttttttagagcggatcgggttttttttagtttgga

SEQ ID NO: 27086 - DNA, 757 bp, Artificial Sequence
  chemically treated genomic DNA (Homo sapiens) CpG-island No: 27086
tccaaactaaaaaaaacccgatccgctctaaaaaaaaatccgaaaaaaaactaacttaaaacgacacgacaaaaaaaataaaaaaaaaaaaaccgacccgactaaaaaaatcccgacgacccgaaaaaaaaaaaaataataacgtaaaacaaaaatcaacgcgaaaccgcgcgaaacaaacgaccgaacgccgtaaaaacaaatcctctccccgaaacgcaccttaaaactccgacgaaccgacctctcgataataataaactcctacaaatcctccatataaccgaacaaactattctaactaaaatccatcgcgacgacgaacgacgacgaatacataaaccgccgaacactctcgccgcccgaaccgaaacgaccccgaaataccgaacgccctcaaccccgcgaccgcccaccaacaaaactttctccgactcttaaccgctaaaaccgaacgtaaaactaccaaacgacgaaaacaaaaacacgacccgacgaaaaaacgaaacgaacccgacgaaaaaacgaaacgaaactcgcgaacgaactacgaaaacgaaaccaaaaacgaaaacccgccaccttacccgcctcgaccccgccccttcccgaacgccgcgccaaaaaaccgaacgcaactaccgcgcaacgacccgacgaccccgccacccttctacgcccgctcctcgccgttctcctaatcccccgtccgcccccaaccaaatataccccaccccacaacgcgtacgaaaacctt

SEQ ID NO: 27087 - DNA, 757 bp, Artificial Sequence
  chemically treated genomic DNA (Homo sapiens) CpG-island No: 27087
tttagattagagaggattcggttcgttttgaggaagggttcgagagggaattggtttagggcgatacggtaagaggggtggaggaggaggggtcggttcgattgagagggtttcggcggttcggaggaggggagggtggtggcgtggggtagagattagcgcgggatcgcgcggggtaggcggtcggacgtcgtgagggtaggtttttttttcggggcgtattttgaggtttcggcggatcggtttttcgatgatggtgagtttttgtaggttttttatgtaatcgaataggttgttttgattgaaatttatcgcggcggcgggcggcggcggatgtatggatcgtcgggtattttcgtcgttcgggtcggagcggtttcgggatgtcggacgtttttagtttcgcggtcgtttattagtaggatttttttcggtttttggtcgttggagtcgagcgtgaggttgttaggcggcgggagtaagagtacggttcggcgagggggcggggcgggttcggcgaggaggcggggcgaggttcgcgggcgggttgcgggggcggggttaggggcgggggttcgttattttgttcgtttcggtttcgttttttttcgggcgtcgcgttaagaggtcggacgtaattgtcgcgtaacgattcggcggtttcgttatttttttgcgttcgtttttcgtcgtttttttaatttttcgttcgtttttaattaagtgtgttttattttatagcgcgtgcgagagtttt

SEQ ID NO: 27088 - DNA, 757 bp, Artificial Sequence
  chemically treated genomic DNA (Homo sapiens) CpG-island No: 27088
aaaactctcgcacgcgctataaaataaaacacacttaattaaaaacgaacgaaaaattaaaaaaacgacgaaaaacgaacgcaaaaaaataacgaaaccgccgaatcgttacgcgacaattacgtccgacctcttaacgcgacgcccgaaaaaaaacgaaaccgaaacgaacaaaataacgaacccccgcccctaaccccgcccccgcaacccgcccgcgaacctcgccccgcctcctcgccgaacccgccccgccccctcgccgaaccgtactcttactcccgccgcctaacaacctcacgctcgactccaacgaccaaaaaccgaaaaaaatcctactaataaacgaccgcgaaactaaaaacgtccgacatcccgaaaccgctccgacccgaacgacgaaaatacccgacgatccatacatccgccgccgcccgccgccgcgataaatttcaatcaaaacaacctattcgattacataaaaaacctacaaaaactcaccatcatcgaaaaaccgatccgccgaaacctcaaaatacgccccgaaaaaaaaacctaccctcacgacgtccgaccgcctaccccgcgcgatcccgcgctaatctctaccccacgccaccaccctcccctcctccgaaccgccgaaaccctctcaatcgaaccgacccctcctcctccacccctcttaccgtatcgccctaaaccaattccctctcgaacccttcctcaaaacgaaccgaatcctctctaatctaaa

SEQ ID NO: 27089 - DNA, 604 bp, Artificial Sequence
  chemically treated genomic DNA (Homo sapiens) CpG-island No: 27089
atggtcgagttttcggaagaattggtaggattcgttcgtcgtgttagttacggggagatgttttttttagttattacggtcgagatgagagttttcgtgttgttgttggacgaggcgtcgatttcgaatttcgtaagtttatttgaggcgttcgatttgatgttgatgtttagcgtcgttttgatgaagtcgtggtaggtttgtacgatgttcgttatttgtaggaagttggcggttgatattatttcgatgacgtttttgttggtgagcgttaggtgcgttgagtatatgaagtcgatgatggttttgaagttttgggtcgtgacgatgtttaggtgcgtgatcgtggtttgtttcgacgttttttgtatttggtagtagagcgttttgaagtagcggttgttgtttagtaggacgtttttgtgcgttttgaagattttgttttttacgattacgtagacgtcgtataggacgtcgtgttgtttttgttcgttgagttttcgtagtaggtgtcggtagtgggacgtgatttttatatttttttttcggttgtttatttggaagttttggtgtcgttttttttatagattttgtggaggtaaga

SEQ ID NO: 27090 - DNA, 604 bp, Artificial Sequence
  chemically treated genomic DNA (Homo sapiens) CpG-island No: 27090
tcttacctccacaaaatctataaaaaaaacgacaccaaaacttccaaataaacaaccgaaaaaaaaatataaaaatcacgtcccactaccgacacctactacgaaaactcaacgaacaaaaacaacacgacgtcctatacgacgtctacgtaatcgtaaaaaacaaaatcttcaaaacgcacaaaaacgtcctactaaacaacaaccgctacttcaaaacgctctactaccaaatacaaaaaacgtcgaaacaaaccacgatcacgcacctaaacatcgtcacgacccaaaacttcaaaaccatcatcgacttcatatactcaacgcacctaacgctcaccaacaaaaacgtcatcgaaataatatcaaccgccaacttcctacaaataacgaacatcgtacaaacctaccacgacttcatcaaaacgacgctaaacatcaacatcaaatcgaacgcctcaaataaacttacgaaattcgaaatcgacgcctcgtccaacaacaacacgaaaactctcatctcgaccgtaataactaaaaaaaacatctccccgtaactaacacgacgaacgaatcctaccaattcttccgaaaactcgaccat

SEQ ID NO: 27091 - DNA, 604 bp, Artificial Sequence
  chemically treated genomic DNA (Homo sapiens) CpG-island No: 27091
ttttatttttatagagtttgtagaagaggcgatattagggtttttaaatgaataatcgaaaggaagatatggaaattacgttttattatcggtatttgttgcgggagtttaacgagtagaggtagtacggcgttttgtgcgacgtttgcgtggtcgtggagggtaaggtttttaaggcgtataagaacgttttgttgggtagtagtcgttattttaagacgttttattgttaggtgtagaagacgtcggagtaggttacggttacgtatttggatatcgttacggtttagggttttaaggttattatcgattttatgtatttagcgtatttggcgtttattagtaggaacgttatcgaggtgatgttagtcgttagttttttgtagatgacggatatcgtgtaagtttgttacgattttattaaggcggcgttggatattagtattaagtcggacgttttagatgagtttgcggagttcgagatcggcgtttcgtttagtagtagtacggaagtttttatttcggtcgtgatggttgggaggagtattttttcgtggttggtacggcgaacgagttttgttaattttttcggagattcggttat

SEQ ID NO: 27092 - DNA, 604 bp, Artificial Sequence
  chemically treated genomic DNA (Homo sapiens) CpG-island No: 27092
ataaccgaatctccgaaaaaattaacaaaactcgttcgccgtaccaaccacgaaaaaatactcctcccaaccatcacgaccgaaataaaaacttccgtactactactaaacgaaacgccgatctcgaactccgcaaactcatctaaaacgtccgacttaatactaatatccaacgccgccttaataaaatcgtaacaaacttacacgatatccgtcatctacaaaaaactaacgactaacatcacctcgataacgttcctactaataaacgccaaatacgctaaatacataaaatcgataataaccttaaaaccctaaaccgtaacgatatccaaatacgtaaccgtaacctactccgacgtcttctacacctaacaataaaacgtcttaaaataacgactactacccaacaaaacgttcttatacgccttaaaaaccttaccctccacgaccacgcaaacgtcgcacaaaacgccgtactacctctactcgttaaactcccgcaacaaataccgataataaaacgtaatttccatatcttcctttcgattattcatttaaaaaccctaatatcgcctcttctacaaactctataaaaataaaa

SEQ ID NO: 27093 - DNA, 1243 bp, Artificial Sequence
  chemically treated genomic DNA (Homo sapiens) CpG-island No: 27093
cgggtacgttttttttttttcggggagatatcggtttagaggtatagtttttagcgtagaggtcgtagttcgggtattttcgtttaggtttcgcgtttttttttcgagtcgtcgtgggttcgtcgttagtcgggtttcgcgttatttcggagtttttttttcgcggggcgtttcgtcgttttatttttcgtcgagtttattcgtcgcgttcgtcgttttttaggtcggtcgcgttttttcgttcggcgttttttttgtttggttagggtcgcgttttcgtaaatcgcggttatttggttttcggtcgggtatttttttcgcgcggttttttagtcgtagttatagagagttcgtcggttttatcggttagagcggttcggcgttttttttcgttttagtagtcgatcggtattttttttcgagcgtcgtcgttttcggaagtgtttggcgcgcgggggtagtcgggtaagcggagcgcggaggtcgttgggacgcggtttagtttattttttgaggtcggttcgcgtttcgttaggcgtcgcgcggggttagcgcggggttagcggaggttagcgggggttagtagtagcggtttcgagggcgcggcggacgtaggtaggtcgtaggttgtgcggtgaggcgcgaggttcgaggggcggtttaggattcgaggtgggacgcgggtgtgataggagttagttttggttgtttgtcggggagttttagatttggcggcggcggtttggggcggacgtagtcgggggtcgcgatttaggtttttttttcgtagtcgttttttgttagtcgcgcgtcgtttttaggtgtattttaggagtagtcgcgtcgttgtttattcgttttgtagttcgttttttttagggtcgttttcgttttaagaaatggggtgatggggcgtttttattcggcgtttgtaggggtttttggggagcgcgtcggtggttcgttgttttcgggtggggcgcggggttggcgttcgagggtgtcgtggtttaggcggggttgtagcgagtgtgtttttcgtttcgcgcgcgtgaagcgtgggagcgaagtttcgggggagggcgggagcgcggttgagtttattgtgaatattcggttgggtagtttcgcgagtaggggaggggtcggaatcgatgtgtatgcggagaggtcgtagttattgttgtgagtaggatatagtggcggttgatttgggagaagttatagagggacggggtgggag

SEQ ID NO: 27094 - DNA, 1243 bp, Artificial Sequence
  chemically treated genomic DNA (Homo sapiens) CpG-island No: 27094
ctcccaccccgtccctctataacttctcccaaatcaaccgccactatatcctactcacaacaataactacgacctctccgcatacacatcgattccgacccctcccctactcgcgaaactacccaaccgaatattcacaataaactcaaccgcgctcccgccctcccccgaaacttcgctcccacgcttcacgcgcgcgaaacgaaaaacacactcgctacaaccccgcctaaaccacgacaccctcgaacgccaaccccgcgccccacccgaaaacaacgaaccaccgacgcgctccccaaaaacccctacaaacgccgaataaaaacgccccatcaccccatttcttaaaacgaaaacgaccctaaaaaaaacgaactacaaaacgaataaacaacgacgcgactactcctaaaatacacctaaaaacgacgcgcgactaacaaaaaacgactacgaaaaaaaaacctaaatcgcgacccccgactacgtccgccccaaaccgccgccgccaaatctaaaactccccgacaaacaaccaaaactaactcctatcacacccgcgtcccacctcgaatcctaaaccgcccctcgaacctcgcgcctcaccgcacaacctacgacctacctacgtccgccgcgccctcgaaaccgctactactaacccccgctaacctccgctaaccccgcgctaaccccgcgcgacgcctaacgaaacgcgaaccgacctcaaaaaataaactaaaccgcgtcccaacgacctccgcgctccgcttacccgactacccccgcgcgccaaacacttccgaaaacgacgacgctcgaaaaaaaataccgatcgactactaaaacgaaaaaaaacgccgaaccgctctaaccgataaaaccgacgaactctctataactacgactaaaaaaccgcgcgaaaaaaatacccgaccgaaaaccaaataaccgcgatttacgaaaacgcgaccctaaccaaacaaaaaaaacgccgaacgaaaaaacgcgaccgacctaaaaaacgacgaacgcgacgaataaactcgacgaaaaataaaacgacgaaacgccccgcgaaaaaaaaactccgaaataacgcgaaacccgactaacgacgaacccacgacgactcgaaaaaaaaacgcgaaacctaaacgaaaatacccgaactacgacctctacgctaaaaactatacctctaaaccgatatctccccgaaaaaaaaaaaacgtacccg

SEQ ID NO: 27095 - DNA, 1243 bp, Artificial Sequence
  chemically treated genomic DNA (Homo sapiens) CpG-island No: 27095
tttttatttcgtttttttgtaattttttttaggttagtcgttattgtgttttgtttatagtaatgattgcgattttttcgtatatatatcggtttcggttttttttttgttcgcgggattatttagtcgggtgtttatagtgagtttagtcgcgttttcgttttttttcgaggtttcgtttttacgttttacgcgcgcggaacggggaatatattcgttgtagtttcgtttgggttacggtattttcgagcgttagtttcgcgttttattcgggagtagcgagttatcggcgcgttttttaggagtttttgtaggcgtcgggtagggacgttttattattttattttttaaaacggggacggttttggggggagcggattatagggcgggtgagtagcggcgcggttgtttttggagtgtatttggaggcggcgcgcggttggtagggaacgattgcgaaggaagaatttgggtcgcggttttcggttacgttcgttttaagtcgtcgtcgttaggtttgaggtttttcgataagtagttaaagttggtttttgttatattcgcgttttatttcgagttttgggtcgtttttcgggtttcgcgttttatcgtatagtttgcggtttatttgcgttcgtcgcgttttcggagtcgttgttgttgattttcgttgattttcgttgatttcgcgttaatttcgcgcggcgtttgacgggacgcgggtcggttttagggaatgagttgaatcgcgttttagcggttttcgcgtttcgtttgttcggttgttttcgcgcgttaagtattttcggaagcggcggcgttcggaaggaaatgtcgatcggttgttggggcgaaagggggcgtcgggtcgttttagtcggtgaggtcggcgggttttttgtggttgcggttgggaaatcgcgcggaggaggtgttcggtcggggattaggtggtcgcggtttgcggggacgcggttttggttagatagaagagacgtcgggcgggggggcgcggtcggtttggaaggcggcgggcgcggcgggtgggttcggcggagggtgaggcggcggggcgtttcgcggggaaggggtttcggagtgacgcgggattcggttagcggcgagtttacggcggttcggaagggaagcgcggagtttgagcgggggtattcgggttgcgatttttgcgttgggagttgtgtttttgagtcggtgttttttcgagggaaaggggacgtgttcg

SEQ ID NO: 27096 - DNA, 1243 bp, Artificial Sequence
  chemically treated genomic DNA (Homo sapiens) CpG-island No: 27096
cgaacacgtcccctttccctcgaaaaaacaccgactcaaaaacacaactcccaacgcaaaaatcgcaacccgaatacccccgctcaaactccgcgcttcccttccgaaccgccgtaaactcgccgctaaccgaatcccgcgtcactccgaaaccccttccccgcgaaacgccccgccgcctcaccctccgccgaacccacccgccgcgcccgccgccttccaaaccgaccgcgcccccccgcccgacgtctcttctatctaaccaaaaccgcgtccccgcaaaccgcgaccacctaatccccgaccgaacacctcctccgcgcgatttcccaaccgcaaccacaaaaaacccgccgacctcaccgactaaaacgacccgacgccccctttcgccccaacaaccgatcgacatttccttccgaacgccgccgcttccgaaaatacttaacgcgcgaaaacaaccgaacaaacgaaacgcgaaaaccgctaaaacgcgattcaactcattccctaaaaccgacccgcgtcccgtcaaacgccgcgcgaaattaacgcgaaatcaacgaaaatcaacgaaaatcaacaacaacgactccgaaaacgcgacgaacgcaaataaaccgcaaactatacgataaaacgcgaaacccgaaaaacgacccaaaactcgaaataaaacgcgaatataacaaaaaccaactttaactacttatcgaaaaacctcaaacctaacgacgacgacttaaaacgaacgtaaccgaaaaccgcgacccaaattcttccttcgcaatcgttccctaccaaccgcgcgccgcctccaaatacactccaaaaacaaccgcgccgctactcacccgccctataatccgctccccccaaaaccgtccccgttttaaaaaataaaataataaaacgtccctacccgacgcctacaaaaactcctaaaaaacgcgccgataactcgctactcccgaataaaacgcgaaactaacgctcgaaaataccgtaacccaaacgaaactacaacgaatatattccccgttccgcgcgcgtaaaacgtaaaaacgaaacctcgaaaaaaaacgaaaacgcgactaaactcactataaacacccgactaaataatcccgcgaacaaaaaaaaaaccgaaaccgatatatatacgaaaaaatcgcaatcattactataaacaaaacacaataacgactaacctaaaaaaaattacaaaaaaacgaaataaaaa

SEQ ID NO: 27097 - DNA, 643 bp, Artificial Sequence
  chemically treated genomic DNA (Homo sapiens) CpG-island No: 27097
atacgtatttttgggtaagatcgcgatttagatttttagatatttcgagagacgtcgaagatttagatagagttacgtagttacgtatattttatagacgtttttttttttatttagagttcgagatatagcgtcgcgaatattttagatatacgttcggagttttagatatttcgtagattagatagtgttttatacgtttttttattttcgtttaaagttgataaagagtcggtttaaatgttttatcgcgattgtttttagggaaataaaatggaaattttacggattcgttcgttttaattttttcgcgtcgtgcgtcggcgttgagtttcgggttcgagttcgggcgggcggggcgcggatagcgggggtcgtgttaggttcgtagcgtcgcgggataaagtcgggtcggtcgttagttgtcgcgagtcgggagggcgcgttcggggcgcggcgggcgttgttcgggcgtagggcgttcggttcgagggggcgcgtagggttcggattttcgttcgtagttgtgtttcgatatagggttcgagttcgatggagttttcggggaggggggcgtggggttatttattgatttttatgttttggaataaagagcgtttgtagttgtacgtgtaggagatat

SEQ ID NO: 27098 - DNA, 643 bp, Artificial Sequence
  chemically treated genomic DNA (Homo sapiens) CpG-island No: 27098
atatctcctacacgtacaactacaaacgctctttattccaaaacataaaaatcaataaataaccccacgcccccctccccgaaaactccatcgaactcgaaccctatatcgaaacacaactacgaacgaaaatccgaaccctacgcgccccctcgaaccgaacgccctacgcccgaacaacgcccgccgcgccccgaacgcgccctcccgactcgcgacaactaacgaccgacccgactttatcccgcgacgctacgaacctaacacgacccccgctatccgcgccccgcccgcccgaactcgaacccgaaactcaacgccgacgcacgacgcgaaaaaattaaaacgaacgaatccgtaaaatttccattttatttccctaaaaacaatcgcgataaaacatttaaaccgactctttatcaactttaaacgaaaataaaaaaacgtataaaacactatctaatctacgaaatatctaaaactccgaacgtatatctaaaatattcgcgacgctatatctcgaactctaaataaaaaaaaaaacgtctataaaatatacgtaactacgtaactctatctaaatcttcgacgtctctcgaaatatctaaaaatctaaatcgcgatcttacccaaaaatacgtat

SEQ ID NO: 27099 - DNA, 643 bp, Artificial Sequence
  chemically treated genomic DNA (Homo sapiens) CpG-island No: 27099
atgttttttgtacgtgtaattgtaaacgttttttgttttagagtatggagattagtgagtgattttacgttttttttttcggagattttatcgggttcggattttatgtcggggtatagttgcgagcgggggttcgggttttgcgcgttttttcggatcgaacgttttgcgttcgggtagcgttcgtcgcgtttcgggcgcgttttttcggttcgcggtagttggcggtcggttcggttttgtttcgcggcgttgcgagtttggtacggttttcgttgttcgcgtttcgttcgttcggattcggattcggggtttagcgtcggcgtacggcgcgggagggttggggcgggcggattcgtgaagtttttattttatttttttgagggtagtcgcgatggagtatttaggtcggttttttattaattttgggcgggggtggaggggcgtgtgagatattgtttggtttgcgaggtgtttggggtttcgggcgtgtgtttggagtgttcgcggcgttgtgtttcgggttttgagtgaaaaaaagagcgtttgtggagtgtgcgtggttgcgtggttttgtttgggttttcggcgtttttcggggtgtttgggggtttgagtcgcggttttgtttaagagtgcgtgt

SEQ ID NO: 27100 - DNA, 643 bp, Artificial Sequence
  chemically treated genomic DNA (Homo sapiens) CpG-island No: 27100
acacgcactcttaaacaaaaccgcgactcaaacccccaaacaccccgaaaaacgccgaaaacccaaacaaaaccacgcaaccacgcacactccacaaacgctctttttttcactcaaaacccgaaacacaacgccgcgaacactccaaacacacgcccgaaaccccaaacacctcgcaaaccaaacaatatctcacacgcccctccacccccgcccaaaattaataaaaaaccgacctaaatactccatcgcgactaccctcaaaaaaataaaataaaaacttcacgaatccgcccgccccaaccctcccgcgccgtacgccgacgctaaaccccgaatccgaatccgaacgaacgaaacgcgaacaacgaaaaccgtaccaaactcgcaacgccgcgaaacaaaaccgaaccgaccgccaactaccgcgaaccgaaaaaacgcgcccgaaacgcgacgaacgctacccgaacgcaaaacgttcgatccgaaaaaacgcgcaaaacccgaacccccgctcgcaactataccccgacataaaatccgaacccgataaaatctccgaaaaaaaaaacgtaaaatcactcactaatctccatactctaaaacaaaaaacgtttacaattacacgtacaaaaaacat

SEQ ID NO: 27101 - DNA, 661 bp, Artificial Sequence
  chemically treated genomic DNA (Homo sapiens) CpG-island No: 27101
tggttgcggttttttttcgcgttcgatttatttgggatcggtcgcgatatttcgtttgttagtagggtttagggtcgggaaagttttttttcggtttttcggaggggggaatttttatgacgttttcgtgcgttacgtttcgcgtttttttttattggttgaaagtttaattttggattggcgtagttaattcggagcgattcgggcgcgtttttgagaggggataggtttatttagggcggggagcggggtgataggatattaggcgcgagttcggtcggttaggggatcgtcgagaaggtattcgttgatttagcgttatttcgggtcgggagttttcgttgtttttcggttttggttgcgtttaacgtttggttttttttgaagcgggggatttttagggggaagtcgacggttttagttttcggggtttttattttgagcggcgcgttgtcgggaagttagcggaagaggaaggaagttatttttgcggtcggtttcgggcgttttttggcggtttttttgggttcgcgagtagattttattcggtttcggtttttttttcgtttcgttttattagttttaaggtttcgggagagatagttcggatttcgaatttttttagaagtgataggtttttagcgggttagggtttaggagt

SEQ ID NO: 27102 - DNA, 661 bp, Artificial Sequence
  chemically treated genomic DNA (Homo sapiens) CpG-island No: 27102
actcctaaaccctaacccgctaaaaacctatcacttctaaaaaaattcgaaatccgaactatctctcccgaaaccttaaaactaataaaacgaaacgaaaaaaaaaccgaaaccgaataaaatctactcgcgaacccaaaaaaaccgccaaaaaacgcccgaaaccgaccgcaaaaataacttccttcctcttccgctaacttcccgacaacgcgccgctcaaaataaaaaccccgaaaactaaaaccgtcgacttccccctaaaaatcccccgcttcaaaaaaaaccaaacgttaaacgcaaccaaaaccgaaaaacaacgaaaactcccgacccgaaataacgctaaatcaacgaataccttctcgacgatcccctaaccgaccgaactcgcgcctaatatcctatcaccccgctccccgccctaaataaacctatcccctctcaaaaacgcgcccgaatcgctccgaattaactacgccaatccaaaattaaactttcaaccaataaaaaaaaacgcgaaacgtaacgcacgaaaacgtcataaaaattcccccctccgaaaaaccgaaaaaaaactttcccgaccctaaaccctactaacaaacgaaatatcgcgaccgatcccaaataaatcgaacgcgaaaaaaaaccgcaacca

SEQ ID NO: 27103 - DNA, 661 bp, Artificial Sequence
  chemically treated genomic DNA (Homo sapiens) CpG-island No: 27103
gtttttgagttttggttcgttgggaatttgttatttttaaaaaagttcgaggttcggattgtttttttcggagttttgaggttgatgagacggagcgagagaggggtcggggtcgaatggagtttattcgcgggtttagggaggtcgttagagggcgttcgggatcgatcgtaagaataattttttttttttttcgttaatttttcggtagcgcgtcgtttagggtgggggtttcgagggttggggtcgtcggtttttttttggggatttttcgttttagagaaagttaagcgttaggcgtagttaaagtcgagaggtagcggaagttttcggttcggggtggcgttgggttagcgggtattttttcggcggttttttggtcggtcgaattcgcgtttggtgttttgttatttcgtttttcgttttgagtgagtttgtttttttttaggggcgcgttcgagtcgtttcgggttggttgcgttagtttagagttaaatttttagttaatgaaaaagggcgcgaggcgtgacgtacggaaacgttatgggaattttttttttcggggggtcgagaaggggttttttcggttttgagttttgttggtaggcgaggtgtcgcgatcggttttaggtgggtcgggcgcggagagaagtcgtaatta

SEQ ID NO: 27104 - DNA, 661 bp, Artificial Sequence
  chemically treated genomic DNA (Homo sapiens) CpG-island No: 27104
taattacgacttctctccgcgcccgacccacctaaaaccgatcgcgacacctcgcctaccaacaaaactcaaaaccgaaaaaaccccttctcgaccccccgaaaaaaaaaattcccataacgtttccgtacgtcacgcctcgcgccctttttcattaactaaaaatttaactctaaactaacgcaaccaacccgaaacgactcgaacgcgcccctaaaaaaaaacaaactcactcaaaacgaaaaacgaaataacaaaacaccaaacgcgaattcgaccgaccaaaaaaccgccgaaaaaatacccgctaacccaacgccaccccgaaccgaaaacttccgctacctctcgactttaactacgcctaacgcttaactttctctaaaacgaaaaatccccaaaaaaaaaccgacgaccccaaccctcgaaacccccaccctaaacgacgcgctaccgaaaaattaacgaaaaaaaaaaaaaattattcttacgatcgatcccgaacgccctctaacgacctccctaaacccgcgaataaactccattcgaccccgacccctctctcgctccgtctcatcaacctcaaaactccgaaaaaaacaatccgaacctcgaacttttttaaaaataacaaattcccaacgaaccaaaactcaaaaac

SEQ ID NO: 27105 - DNA, 537 bp, Artificial Sequence
  chemically treated genomic DNA (Homo sapiens) CpG-island No: 27105
tcggcgttttaattttttttagttcgcgtttgttcgttttttcgcggtttagagtatattagtatttgacgatagcggtaatttggagcgggttcggttggttagggtaaaggcggcggtatttttcgtagatggcgtgtagtttcgggggaaagagcgaagcgaaggtcgggggggtagtcgggttaggggtcgggggcgcggtagggtcgggggcgtcgttaggtcgtagtttcgttatcggggtgcgtagggtaggtattgggggaattggagagggtaaacgacggggagagtattgacgggttagcgggcggattcggtgggtgagatttttcgaggcgatgggggttgtagtgaggtttagtttcgcgtttgcgtacggcgtattgttcgtttaggttgtcgtcgtcgtcgagtttgttagagggtgtttcggggcggcggggcgttaaggggggcgggcgtcggcgtattttatttaagtatttattggttaatgtttgtgttagttataggtagggaaggtgggatttg

SEQ ID NO: 27106 - DNA, 537 bp, Artificial Sequence
  chemically treated genomic DNA (Homo sapiens) CpG-island No: 27106
caaatcccaccttccctacctataactaacacaaacattaaccaataaatacttaaataaaatacgccgacgcccgccccccttaacgccccgccgccccgaaacaccctctaacaaactcgacgacgacgacaacctaaacgaacaatacgccgtacgcaaacgcgaaactaaacctcactacaacccccatcgcctcgaaaaatctcacccaccgaatccgcccgctaacccgtcaatactctccccgtcgtttaccctctccaattcccccaatacctaccctacgcaccccgataacgaaactacgacctaacgacgcccccgaccctaccgcgcccccgacccctaacccgactacccccccgaccttcgcttcgctctttcccccgaaactacacgccatctacgaaaaataccgccgcctttaccctaaccaaccgaacccgctccaaattaccgctatcgtcaaatactaatatactctaaaccgcgaaaaaacgaacaaacgcgaactaaaaaaaattaaaacgccga

SEQ ID NO: 27107 - DNA, 537 bp, Artificial Sequence
  chemically treated genomic DNA (Homo sapiens) CpG-island No: 27107
taagttttattttttttgtttgtgattggtatagatattagttaatgggtgtttggatagggtgcgtcggcgttcgttttttttagcgtttcgtcgtttcgaggtattttttggtagattcggcggcggcgatagtttgggcggatagtgcgtcgtgcgtaggcgcggagttagattttattgtagtttttatcgtttcggggagttttatttatcgagttcgttcgttggttcgttagtgtttttttcgtcgtttgttttttttagtttttttagtgtttgttttacgtatttcgatggcgaagttgcggtttagcggcgttttcggttttatcgcgttttcggtttttggttcgattgttttttcggttttcgtttcgttttttttttcgggattgtacgttatttacggagagtgtcgtcgtttttattttgattagtcgaattcgttttaggttatcgttatcgttaagtattggtatgttttgggtcgcggggagacggataggcgcgggttggaaagggttaaagcgtcga

SEQ ID NO: 27108 - DNA, 537 bp, Artificial Sequence
  chemically treated genomic DNA (Homo sapiens) CpG-island No: 27108
tcgacgctttaaccctttccaacccgcgcctatccgtctccccgcgacccaaaacataccaatacttaacgataacgataacctaaaacgaattcgactaatcaaaataaaaacgacgacactctccgtaaataacgtacaatcccgaaaaaaaaaacgaaacgaaaaccgaaaaaacaatcgaaccaaaaaccgaaaacgcgataaaaccgaaaacgccgctaaaccgcaacttcgccatcgaaatacgtaaaacaaacactaaaaaaactaaaaaaaacaaacgacgaaaaaaacactaacgaaccaacgaacgaactcgataaataaaactccccgaaacgataaaaactacaataaaatctaactccgcgcctacgcacgacgcactatccgcccaaactatcgccgccgccgaatctaccaaaaaatacctcgaaacgacgaaacgctaaaaaaaacgaacgccgacgcaccctatccaaacacccattaactaatatctataccaatcacaaacaaaaaaaataaaactta

SEQ ID NO: 27109 - DNA, 633 bp, Artificial Sequence
  chemically treated genomic DNA (Homo sapiens) CpG-island No: 27109
tcgaagcgacgtagttcggttaggtgaagttgtattagcgatcggaaggttcggttaacgcgttgtagtcggagtagttggcgtagcgggattcggtttaggacgtgtgggagtagtacgtttttttagggtaggtttaggaatttgcgagtaaaggggcgttggtattggcgtttcggggttattattatttgcgagttcgttttcgttatgtttttgcgttttagtttttaagagcggtttttagatttagtttcggttcggttttttttttttaggttttttttttttttcggttttttcggtgttcggtatttgacggtttcgggtttttgttttttttcggacggttttatcggtggttttatcggttgtttattgcgcgtgcgtagtaagattttttcgttttggttttggagtggtcgtattaaattcgtttttttggtttgtagagatagatttatttaatcgagtgtcgttttatcgaggattcgatttgaaagtttttcgggtggatttcgaaacggaggcggaatagatcggtggtgtaatattaggtttcgttttttcggttatagggtttgaggtttgaagttggagaatgcggtgggtattatagattggtttttgtcg

SEQ ID NO: 27110 - DNA, 633 bp, Artificial Sequence
  chemically treated genomic DNA (Homo sapiens) CpG-island No: 27110
cgacaaaaaccaatctataatacccaccgcattctccaacttcaaacctcaaaccctataaccgaaaaaacgaaacctaatattacaccaccgatctattccgcctccgtttcgaaatccacccgaaaaactttcaaatcgaatcctcgataaaacgacactcgattaaataaatctatctctacaaaccaaaaaaacgaatttaatacgaccactccaaaaccaaaacgaaaaaatcttactacgcacgcgcaataaacaaccgataaaaccaccgataaaaccgtccgaaaaaaaacaaaaacccgaaaccgtcaaataccgaacaccgaaaaaaccgaaaaaaaaaaaaaacctaaaaaaaaaaaaccgaaccgaaactaaatctaaaaaccgctcttaaaaactaaaacgcaaaaacataacgaaaacgaactcgcaaataataataaccccgaaacgccaataccaacgcccctttactcgcaaattcctaaacctaccctaaaaaaacgtactactcccacacgtcctaaaccgaatcccgctacgccaactactccgactacaacgcgttaaccgaaccttccgatcgctaatacaacttcacctaaccgaactacgtcgcttcga

SEQ ID NO: 27111 - DNA, 633 bp, Artificial Sequence
  chemically treated genomic DNA (Homo sapiens) CpG-island No: 27111
cgatagaagttagtttatgatgtttatcgtattttttagttttaggttttaagttttgtagtcgagaaggcgaggtttaatgttatattatcggtttgtttcgttttcgtttcggggtttattcgaaaagtttttagatcggattttcggtgagacggtattcgattaaataggtttgtttttataggttaaggaggcgggtttggtgcggttattttaaggttaaagcgagaaaattttattgcgtacgcgtaatagatagtcgatggagttatcgatggagtcgttcggaggggagtaagagttcggagtcgttaggtatcgagtatcggaggggtcgagagggaagaggaatttgagggaggggagtcgagtcggggttgggtttgggggtcgtttttgggagttggggcgtaggaatataacggaggcggattcgtaggtaatagtggtttcgggacgttagtgttaacgtttttttattcgtaggtttttggatttgttttgggaagacgtgttgtttttatacgttttgaatcgggtttcgttgcgttagttgtttcggttgtagcgcgttagtcgggtttttcggtcgttggtgtagttttatttggtcgggttgcgtcgtttcga

SEQ ID NO: 27112 - DNA, 633 bp, Artificial Sequence
  chemically treated genomic DNA (Homo sapiens) CpG-island No: 27112
tcgaaacgacgcaacccgaccaaataaaactacaccaacgaccgaaaaacccgactaacgcgctacaaccgaaacaactaacgcaacgaaacccgattcaaaacgtataaaaacaacacgtcttcccaaaacaaatccaaaaacctacgaataaaaaaacgttaacactaacgtcccgaaaccactattacctacgaatccgcctccgttatattcctacgccccaactcccaaaaacgacccccaaacccaaccccgactcgactcccctccctcaaattcctcttccctctcgacccctccgatactcgatacctaacgactccgaactcttactcccctccgaacgactccatcgataactccatcgactatctattacgcgtacgcaataaaattttctcgctttaaccttaaaataaccgcaccaaacccgcctccttaacctataaaaacaaacctatttaatcgaataccgtctcaccgaaaatccgatctaaaaacttttcgaataaaccccgaaacgaaaacgaaacaaaccgataatataacattaaacctcgccttctcgactacaaaacttaaaacctaaaactaaaaaatacgataaacatcataaactaacttctatcg

SEQ ID NO: 27113 - DNA, 693 bp, Artificial Sequence
  chemically treated genomic DNA (Homo sapiens) CpG-island No: 27113
tcgggcggcgtaggacgttcgtcgcgcgaggggcgggggttaagcgtatcgaggggcggtgttcgagggcgcgggaggcgggagaggttgtcgcgtcgtgtgttttggtagtcgtagtttcgtttcgtcgcgttcggttcggttttgtttcgtagcgtttcgttagttagttttttgtatttttcgcggtcgaggcgttttttggtgtttttcgcgtagttatggtttagtatttttttttggtcgtttgcgacgtggtcggattcgatttggattatattttgtgtcgttataatttgttcgagagcgtttcggtgagtggcgcgggtttcggggcgtattgcgcgtaatttttatggcggttggggtttgagttttttttaggtttgggtaacggcggacgttgttcggggtttgcggcggtcgagttttgtcgtagagcgcggtttttagcggcgagaaggggcggaagtgtgtagttttcgtttcgcgtcggtgtcgtggggatcggtatatttattttagttattagttaatgttgagagggatagggaagaacgaaggaggggtaaattgcgtaagatcgggttggggaatcggtgatttttagggtcgaggaggggcggggttagggggattagggttgtttttgaagattttacgtcgtggaattttttttgtatgtttttttgg

SEQ ID NO: 27114 - DNA, 693 bp, Artificial Sequence
  chemically treated genomic DNA (Homo sapiens) CpG-island No: 27114
ccaaaaaaacatacaaaaaaaattccacgacgtaaaatcttcaaaaacaaccctaatccccctaaccccgcccctcctcgaccctaaaaatcaccgattccccaacccgatcttacgcaatttacccctccttcgttcttccctatccctctcaacattaactaataactaaaataaatataccgatccccacgacaccgacgcgaaacgaaaactacacacttccgccccttctcgccgctaaaaaccgcgctctacgacaaaactcgaccgccgcaaaccccgaacaacgtccgccgttacccaaacctaaaaaaaactcaaaccccaaccgccataaaaattacgcgcaatacgccccgaaacccgcgccactcaccgaaacgctctcgaacaaattataacgacacaaaatataatccaaatcgaatccgaccacgtcgcaaacgaccaaaaaaaaatactaaaccataactacgcgaaaaacaccaaaaaacgcctcgaccgcgaaaaatacaaaaaactaactaacgaaacgctacgaaacaaaaccgaaccgaacgcgacgaaacgaaactacgactaccaaaacacacgacgcgacaacctctcccgcctcccgcgccctcgaacaccgcccctcgatacgcttaacccccgcccctcgcgcgacgaacgtcctacgccgcccga

SEQ ID NO: 27115 - DNA, 693 bp, Artificial Sequence
  chemically treated genomic DNA (Homo sapiens) CpG-island No: 27115
ttagaaagatatgtagagaaagttttacgacgtgagatttttaaggatagttttagtttttttgatttcgttttttttcggttttagaaattatcgattttttagttcggttttgcgtagtttgtttttttttcgtttttttttattttttttaatattagttaatggttgaggtaaatgtgtcggtttttacggtatcggcgcggagcggaggttgtatattttcgttttttttcgtcgttggaggtcgcgttttgcggtaagattcggtcgtcgtaggtttcgggtagcgttcgtcgttgtttaaatttggaggaaatttaagttttagtcgttatggaggttgcgcgtagtgcgtttcggagttcgcgttatttatcggggcgttttcgggtaggttgtagcgatatagagtgtggtttaggtcgaattcgattacgtcgtaggcggttagggagaagtgttgagttatggttgcgcggggagtattagggagcgtttcggtcgcgaagggtgtaaggagttggttggcgggacgttgcgggataggatcgggtcggacgcggcggggcggggttgcggttgttagggtatacggcgcggtagtttttttcgtttttcgcgttttcgagtatcgtttttcgatacgtttagttttcgtttttcgcgcggcgggcgttttgcgtcgttcgg

SEQ ID NO: 27116 - DNA, 693 bp, Artificial Sequence
  chemically treated genomic DNA (Homo sapiens) CpG-island No: 27116
ccgaacgacgcaaaacgcccgccgcgcgaaaaacgaaaactaaacgtatcgaaaaacgatactcgaaaacgcgaaaaacgaaaaaaactaccgcgccgtataccctaacaaccgcaaccccgccccgccgcgtccgacccgatcctatcccgcaacgtcccgccaaccaactccttacacccttcgcgaccgaaacgctccctaatactccccgcgcaaccataactcaacacttctccctaaccgcctacgacgtaatcgaattcgacctaaaccacactctatatcgctacaacctacccgaaaacgccccgataaataacgcgaactccgaaacgcactacgcgcaacctccataacgactaaaacttaaatttcctccaaatttaaacaacgacgaacgctacccgaaacctacgacgaccgaatcttaccgcaaaacgcgacctccaacgacgaaaaaaaacgaaaatatacaacctccgctccgcgccgataccgtaaaaaccgacacatttacctcaaccattaactaatattaaaaaaaataaaaaaaaacgaaaaaaaaacaaactacgcaaaaccgaactaaaaaatcgataatttctaaaaccgaaaaaaaacgaaatcaaaaaaactaaaactatccttaaaaatctcacgtcgtaaaactttctctacatatctttctaa

SEQ ID NO: 27117 - DNA, 647 bp, Artificial Sequence
  chemically treated genomic DNA (Homo sapiens) CpG-island No: 27117
ttcgttatttttttttagaaggtaaagggaagttttggcggaagaggttttcggaacggatcggaaggggtcggttttgtgggcgggtttaatcggttgggagtttcgtggagggttgaggttgagttttggaggttgcgttggttggggcggatagttttatttgcgggtttcgattttcgtagattttggtttgacggcgttcgtgatgttcgtcgtaggcgaaacgggcgtgttaaaggtcggttgttaaggttggggggaatttaggtaattacgggcgtttttataaaagtatttggaagttttttaattattcggagtcggatgtcggttgttgagtcgagttgtttgatcgtgcgtgtgtacggggtggtttggagggttgtttgatcgtgtgtttcgtgtgttgaatttttcgttagttttttttgatcgaagtattcgtgtcggaatgtgtggtaggtttgagttacggtttaggtttttagagtattttggaaatatcgtttcgggggtttggacgtaacgaagcggaaaaatgcggttttcgcggatagttggtttagtttgttcgaaagaggcgaagttgtgtcgttggatagtgaatcggtacgtgattgggtatttaatattcgggattatat

SEQ ID NO: 27118 - DNA, 647 bp, Artificial Sequence
  chemically treated genomic DNA (Homo sapiens) CpG-island No: 27118
atataatcccgaatattaaatacccaatcacgtaccgattcactatccaacgacacaacttcgcctctttcgaacaaactaaaccaactatccgcgaaaaccgcatttttccgcttcgttacgtccaaacccccgaaacgatatttccaaaatactctaaaaacctaaaccgtaactcaaacctaccacacattccgacacgaatacttcgatcaaaaaaaactaacgaaaaattcaacacacgaaacacacgatcaaacaaccctccaaaccaccccgtacacacgcacgatcaaacaactcgactcaacaaccgacatccgactccgaataattaaaaaacttccaaatacttttataaaaacgcccgtaattacctaaattccccccaaccttaacaaccgacctttaacacgcccgtttcgcctacgacgaacatcacgaacgccgtcaaaccaaaatctacgaaaatcgaaacccgcaaataaaactatccgccccaaccaacgcaacctccaaaactcaacctcaaccctccacgaaactcccaaccgattaaacccgcccacaaaaccgaccccttccgatccgttccgaaaacctcttccgccaaaacttccctttaccttctaaaaaaaaataacgaa

SEQ ID NO: 27119 - DNA, 647 bp, Artificial Sequence
  chemically treated genomic DNA (Homo sapiens) CpG-island No: 27119
gtgtggtttcggatgttaagtgtttaattacgtgtcggtttattgtttaacggtatagtttcgtttttttcggataggttggattaattgttcgcggagatcgtattttttcgtttcgttacgtttaggttttcgaaacgatgtttttagaatgttttgaaggtttggatcgtggtttagatttgttatatatttcgatacgagtgtttcgattaggggaggttgacggagggtttaatatacggaatatacggttaaatagttttttaggttatttcgtgtatacgtacggttaggtagttcggtttagtaatcggtattcggtttcgagtagttgaggggtttttaagtatttttgtgggaacgttcgtagttatttgagttttttttagttttagtaatcggtttttaatacgttcgtttcgtttgcggcggatattacgaacgtcgttaagttagaatttgcgaaaatcggaattcgtagataaggttgttcgttttaattaacgtaatttttaggatttaattttagttttttacgaggtttttagtcgattggattcgtttataagatcggtttttttcggttcgtttcggaagtttttttcgttagagtttttttttgttttttaggaggaaatgacgga

SEQ ID NO: 27120 - DNA, 647 bp, Artificial Sequence
  chemically treated genomic DNA (Homo sapiens) CpG-island No: 27120
tccgtcatttcctcctaaaaaacaaaaaaaaactctaacgaaaaaaacttccgaaacgaaccgaaaaaaaccgatcttataaacgaatccaatcgactaaaaacctcgtaaaaaactaaaattaaatcctaaaaattacgttaattaaaacgaacaaccttatctacgaattccgattttcgcaaattctaacttaacgacgttcgtaatatccgccgcaaacgaaacgaacgtattaaaaaccgattactaaaactaaaaaaaactcaaataactacgaacgttcccacaaaaatacttaaaaacccctcaactactcgaaaccgaataccgattactaaaccgaactacctaaccgtacgtatacacgaaataacctaaaaaactatttaaccgtatattccgtatattaaaccctccgtcaacctcccctaatcgaaacactcgtatcgaaatatataacaaatctaaaccacgatccaaaccttcaaaacattctaaaaacatcgtttcgaaaacctaaacgtaacgaaacgaaaaaatacgatctccgcgaacaattaatccaacctatccgaaaaaaacgaaactataccgttaaacaataaaccgacacgtaattaaacacttaacatccgaaaccacac

SEQ ID NO: 27121 - DNA, 682 bp, Artificial Sequence
  chemically treated genomic DNA (Homo sapiens) CpG-island No: 27121
ggtttcggttagtgttgcggtttcggttttggtcggtaggggtcgcgtttcgcggcgttcggggtttcgtcgcgttcgtcgtcgtcgttcgttttttcgttttttttttagtcggggttttcgttacgtcgcggagtcgggagtcggagttcgagttcgcggcggcggcgggaggcggcgagggggcgtcgcggcggcggcggtggggtttgcggggcgggcggtcgggttcggttaggtcgcgatggcgattaagaaggtaggttcgcggttggagacggagatcgagcgtgtcgtttcgagtgttagtgggagcggatttttgagttcgttaagtagttgtcggttaagtttatcgttaacggtacgtatcgggcgcgtcggtttgggttgcggggggcgtcgcggttttcgcggggacgggttttcgaggcgcggtcgggcgcggggggcgggtaggggcgcggtcgggtcgcgagggagttgcggtttaggggatgtgcgcgggatcggggtttgggggtgttcgggtgtttcggagttacgcggtgtgggttgatgggggggcgttaggggttgtttcggcgtttggggtttaagcgtgtagggcgggtttttgcggagtttggggtgttcgggggttttagcgagttcgttgttttattgggattataggaggtta

SEQ ID NO: 27122 - DNA, 682 bp, Artificial Sequence
  chemically treated genomic DNA (Homo sapiens) CpG-island No: 27122
taacctcctataatcccaataaaacaacgaactcgctaaaacccccgaacaccccaaactccgcaaaaacccgccctacacgcttaaaccccaaacgccgaaacaacccctaacgcccccccatcaacccacaccgcgtaactccgaaacacccgaacacccccaaaccccgatcccgcgcacatcccctaaaccgcaactccctcgcgacccgaccgcgcccctacccgccccccgcgcccgaccgcgcctcgaaaacccgtccccgcgaaaaccgcgacgccccccgcaacccaaaccgacgcgcccgatacgtaccgttaacgataaacttaaccgacaactacttaacgaactcaaaaatccgctcccactaacactcgaaacgacacgctcgatctccgtctccaaccgcgaacctaccttcttaatcgccatcgcgacctaaccgaacccgaccgcccgccccgcaaaccccaccgccgccgccgcgacgccccctcgccgcctcccgccgccgccgcgaactcgaactccgactcccgactccgcgacgtaacgaaaaccccgactaaaaaaaaaacgaaaaaacgaacgacgacgacgaacgcgacgaaaccccgaacgccgcgaaacgcgacccctaccgaccaaaaccgaaaccgcaacactaaccgaaacc

SEQ ID NO: 27123 - DNA, 682 bp, Artificial Sequence
  chemically treated genomic DNA (Homo sapiens) CpG-island No: 27123
tgattttttgtggttttagtggagtagcggattcgttgagattttcggatattttagatttcgtagaagttcgttttgtacgtttgaattttaggcgtcgggatagtttttggcgtttttttattaatttatatcgcgtgatttcggggtattcgggtatttttaggtttcggtttcgcgtatattttttgggtcgtagttttttcgcggttcggtcgcgtttttgttcgtttttcgcgttcggtcgcgtttcgggggttcgttttcgcggaggtcgcggcgtttttcgtagtttaggtcggcgcgttcggtgcgtatcgttggcgatgagtttggtcgatagttgtttgacgagtttagggattcgtttttattggtattcggagcggtacgttcgattttcgtttttagtcgcgagtttgtttttttggtcgttatcgcggtttggtcgggttcggtcgttcgtttcgtaggttttatcgtcgtcgtcgcggcgttttttcgtcgtttttcgtcgtcgtcgcgggttcgggtttcggttttcggtttcgcggcgtaacgggagtttcggttggggaaagggcggggaggcgggcggcggcggcgggcgcggcggggtttcgggcgtcgcgaggcgcggtttttgtcggttagggtcggagtcgtagtattgatcggggtt

SEQ ID NO: 27124 - DNA, 682 bp, Artificial Sequence
  chemically treated genomic DNA (Homo sapiens) CpG-island No: 27124
aaccccgatcaatactacgactccgaccctaaccgacaaaaaccgcgcctcgcgacgcccgaaaccccgccgcgcccgccgccgccgcccgcctccccgccctttccccaaccgaaactcccgttacgccgcgaaaccgaaaaccgaaacccgaacccgcgacgacgacgaaaaacgacgaaaaaacgccgcgacgacgacgataaaacctacgaaacgaacgaccgaacccgaccaaaccgcgataacgaccaaaaaaacaaactcgcgactaaaaacgaaaatcgaacgtaccgctccgaataccaataaaaacgaatccctaaactcgtcaaacaactatcgaccaaactcatcgccaacgatacgcaccgaacgcgccgacctaaactacgaaaaacgccgcgacctccgcgaaaacgaacccccgaaacgcgaccgaacgcgaaaaacgaacaaaaacgcgaccgaaccgcgaaaaaactacgacccaaaaaatatacgcgaaaccgaaacctaaaaatacccgaataccccgaaatcacgcgatataaattaataaaaaaacgccaaaaactatcccgacgcctaaaattcaaacgtacaaaacgaacttctacgaaatctaaaatatccgaaaatctcaacgaatccgctactccactaaaaccacaaaaaatca

SEQ ID NO: 27125 - DNA, 939 bp, Artificial Sequence
  chemically treated genomic DNA (Homo sapiens) CpG-island No: 27125
ggtcgtaatttcgtattcgggtaaatacgcgttttcgtttcgggagcggttttttagcgttttgggagcgacgggtttcgtttttcggcgttcggagtttaaagtcggtcgggttgtcgtcgcgattttttcgggtcgtttttttcgtttcgagcgttatatttcgcgtttttgttttagggacggcggcgcgttttagttcgtttttcggagcgtatagagatcggttagttcggcgtcgtcgcgttttagttttagacggacgattggttttttttcgttcggcgttttagcgtttttcgcggcggtttggttttagtttcggcgtttttacgtttaagaatagtttttttttttttcggacgtttcgcgttatatcggatatagtttcggttttatagttttagagatattaagggatatttatttcggaggtttttttcgtcgttgttgttgtcgttgggatcgttgtcgtcgttttcgtcgtcgtcgttattagtatcgtcgttcgtatcggcgttagtattttcggttattttttttttatcgtcgtcgtcgtcgttttttttttttttgttagtggtttaggtttcgggattgttttaggtttttttcgtcgttattttgatttttagacggagtaggaggggttcggttcggcgtggttttggggcgtttgcgcggcgttgcggagtcggtcggagttttcgtttttttttgtcgtcgtttcgtttagggttacgtggttcgacgtcgtcgcgcgagttgggtcgcgtgggggggcggtgcgttcgttggatttatgggagcggagtgcgcgcgtattatttttgttcgtcggttgggagtcgggcgtcgggtcgttgggagtttgttttttgtggtagtattttgtttagtttagcgaattgtgatatattattaaatgtattagaatat

SEQ ID NO: 27126 - DNA, 939 bp, Artificial Sequence
  chemically treated genomic DNA (Homo sapiens) CpG-island No: 27126
atattctaatacatttaataatatatcacaattcgctaaactaaacaaaatactaccacaaaaaacaaactcccaacgacccgacgcccgactcccaaccgacgaacaaaaataatacgcgcgcactccgctcccataaatccaacgaacgcaccgcccccccacgcgacccaactcgcgcgacgacgtcgaaccacgtaaccctaaacgaaacgacgacaaaaaaaaacgaaaactccgaccgactccgcaacgccgcgcaaacgccccaaaaccacgccgaaccgaacccctcctactccgtctaaaaatcaaaataacgacgaaaaaaacctaaaacaatcccgaaacctaaaccactaacaaaaaaaaaaaaaacgacgacgacgacgataaaaaaaaaataaccgaaaatactaacgccgatacgaacgacgatactaataacgacgacgacgaaaacgacgacaacgatcccaacgacaacaacaacgacgaaaaaaacctccgaaataaatatcccttaatatctctaaaactataaaaccgaaactatatccgatataacgcgaaacgtccgaaaaaaaaaaaaactattcttaaacgtaaaaacgccgaaactaaaaccaaaccgccgcgaaaaacgctaaaacgccgaacgaaaaaaaaccaatcgtccgtctaaaactaaaacgcgacgacgccgaactaaccgatctctatacgctccgaaaaacgaactaaaacgcgccgccgtccctaaaacaaaaacgcgaaatataacgctcgaaacgaaaaaaacgacccgaaaaaatcgcgacgacaacccgaccgactttaaactccgaacgccgaaaaacgaaacccgtcgctcccaaaacgctaaaaaaccgctcccgaaacgaaaacgcgtatttacccgaatacgaaattacgacc

SEQ ID NO: 27127 - DNA, 939 bp, Artificial Sequence
  chemically treated genomic DNA (Homo sapiens) CpG-island No: 27127
atattttgatatatttaataatgtgttataattcgttggattaagtaggatgttgttataagaggtaaatttttagcgattcgacgttcggtttttagtcgacgagtaaaaataatgcgcgcgtatttcgtttttatggatttagcgaacgtatcgtttttttacgcggtttaattcgcgcggcgacgtcgggttacgtgattttgagcgggacgacggtaggggagggcgggggtttcggtcggtttcgtagcgtcgcgtaggcgttttagggttacgtcgaatcgagttttttttgtttcgtttaggagttaaaatggcggcgaggggaatttggagtagtttcggagtttgagttattgataggagaggagagggcggcggcggcggcggtgggaggaggatggtcgggggtgttggcgtcggtgcggacggcggtgttggtggcggcggcggcggaggcgacggtagcggttttagcggtagtagtagcggcgggaggagttttcggggtgagtgttttttggtgtttttgaggttgtggagtcgaggttgtgttcggtgtggcgcggggcgttcgggagaggaaggggttgtttttaggcgtgggggcgtcggggttggggttaagtcgtcgcgggaggcgttggggcgtcgggcggggaggggttagtcgttcgtttggggttgaggcgcggcggcgtcggattggtcggtttttgtgcgtttcgaggggcgggttggagcgcgtcgtcgtttttggggtaggggcgcgaggtgtggcgttcggggcggggagagcggttcgagggagtcgcgacggtagttcggtcggttttgggtttcgggcgtcgaggggcgggattcgtcgtttttaggacgttgagaaatcgttttcgagacgggggcgcgtgtttattcgggtgcggggttgcgatt

SEQ ID NO: 27128 - DNA, 939 bp, Artificial Sequence
  chemically treated genomic DNA (Homo sapiens) CpG-island No: 27128
aatcgcaaccccgcacccgaataaacacgcgcccccgtctcgaaaacgatttctcaacgtcctaaaaacgacgaatcccgcccctcgacgcccgaaacccaaaaccgaccgaactaccgtcgcgactccctcgaaccgctctccccgccccgaacgccacacctcgcgcccctaccccaaaaacgacgacgcgctccaacccgcccctcgaaacgcacaaaaaccgaccaatccgacgccgccgcgcctcaaccccaaacgaacgactaacccctccccgcccgacgccccaacgcctcccgcgacgacttaaccccaaccccgacgcccccacgcctaaaaacaaccccttcctctcccgaacgccccgcgccacaccgaacacaacctcgactccacaacctcaaaaacaccaaaaaacactcaccccgaaaactcctcccgccgctactactaccgctaaaaccgctaccgtcgcctccgccgccgccgccaccaacaccgccgtccgcaccgacgccaacacccccgaccatcctcctcccaccgccgccgccgccgccctctcctctcctatcaataactcaaactccgaaactactccaaattcccctcgccgccattttaactcctaaacgaaacaaaaaaaactcgattcgacgtaaccctaaaacgcctacgcgacgctacgaaaccgaccgaaacccccgccctcccctaccgtcgtcccgctcaaaatcacgtaacccgacgtcgccgcgcgaattaaaccgcgtaaaaaaacgatacgttcgctaaatccataaaaacgaaatacgcgcgcattatttttactcgtcgactaaaaaccgaacgtcgaatcgctaaaaatttacctcttataacaacatcctacttaatccaacgaattataacacattattaaatatatcaaaatat

SEQ ID NO: 27129 - DNA, 575 bp, Artificial Sequence
  chemically treated genomic DNA (Homo sapiens) CpG-island No: 27129
ttgacgcgatatgttttttttgcgtgggcgttgttttgttcgtcgttattatcgtcgtttggttttgttcggtttgtagttcgtttttcgtttcgtttattcggggttttcgcgttagtttttgtttgtcgcggtgagttgaggtttagttattatggtgggcgggaagcgcgtggttttggcggggcgtttcgacgggtggggagaagggaggatacggcgtgtaggtttcgcgtgggaggtttttgtggtttggtcgtcgttgggggaggtttttgtggtttggtcgtttttgggggaggtttttgggagagggtcgcggtgaggatgtcgtcgtcgggtataggggcggaaagttcgggattttgaggaacgcgcggggattgggtttttttcgttgttattttttatcggtatttggttcgggggcggggttgtggtttcgcggaggaatgatttattattttcggacgttttcggtattgcgaagatttagcgttttcgataaaatggtggaaattttgggttatatcgaagttttagagtgcgaaggttggaatcggagattttttaga

SEQ ID NO: 27130 - DNA, 575 bp, Artificial Sequence
  chemically treated genomic DNA (Homo sapiens) CpG-island No: 27130
tctaaaaaatctccgattccaaccttcgcactctaaaacttcgatataacccaaaatttccaccattttatcgaaaacgctaaatcttcgcaataccgaaaacgtccgaaaataataaatcattcctccgcgaaaccacaaccccgcccccgaaccaaataccgataaaaaataacaacgaaaaaaacccaatccccgcgcgttcctcaaaatcccgaactttccgcccctatacccgacgacgacatcctcaccgcgaccctctcccaaaaacctcccccaaaaacgaccaaaccacaaaaacctcccccaacgacgaccaaaccacaaaaacctcccacgcgaaacctacacgccgtatcctcccttctccccacccgtcgaaacgccccgccaaaaccacgcgcttcccgcccaccataataactaaacctcaactcaccgcgacaaacaaaaactaacgcgaaaaccccgaataaacgaaacgaaaaacgaactacaaaccgaacaaaaccaaacgacgataataacgacgaacaaaacaacgcccacgcaaaaaaaacatatcgcgtcaa

SEQ ID NO: 27131 - DNA, 575 bp, Artificial Sequence
  chemically treated genomic DNA (Homo sapiens) CpG-island No: 27131
tttaaggggttttcggttttaattttcgtattttggaatttcgatgtggtttaggatttttattattttatcgaaaacgttagattttcgtagtgtcgaggacgttcgaggatggtaaattattttttcgcgaaattatagtttcgttttcgagttaggtgtcggtaaagggtaataacgaaggaggtttaattttcgcgcgttttttagggtttcgggtttttcgtttttgtgttcgacgacggtatttttatcgcgatttttttttaggaattttttttaaaggcgattaagttataggaattttttttaacggcgattaagttataagagttttttacgcgaggtttgtacgtcgtgtttttttttttttttattcgtcggggcgtttcgttagggttacgcgtttttcgtttattatgatggttgggttttaatttatcgcggtagataggggttggcgcgggggtttcgagtgggcgaagcggggagcgggttgtaggtcgagtagggttaagcggcggtagtggcggcgggtaggatagcgtttacgtaggagaggtatatcgcgttag

SEQ ID NO: 27132 - DNA, 575 bp, Artificial Sequence
  chemically treated genomic DNA (Homo sapiens) CpG-island No: 27132
ctaacgcgatatacctctcctacgtaaacgctatcctacccgccgccactaccgccgcttaaccctactcgacctacaacccgctccccgcttcgcccactcgaaacccccgcgccaacccctatctaccgcgataaattaaaacccaaccatcataataaacgaaaaacgcgtaaccctaacgaaacgccccgacgaataaaaaaaaaaaaaaacacgacgtacaaacctcgcgtaaaaaactcttataacttaatcgccgttaaaaaaaattcctataacttaatcgcctttaaaaaaaattcctaaaaaaaaatcgcgataaaaataccgtcgtcgaacacaaaaacgaaaaacccgaaaccctaaaaaacgcgcgaaaattaaacctccttcgttattaccctttaccgacacctaactcgaaaacgaaactataatttcgcgaaaaaataatttaccatcctcgaacgtcctcgacactacgaaaatctaacgttttcgataaaataataaaaatcctaaaccacatcgaaattccaaaatacgaaaattaaaaccgaaaaccccttaaa

SEQ ID NO: 27133 - DNA, 673 bp, Artificial Sequence
  chemically treated genomic DNA (Homo sapiens) CpG-island No: 27133
gttttggtcgcggattttagcggataagcgatttttcgcgtttttatttttagtattttagagggttcggatatttcgtatttagtgggtattttttgtttatttcgcggttcgcggatcggatattgttttcgatttttttttttcgtaggtttttcgttttgtttttatttacgtagggcgtcggggtttttggttaatattgttttcgaggtggcggcgcgttcgcggggttcgtcgtttaggtttttagggagtcgcggtcgtattcggagtaaggcgttttttgtagagttcgtcgtcgggtgcgttttttttttatcgcgcggggatagatagtaggtagcgttaatgcgagcggagcggagcgggcgggtaggggcggggcgatcgtcggaggcgcggggcggcgcgggcgtcgggatttatttgtagtagtagtttgtttgtttgtcgcggggaagtttatcgtgtttcgttcgggcgttaatttttattgttagattatattagcgtcgaggcggggatcgtaagagagttagtcggaaggttcggggggcgggggaaggcgggggggattagggtaatgaatttcgcgttttttgagacgttaaatagtgaggttcggttttaaattatagatagtcgtattatatatttttttttttttttt

SEQ ID NO: 27134 - DNA, 673 bp, Artificial Sequence
  chemically treated genomic DNA (Homo sapiens) CpG-island No: 27134
aaaaaaaaaaaaaaaatatataatacgactatctataatttaaaaccgaacctcactatttaacgtctcaaaaaacgcgaaattcattaccctaatcccccccgccttcccccgccccccgaaccttccgactaactctcttacgatccccgcctcgacgctaatataatctaacaataaaaattaacgcccgaacgaaacacgataaacttccccgcgacaaacaaacaaactactactacaaataaatcccgacgcccgcgccgccccgcgcctccgacgatcgccccgcccctacccgcccgctccgctccgctcgcattaacgctacctactatctatccccgcgcgataaaaaaaaaacgcacccgacgacgaactctacaaaaaacgccttactccgaatacgaccgcgactccctaaaaacctaaacgacgaaccccgcgaacgcgccgccacctcgaaaacaatattaaccaaaaaccccgacgccctacgtaaataaaaacaaaacgaaaaacctacgaaaaaaaaaaatcgaaaacaatatccgatccgcgaaccgcgaaataaacaaaaaatacccactaaatacgaaatatccgaaccctctaaaatactaaaaataaaaacgcgaaaaatcgcttatccgctaaaatccgcgaccaaaac

SEQ ID NO: 27135 - DNA, 673 bp, Artificial Sequence
  chemically treated genomic DNA (Homo sapiens) CpG-island No: 27135
gggggaggagaggagatgtgtaatgcgattgtttataatttgaaatcggattttattatttagcgttttagaaaacgcggggtttattgttttggtttttttcgttttttttcgtttttcgaatttttcggttggtttttttgcggttttcgtttcggcgttgatgtggtttggtagtggagattggcgttcgggcggagtacgatgggttttttcgcggtaggtaggtaggttgttgttgtaggtgggtttcggcgttcgcgtcgtttcgcgttttcggcggtcgtttcgtttttgttcgttcgtttcgtttcgttcgtattggcgttgtttgttgtttgttttcgcgcggtggggagggggcgtattcggcggcgggttttgtagagggcgttttgtttcgggtgcgatcgcggttttttggaggtttgggcggcgggtttcgcgagcgcgtcgttatttcgggagtagtgttggttaaggatttcgacgttttacgtaagtaaaggtagggcggggagtttgcgggggaggagggtcgggggtaatgttcggttcgcggatcgcggagtgggtaagaggtgtttattggatacggggtattcgagttttttgaggtgttgggagtaagaacgcgggaggtcgtttgttcgttggaattcgcggttagggt

SEQ ID NO: 27136 - DNA, 673 bp, Artificial Sequence
  chemically treated genomic DNA (Homo sapiens) CpG-island No: 27136
accctaaccgcgaattccaacgaacaaacgacctcccgcgttcttactcccaacacctcaaaaaactcgaataccccgtatccaataaacacctcttacccactccgcgatccgcgaaccgaacattacccccgaccctcctcccccgcaaactccccgccctacctttacttacgtaaaacgtcgaaatccttaaccaacactactcccgaaataacgacgcgctcgcgaaacccgccgcccaaacctccaaaaaaccgcgatcgcacccgaaacaaaacgccctctacaaaacccgccgccgaatacgccccctccccaccgcgcgaaaacaaacaacaaacaacgccaatacgaacgaaacgaaacgaacgaacaaaaacgaaacgaccgccgaaaacgcgaaacgacgcgaacgccgaaacccacctacaacaacaacctacctacctaccgcgaaaaaacccatcgtactccgcccgaacgccaatctccactaccaaaccacatcaacgccgaaacgaaaaccgcaaaaaaaccaaccgaaaaattcgaaaaacgaaaaaaaacgaaaaaaaccaaaacaataaaccccgcgttttctaaaacgctaaataataaaatccgatttcaaattataaacaatcgcattacacatctcctctcctccccc

SEQ ID NO: 27137 - DNA, 521 bp, Artificial Sequence
  chemically treated genomic DNA (Homo sapiens) CpG-island No: 27137
ggcgtatgcgtagttcggaaggattcgagttttttaattaatcgagagttaataggtcggggattgcgggacggaagagggaggggaagatgaagaaaatcggtgatgaatggttggcggaaatgattggcggaaagaaagagttagtttatagtgcgtttttgtattcggcgggaaattcggtcgaagagggagttggaaaggatttcggaattcggtcgtaattttagttaattagggagtagagttgcggggcggggttggggcggggtagtttcgcgggagatagtttcgcgggttcgggaggcgagttttcggttttcgtttagtttttggggacgcggtggcggggtttgaatcgtttggtttttagggagttttgggcgggttttcgtacgggagcgtggtaggcgttggattcgatagtagatgtggaattggagagtttggcgcgtttttatattttgttatatatttacgttattagattggggtcgggttttttcgcgttttgttttgga

SEQ ID NO: 27138 - DNA, 521 bp, Artificial Sequence
  chemically treated genomic DNA (Homo sapiens) CpG-island No: 27138
tccaaaacaaaacgcgaaaaaacccgaccccaatctaataacgtaaatatataacaaaatataaaaacgcgccaaactctccaattccacatctactatcgaatccaacgcctaccacgctcccgtacgaaaacccgcccaaaactccctaaaaaccaaacgattcaaaccccgccaccgcgtccccaaaaactaaacgaaaaccgaaaactcgcctcccgaacccgcgaaactatctcccgcgaaactaccccgccccaaccccgccccgcaactctactccctaattaactaaaattacgaccgaattccgaaatcctttccaactccctcttcgaccgaatttcccgccgaatacaaaaacgcactataaactaactctttctttccgccaatcatttccgccaaccattcatcaccgattttcttcatcttcccctccctcttccgtcccgcaatccccgacctattaactctcgattaattaaaaaactcgaatccttccgaactacgcatacgcc

SEQ ID NO: 27139 - DNA, 521 bp, Artificial Sequence
  chemically treated genomic DNA (Homo sapiens) CpG-island No: 27139
tttagagtagaacgcggaggggttcgattttagtttggtggcgtaggtgtgtgataaagtatgagggcgcgttaagttttttagttttatatttgttgtcgagtttagcgtttgttacgttttcgtgcggggattcgtttaaaattttttggaagttaggcgatttagatttcgttatcgcgtttttagagattgggcggaaatcggagattcgtttttcgaattcgcgaaattatttttcgcgagattgtttcgttttaatttcgtttcgtaattttattttttgattggttggaattacggtcggatttcggagttttttttagtttttttttcggtcgggtttttcgtcgaatataaaggcgtattgtgaattggtttttttttttcgttaattattttcgttagttatttattatcgattttttttatttttttttttttttttcgtttcgtagttttcgatttgttagttttcggttagttaagggattcgggttttttcgaattgcgtatgcgtt

SEQ ID NO: 27140 - DNA, 521 bp, Artificial Sequence
  chemically treated genomic DNA (Homo sapiens) CpG-island No: 27140
aacgcatacgcaattcgaaaaaacccgaatcccttaactaaccgaaaactaacaaatcgaaaactacgaaacgaaaaaaaaaaaaaaaaataaaaaaaatcgataataaataactaacgaaaataattaacgaaaaaaaaaaaccaattcacaatacgcctttatattcgacgaaaaacccgaccgaaaaaaaaactaaaaaaaactccgaaatccgaccgtaattccaaccaatcaaaaaataaaattacgaaacgaaattaaaacgaaacaatctcgcgaaaaataatttcgcgaattcgaaaaacgaatctccgatttccgcccaatctctaaaaacgcgataacgaaatctaaatcgcctaacttccaaaaaattttaaacgaatccccgcacgaaaacgtaacaaacgctaaactcgacaacaaatataaaactaaaaaacttaacgcgccctcatactttatcacacacctacgccaccaaactaaaatcgaacccctccgcgttctactctaaa

SEQ ID NO: 27141 - DNA, 821 bp, Artificial Sequence
  chemically treated genomic DNA (Homo sapiens) CpG-island No: 27141
agtcgaattcggtgtttttgttcgtttggggtttcgttagcgcgtcgtaagtttttttagaaatttaaattttgtaggtcgtatttttaattcgtattttatttaggttttcgtttggcgtcgatttgttttagtttaattttcggtttcgtagattaggtatttttcgggacgcggggtagattttgcgttcgggttttttttcgtagtcgggttgttcggtttttgcgcgcgtataataggcggtacggcgtagttttcgggagcgcgggattcgggtgttagtttcggcgtttagttatagcgatatagatttgggtgtcggggttcgttagggagttttgtgattcggggattttcgcgatgtagagaattagggatcgcgtacggagtttaggcgcgtagtttgtagttaggattagtttttcgttttcgtcgttgaagtcgtttcgagttttacgtttttttcgttgtcgggttcggttgttttagggtttcgttcgttcgttttagagtgagcgattttcgatttacggagaagcgattttattatcggtgttcgatatttagagttaagggagcgagaagaaggcgaagaaagaggcggagagcggtgtattgttttcgttgggattcgcgatttttagaaattttttcgaaatttagtttcgtcgtcgtttcgtcggtagggggtatagcgggcgttcggggcgcggcggttgagcgatggggcgagcggaaagggtttagacgtttggtttttgtttatatttcggagaaagttttgagtattaggcgttgggttttttggttattttttt

SEQ ID NO: 27142 - DNA, 821 bp, Artificial Sequence
  chemically treated genomic DNA (Homo sapiens) CpG-island No: 27142
aaaaaaataaccaaaaaacccaacgcctaatactcaaaactttctccgaaatataaacaaaaaccaaacgtctaaaccctttccgctcgccccatcgctcaaccgccgcgccccgaacgcccgctataccccctaccgacgaaacgacgacgaaactaaatttcgaaaaaatttctaaaaatcgcgaatcccaacgaaaacaatacaccgctctccgcctctttcttcgccttcttctcgctcccttaactctaaatatcgaacaccgataataaaatcgcttctccgtaaatcgaaaatcgctcactctaaaacgaacgaacgaaaccctaaaacaaccgaacccgacaacgaaaaaaacgtaaaactcgaaacgacttcaacgacgaaaacgaaaaactaatcctaactacaaactacgcgcctaaactccgtacgcgatccctaattctctacatcgcgaaaatccccgaatcacaaaactccctaacgaaccccgacacccaaatctatatcgctataactaaacgccgaaactaacacccgaatcccgcgctcccgaaaactacgccgtaccgcctattatacgcgcgcaaaaaccgaacaacccgactacgaaaaaaaacccgaacgcaaaatctaccccgcgtcccgaaaaatacctaatctacgaaaccgaaaattaaactaaaacaaatcgacgccaaacgaaaacctaaataaaatacgaattaaaaatacgacctacaaaatttaaatttctaaaaaaacttacgacgcgctaacgaaaccccaaacgaacaaaaacaccgaattcgact

SEQ ID NO: 27143 - DNA, 821 bp, Artificial Sequence
  chemically treated genomic DNA (Homo sapiens) CpG-island No: 27143
agaggggtgattagagagtttaacgtttggtgtttaagatttttttcgaggtatgaataagaattaggcgtttgggtttttttcgttcgttttatcgtttagtcgtcgcgtttcggacgttcgttgtgttttttgtcggcggggcggcggcgggattgggtttcgggagggtttttggaagtcgcgagttttagcgaaggtagtgtatcgtttttcgttttttttttcgtttttttttcgtttttttagttttgggtgtcgggtatcggtggtaaggtcgttttttcgtgagtcggaggtcgtttattttgggacgggcggacgaggttttagggtagtcgagttcggtagcgggggaggcgtggagttcggggcggttttagcggcgggggcgggaggttggttttggttgtagattgcgcgtttgggtttcgtgcgcggtttttggttttttgtatcgcggaggttttcggattatagggttttttggcgggtttcggtatttaggtttgtgtcgttgtggttgggcgtcgggattagtattcgagtttcgcgttttcgggggttgcgtcgtgtcgtttgttgtgcgcgcgtagaggtcggatagttcggttgcgggaagggattcgagcgtagggtttgtttcgcgtttcggaaagtgtttagtttgcggagtcggaggttgagttggggtagatcggcgttagacgggggtttgggtgagatacgagttgggggtgcggtttgtagaatttgggtttttggaggagtttacggcgcgttggcggagttttaggcgaataggagtatcggattcggtt

SEQ ID NO: 27144 - DNA, 821 bp, Artificial Sequence
  chemically treated genomic DNA (Homo sapiens) CpG-island No: 27144
aaccgaatccgatactcctattcgcctaaaactccgccaacgcgccgtaaactcctccaaaaacccaaattctacaaaccgcacccccaactcgtatctcacccaaacccccgtctaacgccgatctaccccaactcaacctccgactccgcaaactaaacactttccgaaacgcgaaacaaaccctacgctcgaatcccttcccgcaaccgaactatccgacctctacgcgcgcacaacaaacgacacgacgcaacccccgaaaacgcgaaactcgaatactaatcccgacgcccaaccacaacgacacaaacctaaataccgaaacccgccaaaaaaccctataatccgaaaacctccgcgatacaaaaaaccaaaaaccgcgcacgaaacccaaacgcgcaatctacaaccaaaaccaacctcccgcccccgccgctaaaaccgccccgaactccacgcctcccccgctaccgaactcgactaccctaaaacctcgtccgcccgtcccaaaataaacgacctccgactcacgaaaaaacgaccttaccaccgatacccgacacccaaaactaaaaaaacgaaaaaaaaacgaaaaaaaaaacgaaaaacgatacactaccttcgctaaaactcgcgacttccaaaaaccctcccgaaacccaatcccgccgccgccccgccgacaaaaaacacaacgaacgtccgaaacgcgacgactaaacgataaaacgaacgaaaaaaacccaaacgcctaattcttattcatacctcgaaaaaaatcttaaacaccaaacgttaaactctctaatcacccctct

SEQ ID NO: 27145 - DNA, 674 bp, Artificial Sequence
  chemically treated genomic DNA (Homo sapiens) CpG-island No: 27145
tcgcgttcgtttcgttttttatttacgtttttcgattcgattcgttttttcgaattttcgttttttgagatttcgttttcgattcgttttaattggtcgcggcggtagtcgagtcgcgggagttgcgcgttgagttcgcggtagtacggggagcgttcgttcgtttcgttttggatttaattaagcgtttcgcggaggggtgcggttatttgggggtaggagaaagcggagtacgttatttttttagggatttaggaagcgaggcgagttttaggtggacgcggtggtgtggattacggcgattagggtttttttttttgttgtggagacggaggtgcgaggggacgtcggcggttttttattttttggtcgagtggtttttttcgttttcggttggattttttcggggcgttttttttagagtcgagtcgggttggtcgggggcggttgtttggtttgagtgtcgttttattaaagcggaacgtcggaggggaggttatttcgagagaaggcggttttcggcggaggtggtttcgtgaattttgtagttttttgttcgttcgttattcgagacgtcgcgtttcgtgggttttacgttggatggagggggcgtcgtcgaggatgtttagtttttttttttaattttatttttttagttttttaggtagatatag

SEQ ID NO: 27146 - DNA, 674 bp, Artificial Sequence
  chemically treated genomic DNA (Homo sapiens) CpG-island No: 27146
ctatatctacctaaaaaactaaaaaaataaaattaaaaaaaaaaactaaacatcctcgacgacgccccctccatccaacgtaaaacccacgaaacgcgacgtctcgaataacgaacgaacaaaaaactacaaaattcacgaaaccacctccgccgaaaaccgccttctctcgaaataacctcccctccgacgttccgctttaataaaacgacactcaaaccaaacaaccgcccccgaccaacccgactcgactctaaaaaaaacgccccgaaaaaatccaaccgaaaacgaaaaaaaccactcgaccaaaaaataaaaaaccgccgacgtcccctcgcacctccgtctccacaacaaaaaaaaaaaccctaatcgccgtaatccacaccaccgcgtccacctaaaactcgcctcgcttcctaaatccctaaaaaaataacgtactccgctttctcctacccccaaataaccgcacccctccgcgaaacgcttaattaaatccaaaacgaaacgaacgaacgctccccgtactaccgcgaactcaacgcgcaactcccgcgactcgactaccgccgcgaccaattaaaacgaatcgaaaacgaaatctcaaaaaacgaaaattcgaaaaaacgaatcgaatcgaaaaacgtaaataaaaaacgaaacgaacgcga

SEQ ID NO: 27147 - DNA, 674 bp, Artificial Sequence
  chemically treated genomic DNA (Homo sapiens) CpG-island No: 27147
ttgtgtttatttgaggaattggagaggtagaattagagggggaggttgggtattttcggcggcgttttttttatttagcgtgaaatttacgaggcgcggcgtttcgagtggcgggcgggtagggggttgtaggatttacgaagttattttcgtcggggatcgttttttttcggagtggtttttttttcggcgtttcgttttagtaagacgatatttaggttaaatagtcgttttcggttagttcgattcggttttggagggagcgtttcgagggagtttagtcggaggcggagaaggttattcggttagaaggtggggagtcgtcggcgttttttcgtattttcgtttttatagtagggggaaaggttttgatcgtcgtggtttatattatcgcgtttatttgaggttcgtttcgttttttgggtttttagaggggtggcgtatttcgtttttttttgtttttaagtggtcgtattttttcgcgggacgtttggttgggtttagggcggggcgggcgggcgtttttcgtattgtcgcgagtttagcgcgtagttttcgcggttcggttgtcgtcgcggttagttggggcgggtcgggggcggggttttagggggcggggattcgggggggcgggtcgggtcgggaggcgtgggtggggggcggggcggacgcgg

SEQ ID NO: 27148 - DNA, 674 bp, Artificial Sequence
  chemically treated genomic DNA (Homo sapiens) CpG-island No: 27148
ccgcgtccgccccgccccccacccacgcctcccgacccgacccgcccccccgaatccccgccccctaaaaccccgcccccgacccgccccaactaaccgcgacgacaaccgaaccgcgaaaactacgcgctaaactcgcgacaatacgaaaaacgcccgcccgccccgccctaaacccaaccaaacgtcccgcgaaaaaatacgaccacttaaaaacaaaaaaaaacgaaatacgccacccctctaaaaacccaaaaaacgaaacgaacctcaaataaacgcgataatataaaccacgacgatcaaaacctttccccctactataaaaacgaaaatacgaaaaaacgccgacgactccccaccttctaaccgaataaccttctccgcctccgactaaactccctcgaaacgctccctccaaaaccgaatcgaactaaccgaaaacgactatttaacctaaatatcgtcttactaaaacgaaacgccgaaaaaaaaaccactccgaaaaaaaacgatccccgacgaaaataacttcgtaaatcctacaaccccctacccgcccgccactcgaaacgccgcgcctcgtaaatttcacgctaaataaaaaaaacgccgccgaaaatacccaacctccccctctaattctacctctccaattcctcaaataaacacaa

SEQ ID NO: 27149 - DNA, 841 bp, Artificial Sequence
  chemically treated genomic DNA (Homo sapiens) CpG-island No: 27149
taggcgttcgtggcggggtcgatttcgggttgcgggaggtagaggggtcggaggggatagcgggtcgggtcggcgagcgggcgagtaaggagttaagtcgggcggtagggcgagcgtttgttagacgcgagtatgtgtagtttgtagcgtattcgtattatgggtgagtgtcgtcgtcgtcgtcgtcgtcgtcgtcgtcgggggttttttttttttcgggtagcggcggttgtagtttttcggatttcgcgtcgtcgcggcggacgtcgatatataatgcgggattaggcgcggcgcgggagtgttaggcggcgtgggggaggtacggttcgtaattcggcgcggggggagttagagcgtcgggtttgggggcggggagtaggcggtgtaggagagcgtttcgagtttcggcgcgggaggaggagcgggagttagttttggagacggcgtttttagtcgtatttgcgtttggtaggcggtcggttttgtttagtttttatttacggtttcggtttcgtatcggtaggtgttttttatgttcgtagagaggttttttcgtcgtttagagaggtggtcgcgaggggtcggtagtttcgatcgcggagggcgcgggcgatggggacggtgaggggaagattgggcgatcggatttggggttgtagtagatttcgttttttttttgttttcggtttcgaggttgttgtttcggttcgagatttagtcgtagattagataggtggtgcgttcggggtttggattttttgcgggggatgggcgtataggggggcgtgttggggaagggggtgcgcgttggtaattttttttgtttgaaataaagggg

SEQ ID NO: 27150 - DNA, 841 bp, Artificial Sequence
  chemically treated genomic DNA (Homo sapiens) CpG-island No: 27150
cccctttatttcaaacaaaaaaaattaccaacgcgcacccccttccccaacacgcccccctatacgcccatcccccgcaaaaaatccaaaccccgaacgcaccacctatctaatctacgactaaatctcgaaccgaaacaacaacctcgaaaccgaaaacaaaaaaaaaacgaaatctactacaaccccaaatccgatcgcccaatcttcccctcaccgtccccatcgcccgcgccctccgcgatcgaaactaccgacccctcgcgaccacctctctaaacgacgaaaaaacctctctacgaacataaaaaacacctaccgatacgaaaccgaaaccgtaaataaaaactaaacaaaaccgaccgcctaccaaacgcaaatacgactaaaaacgccgtctccaaaactaactcccgctcctcctcccgcgccgaaactcgaaacgctctcctacaccgcctactccccgcccccaaacccgacgctctaactccccccgcgccgaattacgaaccgtacctcccccacgccgcctaacactcccgcgccgcgcctaatcccgcattatatatcgacgtccgccgcgacgacgcgaaatccgaaaaactacaaccgccgctacccgaaaaaaaaaaaacccccgacgacgacgacgacgacgacgacgacgacactcacccataatacgaatacgctacaaactacacatactcgcgtctaacaaacgctcgccctaccgcccgacttaactccttactcgcccgctcgccgacccgacccgctatcccctccgacccctctacctcccgcaacccgaaatcgaccccgccacgaacgccta

SEQ ID NO: 27151 - DNA, 841 bp, Artificial Sequence
  chemically treated genomic DNA (Homo sapiens) CpG-island No: 27151
tttttttgttttaggtagggaaagttgttaacgcgtatttttttttttaatacgtttttttgtgcgtttatttttcgtagggaatttaagtttcgggcgtattatttatttaatttgcggttggatttcgaatcggggtagtagtttcgaaatcgaaagtaaagaggaagcgggatttgttatagttttaagttcggtcgtttagttttttttttatcgtttttatcgttcgcgtttttcgcggtcggagttgtcggtttttcgcggttatttttttgggcggcggaaaggtttttttgcgggtatagggggtatttatcggtgcggggtcggggtcgtgggtaggggttgggtagagtcggtcgtttgttaggcgtaggtgcggttaggagcgtcgtttttagggttggttttcgttttttttttcgcgtcgggattcggggcgtttttttgtatcgtttgtttttcgtttttaagttcggcgttttggtttttttcgcgtcgagttgcgggtcgtgttttttttacgtcgtttggtattttcgcgtcgcgtttagtttcgtattgtgtgtcggcgttcgtcgcggcggcgcggggttcggggggttgtagtcgtcgttgttcgggaggaaaggagttttcggcggcggcggcggcggcggcggcggcggtatttatttatagtacggatgcgttgtaaattgtatatgttcgcgtttgataggcgttcgttttgtcgttcggtttaattttttgttcgttcgttcgtcggttcggttcgttgtttttttcgatttttttgtttttcgtagttcggggtcggtttcgttacgggcgttta

SEQ ID NO: 27152 - DNA, 841 bp, Artificial Sequence
  chemically treated genomic DNA (Homo sapiens) CpG-island No: 27152
taaacgcccgtaacgaaaccgaccccgaactacgaaaaacaaaaaaatcgaaaaaaacaacgaaccgaaccgacgaacgaacgaacaaaaaattaaaccgaacgacaaaacgaacgcctatcaaacgcgaacatatacaatttacaacgcatccgtactataaataaataccgccgccgccgccgccgccgccgccgccgaaaactcctttcctcccgaacaacgacgactacaaccccccgaaccccgcgccgccgcgacgaacgccgacacacaatacgaaactaaacgcgacgcgaaaataccaaacgacgtaaaaaaaacacgacccgcaactcgacgcgaaaaaaaccaaaacgccgaacttaaaaacgaaaaacaaacgatacaaaaaaacgccccgaatcccgacgcgaaaaaaaaaacgaaaaccaaccctaaaaacgacgctcctaaccgcacctacgcctaacaaacgaccgactctacccaacccctacccacgaccccgaccccgcaccgataaataccccctatacccgcaaaaaaacctttccgccgcccaaaaaaataaccgcgaaaaaccgacaactccgaccgcgaaaaacgcgaacgataaaaacgataaaaaaaaaactaaacgaccgaacttaaaactataacaaatcccgcttcctctttactttcgatttcgaaactactaccccgattcgaaatccaaccgcaaattaaataaataatacgcccgaaacttaaattccctacgaaaaataaacgcacaaaaaaacgtattaaaaaaaaaaatacgcgttaacaactttccctacctaaaacaaaaaaa

SEQ ID NO: 27153 - DNA, 545 bp, Artificial Sequence
  chemically treated genomic DNA (Homo sapiens) CpG-island No: 27153
tcgcggcgcgagttttttggggcgttcggttttttaagttagattcgcgttttagcgtttttcgtcgttgggagttcgtttttaggtagggaggtatttgtttcggatcgttttttgggttcgaggggtcgtttttcgcgcgtagtttgacgtttttcgtcgcggcgtagttttagtttattatagcggcgggagcgcgggtcgtttatttttagcgagttcgcggtcgttttcgtcgcgtattgggtatacgggcgttttcgggtcgtcgtcgtagtcgattttgcgtcgttttcgtcggagtttcgggttgtcgtcggttttttttttttcggtagtaggggtcgtgggttgcggggcggggcgaggttggagcgggaggggtgttcgcgggttcgttgtataaagttcggtcgagttttgttgcgttttatttaacgtttcgtcgggcgttttttttttttcggtttttcgttcgttttttaaaggtagagcgttgggtttagttttttaggtagttcgcggagaggtataggaaatgattt

SEQ ID NO: 27154 - DNA, 545 bp, Artificial Sequence
  chemically treated genomic DNA (Homo sapiens) CpG-island No: 27154
aaatcatttcctatacctctccgcgaactacctaaaaaactaaacccaacgctctacctttaaaaaacgaacgaaaaaccgaaaaaaaaaaaacgcccgacgaaacgttaaataaaacgcaacaaaactcgaccgaactttatacaacgaacccgcgaacacccctcccgctccaacctcgccccgccccgcaacccacgacccctactaccgaaaaaaaaaaaaccgacgacaacccgaaactccgacgaaaacgacgcaaaatcgactacgacgacgacccgaaaacgcccgtatacccaatacgcgacgaaaacgaccgcgaactcgctaaaaataaacgacccgcgctcccgccgctataataaactaaaactacgccgcgacgaaaaacgtcaaactacgcgcgaaaaacgacccctcgaacccaaaaaacgatccgaaacaaatacctccctacctaaaaacgaactcccaacgacgaaaaacgctaaaacgcgaatctaacttaaaaaaccgaacgccccaaaaaactcgcgccgcga

SEQ ID NO: 27155 - DNA, 545 bp, Artificial Sequence
  chemically treated genomic DNA (Homo sapiens) CpG-island No: 27155
aggttattttttgtgttttttcgcgagttgtttggagagttgagtttagcgttttgtttttaaggagcgggcggggagtcgaggggaggagggcgttcggcggagcgttgaatggggcgtagtaaggttcggtcgggttttgtgtagcgagttcgcgggtatttttttcgttttagtttcgtttcgtttcgtagtttacgatttttgttgtcggggaggggagaatcggcggtagttcgggatttcggcgagagcgacgtaaggtcggttgcggcggcggttcgagggcgttcgtgtgtttagtgcgcggcggggacggtcgcgagttcgttggaggtgagcgattcgcgttttcgtcgttgtggtgggttggggttgcgtcgcggcggagggcgttaggttgcgcgcgggggacggtttttcgggtttagaggacgattcggagtaggtgtttttttatttggaagcgagtttttagcggcggggagcgttggagcgcgggtttggtttgggaagtcgggcgttttaggggattcgcgtcgcga

SEQ ID NO: 27156 - DNA, 545 bp, Artificial Sequence
  chemically treated genomic DNA (Homo sapiens) CpG-island No: 27156
tcgcgacgcgaatcccctaaaacgcccgacttcccaaaccaaacccgcgctccaacgctccccgccgctaaaaactcgcttccaaataaaaaaacacctactccgaatcgtcctctaaacccgaaaaaccgtcccccgcgcgcaacctaacgccctccgccgcgacgcaaccccaacccaccacaacgacgaaaacgcgaatcgctcacctccaacgaactcgcgaccgtccccgccgcgcactaaacacacgaacgccctcgaaccgccgccgcaaccgaccttacgtcgctctcgccgaaatcccgaactaccgccgattctcccctccccgacaacaaaaatcgtaaactacgaaacgaaacgaaactaaaacgaaaaaaatacccgcgaactcgctacacaaaacccgaccgaaccttactacgccccattcaacgctccgccgaacgccctcctcccctcgactccccgcccgctccttaaaaacaaaacgctaaactcaactctccaaacaactcgcgaaaaaacacaaaaaataacct

SEQ ID NO: 27157 - DNA, 634 bp, Artificial Sequence
  chemically treated genomic DNA (Homo sapiens) CpG-island No: 27157
gcgggttcgcggatcgttttttgcgtttagcggttttgggggaaatttttttgggcggtcgtacgtttttttagacgttaagttcggttcgggtcgtaggggttatttcgggcgtcggttgtgcgttcggattttagggttcgcgttttcgtttcggggtggggtaagggcggtgcggaaagcgttagtgtttaggaaggttttaggcgtcgtagttcggaggggtcgtatagcgttagtggttgttttgcgtttcgcgcgcgttagtagttttgtttgttttagttcggtgggtggagtgagttgcgtattcgttcgggagcgcgtttttatagttcggatcggatcgagtggagacgcgagtgggatttttattgttacgtttttttgtatttttttttatttatcgttcgattgatacgatcgttgttttattttcgggagagagtattattagcgtatagtttagaagttgggtacgtgtttagttcggagttgttgcgcgaggggtggacgaggagatcgggagacgaaggcgcggggaagggtatcggtatgagatgagggggaatgataggtgggttagtgagttttagttgcgttttttagtagggggatagatgtagagttcgcg

SEQ ID NO: 27158 - DNA, 634 bp, Artificial Sequence
  chemically treated genomic DNA (Homo sapiens) CpG-island No: 27158
cgcgaactctacatctatccccctactaaaaaacgcaactaaaactcactaacccacctatcattccccctcatctcataccgatacccttccccgcgccttcgtctcccgatctcctcgtccacccctcgcgcaacaactccgaactaaacacgtacccaacttctaaactatacgctaataatactctctcccgaaaataaaacaacgatcgtatcaatcgaacgataaataaaaaaaaatacaaaaaaacgtaacaataaaaatcccactcgcgtctccactcgatccgatccgaactataaaaacgcgctcccgaacgaatacgcaactcactccacccaccgaactaaaacaaacaaaactactaacgcgcgcgaaacgcaaaacaaccactaacgctatacgacccctccgaactacgacgcctaaaaccttcctaaacactaacgctttccgcaccgcccttaccccaccccgaaacgaaaacgcgaaccctaaaatccgaacgcacaaccgacgcccgaaataacccctacgacccgaaccgaacttaacgtctaaaaaaacgtacgaccgcccaaaaaaatttcccccaaaaccgctaaacgcaaaaaacgatccgcgaacccgc

SEQ ID NO: 27159 - DNA, 634 bp, Artificial Sequence
  chemically treated genomic DNA (Homo sapiens) CpG-island No: 27159
cgcgggttttgtatttgtttttttgttggggagcgtaattggaatttattaatttatttgttatttttttttattttatatcgatattttttttcgcgttttcgtttttcggttttttcgtttatttttcgcgtagtagtttcgggttgaatacgtatttaatttttgggttgtgcgttggtggtgttttttttcggagatgaggtagcgatcgtgttaatcgggcggtggatggagagaggtgtaaaagagcgtggtagtggaggttttattcgcgtttttattcggttcgattcgggttgtggggacgcgttttcgggcgagtgcgtagtttattttatttatcgagttgaagtaggtaggattgttggcgcgcgcgggacgtagagtagttattgacgttgtacggttttttcgggttgcggcgtttgaaatttttttgaatattggcgtttttcgtatcgtttttattttatttcggagcgggagcgcgagttttgaagttcgagcgtatagtcggcgttcggaatggtttttgcgattcgggtcgggtttggcgtttgggggagcgtgcggtcgtttaggggagttttttttaggatcgttgagcgtaggaggcgattcgcgagttcgt

SEQ ID NO: 27160 - DNA, 634 bp, Artificial Sequence
  chemically treated genomic DNA (Homo sapiens) CpG-island No: 27160
acgaactcgcgaatcgcctcctacgctcaacgatcctaaaaaaaactcccctaaacgaccgcacgctcccccaaacgccaaacccgacccgaatcgcaaaaaccattccgaacgccgactatacgctcgaacttcaaaactcgcgctcccgctccgaaataaaataaaaacgatacgaaaaacgccaatattcaaaaaaatttcaaacgccgcaacccgaaaaaaccgtacaacgtcaataactactctacgtcccgcgcgcgccaacaatcctacctacttcaactcgataaataaaataaactacgcactcgcccgaaaacgcgtccccacaacccgaatcgaaccgaataaaaacgcgaataaaacctccactaccacgctcttttacacctctctccatccaccgcccgattaacacgatcgctacctcatctccgaaaaaaaacaccaccaacgcacaacccaaaaattaaatacgtattcaacccgaaactactacgcgaaaaataaacgaaaaaaccgaaaaacgaaaacgcgaaaaaaaatatcgatataaaataaaaaaaaataacaaataaattaataaattccaattacgctccccaacaaaaaaacaaatacaaaacccgcg

SEQ ID NO: 27161 - DNA, 550 bp, Artificial Sequence
  chemically treated genomic DNA (Homo sapiens) CpG-island No: 27161
cgtttcgggagtcgcgttcgcgttagtagttcggattcgggattcgagcgggagacgtcgagatgtgagttttcgattggttattgttttttttggtattttttttttttattttatcggttcgattggatagcgatcgtttgtttcgattttcggggagaggagtaattattaggcgtatagtttagaagttgggttacgttgtttagttcggagttcgttgcgcgagggggtggacgaggagatcgggagacgaaggcgcggggaaggggtttcggtttgagttgagggggattgggagggtgggggtttgagggttcgcgggcgcgttttagtagggggagagatgtagagttcgcgtttaggcgtcggtcgtcgcggtagtagttttagtagtagttttagtattagtatcggcggatattatagtggggcgcgagcggattggtttcgcgatttgatttttatttttttcgtacgtatagtttgcgaggcggcggggacgtatataatattgttgtttttttatattttatcggtggttgaaaag

SEQ ID NO: 27162 - DNA, 550 bp, Artificial Sequence
  chemically treated genomic DNA (Homo sapiens) CpG-island No: 27162
cttttcaaccaccgataaaatataaaaaaacaacaatattatatacgtccccgccgcctcgcaaactatacgtacgaaaaaaataaaaatcaaatcgcgaaaccaatccgctcgcgccccactataatatccgccgatactaatactaaaactactactaaaactactaccgcgacgaccgacgcctaaacgcgaactctacatctctccccctactaaaacgcgcccgcgaaccctcaaacccccaccctcccaatccccctcaactcaaaccgaaaccccttccccgcgccttcgtctcccgatctcctcgtccaccccctcgcgcaacgaactccgaactaaacaacgtaacccaacttctaaactatacgcctaataattactcctctccccgaaaatcgaaacaaacgatcgctatccaatcgaaccgataaaataaaaaaaaaaaataccaaaaaaaacaataaccaatcgaaaactcacatctcgacgtctcccgctcgaatcccgaatccgaactactaacgcgaacgcgactcccgaaacg

SEQ ID NO: 27163 - DNA, 550 bp, Artificial Sequence
  chemically treated genomic DNA (Homo sapiens) CpG-island No: 27163
ttttttagttatcgatgaaatatggagagatagtagtattgtgtacgttttcgtcgtttcgtaagttgtgcgtgcgaaagggatgggaattaagtcgcgggattagttcgttcgcgttttattgtggtgttcgtcggtgttgatgttgaggttgttgttgaggttgttatcgcggcggtcggcgtttgggcgcgggttttgtatttttttttttgttggggcgcgttcgcgggtttttaagtttttatttttttaattttttttagtttagatcgagatttttttttcgcgttttcgtttttcggttttttcgtttattttttcgcgtagcgagtttcgggttgaatagcgtagtttaatttttgggttgtgcgtttggtggttgttttttttttcggagatcgaggtaagcgatcgttgtttaatcgggtcggtggaatgggagaagagggtgttagagagagtagtggttagtcggaggtttatatttcggcgtttttcgttcgggtttcgaattcgggttgttggcgcggacgcggttttcggggcg

SEQ ID NO: 27164 - DNA, 550 bp, Artificial Sequence
  chemically treated genomic DNA (Homo sapiens) CpG-island No: 27164
cgccccgaaaaccgcgtccgcgccaacaacccgaattcgaaacccgaacgaaaaacgccgaaatataaacctccgactaaccactactctctctaacaccctcttctcccattccaccgacccgattaaacaacgatcgcttacctcgatctccgaaaaaaaaaacaaccaccaaacgcacaacccaaaaattaaactacgctattcaacccgaaactcgctacgcgaaaaaataaacgaaaaaaccgaaaaacgaaaacgcgaaaaaaaaatctcgatctaaactaaaaaaaattaaaaaaataaaaacttaaaaacccgcgaacgcgccccaacaaaaaaaaaaatacaaaacccgcgcccaaacgccgaccgccgcgataacaacctcaacaacaacctcaacatcaacaccgacgaacaccacaataaaacgcgaacgaactaatcccgcgacttaattcccatccctttcgcacgcacaacttacgaaacgacgaaaacgtacacaatactactatctctccatatttcatcgataactaaaaaa

SEQ ID NO: 27165 - DNA, 745 bp, Artificial Sequence
  chemically treated genomic DNA (Homo sapiens) CpG-island No: 27165
aaggatcgcgtaagggttaatgatgaaagttggcgattaggtggggcgtttatattcgttttcggttacggtgggcgtcggaggtgagggggcgttattcgggtagtagtgtttcgggtggcgcgcgggagagttgttaggttgacggagaggtcggttcgagtgggggtcgtttcgtcgtcgtcgtcgtcgtcgtcgttgtgatgcggagtcggtgttgcgtcgggcggtggagttagagttcgggcgcgggagtaggagttgtaagattagtattagcggtttcggtatttgtattagttttcgggtttcgcgttgcgtttttcgtttcgtcgtattcggggtcgtcgtttcgcgttttttatggatgttaaggcggtttttaacggggtggttattatcgaggatcggattttgcggattatcggttattatggttattatttaggttattttagttagaaaagtaagacgtcgcgcggttgttttgcgcgaggcggggaagggaggtgggcgcgtaggggtgtcgcggggatgcggacgggcgggcgcgcggtacggatatttgtagttttgcggacgttgttaatatcgtttttttggcggcggggatttttcggggagaaaagtatgttcgttgttttcggtgttgaatcgtgagagggtaaggggttcggttgggtgcgtttaggagtttggaaatagtcgtagttttggggggaggtgcggaggggatttggtgagt

SEQ ID NO: 27166 - DNA, 745 bp, Artificial Sequence
  chemically treated genomic DNA (Homo sapiens) CpG-island No: 27166
actcaccaaatcccctccgcacctccccccaaaactacgactatttccaaactcctaaacgcacccaaccgaaccccttaccctctcacgattcaacaccgaaaacaacgaacatacttttctccccgaaaaatccccgccgccaaaaaaacgatattaacaacgtccgcaaaactacaaatatccgtaccgcgcgcccgcccgtccgcatccccgcgacacccctacgcgcccacctcccttccccgcctcgcgcaaaacaaccgcgcgacgtcttacttttctaactaaaataacctaaataataaccataataaccgataatccgcaaaatccgatcctcgataataaccaccccgttaaaaaccgccttaacatccataaaaaacgcgaaacgacgaccccgaatacgacgaaacgaaaaacgcaacgcgaaacccgaaaactaatacaaataccgaaaccgctaatactaatcttacaactcctactcccgcgcccgaactctaactccaccgcccgacgcaacaccgactccgcatcacaacgacgacgacgacgacgacgacgaaacgacccccactcgaaccgacctctccgtcaacctaacaactctcccgcgcgccacccgaaacactactacccgaataacgccccctcacctccgacgcccaccgtaaccgaaaacgaatataaacgccccacctaatcgccaactttcatcattaacccttacgcgatcctt

SEQ ID NO: 27167 - DNA, 745 bp, Artificial Sequence
  chemically treated genomic DNA (Homo sapiens) CpG-island No: 27167
gtttattaggtttttttcgtatttttttttaaggttacgattgtttttaaatttttgggcgtatttagtcgggttttttgtttttttacggtttagtatcgaggatagcggatatattttttttttcggggggttttcgtcgttaggaaggcggtgttgatagcgttcgtagggttgtaggtgttcgtatcgcgcgttcgttcgttcgtattttcgcggtatttttgcgcgtttatttttttttttcgtttcgcgtagggtagtcgcgcggcgttttatttttttggttggagtaatttggataatagttatagtagtcggtgattcgtaggattcggttttcgatagtggttatttcgttgggggtcgttttgatatttatagagagcgcggggcgacggtttcgagtgcggcggggcggagagcgtagcgcggggttcgggagttggtgtaggtgtcggagtcgttggtgttgattttgtagtttttgttttcgcgttcgggttttgattttatcgttcggcgtagtatcggtttcgtattatagcggcggcggcggcggcggcggcggagcggtttttattcgggtcggttttttcgttagtttggtagttttttcgcgcgttattcggagtattgttgttcgaatagcgtttttttattttcgacgtttatcgtggtcgggggcgggtgtgggcgttttatttggtcgttagtttttattattaatttttgcgcgattttt

SEQ ID NO: 27168 - DNA, 745 bp, Artificial Sequence
  chemically treated genomic DNA (Homo sapiens) CpG-island No: 27168
aaaaatcgcgcaaaaattaataataaaaactaacgaccaaataaaacgcccacacccgcccccgaccacgataaacgtcgaaaataaaaaaacgctattcgaacaacaatactccgaataacgcgcgaaaaaactaccaaactaacgaaaaaaccgacccgaataaaaaccgctccgccgccgccgccgccgccgccgctataatacgaaaccgatactacgccgaacgataaaatcaaaacccgaacgcgaaaacaaaaactacaaaatcaacaccaacgactccgacacctacaccaactcccgaaccccgcgctacgctctccgccccgccgcactcgaaaccgtcgccccgcgctctctataaatatcaaaacgacccccaacgaaataaccactatcgaaaaccgaatcctacgaatcaccgactactataactattatccaaattactccaaccaaaaaaataaaacgccgcgcgactaccctacgcgaaacgaaaaaaaaaaataaacgcgcaaaaataccgcgaaaatacgaacgaacgaacgcgcgatacgaacacctacaaccctacgaacgctatcaacaccgccttcctaacgacgaaaaccccccgaaaaaaaaaatatatccgctatcctcgatactaaaccgtaaaaaaacaaaaaacccgactaaatacgcccaaaaatttaaaaacaatcgtaaccttaaaaaaaaatacgaaaaaaacctaataaac

SEQ ID NO: 27169 - DNA, 789 bp, Artificial Sequence
  chemically treated genomic DNA (Homo sapiens) CpG-island No: 27169
cgtgcggatttgtgtttttcggggaggtttgcggtttaggttcgatttttgcgatttgttttaggtaggtttgtatgtgcgcggcggtcgcgtgttgtatagtgtgagggaacgtgtattaaacgttcgcgggatatttgtgttcgtttagttaagagtgtattcgtgtgcgcgagcggggtttttgggacgtcgtcgtggtcgggggcggttttgcgaggggagggggttatagggattggtcggcgtcggtttcgtgcgtacggaggcgggggcggggggcgggggtcgcgaggggggaggcggtatgaaaagggcggcgcgcgcggcggcggcggtagtttttcggtagcggcggtggagagcgtagcgcgtagttcggtgtagttttggtttttttttcgttgcgcgttcgcgttttttttcgcgttcgtaattagaagtttagtgcggcgttaggagtcggattcgcgttcgtatcgttttcgggatcgcgatttcggtcgtttagagatgatcgcgatcgaagtttttttgcgcgtttttttgtttttgttggttttcggttatagtatttatggtgagtttttcggcggttcggttcgcgttttttttggggaagtttgcgatttttcgtcggtcgttcggtgtttcgtacgtttcgtttcgtgagttttaatttcgttcgtttcgtttagttttaagtttcgcgttgtgtttgtttcgttttatttattacgttcgtatgttaaggttcgttttaggggttttagggcgtaggggatgtgt

SEQ ID NO: 27170 - DNA, 789 bp, Artificial Sequence
  chemically treated genomic DNA (Homo sapiens) CpG-island No: 27170
acacatcccctacgccctaaaacccctaaaacgaaccttaacatacgaacgtaataaataaaacgaaacaaacacaacgcgaaacttaaaactaaacgaaacgaacgaaattaaaactcacgaaacgaaacgtacgaaacaccgaacgaccgacgaaaaatcgcaaacttccccaaaaaaaacgcgaaccgaaccgccgaaaaactcaccataaatactataaccgaaaaccaacaaaaacaaaaaaacgcgcaaaaaaacttcgatcgcgatcatctctaaacgaccgaaatcgcgatcccgaaaacgatacgaacgcgaatccgactcctaacgccgcactaaacttctaattacgaacgcgaaaaaaaacgcgaacgcgcaacgaaaaaaaaaccaaaactacaccgaactacgcgctacgctctccaccgccgctaccgaaaaactaccgccgccgccgcgcgcgccgcccttttcataccgcctcccccctcgcgacccccgccccccgcccccgcctccgtacgcacgaaaccgacgccgaccaatccctataaccccctcccctcgcaaaaccgcccccgaccacgacgacgtcccaaaaaccccgctcgcgcacacgaatacactcttaactaaacgaacacaaatatcccgcgaacgtttaatacacgttccctcacactatacaacacgcgaccgccgcgcacatacaaacctacctaaaacaaatcgcaaaaatcgaacctaaaccgcaaacctccccgaaaaacacaaatccgcacg

SEQ ID NO: 27171 - DNA, 789 bp, Artificial Sequence
  chemically treated genomic DNA (Homo sapiens) CpG-island No: 27171
atatattttttgcgttttgggatttttgggacgggttttggtatgcgagcgtggtgggtagggcgagataggtatagcgcggggtttagggttaggcgggacgggcggagttggggtttacgagacggggcgtgcggggtatcgggcggtcggcggggagtcgtaggtttttttagagggggcgcgagtcgggtcgtcggggaatttattataggtgttgtggtcgaaagttagtaggagtaagaggacgcgtaggagggtttcggtcgcggttatttttgggcggtcggggtcgcggtttcgggagcggtgcgggcgcgggttcggtttttggcgtcgtattgggtttttggttgcggacgcgaaagggggcgcgggcgcgtagcgaggggaaagttagggttgtatcgggttgcgcgttgcgttttttatcgtcgttgtcggggagttgtcgtcgtcgtcgcgcgcgtcgttttttttatatcgttttttttttcgcggttttcgtttttcgttttcgttttcgtgcgtacggggtcggcgtcggttagtttttgtgatttttttttttcgtagggtcgttttcgattacggcggcgttttagaagtttcgttcgcgtatacgggtgtatttttggttagacgggtataggtatttcgcgagcgtttggtatacgtttttttatattgtatagtacgcggtcgtcgcgtatatataggtttgtttaggataagtcgtaggaatcgaatttgggtcgtagattttttcggagagtataaattcgtacg

SEQ ID NO: 27172 - DNA, 789 bp, Artificial Sequence
  chemically treated genomic DNA (Homo sapiens) CpG-island No: 27172
cgtacgaatttatactctccgaaaaaatctacgacccaaattcgattcctacgacttatcctaaacaaacctatatatacgcgacgaccgcgtactatacaatataaaaaaacgtataccaaacgctcgcgaaatacctatacccgtctaaccaaaaatacacccgtatacgcgaacgaaacttctaaaacgccgccgtaatcgaaaacgaccctacgaaaaaaaaaaatcacaaaaactaaccgacgccgaccccgtacgcacgaaaacgaaaacgaaaaacgaaaaccgcgaaaaaaaaaacgatataaaaaaaacgacgcgcgcgacgacgacgacaactccccgacaacgacgataaaaaacgcaacgcgcaacccgatacaaccctaactttcccctcgctacgcgcccgcgccccctttcgcgtccgcaaccaaaaacccaatacgacgccaaaaaccgaacccgcgcccgcaccgctcccgaaaccgcgaccccgaccgcccaaaaataaccgcgaccgaaaccctcctacgcgtcctcttactcctactaactttcgaccacaacacctataataaattccccgacgacccgactcgcgccccctctaaaaaaacctacgactccccgccgaccgcccgataccccgcacgccccgtctcgtaaaccccaactccgcccgtcccgcctaaccctaaaccccgcgctatacctatctcgccctacccaccacgctcgcataccaaaacccgtcccaaaaatcccaaaacgcaaaaaatatat

SEQ ID NO: 27173 - DNA, 723 bp, Artificial Sequence
  chemically treated genomic DNA (Homo sapiens) CpG-island No: 27173
tggacggttaggggtttttggagtttcgcgagagggtacgggttcgcgagaaggatttggatggttcgtgttttcgtcgttaggtttcgttcggtcgttttttagtcgttttcgtttcgttcgcgttttatttttcgaacgtagcggtcggtcgggtcggagtttgggttagagtcggagtttgggtcgcgggattagcgtcgggggttacgttttggcgttgtattttttttttggtcgtttttgtcgggaaggcgggcggcgcgtttagtagttttatattggttatcgttttgtcgatggtgaattagtcgttgatttgttcgatggtgagttttcgtagtatttttaaggtttaggcgtcggtattttttaattgtcgggttttcgcggcgggaataggcgacggcggaagcgtattttggaagtttcgttttcgttcgaggttttttaattagaacgcgtcgcgcgtttttgtgggcgggtttcggttcgggcgcgtgttgttcgcgttgtttggttttcgtgtcgtcggtttcgtttcgtcgcgttaggtttgtcgggagtcgtcgtttcgagcgagtttagggtgagtttttttaggattttaggggaagtttgagcgtcgcggttggttcgggagtttgttttacgggagtttcgtggtaatttttgtgtgtataagaaaatgtttttcggttattttttggtttttttatttag

SEQ ID NO: 27174 - DNA, 723 bp, Artificial Sequence
  chemically treated genomic DNA (Homo sapiens) CpG-island No: 27174
ctaaataaaaaaaccaaaaaataaccgaaaaacattttcttatacacacaaaaattaccacgaaactcccgtaaaacaaactcccgaaccaaccgcgacgctcaaacttcccctaaaatcctaaaaaaactcaccctaaactcgctcgaaacgacgactcccgacaaacctaacgcgacgaaacgaaaccgacgacacgaaaaccaaacaacgcgaacaacacgcgcccgaaccgaaacccgcccacaaaaacgcgcgacgcgttctaattaaaaaacctcgaacgaaaacgaaacttccaaaatacgcttccgccgtcgcctattcccgccgcgaaaacccgacaattaaaaaataccgacgcctaaaccttaaaaatactacgaaaactcaccatcgaacaaatcaacgactaattcaccatcgacaaaacgataaccaatataaaactactaaacgcgccgcccgccttcccgacaaaaacgaccaaaaaaaaaatacaacgccaaaacgtaacccccgacgctaatcccgcgacccaaactccgactctaacccaaactccgacccgaccgaccgctacgttcgaaaaataaaacgcgaacgaaacgaaaacgactaaaaaacgaccgaacgaaacctaacgacgaaaacacgaaccatccaaatccttctcgcgaacccgtaccctctcgcgaaactccaaaaacccctaaccgtcca

SEQ ID NO: 27175 - DNA, 723 bp, Artificial Sequence
  chemically treated genomic DNA (Homo sapiens) CpG-island No: 27175
ttaaatagagaggttagggagtgatcggagggtatttttttgtatatataggggttgttacggaattttcgtgaaatagattttcgggttagtcgcggcgtttaagttttttttgaggttttagaaaggtttattttgggttcgttcggggcggcggttttcggtaggtttagcgcggcggggcggggtcggcggtacgaggattaggtagcgcgggtagtacgcgttcgggtcggagttcgtttataagggcgcgcggcgcgttttgattggaaggtttcgagcgggggcggggtttttagggtgcgttttcgtcgtcgtttgttttcgtcgcggagattcggtagttgggggatgtcgacgtttgggttttgaggatgttgcggaagtttattatcgagtagattaacgattggtttattatcggtaagacggtgattaatgtggagttgttgggcgcgtcgttcgttttttcggtaggggcggttagggaggaggtgtagcgttaggacgtggttttcggcgttggtttcgcggtttaggtttcggttttggtttaagtttcggttcggtcggtcgttgcgttcgaaaggtaggacgcgggcggggcggaggcggttggagggcggtcgggcgaggtttggcgacgagggtacgggttatttagatttttttcgcgagttcgtgttttttcgcggggttttagggatttttgatcgttta

SEQ ID NO: 27176 - DNA, 723 bp, Artificial Sequence
  chemically treated genomic DNA (Homo sapiens) CpG-island No: 27176
taaacgatcaaaaatccctaaaaccccgcgaaaaaacacgaactcgcgaaaaaaatctaaataacccgtaccctcgtcgccaaacctcgcccgaccgccctccaaccgcctccgccccgcccgcgtcctacctttcgaacgcaacgaccgaccgaaccgaaacttaaaccaaaaccgaaacctaaaccgcgaaaccaacgccgaaaaccacgtcctaacgctacacctcctccctaaccgcccctaccgaaaaaacgaacgacgcgcccaacaactccacattaatcaccgtcttaccgataataaaccaatcgttaatctactcgataataaacttccgcaacatcctcaaaacccaaacgtcgacatcccccaactaccgaatctccgcgacgaaaacaaacgacgacgaaaacgcaccctaaaaaccccgcccccgctcgaaaccttccaatcaaaacgcgccgcgcgcccttataaacgaactccgacccgaacgcgtactacccgcgctacctaatcctcgtaccgccgaccccgccccgccgcgctaaacctaccgaaaaccgccgccccgaacgaacccaaaataaacctttctaaaacctcaaaaaaaacttaaacgccgcgactaacccgaaaatctatttcacgaaaattccgtaacaacccctatatatacaaaaaaataccctccgatcactccctaacctctctatttaa

SEQ ID NO: 27177 - DNA, 1476 bp, Artificial Sequence
  chemically treated genomic DNA (Homo sapiens) CpG-island No: 27177
gcggggttttaggcgggagatcgttcgggcgaaggttaaggttcgggagttggtgcggggggcgcggtttcgagagtcgcggaagacgtcggtgggggagaagtaggtgttagttaagggcgtcgggtcggggttggtttcgagcgcgcggtttcgggttatatgttcgtttcgggggtttttcgcgttttttttattggtttttgggtcgtagttttacggcgcgtcggtagtcgggggttaggtcgcggttagagtgcgggcgcgcgtcgtcgtcgtacggacgttttcggtttatagtcggttttcgggagttcgggttcgagtttcggttttgtcgtgattcgttgcgggattcgggtcggtttttttttgtcgggttttagtttttttatcgttcgcggttttttttagtcggggtttacgtaagggcgggggaggttatcggtgtttattgcgcgttcgtttttttttcgtcgtcgggagcgcggacgtcgacgtatttggtcgtcgttgagagcgagggtagcgggcggagcgcggaagtttcgttttttttttcgttttcgtttttatcgggttaattagagggggttacgggattcgtgcggggcgtcgcgttgggggcggggtttgcgggggttgaagagcgagtcgggcgggcgggtcgtacgtgtcgggttggggttgaggttgaggttgaggttgaggcggcggcggcggcggtcgggtgttcgggatagcgacgtagcgcgtcggcggtcgcgatagggttagcgagagtttcgtagttcgtcgtagttgtcgtttcgtcgcggtcgggtcggagagtacggcggcgggagcgcggttttaggaggcggtcggagcggtgggtatagttcggcgcggagtttttgttaggcggcggtcgagggcgtcgcggatttttttcgcgatgatgtcggtgggtgagggcgggcgggaggtggcggcggtttttttcgcgggtcgttggttaaattttttttttttcgcggtttttagttttcgcgggtcggtgcgaggtcgggcgggcggggaaggaagtggttgggcgggcgcgttcggtcgcggcgttttttaggcgggtaggtgggggcggcgtcgggttgttagcgcggggtcggggtcgtttgcgggttttttttgttcggttttcgcggtcgcggggagaagtagatgtatttggggtcggttattttttcggtttttttaggtgcgcggtcggacgttggggtataggtttggtgggtggcgtagttgtgattcgtttgaaacgaacgttttggggtcgttttgggagtcggcggggtgggtattcgcgttcggagtttttatattttgtaggcgtattttcgtagttttcgcggttgtattgaggaaaggtgtcgagtgtacggatttggagagttattttaggaatttttttttttcgtatttgtaatgttggttcgt

SEQ ID NO: 27178 - DNA, 1476 bp, Artificial Sequence
  chemically treated genomic DNA (Homo sapiens) CpG-island No: 27178
acgaaccaacattacaaatacgaaaaaaaaaaattcctaaaataactctccaaatccgtacactcgacacctttcctcaatacaaccgcgaaaactacgaaaatacgcctacaaaatataaaaactccgaacgcgaatacccaccccgccgactcccaaaacgaccccaaaacgttcgtttcaaacgaatcacaactacgccacccaccaaacctataccccaacgtccgaccgcgcacctaaaaaaaccgaaaaaataaccgaccccaaatacatctacttctccccgcgaccgcgaaaaccgaacaaaaaaaacccgcaaacgaccccgaccccgcgctaacaacccgacgccgcccccacctacccgcctaaaaaacgccgcgaccgaacgcgcccgcccaaccacttccttccccgcccgcccgacctcgcaccgacccgcgaaaactaaaaaccgcgaaaaaaaaaaaatttaaccaacgacccgcgaaaaaaaccgccgccacctcccgcccgccctcacccaccgacatcatcgcgaaaaaaatccgcgacgccctcgaccgccgcctaacaaaaactccgcgccgaactatacccaccgctccgaccgcctcctaaaaccgcgctcccgccgccgtactctccgacccgaccgcgacgaaacgacaactacgacgaactacgaaactctcgctaaccctatcgcgaccgccgacgcgctacgtcgctatcccgaacacccgaccgccgccgccgccgcctcaacctcaacctcaacctcaaccccaacccgacacgtacgacccgcccgcccgactcgctcttcaacccccgcaaaccccgcccccaacgcgacgccccgcacgaatcccgtaaccccctctaattaacccgataaaaacgaaaacgaaaaaaaaaacgaaacttccgcgctccgcccgctaccctcgctctcaacgacgaccaaatacgtcgacgtccgcgctcccgacgacgaaaaaaaaacgaacgcgcaataaacaccgataacctcccccgcccttacgtaaaccccgactaaaaaaaaccgcgaacgataaaaaaactaaaacccgacaaaaaaaaaccgacccgaatcccgcaacgaatcacgacaaaaccgaaactcgaacccgaactcccgaaaaccgactataaaccgaaaacgtccgtacgacgacgacgcgcgcccgcactctaaccgcgacctaacccccgactaccgacgcgccgtaaaactacgacccaaaaaccaataaaaaaaacgcgaaaaacccccgaaacgaacatataacccgaaaccgcgcgctcgaaaccaaccccgacccgacgcccttaactaacacctacttctcccccaccgacgtcttccgcgactctcgaaaccgcgccccccgcaccaactcccgaaccttaaccttcgcccgaacgatctcccgcctaaaaccccgc

SEQ ID NO: 27179 - DNA, 1476 bp, Artificial Sequence
  chemically treated genomic DNA (Homo sapiens) CpG-island No: 27179
acgaattaatattgtagatacgggaaaagggaatttttaagatggttttttaaattcgtgtattcggtatttttttttagtataatcgcgaaggttacgggaatgcgtttgtagagtgtgggaatttcgggcgcgggtgtttatttcgtcgatttttagggcgattttagaacgttcgttttaggcgggttatagttgcgttatttattagatttgtgttttagcgttcgatcgcgtatttgagaggatcgaggagatgatcggttttaaatgtatttgttttttttcgcggtcgcggaggtcgagtaggaagggttcgtaggcggtttcggtttcgcgttgatagttcggcgtcgtttttatttgttcgtttggggggcgtcgcggtcgggcgcgttcgtttagttattttttttttcgttcgttcggtttcgtatcggttcgcgggggttgggagtcgcgggaggaaggaggtttggttagcggttcgcggaggaagtcgtcgttatttttcgttcgtttttatttatcggtattatcgcggggagagttcgcgacgttttcggtcgtcgtttgatagggatttcgcgtcgagttgtgtttatcgtttcggtcgttttttaaggtcgcgttttcgtcgtcgtgtttttcggttcggtcgcggcgaggcggtagttgcggcgggttgcggggttttcgttggttttgtcgcggtcgtcggcgcgttgcgtcgttgtttcgggtattcggtcgtcgtcgtcgtcgttttaattttagttttagttttagttttagttcgatacgtgcggttcgttcgttcggttcgttttttagttttcgtaggtttcgtttttagcgcgacgtttcgtacgggtttcgtagttttttttgattggttcggtgggagcgggggcggggagaggggcggggttttcgcgtttcgttcgttattttcgtttttagcggcggttaggtgcgtcggcgttcgcgttttcggcggcgggggaggggcggacgcgtagtgggtatcggtggtttttttcgtttttgcgtgagtttcgattagggaagatcgcggacggtgggaggattgaggttcgatagggaagggtcggttcgggtttcgtagcggattacggtagggtcgggattcgaattcgggttttcgggggtcgattgtgggtcgggagcgttcgtgcggcgacggcgcgcgttcgtattttgatcgcggtttgattttcggttgtcggcgcgtcgtggggttgcggtttagaggttagtgggaggggcgcggggggttttcggagcgagtatgtgattcgaggtcgcgcgttcggaattagtttcggttcgacgtttttggttggtatttgttttttttttatcggcgtttttcgcggttttcggggtcgcgtttttcgtattagttttcgagttttggttttcgttcgagcgatttttcgtttagaatttcgt

SEQ ID NO: 27180 - DNA, 1476 bp, Artificial Sequence
  chemically treated genomic DNA (Homo sapiens) CpG-island No: 27180
acgaaattctaaacgaaaaatcgctcgaacgaaaaccaaaactcgaaaactaatacgaaaaacgcgaccccgaaaaccgcgaaaaacgccgataaaaaaaaaacaaataccaaccaaaaacgtcgaaccgaaactaattccgaacgcgcgacctcgaatcacatactcgctccgaaaaccccccgcgcccctcccactaacctctaaaccgcaaccccacgacgcgccgacaaccgaaaatcaaaccgcgatcaaaatacgaacgcgcgccgtcgccgcacgaacgctcccgacccacaatcgacccccgaaaacccgaattcgaatcccgaccctaccgtaatccgctacgaaacccgaaccgacccttccctatcgaacctcaatcctcccaccgtccgcgatcttccctaatcgaaactcacgcaaaaacgaaaaaaaccaccgatacccactacgcgtccgcccctcccccgccgccgaaaacgcgaacgccgacgcacctaaccgccgctaaaaacgaaaataacgaacgaaacgcgaaaaccccgcccctctccccgcccccgctcccaccgaaccaatcaaaaaaaactacgaaacccgtacgaaacgtcgcgctaaaaacgaaacctacgaaaactaaaaaacgaaccgaacgaacgaaccgcacgtatcgaactaaaactaaaactaaaactaaaattaaaacgacgacgacgacgaccgaatacccgaaacaacgacgcaacgcgccgacgaccgcgacaaaaccaacgaaaaccccgcaacccgccgcaactaccgcctcgccgcgaccgaaccgaaaaacacgacgacgaaaacgcgaccttaaaaaacgaccgaaacgataaacacaactcgacgcgaaatccctatcaaacgacgaccgaaaacgtcgcgaactctccccgcgataataccgataaataaaaacgaacgaaaaataacgacgacttcctccgcgaaccgctaaccaaacctccttcctcccgcgactcccaacccccgcgaaccgatacgaaaccgaacgaacgaaaaaaaaaataactaaacgaacgcgcccgaccgcgacgccccccaaacgaacaaataaaaacgacgccgaactatcaacgcgaaaccgaaaccgcctacgaacccttcctactcgacctccgcgaccgcgaaaaaaaacaaatacatttaaaaccgatcatctcctcgatcctctcaaatacgcgatcgaacgctaaaacacaaatctaataaataacgcaactataacccgcctaaaacgaacgttctaaaatcgccctaaaaatcgacgaaataaacacccgcgcccgaaattcccacactctacaaacgcattcccgtaaccttcgcgattatactaaaaaaaaataccgaatacacgaatttaaaaaaccatcttaaaaattcccttttcccgtatctacaatattaattcgt

SEQ ID NO: 27181 - DNA, 608 bp, Artificial Sequence
  chemically treated genomic DNA (Homo sapiens) CpG-island No: 27181
  misc_feature (594)..(595): n is either a, c, g or t
tggtacgcgtgcgtacggtgttggtgagcgtgtgtgtgcgtgttcgtttgaggggaatgtgatcgtcgtgtatgcgttcgcgatagtgcggggggtcgtatatcggattcgtgcgtgtgcgtaggggtcgcgtgtggttatgggtatacgggcgtgtacgtacgggggttgcgtatgttatgttggcgtggggggtgcgggcgaggtggtcgcggggaggagcggcgttatattttttcggtttttacgcggtttgcgtggttttttgattcggaaaggcggggacgcggggacgtcggcggcgggggcgcggcgggggcggcgagagcgaggaggttcgcggggcgtcggcggggacggtcggtaggcgggggcgtcggcgcgtttcgttcgttcgcgcgcggcgttgttaaggcgggtcggtcgcgcgggcgttagggttttcgtacgggtcgcgggttttcgggggcgtcggtcgtgggcggcgcgtttcggttttgttttttattttcgttttcggggcgggagggggttcgggaatttattcgagagaaattattcgggttttagaataaagaaaagagattagttcgnnattaaggttatta

SEQ ID NO: 27182 - DNA, 608 bp, Artificial Sequence
  chemically treated genomic DNA (Homo sapiens) CpG-island No: 27182
  misc_feature (14)..(15): n is either a, c, g or t
taataaccttaatnncgaactaatctcttttctttattctaaaacccgaataatttctctcgaataaattcccgaaccccctcccgccccgaaaacgaaaataaaaaacaaaaccgaaacgcgccgcccacgaccgacgcccccgaaaacccgcgacccgtacgaaaaccctaacgcccgcgcgaccgacccgccttaacaacgccgcgcgcgaacgaacgaaacgcgccgacgcccccgcctaccgaccgtccccgccgacgccccgcgaacctcctcgctctcgccgcccccgccgcgcccccgccgccgacgtccccgcgtccccgcctttccgaatcaaaaaaccacgcaaaccgcgtaaaaaccgaaaaaatataacgccgctcctccccgcgaccacctcgcccgcaccccccacgccaacataacatacgcaacccccgtacgtacacgcccgtatacccataaccacacgcgacccctacgcacacgcacgaatccgatatacgaccccccgcactatcgcgaacgcatacacgacgatcacattcccctcaaacgaacacgcacacacacgctcaccaacaccgtacgcacgcgtacca

SEQ ID NO: 27183 - DNA, 608 bp, Artificial Sequence
  chemically treated genomic DNA (Homo sapiens) CpG-island No: 27183
  misc_feature (14)..(15): n is either a, c, g or t
tagtgattttggtnncgggttggttttttttttttgttttaagattcggatagtttttttcgggtggattttcgggttttttttcgtttcggaggcgggggtggagggtagagtcggagcgcgtcgtttacggtcggcgttttcgggggttcgcgattcgtgcgaaggttttagcgttcgcgcggtcggttcgttttagtaacgtcgcgcgcgggcgggcgggacgcgtcggcgttttcgtttgtcggtcgttttcgtcggcgtttcgcgggttttttcgttttcgtcgttttcgtcgcgttttcgtcgtcggcgttttcgcgttttcgttttttcgggttaaaaagttacgtaggtcgcgtgggggtcgagagggtgtggcgtcgttttttttcgcggttatttcgttcgtattttttacgttagtatagtatacgtagttttcgtgcgtgtacgttcgtgtgtttatggttatacgcgatttttacgtatacgtacgggttcgatatgcggtttttcgtattgtcgcggacgtatatacgacggttatattttttttaagcggatacgtatatatacgtttattaatatcgtgcgtacgcgtatta

SEQ ID NO: 27184 - DNA, 608 bp, Artificial Sequence
  chemically treated genomic DNA (Homo sapiens) CpG-island No: 27184
  misc_feature (594)..(595): n is either a, c, g or t
taatacgcgtacgcacgatattaataaacgtatatatacgtatccgcttaaaaaaaatataaccgtcgtatatacgtccgcgacaatacgaaaaaccgcatatcgaacccgtacgtatacgtaaaaatcgcgtataaccataaacacacgaacgtacacgcacgaaaactacgtatactatactaacgtaaaaaatacgaacgaaataaccgcgaaaaaaaacgacgccacaccctctcgacccccacgcgacctacgtaactttttaacccgaaaaaacgaaaacgcgaaaacgccgacgacgaaaacgcgacgaaaacgacgaaaacgaaaaaacccgcgaaacgccgacgaaaacgaccgacaaacgaaaacgccgacgcgtcccgcccgcccgcgcgcgacgttactaaaacgaaccgaccgcgcgaacgctaaaaccttcgcacgaatcgcgaacccccgaaaacgccgaccgtaaacgacgcgctccgactctaccctccacccccgcctccgaaacgaaaaaaaacccgaaaatccacccgaaaaaaactatccgaatcttaaaacaaaaaaaaaaaaccaacccgnnaccaaaatcacta

SEQ ID NO: 27185 - DNA, 978 bp, Artificial Sequence
  chemically treated genomic DNA (Homo sapiens) CpG-island No: 27185
  misc_feature (38)..(39): n is either a, c, g or t
ggagcgagggagcgagggagcgcggcgcggtcgtcgtnntgcgcgagtttggggttgtagtttagtcgggattttttagtcggcggtagcgcggcggtcgcgcggttttttttcgtttttcgttatggggtagttcggggagtagaacgttgcggatcgcggcggaggacgcgttcgtcgtttttgagtcggtcgagcggcgacggatcgcgaggtaaggggtcgcggcgggcgggcgggttttcggcgcgcggtcgggcgtttttattttcgtcgtttttatttcgcgttttgggcggcggggttcgggggtttcggggttgttcggcgcgggttcggcgcggcgtaggttcggttcgttttagcggcgacggcggggcgcggttttagtttggtttcgcgttttagtcgggttgtttttcgttttcggacgttttaatttcggtaaattttgtttcggaggtcgggttcggggttcgagggggtcggggcgttcgtatttttttaggaaacggggcgcgtaggtttcgttacggtcgtgattttcgttggcgttgaggattcggtatttcgcggggtcgcgggttttacgcggggggacgggcggtttaggggttgcgtggtcgagcgcgttgttcgggtcggtcgggggggttcgggcgttattggaaagttggttttgagttatttcgttttagaggcgttttcgatcgtttggcgggcggcgcgggggttcgggtatgggtagagggcgcgaatttttttcgcgcggtcgtcgagggtcggcgattttcggggtatcgggcggtttttggtcgcgggttttgcgtttttttcgcgggcgttaggcggttttcggcgggttggtcggttttacgtcgttagttagtttcgtgtggggatttcggtttagtatttggattcgaggagataattttgtgtggaaaatttttttttttcggttggaaatagtaataa

SEQ ID NO: 27186 - DNA, 978 bp, Artificial Sequence
  chemically treated genomic DNA (Homo sapiens) CpG-island No: 27186
  misc_feature (940)..(941): n is either a, c, g or t
ttattactatttccaaccgaaaaaaaaaaattttccacacaaaattatctcctcgaatccaaatactaaaccgaaatccccacacgaaactaactaacgacgtaaaaccgaccaacccgccgaaaaccgcctaacgcccgcgaaaaaaacgcaaaacccgcgaccaaaaaccgcccgataccccgaaaatcgccgaccctcgacgaccgcgcgaaaaaaattcgcgccctctacccatacccgaacccccgcgccgcccgccaaacgatcgaaaacgcctctaaaacgaaataactcaaaaccaactttccaataacgcccgaacccccccgaccgacccgaacaacgcgctcgaccacgcaacccctaaaccgcccgtccccccgcgtaaaacccgcgaccccgcgaaataccgaatcctcaacgccaacgaaaatcacgaccgtaacgaaacctacgcgccccgtttcctaaaaaaatacgaacgccccgaccccctcgaaccccgaacccgacctccgaaacaaaatttaccgaaattaaaacgtccgaaaacgaaaaacaacccgactaaaacgcgaaaccaaactaaaaccgcgccccgccgtcgccgctaaaacgaaccgaacctacgccgcgccgaacccgcgccgaacaaccccgaaacccccgaaccccgccgcccaaaacgcgaaataaaaacgacgaaaataaaaacgcccgaccgcgcgccgaaaacccgcccgcccgccgcgaccccttacctcgcgatccgtcgccgctcgaccgactcaaaaacgacgaacgcgtcctccgccgcgatccgcaacgttctactccccgaactaccccataacgaaaaacgaaaaaaaaccgcgcgaccgccgcgctaccgccgactaaaaaatcccgactaaactacaaccccaaactcgcgcannacgacgaccgcgccgcgctccctcgctccctcgctcc

SEQ ID NO: 27187 - DNA, 978 bp, Artificial Sequence
  chemically treated genomic DNA (Homo sapiens) CpG-island No: 27187
  misc_feature (940)..(941): n is either a, c, g or t
ttgttattgtttttaatcgaagggagagaattttttatatagaattattttttcgggtttaaatattagatcgaagtttttatacggggttggttggcggcgtggaatcggttagttcgtcgagagtcgtttggcgttcgcggggaagacgtagagttcgcggttaggagtcgttcggtgtttcgggagtcgtcggttttcggcggtcgcgcgagggggattcgcgttttttgtttatattcggattttcgcgtcgttcgttaagcggtcggaggcgtttttgaggcggaatgatttaggattaattttttaataacgttcgggttttttcggtcggttcgggtagcgcgttcggttacgtagtttttgagtcgttcgttttttcgcgtgaaattcgcggtttcgcggggtgtcgggtttttaacgttagcgggggttacggtcgtagcgaggtttgcgcgtttcgttttttgaaaaggtgcgggcgtttcggttttttcgggtttcgagttcggttttcgggataaagtttgtcgaagttgaggcgttcggaggcgggaggtagttcggttggggcgcggggttaggttgaagtcgcgtttcgtcgtcgtcgttgggacgggtcgggtttgcgtcgcgtcgggttcgcgtcgggtagtttcgaggttttcgggtttcgtcgtttagggcgcgggatggaggcgacggggatggaggcgttcggtcgcgcgtcggaggttcgttcgttcgtcgcggttttttatttcgcggttcgtcgtcgttcggtcggtttaggggcgacgggcgcgtttttcgtcgcggttcgtagcgttttgtttttcgggttgttttatggcggggggcggggaagagtcgcgcggtcgtcgcgttgtcgtcggttggaaagtttcggttgggttgtaattttaggttcgcgtanngcggcggtcgcgtcgcgttttttcgttttttcgtttt

SEQ ID NO: 27188 - DNA, 978 bp, Artificial Sequence
  chemically treated genomic DNA (Homo sapiens) CpG-island No: 27188
  misc_feature (38)..(39): n is either a, c, g or t
aaaacgaaaaaacgaaaaaacgcgacgcgaccgccgcnntacgcgaacctaaaattacaacccaaccgaaactttccaaccgacgacaacgcgacgaccgcgcgactcttccccgccccccgccataaaacaacccgaaaaacaaaacgctacgaaccgcgacgaaaaacgcgcccgtcgcccctaaaccgaccgaacgacgacgaaccgcgaaataaaaaaccgcgacgaacgaacgaacctccgacgcgcgaccgaacgcctccatccccgtcgcctccatcccgcgccctaaacgacgaaacccgaaaacctcgaaactacccgacgcgaacccgacgcgacgcaaacccgacccgtcccaacgacgacgacgaaacgcgacttcaacctaaccccgcgccccaaccgaactacctcccgcctccgaacgcctcaacttcgacaaactttatcccgaaaaccgaactcgaaacccgaaaaaaccgaaacgcccgcaccttttcaaaaaacgaaacgcgcaaacctcgctacgaccgtaacccccgctaacgttaaaaacccgacaccccgcgaaaccgcgaatttcacgcgaaaaaacgaacgactcaaaaactacgtaaccgaacgcgctacccgaaccgaccgaaaaaacccgaacgttattaaaaaattaatcctaaatcattccgcctcaaaaacgcctccgaccgcttaacgaacgacgcgaaaatccgaatataaacaaaaaacgcgaatccccctcgcgcgaccgccgaaaaccgacgactcccgaaacaccgaacgactcctaaccgcgaactctacgtcttccccgcgaacgccaaacgactctcgacgaactaaccgattccacgccgccaaccaaccccgtataaaaacttcgatctaatatttaaacccgaaaaaataattctatataaaaaattctctcccttcgattaaaaacaataacaa

SEQ ID NO: 27189 - DNA, 567 bp, Artificial Sequence
  chemically treated genomic DNA (Homo sapiens) CpG-island No: 27189
  misc_feature (506)..(506): n is either a, c, g or t
ttgacgcgatatgttttttttgcgtgggcgttgttttgttcgtcgttattatcgtcgtttggttttgttcggtttgtagttcgtttttcgtttcgtttattcggggttttcgcgttaagttttttgtttgtcgcggtgagttgaggtttagttattatggtgggcgggaagcgcgtagttttggcggggcgtttcgacgggtggggagaagggaggatacggcgtgtaggtttcgcgtgggaggtttttgtggtttggtcgtcgttgggggaggtttttgtggtttggtcgtttttgggggaggtttttgggagagggtcgcggtgaggatgtcgtcgtcgggtataggggcggaaagtcgggagatttgaggaacgcgcggggattgggttttttcgttgttatttttatacgtattggttcggaggagggttgtggtttcgcggagaatgattaatatttcggacgtattcggattgcgaaatttagcgtttttattatattgntgaatttttgggtatatcgtagtttagagtgcgagagttggatcgagatttttagatgaat

SEQ ID NO: 27190 - DNA, 567 bp, Artificial Sequence
  chemically treated genomic DNA (Homo sapiens) CpG-island No: 27190
  misc_feature (62)..(62): n is either a, c, g or t
attcatctaaaaatctcgatccaactctcgcactctaaactacgatatacccaaaaattcancaatataataaaaacgctaaatttcgcaatccgaatacgtccgaaatattaatcattctccgcgaaaccacaaccctcctccgaaccaatacgtataaaaataacaacgaaaaaacccaatccccgcgcgttcctcaaatctcccgactttccgcccctatacccgacgacgacatcctcaccgcgaccctctcccaaaaacctcccccaaaaacgaccaaaccacaaaaacctcccccaacgacgaccaaaccacaaaaacctcccacgcgaaacctacacgccgtatcctcccttctccccacccgtcgaaacgccccgccaaaactacgcgcttcccgcccaccataataactaaacctcaactcaccgcgacaaacaaaaaacttaacgcgaaaaccccgaataaacgaaacgaaaaacgaactacaaaccgaacaaaaccaaacgacgataataacgacgaacaaaacaacgcccacgcaaaaaaaacatatcgcgtcaa

SEQ ID NO: 27191 - DNA, 567 bp, Artificial Sequence
  chemically treated genomic DNA (Homo sapiens) CpG-island No: 27191
  misc_feature (62)..(62): n is either a, c, g or t
atttatttaggggtttcggtttaattttcgtattttgaattgcgatgtgtttaggagtttantagtgtagtgaaaacgttagatttcgtagttcgagtacgttcgaggtgttaattatttttcgcgaaattatagttttttttcgagttagtgcgtgtaaaggtaataacgaagaggtttaattttcgcgcgttttttaggtttttcggtttttcgtttttgtgttcgacgacggtatttttatcgcgatttttttttaggaattttttttaaaggcgattaagttataggaattttttttaacggcgattaagttataagagttttttacgcgaggtttgtacgtcgtgtttttttttttttttattcgtcggggcgtttcgttagggttacgcgtttttcgtttattatgatggttgggttttaatttatcgcggtagatagggggtttggcgcgggggtttcgagtgggcgaagcggggagcgggttgtaggtcgagtagggttaagcggcggtagtggcggcgggtaggatagcgtttacgtaggagaggtatatcgcgttag

SEQ ID NO: 27192 - DNA, 567 bp, Artificial Sequence
  chemically treated genomic DNA (Homo sapiens) CpG-island No: 27192
  misc_feature (506)..(506): n is either a, c, g or t
ctaacgcgatatacctctcctacgtaaacgctatcctacccgccgccactaccgccgcttaaccctactcgacctacaacccgctccccgcttcgcccactcgaaacccccgcgccaaaccccctatctaccgcgataaattaaaacccaaccatcataataaacgaaaaacgcgtaaccctaacgaaacgccccgacgaataaaaaaaaaaaaaaacacgacgtacaaacctcgcgtaaaaaactcttataacttaatcgccgttaaaaaaaattcctataacttaatcgcctttaaaaaaaattcctaaaaaaaaatcgcgataaaaataccgtcgtcgaacacaaaaacgaaaaaccgaaaaacctaaaaaacgcgcgaaaattaaacctcttcgttattacctttacacgcactaactcgaaaaaaaactataatttcgcgaaaaataattaacacctcgaacgtactcgaactacgaaatctaacgttttcactacactantaaactcctaaacacatcgcaattcaaaatacgaaaattaaaccgaaacccctaaataaat

SEQ ID NO: 27193 - DNA, 631 bp, Artificial Sequence
  chemically treated genomic DNA (Homo sapiens) CpG-island No: 27193
tcgtagggttcggcgttttatttattcgtgttttttttgttgtttttagtttcggacgagagtagtttggagattagttcgttagattcgtcgtagcggtcgttcgttaggttcgcgttttcgggttcggacgtcgagaaaaggaagaagcggcgggtgttattttttaaggcgtagacgttggagttggagcggcgttttcggtagtagcggtatttgtttgcgttcgagcgcgagtagttggcgagtttgtttcgttttacgtttacgtaggttaagatttggttttagaattatcgttataagttgaagcgcgttcgcgttttaggggcggcggagtcgtttgatttggtagtattcgtcgagttgtacgtcgcgttcggtttgttgcgtcgcgtggtggtgtcggtgtttgttcgcgacgggtagtcgtgcggcggcggcggcggtggcgaggtgggaatcgtcgcggtttaggagaagtgcggcgtttttttagtcgtcgtttgttttttgtcgggttattttgttttcggtttcggttcggcgtttggtttttttttcgtttattagtatttagtatttttcgttttggttttttggaattggtgaggtcgtagggcggtatttg

SEQ ID NO: 27194 - DNA, 631 bp, Artificial Sequence
  chemically treated genomic DNA (Homo sapiens) CpG-island No: 27194
caaataccgccctacgacctcaccaattccaaaaaaccaaaacgaaaaatactaaatactaataaacgaaaaaaaaaccaaacgccgaaccgaaaccgaaaacaaaataacccgacaaaaaacaaacgacgactaaaaaaacgccgcacttctcctaaaccgcgacgattcccacctcgccaccgccgccgccgccgcacgactacccgtcgcgaacaaacaccgacaccaccacgcgacgcaacaaaccgaacgcgacgtacaactcgacgaatactaccaaatcaaacgactccgccgcccctaaaacgcgaacgcgcttcaacttataacgataattctaaaaccaaatcttaacctacgtaaacgtaaaacgaaacaaactcgccaactactcgcgctcgaacgcaaacaaataccgctactaccgaaaacgccgctccaactccaacgtctacgccttaaaaaataacacccgccgcttcttccttttctcgacgtccgaacccgaaaacgcgaacctaacgaacgaccgctacgacgaatctaacgaactaatctccaaactactctcgtccgaaactaaaaacaacaaaaaaaacacgaataaataaaacgccgaaccctacga

SEQ ID NO: 27195 - DNA, 631 bp, Artificial Sequence
  chemically treated genomic DNA (Homo sapiens) CpG-island No: 27195
taggtgtcgttttgcggttttattagttttaggagattagggcgggggatgttaagtgttggtaggcggggaagaggttaagcgtcgagtcgggatcgaaggtagggtagttcggtagagggtaggcggcggttggaggggcgtcgtattttttttgggtcgcggcggtttttatttcgttatcgtcgtcgtcgtcgtacggttgttcgtcgcgaataagtatcggtattattacgcgacgtagtaggtcgggcgcggcgtgtagttcggcggatgttgttaggttaggcgatttcgtcgtttttggagcgcgagcgcgttttagtttgtagcgatgattttggaattagattttgatttgcgtgggcgtgaggcgaagtaggttcgttagttgttcgcgttcgggcgtagataggtatcgttgttgtcggaagcgtcgttttaattttagcgtttgcgttttggagaatagtattcgtcgttttttttttttttcggcgttcgagttcggagacgcgggtttagcggacggtcgttgcgacgagtttggcgggttggtttttaggttgttttcgttcgaggttagggatagtaaaggagatacgggtgggtgagacgtcggattttacga

SEQ ID NO: 27196 - DNA, 631 bp, Artificial Sequence
  chemically treated genomic DNA (Homo sapiens) CpG-island No: 27196
tcgtaaaatccgacgtctcacccacccgtatctcctttactatccctaacctcgaacgaaaacaacctaaaaaccaacccgccaaactcgtcgcaacgaccgtccgctaaacccgcgtctccgaactcgaacgccgaaaaaaaaaaaaaacgacgaatactattctccaaaacgcaaacgctaaaattaaaacgacgcttccgacaacaacgatacctatctacgcccgaacgcgaacaactaacgaacctacttcgcctcacgcccacgcaaatcaaaatctaattccaaaatcatcgctacaaactaaaacgcgctcgcgctccaaaaacgacgaaatcgcctaacctaacaacatccgccgaactacacgccgcgcccgacctactacgtcgcgtaataataccgatacttattcgcgacgaacaaccgtacgacgacgacgacgataacgaaataaaaaccgccgcgacccaaaaaaaatacgacgcccctccaaccgccgcctaccctctaccgaactaccctaccttcgatcccgactcgacgcttaacctcttccccgcctaccaacacttaacatcccccgccctaatctcctaaaactaataaaaccgcaaaacgacaccta

SEQ ID NO: 27197 - DNA, 565 bp, Artificial Sequence
  chemically treated genomic DNA (Homo sapiens) CpG-island No: 27197
tcgtcgtcgaattatgtcgatgagtttaaagtatacgatttcgtttttagtgtttgatattttgagttttttggaggaaagttataagaaagtgggtatggagggcggcggtttcggggtttcgttggcggcgtataggtagggttaggcggtatcgttaatagcggttatgtagtagtacgtcgtggggtattacggcgtcgttatcgtcgtttattatatgacggcggcgggggtgttttagttttcgtatttcgtcgtggggggttattgtaacggtaatttgggtaatatgagcgagttgtcgtcgtattaggatattatgaggaatagcgtttttggtttcggatggtacggcgttaatttagattcgcgttttttcgttagtaagtgaggtcgttttattgcggggtcgcgggttgagtttaggaggtgcggcgagagtcgtttagaaggcgcggcgtcggtaggtgcgcgttgggtattagggagggcggttcggtagcggcgttagggatttgggtgcgggagttggggatgtttttttttgttcggttgggggttt

SEQ ID NO: 27198 - DNA, 565 bp, Artificial Sequence
  chemically treated genomic DNA (Homo sapiens) CpG-island No: 27198
aaacccccaaccgaacaaaaaaaaacatccccaactcccgcacccaaatccctaacgccgctaccgaaccgccctccctaatacccaacgcgcacctaccgacgccgcgccttctaaacgactctcgccgcacctcctaaactcaacccgcgaccccgcaataaaacgacctcacttactaacgaaaaaacgcgaatctaaattaacgccgtaccatccgaaaccaaaaacgctattcctcataatatcctaatacgacgacaactcgctcatattacccaaattaccgttacaataaccccccacgacgaaatacgaaaactaaaacacccccgccgccgtcatataataaacgacgataacgacgccgtaataccccacgacgtactactacataaccgctattaacgataccgcctaaccctacctatacgccgccaacgaaaccccgaaaccgccgccctccatacccactttcttataactttcctccaaaaaactcaaaatatcaaacactaaaaacgaaatcgtatactttaaactcatcgacataattcgacgacga

SEQ ID NO: 27199 - DNA, 565 bp, Artificial Sequence
  chemically treated genomic DNA (Homo sapiens) CpG-island No: 27199
ggatttttagtcgagtagggggaagtatttttagttttcgtatttaagtttttggcgtcgttgtcgggtcgttttttttgatgtttagcgcgtatttgtcggcgtcgcgttttttggacggttttcgtcgtattttttgagtttagttcgcggtttcgtagtggggcggttttatttattggcggggaagcgcgggtttgggttggcgtcgtattattcggggttagaggcgttgttttttatggtgttttggtacggcggtagttcgtttatgttgtttaggttgtcgttgtagtagttttttacggcggagtgcgagagttggggtattttcgtcgtcgttatgtggtaggcggcggtgacggcgtcgtggtgttttacggcgtgttgttgtatggtcgttgttggcggtgtcgtttggttttgtttgtacgtcgttagcggagtttcgaggtcgtcgttttttatgtttatttttttgtagtttttttttaggggatttaagatgttagatattgagaacggagtcgtgtgttttggatttatcgatatgattcggcggcgg

SEQ ID NO: 27200 - DNA, 565 bp, Artificial Sequence
  chemically treated genomic DNA (Homo sapiens) CpG-island No: 27200
ccgccgccgaatcatatcgataaatccaaaacacacgactccgttctcaatatctaacatcttaaatcccctaaaaaaaaactacaaaaaaataaacataaaaaacgacgacctcgaaactccgctaacgacgtacaaacaaaaccaaacgacaccgccaacaacgaccatacaacaacacgccgtaaaacaccacgacgccgtcaccgccgcctaccacataacgacgacgaaaataccccaactctcgcactccgccgtaaaaaactactacaacgacaacctaaacaacataaacgaactaccgccgtaccaaaacaccataaaaaacaacgcctctaaccccgaataatacgacgccaacccaaacccgcgcttccccgccaataaataaaaccgccccactacgaaaccgcgaactaaactcaaaaaatacgacgaaaaccgtccaaaaaacgcgacgccgacaaatacgcgctaaacatcaaaaaaaacgacccgacaacgacgccaaaaacttaaatacgaaaactaaaaatacttccccctactcgactaaaaatcc

SEQ ID NO: 27201 - DNA, 839 bp, Artificial Sequence
  chemically treated genomic DNA (Homo sapiens) CpG-island No: 27201
gcgtcgtcggttggggcgggtcgggcgggttaatggcgcggaaaataggggtggtttggttcggtttggtttcggtcgacgttgtgcgtttgtcgtttatagtttttcgttttatgggttcggcgagcggtatgaatatgagcggtatgggcggtttgggttcgttgggggacgtgagtaagaatatggtttcgttgttaagcgcgtcgcgtaggaagcgtcgggtgtttttttcgtaggcgtaggtgtacgagttggagcgacgttttaagtaatagaagtatttgtcggcgtcggagcgcgagtatttggttagtatgatttatttgacgtttacgtaggttaagatttggttttagaattatcgttataaaatgaagcgttaggttaaggataaggcggcgtagtagtaattgtagtaggatagcggcggcggcgggggcggcgggggtatcgggtgttcgtagtagtaataggtttagtagtagtcgtcgcgacgcgtggcggtgtcggttttggtgaaagacggtaaatcgtgttaggcgggtgttttcgcgtcgggcgtcgttagtttataaggttacgcgtagtagtaggcgtagtattaggcgtaggtcgcgtaggcggcggtagcggttattttcgtgggtagcggtggcgtcggttttggcgtatattcgggttattagttaggtagcgtaggttagttttcggatttggcgtattacgtcgttagtttcgcggcgttgtagggttaggtatttagtttgttttatttgaatttttcgggttcggattacggtattatgttttgttttattttgttatacggtcggatt

SEQ ID NO: 27202 - DNA, 839 bp, Artificial Sequence
  chemically treated genomic DNA (Homo sapiens) CpG-island No: 27202
aatccgaccgtataacaaaataaaacaaaacataataccgtaatccgaacccgaaaaattcaaataaaacaaactaaatacctaaccctacaacgccgcgaaactaacgacgtaatacgccaaatccgaaaactaacctacgctacctaactaataacccgaatatacgccaaaaccgacgccaccgctacccacgaaaataaccgctaccgccgcctacgcgacctacgcctaatactacgcctactactacgcgtaaccttataaactaacgacgcccgacgcgaaaacacccgcctaacacgatttaccgtctttcaccaaaaccgacaccgccacgcgtcgcgacgactactactaaacctattactactacgaacacccgatacccccgccgcccccgccgccgccgctatcctactacaattactactacgccgccttatccttaacctaacgcttcattttataacgataattctaaaaccaaatcttaacctacgtaaacgtcaaataaatcatactaaccaaatactcgcgctccgacgccgacaaatacttctattacttaaaacgtcgctccaactcgtacacctacgcctacgaaaaaaacacccgacgcttcctacgcgacgcgcttaacaacgaaaccatattcttactcacgtcccccaacgaacccaaaccgcccataccgctcatattcataccgctcgccgaacccataaaacgaaaaactataaacgacaaacgcacaacgtcgaccgaaaccaaaccgaaccaaaccacccctattttccgcgccattaacccgcccgacccgccccaaccgacgacgc

SEQ ID NO: 27203 - DNA, 839 bp, Artificial Sequence
  chemically treated genomic DNA (Homo sapiens) CpG-island No: 27203
ggttcgatcgtatagtaaggtggagtaggatatggtgtcgtagttcgagttcgaggagtttaggtgggataggttggatatttggttttgtagcgtcgcggggttggcggcgtggtgcgttaggttcggagattggtttgcgttgtttggttggtggttcgggtgtgcgttaaggtcggcgttatcgttgtttacggagatggtcgttgtcgtcgtttgcgcggtttgcgtttggtgttgcgtttgttgttgcgcgtggttttgtaggttggcggcgttcggcgcgggggtattcgtttggtacggtttgtcgttttttattaggatcggtatcgttacgcgtcgcggcgattgttgttgagtttgttgttgttgcgggtattcggtgttttcgtcgttttcgtcgtcgtcgttgttttgttgtagttgttgttgcgtcgttttgtttttggtttggcgttttattttgtagcggtggttttggaattagattttgatttgcgtgggcgttaggtggattatgttggttaggtgttcgcgtttcggcgtcgataggtatttttgttgtttgaagcgtcgttttagttcgtatatttgcgtttgcgagaagagtattcggcgttttttgcgcggcgcgtttggtagcggggttatgtttttgtttacgttttttagcgagtttaggtcgtttatgtcgtttatgtttatgtcgttcgtcgggtttatgaagcgggagattgtaagcgataaacgtatagcgtcggtcggggttaggtcgagttaggttatttttgtttttcgcgttattggttcgttcggttcgttttaatcgacggcgt

SEQ ID NO: 27204 - DNA, 839 bp, Artificial Sequence
  chemically treated genomic DNA (Homo sapiens) CpG-island No: 27204
acgccgtcgattaaaacgaaccgaacgaaccaataacgcgaaaaacaaaaataacctaactcgacctaaccccgaccgacgctatacgtttatcgcttacaatctcccgcttcataaacccgacgaacgacataaacataaacgacataaacgacctaaactcgctaaaaaacgtaaacaaaaacataaccccgctaccaaacgcgccgcgcaaaaaacgccgaatactcttctcgcaaacgcaaatatacgaactaaaacgacgcttcaaacaacaaaaatacctatcgacgccgaaacgcgaacacctaaccaacataatccacctaacgcccacgcaaatcaaaatctaattccaaaaccaccgctacaaaataaaacgccaaaccaaaaacaaaacgacgcaacaacaactacaacaaaacaacgacgacgacgaaaacgacgaaaacaccgaatacccgcaacaacaacaaactcaacaacaatcgccgcgacgcgtaacgataccgatcctaataaaaaacgacaaaccgtaccaaacgaatacccccgcgccgaacgccgccaacctacaaaaccacgcgcaacaacaaacgcaacaccaaacgcaaaccgcgcaaacgacgacaacgaccatctccgtaaacaacgataacgccgaccttaacgcacacccgaaccaccaaccaaacaacgcaaaccaatctccgaacctaacgcaccacgccgccaaccccgcgacgctacaaaaccaaatatccaacctatcccacctaaactcctcgaactcgaactacgacaccatatcctactccaccttactatacgatcgaacc

SEQ ID NO: 27205 - DNA, 631 bp, Artificial Sequence
  chemically treated genomic DNA (Homo sapiens) CpG-island No: 27205
gaattcgcggcgtaagggaagaattgtgtggagatgacgtttagttggaggggcgtttaagtttaggtcgtcgtttaggttttcgatggggattttatgtttcgtcgtcgcgcggagtttttttaatacggttcgttggttgattggttttcgcgtgggttcgggtagtgggcgtttgtcgggcgtttttttttttgcggcggagtaggtttttttaaggcgttggtcgttagtttcgcgatacggcgattgaggaggcggcgtggttagtttgattttagtttgcgtttcgggagtttttcgttcgcgttcgttgagttgttcgcggggatcggttgcggttttattgcgtagggtcggttttaggggtgggggcgagcgtttttttttgtagggtttttttttgagttcgtattggttcggcggttatcgaattttcggagagttcgaggtttgatttttttattttttcgtcgggttttagaggtttaaagtttaggattttgggcgtagtttttcgtcgggttgcgtagggacggtcgtttaggtcgttaggatttttgtcgtttaatttcgatgtagtttttaaaagttgtttgtaattattgttaagttaggttattttagtagt

SEQ ID NO: 27206 - DNA, 631 bp, Artificial Sequence
  chemically treated genomic DNA (Homo sapiens) CpG-island No: 27206
actactaaaataacctaacttaacaataattacaaacaacttttaaaaactacatcgaaattaaacgacaaaaatcctaacgacctaaacgaccgtccctacgcaacccgacgaaaaactacgcccaaaatcctaaactttaaacctctaaaacccgacgaaaaaataaaaaaatcaaacctcgaactctccgaaaattcgataaccgccgaaccaatacgaactcaaaaaaaaaccctacaaaaaaaaacgctcgcccccacccctaaaaccgaccctacgcaataaaaccgcaaccgatccccgcgaacaactcaacgaacgcgaacgaaaaactcccgaaacgcaaactaaaatcaaactaaccacgccgcctcctcaatcgccgtatcgcgaaactaacgaccaacgccttaaaaaaacctactccgccgcaaaaaaaaaaacgcccgacaaacgcccactacccgaacccacgcgaaaaccaatcaaccaacgaaccgtattaaaaaaactccgcgcgacgacgaaacataaaatccccatcgaaaacctaaacgacgacctaaacttaaacgcccctccaactaaacgtcatctccacacaattcttcccttacgccgcgaattc

SEQ ID NO: 27207 - DNA, 631 bp, Artificial Sequence
  chemically treated genomic DNA (Homo sapiens) CpG-island No: 27207
attattaaagtgatttgatttgatagtaattgtaggtagtttttgagaattgtatcggggttaaacggtagagattttgacgatttgggcgatcgtttttgcgtagttcggcgggaggttgcgtttagaattttgggttttgggtttttggggttcggcgaggagatgaagaagttaagtttcgagtttttcggaggttcgatggtcgtcgggttagtgcgggtttagaggaagattttgtaaaaaagagcgttcgtttttatttttggagtcgattttgcgtagtagggtcgtagtcggttttcgcgggtagtttagcgggcgcgggcgggaggttttcggaacgtaggttgaggttaggttgattacgtcgtttttttagtcgtcgtatcgcggggttggcggttagcgttttagaagagtttgtttcgtcgtaggaagaaagacgttcgataggcgtttattgttcgaatttacgcgggggttagttagttagcgggtcgtgttgggaaagtttcgcgcggcggcgggatataggatttttatcggggatttgggcgacggtttgagtttgggcgtttttttagttgggcgttatttttatatagttttttttttgcgtcgcgaattt

SEQ ID NO: 27208 - DNA, 631 bp, Artificial Sequence
  chemically treated genomic DNA (Homo sapiens) CpG-island No: 27208
aaattcgcgacgcaaaaaaaaaactatataaaaataacgcccaactaaaaaaacgcccaaactcaaaccgtcgcccaaatccccgataaaaatcctatatcccgccgccgcgcgaaactttcccaacacgacccgctaactaactaacccccgcgtaaattcgaacaataaacgcctatcgaacgtctttcttcctacgacgaaacaaactcttctaaaacgctaaccgccaaccccgcgatacgacgactaaaaaaacgacgtaatcaacctaacctcaacctacgttccgaaaacctcccgcccgcgcccgctaaactacccgcgaaaaccgactacgaccctactacgcaaaatcgactccaaaaataaaaacgaacgctcttttttacaaaatcttcctctaaacccgcactaacccgacgaccatcgaacctccgaaaaactcgaaacttaacttcttcatctcctcgccgaaccccaaaaacccaaaacccaaaattctaaacgcaacctcccgccgaactacgcaaaaacgatcgcccaaatcgtcaaaatctctaccgtttaaccccgatacaattctcaaaaactacctacaattactatcaaatcaaatcactttaataat

SEQ ID NO: 27209 - DNA, 507 bp, Artificial Sequence
  chemically treated genomic DNA (Homo sapiens) CpG-island No: 27209
ttcggtttggagcggtgggaggaggcgagtcgagatgtttgatgttttttattttttttatatagatacgcgtatagacggttcggttttcgttattttttatttttttcgtttttcgtaatttttaggttgtcgggattttgggcggtcgggcgaatatttatcgtcggtttaagggtttaggcgagggcgtttgttagtacgtatagttagcgggcgggtagcggatttggcgggcgtatggtttgttttgagttcgcggcgggcggtttcgcgcgggtaaagagttggcgggcggcgtattaggcgggcgatggtcgggagtttggtagagtggcgttggcgttgtggttttagagttaagaggcgtagtttagggttgggggcgggtttcgggggttcgtttgacgggcggcggatttagttaatggatgggtggaggcggggtcgtcgcgtaggtatggggcggggttggggagtttttgttagtgaggaagttttgttttt

SEQ ID NO: 27210 - DNA, 507 bp, Artificial Sequence
  chemically treated genomic DNA (Homo sapiens) CpG-island No: 27210
aaaaacaaaacttcctcactaacaaaaactccccaaccccgccccatacctacgcgacgaccccgcctccacccatccattaactaaatccgccgcccgtcaaacgaacccccgaaacccgcccccaaccctaaactacgcctcttaactctaaaaccacaacgccaacgccactctaccaaactcccgaccatcgcccgcctaatacgccgcccgccaactctttacccgcgcgaaaccgcccgccgcgaactcaaaacaaaccatacgcccgccaaatccgctacccgcccgctaactatacgtactaacaaacgccctcgcctaaacccttaaaccgacgataaatattcgcccgaccgcccaaaatcccgacaacctaaaaattacgaaaaacgaaaaaaataaaaaataacgaaaaccgaaccgtctatacgcgtatctatataaaaaaaataaaaaacatcaaacatctcgactcgcctcctcccaccgctccaaaccgaa

SEQ ID NO: 27211 - DNA, 507 bp, Artificial Sequence
  chemically treated genomic DNA (Homo sapiens) CpG-island No: 27211
gagagtagagtttttttattggtaggggttttttagtttcgttttatatttgcgcggcggtttcgtttttatttatttattggttagattcgtcgttcgttagacgagttttcggggttcgtttttagttttgagttgcgttttttagttttggggttatagcgttagcgttattttgttaggttttcggttatcgttcgtttggtgcgtcgttcgttagttttttgttcgcgcggggtcgttcgtcgcgggtttagggtagattatgcgttcgttaagttcgttgttcgttcgttggttatgcgtgttggtaggcgttttcgtttgggtttttgggtcggcggtgagtgttcgttcggtcgtttagagtttcggtagtttgggggttgcggagggcgggggaggtgggggatggcgggagtcgggtcgtttgtgcgcgtgtttgtgtaagaggaataggggatattaagtatttcgattcgtttttttttatcgttttagatcgaa

SEQ ID NO: 27212 - DNA, 507 bp, Artificial Sequence
  chemically treated genomic DNA (Homo sapiens) CpG-island No: 27212
ttcgatctaaaacgataaaaaaaaacgaatcgaaatacttaatatcccctattcctcttacacaaacacgcgcacaaacgacccgactcccgccatcccccacctcccccgccctccgcaacccccaaactaccgaaactctaaacgaccgaacgaacactcaccgccgacccaaaaacccaaacgaaaacgcctaccaacacgcataaccaacgaacgaacaacgaacttaacgaacgcataatctaccctaaacccgcgacgaacgaccccgcgcgaacaaaaaactaacgaacgacgcaccaaacgaacgataaccgaaaacctaacaaaataacgctaacgctataaccccaaaactaaaaaacgcaactcaaaactaaaaacgaaccccgaaaactcgtctaacgaacgacgaatctaaccaataaataaataaaaacgaaaccgccgcgcaaatataaaacgaaactaaaaaacccctaccaataaaaaaactctactctc

SEQ ID NO: 27213 - DNA, 601 bp, Artificial Sequence
  chemically treated genomic DNA (Homo sapiens) CpG-island No: 27213
tgagtcgttttttttttttaaaggatgtttatacgtgggtggtattcgttggaatttagcgttcgggtagttttgggaggacgcgtttagttgcgaggaggtgatcggcggcggcgcgggtagttcggaggggcgggacggggcggggtaaggcgggggtcgggtcggaggaggcgggttttcgggattcgcggtgttcggtagtagagttcgttgtagattcgggttttgattatgatttggcgtcgcgcggcgttggcggggacgcggttggtttggagtaggagcggttcggtaggttggtttgatagggcggcgggagttgcgggagttgcggtagttgcggtttttgggtacggggttagcgggtaggagtgtcgcggcgtggtgcgtaggttttgcgggggtttggagaaagcggtgggcggaggtgtttttttgtttcggcgtcgggtgggcgaggcgtattagcgcgtgggttttgagttataatacgtagaggcgttcgagggatgggtagggaagggtgtttttcgcggttgtgttgattttaggagtttgtgattttcgcgttgaaaatattttatttatgtttatttag

SEQ ID NO: 27214 - DNA, 601 bp, Artificial Sequence
  chemically treated genomic DNA (Homo sapiens) CpG-island No: 27214
ctaaataaacataaataaaatattttcaacgcgaaaatcacaaactcctaaaatcaacacaaccgcgaaaaacacccttccctacccatccctcgaacgcctctacgtattataactcaaaacccacgcgctaatacgcctcgcccacccgacgccgaaacaaaaaaacacctccgcccaccgctttctccaaacccccgcaaaacctacgcaccacgccgcgacactcctacccgctaaccccgtacccaaaaaccgcaactaccgcaactcccgcaactcccgccgccctatcaaaccaacctaccgaaccgctcctactccaaaccaaccgcgtccccgccaacgccgcgcgacgccaaatcataatcaaaacccgaatctacaacgaactctactaccgaacaccgcgaatcccgaaaacccgcctcctccgacccgacccccgccttaccccgccccgtcccgcccctccgaactacccgcgccgccgccgatcacctcctcgcaactaaacgcgtcctcccaaaactacccgaacgctaaattccaacgaataccacccacgtataaacatcctttaaaaaaaaaaaacgactca

SEQ ID NO: 27215 - DNA, 601 bp, Artificial Sequence
  chemically treated genomic DNA (Homo sapiens) CpG-island No: 27215
ttaagtgaatatgagtgaagtatttttaacgcgagagttataggtttttgaagttagtatagtcgcggagggtatttttttttgtttatttttcgagcgtttttgcgtgttatgatttagagtttacgcgttagtacgtttcgtttattcggcgtcggggtaaaggggtattttcgtttatcgttttttttagattttcgtaaggtttgcgtattacgtcgcggtatttttgttcgttgatttcgtatttagaggtcgtagttgtcgtagttttcgtagttttcgtcgttttgttaagttagtttgtcgagtcgtttttgttttaaattagtcgcgttttcgttagcgtcgcgcggcgttaaattatggttagagttcggatttgtagcgagttttattgtcggatatcgcggatttcgggagttcgtttttttcggttcggttttcgttttgtttcgtttcgtttcgttttttcggattgttcgcgtcgtcgtcggttattttttcgtagttgagcgcgtttttttagggttgttcgagcgttggattttagcgagtgttatttacgtgtaaatattttttagaggggagaagcggttta

SEQ ID NO: 27216 - DNA, 601 bp, Artificial Sequence
  chemically treated genomic DNA (Homo sapiens) CpG-island No: 27216
taaaccgcttctcccctctaaaaaatatttacacgtaaataacactcgctaaaatccaacgctcgaacaaccctaaaaaaacgcgctcaactacgaaaaaataaccgacgacgacgcgaacaatccgaaaaaacgaaacgaaacgaaacaaaacgaaaaccgaaccgaaaaaaacgaactcccgaaatccgcgatatccgacaataaaactcgctacaaatccgaactctaaccataatttaacgccgcgcgacgctaacgaaaacgcgactaatttaaaacaaaaacgactcgacaaactaacttaacaaaacgacgaaaactacgaaaactacgacaactacgacctctaaatacgaaatcaacgaacaaaaataccgcgacgtaatacgcaaaccttacgaaaatctaaaaaaaacgataaacgaaaatacccctttaccccgacgccgaataaacgaaacgtactaacgcgtaaactctaaatcataacacgcaaaaacgctcgaaaaataaacaaaaaaaaataccctccgcgactatactaacttcaaaaacctataactctcgcgttaaaaatacttcactcatattcacttaa

SEQ ID NO: 27217 - DNA, 623 bp, Artificial Sequence
  chemically treated genomic DNA (Homo sapiens) CpG-island No: 27217
ggattcgtagcgtcgttaggagaagttttgcgtagcgttgggaaacgataaaagaaggtagtttgacgggtagcgatagttatagtaatagtaatagttttattgtcgtcggggattttaggttcggttttcgggaacgagttttgtttttttttttttgtttcgttttcgttttagaggggcgaggatttcggatgttgttttttcggcgttgtgaattatcgttttttttttttaggttttagttttttcgaattcgttacgggtgttgtaaggtttgggaagagtttcgatgtttttagggtggttagagcgttttttcgcgtttagtcgcgttgtaggtgacggcgttcggaggttgtcgggaagtaggcggggtgacgtgtggttgacgagttcggcggcgggtttgttgagatttgtggtcggcggtagttggtgcggggggtagttgagagcgagaggtggatcggggcggtgtgtggttagggttatgacgggtaatgtcggggagtggtgttttatggaaagcgatttcggggtttttatcgagtttattaaaggattcggtgagaattaaggggatcgttttgggtttggggttacgggaggaggtttaagtt

SEQ ID NO: 27218 - DNA, 623 bp, Artificial Sequence
  chemically treated genomic DNA (Homo sapiens) CpG-island No: 27218
aacttaaacctcctcccgtaaccccaaacccaaaacgatccccttaattctcaccgaatcctttaataaactcgataaaaaccccgaaatcgctttccataaaacaccactccccgacattacccgtcataaccctaaccacacaccgccccgatccacctctcgctctcaactaccccccgcaccaactaccgccgaccacaaatctcaacaaacccgccgccgaactcgtcaaccacacgtcaccccgcctacttcccgacaacctccgaacgccgtcacctacaacgcgactaaacgcgaaaaaacgctctaaccaccctaaaaacatcgaaactcttcccaaaccttacaacacccgtaacgaattcgaaaaaactaaaacctaaaaaaaaaaaacgataattcacaacgccgaaaaaacaacatccgaaatcctcgcccctctaaaacgaaaacgaaacaaaaaaaaaaaaacaaaactcgttcccgaaaaccgaacctaaaatccccgacgacaataaaactattactattactataactatcgctacccgtcaaactaccttcttttatcgtttcccaacgctacgcaaaacttctcctaacgacgctacgaatcc

SEQ ID NO: 27219 - DNA, 623 bp, Artificial Sequence
  chemically treated genomic DNA (Homo sapiens) CpG-island No: 27219
agtttgggttttttttcgtgattttaggtttaggacggtttttttggtttttatcgaattttttaatgagttcggtgaagatttcggggtcgttttttatgaggtattatttttcggtattgttcgttatggttttggttatatatcgtttcgatttatttttcgtttttagttgtttttcgtattagttgtcgtcggttatagattttagtaaattcgtcgtcgagttcgttaattatacgttatttcgtttatttttcgatagttttcgggcgtcgttatttgtagcgcgattgagcgcgggaggacgttttagttattttagagatatcgaaattttttttaggttttgtagtattcgtagcggattcggaagggttggggtttgagaagaaagggcggtgatttatagcgtcgaggaggtaatattcgggattttcgtttttttggggcggaggcggggtaaaagaagaggggtaggattcgttttcgggaatcgaatttggaattttcggcggtagtggggttgttgttgttgttgtggttgtcgttgttcgttaggttgtttttttttgtcgttttttagcgttgcgtaggattttttttggcggcgttgcggattt

SEQ ID NO: 27220 - DNA, 623 bp, Artificial Sequence
  chemically treated genomic DNA (Homo sapiens) CpG-island No: 27220
aaatccgcaacgccgccaaaaaaaatcctacgcaacgctaaaaaacgacaaaaaaaaacaacctaacgaacaacgacaaccacaacaacaacaacaaccccactaccgccgaaaattccaaattcgattcccgaaaacgaatcctacccctcttcttttaccccgcctccgccccaaaaaaacgaaaatcccgaatattacctcctcgacgctataaatcaccgccctttcttctcaaaccccaacccttccgaatccgctacgaatactacaaaacctaaaaaaaatttcgatatctctaaaataactaaaacgtcctcccgcgctcaatcgcgctacaaataacgacgcccgaaaactatcgaaaaataaacgaaataacgtataattaacgaactcgacgacgaatttactaaaatctataaccgacgacaactaatacgaaaaacaactaaaaacgaaaaataaatcgaaacgatatataaccaaaaccataacgaacaataccgaaaaataatacctcataaaaaacgaccccgaaatcttcaccgaactcattaaaaaattcgataaaaaccaaaaaaaccgtcctaaacctaaaatcacgaaaaaaaacccaaact

SEQ ID NO: 27221 - DNA, 641 bp, Artificial Sequence
  chemically treated genomic DNA (Homo sapiens) CpG-island No: 27221
cgtaggtcgatgtcgtcggtagaaaagagcgaggggttatcggtttcggcgttcgcggaacgcgttcggggtcgggtgttcggtttgtcgtcgtcggcgttgtgttgcgtttgcggtttgtgcgcgttgttggcgggcgtgaacgtgacgttggtaggcgttttcgttttttttttgttcgagtataacgcgttgttcgtcgtggggttggcgttgttggtgttggcgttcggttttttcgcggtttgttgcgtgtgtagtcgtcggggtttcgcgtttcgtgggcgttcggcggtcgcggcgggttcgggttagggtggcggtcgcgtcgggttcgtggcgttggagatggagagtagcgagtttacggtataggatattacggtcgtgtagtttagttttgtcgttttcgtcgcgtttttcggttgttttagtttcggttttagttttttcgttttggaggtttcggcgttcgcggtcgtttgcgcgttgcgttcggaaggagtttagtttaatttatttcgggcgcgcgtcgttttttagcggattagggtttcgtcgtgatttcgttgttcgggtttatttttttttttttagtgttatttaaggggggaaaagaaagaaaagaaaaagaaaaaaga

SEQ ID NO: 27222 - DNA, 641 bp, Artificial Sequence
  chemically treated genomic DNA (Homo sapiens) CpG-island No: 27222
tcttttttctttttcttttctttcttttccccccttaaataacactaaaaaaaaaaaaataaacccgaacaacgaaatcacgacgaaaccctaatccgctaaaaaacgacgcgcgcccgaaataaattaaactaaactccttccgaacgcaacgcgcaaacgaccgcgaacgccgaaacctccaaaacgaaaaaactaaaaccgaaactaaaacaaccgaaaaacgcgacgaaaacgacaaaactaaactacacgaccgtaatatcctataccgtaaactcgctactctccatctccaacgccacgaacccgacgcgaccgccaccctaacccgaacccgccgcgaccgccgaacgcccacgaaacgcgaaaccccgacgactacacacgcaacaaaccgcgaaaaaaccgaacgccaacaccaacaacgccaaccccacgacgaacaacgcgttatactcgaacaaaaaaaaaacgaaaacgcctaccaacgtcacgttcacgcccgccaacaacgcgcacaaaccgcaaacgcaacacaacgccgacgacgacaaaccgaacacccgaccccgaacgcgttccgcgaacgccgaaaccgataacccctcgctcttttctaccgacgacatcgacctacg

SEQ ID NO: 27223 - DNA, 641 bp, Artificial Sequence
  chemically treated genomic DNA (Homo sapiens) CpG-island No: 27223
ttttttttttttttttttttttttttttttttttttaaatggtattgaaggaaggggaatgaattcggatagcggagttacggcggggttttggttcgttagggggcggcgcgcgttcggggtgggttgagttggatttttttcgagcgtagcgcgtagacggtcgcgggcgtcggggtttttagggcgagggggttggggtcggggttggagtagtcggaggacgcggcggagacggtagggttgagttgtacggtcgtggtgttttgtgtcgtgggttcgttgttttttatttttagcgttacgggttcggcgcggtcgttattttggttcgggttcgtcgcggtcgtcgagcgtttacggggcgcgaggtttcggcggttatatacgtagtaggtcgcgaagaagtcgagcgttagtattagtagcgttagttttacgacgagtagcgcgttgtgttcgggtaagaaggaggcgaaggcgtttgttagcgttacgtttacgttcgttagtagcgcgtatagatcgtaggcgtagtatagcgtcggcgacggtaggtcgggtattcggtttcgggcgcgtttcgcgggcgtcgggatcggtggtttttcgtttttttttgtcggcggtatcggtttgcg

SEQ ID NO: 27224 - DNA, 641 bp, Artificial Sequence
  chemically treated genomic DNA (Homo sapiens) CpG-island No: 27224
cgcaaaccgataccgccgacaaaaaaaaacgaaaaaccaccgatcccgacgcccgcgaaacgcgcccgaaaccgaatacccgacctaccgtcgccgacgctatactacgcctacgatctatacgcgctactaacgaacgtaaacgtaacgctaacaaacgccttcgcctccttcttacccgaacacaacgcgctactcgtcgtaaaactaacgctactaatactaacgctcgacttcttcgcgacctactacgtatataaccgccgaaacctcgcgccccgtaaacgctcgacgaccgcgacgaacccgaaccaaaataacgaccgcgccgaacccgtaacgctaaaaataaaaaacaacgaacccacgacacaaaacaccacgaccgtacaactcaaccctaccgtctccgccgcgtcctccgactactccaaccccgaccccaaccccctcgccctaaaaaccccgacgcccgcgaccgtctacgcgctacgctcgaaaaaaatccaactcaacccaccccgaacgcgcgccgccccctaacgaaccaaaaccccgccgtaactccgctatccgaattcattccccttccttcaataccatttaaaaaaaaaaaaaaaaaaaaaaaaaaaaaaaaaaaa

SEQ ID NO: 27225 - DNA, 595 bp, Artificial Sequence
  chemically treated genomic DNA (Homo sapiens) CpG-island No: 27225
gaggcgggtcgtggtatatatagggcggcgagagcgcgtagtgtcggggttagagcggcgcgttttttttttttcgtttcgtttcgtcgttatttcgcgttcggaatttttggcgcgcggaatttcggtgtcggagcgcgggcgcggcgtattcggagcgggatggagcgggcgcgcgggtcgcgggtcgaggtcgacgcgtttgaggaggaggaggaggcgggggcggttatggttgttgtggtggtggcggttgcgggtggcgcgggatcggcggttttgtaggtggtcggtttttatcggggtttgtgcgcggtgcgtagtcgcgttttgggtttggggttcgtgttattcgcgtagttgcgcgtttttttagtgcgtttcggttcgggtcggttcgaggggggcgtttgacggtagcggggtcggggtcgatgtcgagttttaggttaattttttttacgatcgttatcgcgataagatttagttgttgcgtaggtgcgggtttgggttggttggaggcgggtagaaggcgggaggaggggcggttcgggttgttgggttttaggatagttttgtgaggtgggtattagta

SEQ ID NO: 27226 - DNA, 595 bp, Artificial Sequence
  chemically treated genomic DNA (Homo sapiens) CpG-island No: 27226
tactaatacccacctcacaaaactatcctaaaacccaacaacccgaaccgcccctcctcccgccttctacccgcctccaaccaacccaaacccgcacctacgcaacaactaaatcttatcgcgataacgatcgtaaaaaaaattaacctaaaactcgacatcgaccccgaccccgctaccgtcaaacgcccccctcgaaccgacccgaaccgaaacgcactaaaaaaacgcgcaactacgcgaataacacgaaccccaaacccaaaacgcgactacgcaccgcgcacaaaccccgataaaaaccgaccacctacaaaaccgccgatcccgcgccacccgcaaccgccaccaccacaacaaccataaccgcccccgcctcctcctcctcctcaaacgcgtcgacctcgacccgcgacccgcgcgcccgctccatcccgctccgaatacgccgcgcccgcgctccgacaccgaaattccgcgcgccaaaaattccgaacgcgaaataacgacgaaacgaaacgaaaaaaaaaaaacgcgccgctctaaccccgacactacgcgctctcgccgccctatatataccacgacccgcctc

SEQ ID NO: 27227 - DNA, 595 bp, Artificial Sequence
  chemically treated genomic DNA (Homo sapiens) CpG-island No: 27227
tattagtgtttattttatagggttgttttaaggtttagtagttcgggtcgttttttttttcgttttttgttcgtttttagttaatttaggttcgtatttgcgtagtagttggattttgtcgcggtagcggtcgtaaaaagggttggtttggagttcggtatcggtttcgatttcgttgtcgttaggcgtttttttcgggtcggttcgagtcggggcgtattgggaagacgcgtagttgcgcgggtgatacgagttttaggtttagggcgcggttgcgtatcgcgtataggtttcggtagagatcggttatttgtaggatcgtcggtttcgcgttattcgtagtcgttattattatagtagttatggtcgttttcgttttttttttttttttaggcgcgtcggtttcggttcgcggttcgcgcgttcgttttatttcgtttcgagtgcgtcgcgttcgcgtttcggtatcgaggtttcgcgcgttaaaggtttcgggcgcgggatagcggcgaggcggggcggggaggagggggcgcgtcgttttggtttcggtattgcgcgttttcgtcgttttgtgtatgttacggttcgtttt

SEQ ID NO: 27228 - DNA, 595 bp, Artificial Sequence
  chemically treated genomic DNA (Homo sapiens) CpG-island No: 27228
aaaacgaaccgtaacatacacaaaacgacgaaaacgcgcaataccgaaaccaaaacgacgcgccccctcctccccgccccgcctcgccgctatcccgcgcccgaaacctttaacgcgcgaaacctcgataccgaaacgcgaacgcgacgcactcgaaacgaaataaaacgaacgcgcgaaccgcgaaccgaaaccgacgcgcctaaaaaaaaaaaaaaaacgaaaacgaccataactactataataataacgactacgaataacgcgaaaccgacgatcctacaaataaccgatctctaccgaaacctatacgcgatacgcaaccgcgccctaaacctaaaactcgtatcacccgcgcaactacgcgtcttcccaatacgccccgactcgaaccgacccgaaaaaaacgcctaacgacaacgaaatcgaaaccgataccgaactccaaaccaaccctttttacgaccgctaccgcgacaaaatccaactactacgcaaatacgaacctaaattaactaaaaacgaacaaaaaacgaaaaaaaaaacgacccgaactactaaaccttaaaacaaccctataaaataaacactaata

SEQ ID NO: 27229 - DNA, 554 bp, Artificial Sequence
  chemically treated genomic DNA (Homo sapiens) CpG-island No: 27229
aacggtgttttagcgtttagagtattcgttttgttttagtgtcgagtagtataatttagaggatgattatgttttgttcgagtacgagcggtttggtttcgatcgttttggcgatatcgatcgtcgttattagtatcggtagaacggttatgaggttgattttatagggaatgatgtttagttggtttattttttatcgtgcgattaatcggttagatatcgggatacgtttagttacgtagggattatggttgttcgttgattagttatcgttatgttgaaaatggttatgggtttcgttgtttcggcgatcgtagtgttgttatttatattggtaattattcggttgggtggagttatagggattgtcggcgatgtcgggtgttttcgtttcggcgatcgtcggtaattcggtcgtcggattgatgtttatgtcgtcgttgtcgattttcgggttattcggtattgttttgttttcgaattagatggtaatgcgttcgaatagttttatgttagtattttcgatcggttgtttatacgatatacgtttttcg

SEQ ID NO: 27230 - DNA, 554 bp, Artificial Sequence
  chemically treated genomic DNA (Homo sapiens) CpG-island No: 27230
cgaaaaacgtatatcgtataaacaaccgatcgaaaatactaacataaaactattcgaacgcattaccatctaattcgaaaacaaaacaataccgaataacccgaaaatcgacaacgacgacataaacatcaatccgacgaccgaattaccgacgatcgccgaaacgaaaacacccgacatcgccgacaatccctataactccacccaaccgaataattaccaatataaataacaacactacgatcgccgaaacaacgaaacccataaccattttcaacataacgataactaatcaacgaacaaccataatccctacgtaactaaacgtatcccgatatctaaccgattaatcgcacgataaaaaataaaccaactaaacatcattccctataaaatcaacctcataaccgttctaccgatactaataacgacgatcgatatcgccaaaacgatcgaaaccaaaccgctcgtactcgaacaaaacataatcatcctctaaattatactactcgacactaaaacaaaacgaatactctaaacgctaaaacaccgtt

SEQ ID NO: 27231 - DNA, 554 bp, Artificial Sequence
  chemically treated genomic DNA (Homo sapiens) CpG-island No: 27231
cgaaaaacgtatatcgtgtgaatagtcgatcgggagtgttgatatgagattgttcgagcgtattgttatttggttcgaagataggataatgtcggataattcggggatcggtagcgacggtatggatattaattcggcgatcggattgtcgacgatcgtcggggcggagatattcgatatcgtcggtaatttttatggttttatttagtcgaatgattgttagtgtgaatggtagtattacgatcgtcgggatagcgggatttataattatttttagtataacgatagttggttaacgagtagttatggtttttgcgtagttaagcgtatttcggtgtttgatcgattagtcgtacgatgggaggtgagttaattgagtattattttttatgggattagttttatggtcgttttatcgatgttgatagcgacgatcggtatcgttaaggcgatcgggattaggtcgttcgtgttcgggtaaagtatggttattttttggattgtgttgttcggtattgagatagggcggatattttggacgttgaagtatcgtt

SEQ ID NO: 27232 - DNA, 554 bp, Artificial Sequence
  chemically treated genomic DNA (Homo sapiens) CpG-island No: 27232
aacgatacttcaacgtccaaaatatccgccctatctcaataccgaacaacacaatccaaaaaataaccatactttacccgaacacgaacgacctaatcccgatcgccttaacgataccgatcgtcgctatcaacatcgataaaacgaccataaaactaatcccataaaaaataatactcaattaactcacctcccatcgtacgactaatcgatcaaacaccgaaatacgcttaactacgcaaaaaccataactactcgttaaccaactatcgttatactaaaaataattataaatcccgctatcccgacgatcgtaatactaccattcacactaacaatcattcgactaaataaaaccataaaaattaccgacgatatcgaatatctccgccccgacgatcgtcgacaatccgatcgccgaattaatatccataccgtcgctaccgatccccgaattatccgacattatcctatcttcgaaccaaataacaatacgctcgaacaatctcatatcaacactcccgatcgactattcacacgatatacgtttttcg

SEQ ID NO: 27233 - DNA, 688 bp, Artificial Sequence
  chemically treated genomic DNA (Homo sapiens) CpG-island No: 27233
ggtagagcgcggcggtagtagtagcggcggtcgggtcgtgagcgatttcgggcgatatagtagagtgttggcggtttaggggcgcgtggtagtattgcgagtcgaagggtgggaaggaagttttgagtagaggtagcgcgggcggttcggggggtttatgtagttgcgaggcggtgacgtagagcgggtatacgtatagtagtttagttttgcgcgcgtggtaggcgttaggcgagagatcgtgtagcgcgtgcggcgggggtatagcgtaggggaagagcggcggcgggttgttttcgggcgtttttttttcgttcgtttcgcgtagtattagcgagtttattaggaaggagcgcggtatggtttcggcgcgcggtcgtttcgtagttagttcgttttttgcgtttatcgtatttttcggttttttacgcgttttttttggtcgcggtatttcgtagttgtttttgtttaggaggttgaacgcgcggttgagatttaggttgaaatagtagtttttgttgtcgtgggtatcgtttaaagagcgcggggtgttggttagcgttagtggtgttgaaaggcgtcggcggcgcggtttaaataggattattgttatgtgatggattacgttaggagcggtcggggttttttaatagggtttttgtgtttttttttttggtatttattttgt

SEQ ID NO: 27234 - DNA, 688 bp, Artificial Sequence
  chemically treated genomic DNA (Homo sapiens) CpG-island No: 27234
acaaaataaataccaaaaaaaaaaacacaaaaaccctattaaaaaaccccgaccgctcctaacgtaatccatcacataacaataatcctatttaaaccgcgccgccgacgcctttcaacaccactaacgctaaccaacaccccgcgctctttaaacgatacccacgacaacaaaaactactatttcaacctaaatctcaaccgcgcgttcaacctcctaaacaaaaacaactacgaaataccgcgaccaaaaaaaacgcgtaaaaaaccgaaaaatacgataaacgcaaaaaacgaactaactacgaaacgaccgcgcgccgaaaccataccgcgctccttcctaataaactcgctaatactacgcgaaacgaacgaaaaaaaaacgcccgaaaacaacccgccgccgctcttcccctacgctatacccccgccgcacgcgctacacgatctctcgcctaacgcctaccacgcgcgcaaaactaaactactatacgtatacccgctctacgtcaccgcctcgcaactacataaaccccccgaaccgcccgcgctacctctactcaaaacttccttcccacccttcgactcgcaatactaccacgcgcccctaaaccgccaacactctactatatcgcccgaaatcgctcacgacccgaccgccgctactactaccgccgcgctctacc

SEQ ID NO: 27235 - DNA, 688 bp, Artificial Sequence
  chemically treated genomic DNA (Homo sapiens) CpG-island No: 27235
gtagagtgaatgttaagagaaaaggtataaaaattttattgagaggtttcggtcgtttttggcgtagtttattatatggtaatagttttatttaagtcgcgtcgtcggcgttttttagtattattagcgttggttagtatttcgcgttttttgggcggtgtttacggtagtagaggttattgttttagtttaggttttagtcgcgcgtttagttttttgggtagaggtagttgcgggatatcgcggttagggaaagcgcgtggagagtcgaaaggtgcggtgggcgtagagggcgggttggttgcggggcgatcgcgcgtcggggttatgtcgcgtttttttttggtggattcgttagtgttgcgcgaggcgggcgagaagaaggcgttcgagggtagttcgtcgtcgttttttttttacgttgtgttttcgtcgtacgcgttgtacggtttttcgtttggcgtttgttacgcgcgtaaggttgggttgttgtgcgtgtgttcgttttgcgttatcgtttcgtagttgtatgggtttttcgggtcgttcgcgttgtttttgtttaaggttttttttttatttttcggttcgtagtattgttacgcgtttttgggtcgttagtattttgttgtgtcgttcggggtcgtttacggttcggtcgtcgttgttgttgtcgtcgcgttttatt

SEQ ID NO: 27236 - DNA, 688 bp, Artificial Sequence
  chemically treated genomic DNA (Homo sapiens) CpG-island No: 27236
aataaaacgcgacgacaacaacaacgacgaccgaaccgtaaacgaccccgaacgacacaacaaaatactaacgacccaaaaacgcgtaacaatactacgaaccgaaaaataaaaaaaaaaccttaaacaaaaacaacgcgaacgacccgaaaaacccatacaactacgaaacgataacgcaaaacgaacacacgcacaacaacccaaccttacgcgcgtaacaaacgccaaacgaaaaaccgtacaacgcgtacgacgaaaacacaacgtaaaaaaaaaacgacgacgaactaccctcgaacgccttcttctcgcccgcctcgcgcaacactaacgaatccaccaaaaaaaaacgcgacataaccccgacgcgcgatcgccccgcaaccaacccgccctctacgcccaccgcacctttcgactctccacgcgctttccctaaccgcgatatcccgcaactacctctacccaaaaaactaaacgcgcgactaaaacctaaactaaaacaataacctctactaccgtaaacaccgcccaaaaaacgcgaaatactaaccaacgctaataatactaaaaaacgccgacgacgcgacttaaataaaactattaccatataataaactacgccaaaaacgaccgaaacctctcaataaaatttttataccttttctcttaacattcactctac

SEQ ID NO: 27237 - DNA, 724 bp, Artificial Sequence
  chemically treated genomic DNA (Homo sapiens) CpG-island No: 27237
ttttgtattacggtggtcggaattagtaaacgttaatagtcggaggtcgttcgtttttcgggcgtttgtaggcggcgggtatcgggcgtcgatttttttttttggattagatttatattcgagtttacgttagtttcgtagttcgggcgagcgaagatagtcgcgaaggattaaggtttcggggcgagttgtggcgtcgtttcggtcgtttttcggggcgcggcgttgatttatatttagttgacgttcgtatttgaggcggttgttcgtagttagcgagagggcgcgtagcgaggcgggtagggtaaagttatttattgggaaagcgcggttgttcgggtcgcgtacgggtttttggcgtcgttgttcggtattagttttcgtttttcgcggttcgttgagggagcggagagtttgttcggtttcgtttcgttaggaatcgtcgtcgtcgtcgtcgtcgtcgcggattttttggtaaaaagtaaatttcggttaagattttattttttaatcgtttttgttgttttttcgggggtagcgttaaggtcgagcggtttaattcgtattcgggttaatcggaggtagtatagggcgggaggtgggcggattagagggcggttttatttattcgagagttcgggaggcgggttagaagggattcgttattttcgggttagagtgagattatttcgtttttggcgtttcgtttttttaatcgtttcgg

SEQ ID NO: 27238 - DNA, 724 bp, Artificial Sequence
  chemically treated genomic DNA (Homo sapiens) CpG-island No: 27238
ccgaaacgattaaaaaaacgaaacgccaaaaacgaaataatctcactctaacccgaaaataacgaatcccttctaacccgcctcccgaactctcgaataaataaaaccgccctctaatccgcccacctcccgccctatactacctccgattaacccgaatacgaattaaaccgctcgaccttaacgctacccccgaaaaaacaacaaaaacgattaaaaaataaaatcttaaccgaaatttactttttaccaaaaaatccgcgacgacgacgacgacgacgacgattcctaacgaaacgaaaccgaacaaactctccgctccctcaacgaaccgcgaaaaacgaaaactaataccgaacaacgacgccaaaaacccgtacgcgacccgaacaaccgcgctttcccaataaataactttaccctacccgcctcgctacgcgccctctcgctaactacgaacaaccgcctcaaatacgaacgtcaactaaatataaatcaacgccgcgccccgaaaaacgaccgaaacgacgccacaactcgccccgaaaccttaatccttcgcgactatcttcgctcgcccgaactacgaaactaacgtaaactcgaatataaatctaatccaaaaaaaaaaatcgacgcccgatacccgccgcctacaaacgcccgaaaaacgaacgacctccgactattaacgtttactaattccgaccaccgtaatacaaaa

SEQ ID NO: 27239 - DNA, 724 bp, Artificial Sequence
  chemically treated genomic DNA (Homo sapiens) CpG-island No: 27239
tcggggcgattagggaagcgggacgttaagggcggagtggttttattttaattcgggagtgacgggttttttttggttcgtttttcgagttttcggataggtggagtcgttttttggttcgtttatttttcgttttgtgttattttcgattggttcgggtgcgggttgggtcgttcggttttggcgttgttttcgggaaggtagtaggggcggttgagaagtgaagttttggtcggagtttgttttttgttaggaaattcgcggcggcggcggcggcggcggcgatttttggcggagcggagtcgggtaggtttttcgtttttttagcgggtcgcggagagcgggagttggtgtcgagtagcggcgttaggagttcgtgcgcggttcgggtagtcgcgtttttttagtgagtaattttgttttgttcgtttcgttgcgcgttttttcgttggttgcgggtagtcgttttaggtgcgggcgttagttgggtgtgggttagcgtcgcgtttcgggaggcggtcggagcggcgttatagttcgtttcggagttttggtttttcgcggttgttttcgttcgttcgggttgcggggttggcgtggattcgggtgtgggtttggtttaggagggagagtcggcgttcggtgttcgtcgtttgtaggcgttcgggaggcgggcggttttcggttgttagcgtttgttggtttcggttatcgtggtgtagag

SEQ ID NO: 27240 - DNA, 724 bp, Artificial Sequence
  chemically treated genomic DNA (Homo sapiens) CpG-island No: 27240
ctctacaccacgataaccgaaaccaacaaacgctaacaaccgaaaaccgcccgcctcccgaacgcctacaaacgacgaacaccgaacgccgactctccctcctaaaccaaacccacacccgaatccacgccaaccccgcaacccgaacgaacgaaaacaaccgcgaaaaaccaaaactccgaaacgaactataacgccgctccgaccgcctcccgaaacgcgacgctaacccacacccaactaacgcccgcacctaaaacgactacccgcaaccaacgaaaaaacgcgcaacgaaacgaacaaaacaaaattactcactaaaaaaacgcgactacccgaaccgcgcacgaactcctaacgccgctactcgacaccaactcccgctctccgcgacccgctaaaaaaacgaaaaacctacccgactccgctccgccaaaaatcgccgccgccgccgccgccgccgcgaatttcctaacaaaaaacaaactccgaccaaaacttcacttctcaaccgcccctactaccttcccgaaaacaacgccaaaaccgaacgacccaacccgcacccgaaccaatcgaaaataacacaaaacgaaaaataaacgaaccaaaaaacgactccacctatccgaaaactcgaaaaacgaaccaaaaaaaacccgtcactcccgaattaaaataaaaccactccgcccttaacgtcccgcttccctaatcgccccga

SEQ ID NO: 27241 - DNA, 630 bp, Artificial Sequence
  chemically treated genomic DNA (Homo sapiens) CpG-island No: 27241
tacgtaacgagcggttgcgattttttagtttttaattttgtttttaagtgcgtttcgagcgttattcggcgttgttttcgtattatttcgtgattcgatataaattacggtgagtaggggttttcgttttagtattttattttttatcgttaacgtcgattttaatttcgatagtgcgcgcgtcgtcgtatttatttgtagggtatcggttagtggcgtcgggaggggatgttcgagattcgggattagttcggaattatcgcgagttaaagtagcgttagggtttagtattaggaagcgcgttttcgagtcgcgttcgcgtttcgtcgtatttcggcgttttgtgtcgtgtttattttttgcgttattaggttgtatttagtattttcggagtttttcgaggtttgcgacgtcggtgggaggagtatgcgcggagtcgttagttcgggacgcggggcgttttgtttttgcgcgttagttttagagtttggttttaagcgtaggtttcggcgtatgatattttttcgcgttcggttcgcggcggtttttatattttgtagtttaggaaggtgttttggtttggtttttaggagaattcgatttagatttggggcgttattttttatgaat

SEQ ID NO: 27242 - DNA, 630 bp, Artificial Sequence
  chemically treated genomic DNA (Homo sapiens) CpG-island No: 27242
attcataaaaaataacgccccaaatctaaatcgaattctcctaaaaaccaaaccaaaacaccttcctaaactacaaaatataaaaaccgccgcgaaccgaacgcgaaaaaatatcatacgccgaaacctacgcttaaaaccaaactctaaaactaacgcgcaaaaacaaaacgccccgcgtcccgaactaacgactccgcgcatactcctcccaccgacgtcgcaaacctcgaaaaactccgaaaatactaaatacaacctaataacgcaaaaaataaacacgacacaaaacgccgaaatacgacgaaacgcgaacgcgactcgaaaacgcgcttcctaatactaaaccctaacgctactttaactcgcgataattccgaactaatcccgaatctcgaacatcccctcccgacgccactaaccgataccctacaaataaatacgacgacgcgcgcactatcgaaattaaaatcgacgttaacgataaaaaataaaatactaaaacgaaaacccctactcaccgtaatttatatcgaatcacgaaataatacgaaaacaacgccgaataacgctcgaaacgcacttaaaaacaaaattaaaaactaaaaaatcgcaaccgctcgttacgta

SEQ ID NO: 27243 - DNA, 630 bp, Artificial Sequence
  chemically treated genomic DNA (Homo sapiens) CpG-island No: 27243
gtttataaaagatgacgttttaggtttggatcgaatttttttgggagttagattaaagtatttttttggattgtaaagtgtggaagtcgtcgcgggtcgggcgcggggaggtgttatgcgtcggaatttgcgtttggggttaagttttggagttgacgcgtaggggtaaggcgtttcgcgtttcggattggcggtttcgcgtatgttttttttatcggcgtcgtaggtttcgagaggtttcggaagtattgggtgtagtttgatggcgtaggaggtagatacggtatagggcgtcgagatgcggcggggcgcgggcgcggttcggggacgcgttttttggtgttgggttttggcgttgttttggttcgcggtggtttcgggttggtttcgggtttcgggtattttttttcggcgttattggtcggtgttttataagtgagtgcggcggcgcgcgtattgtcggggttggggtcggcgttgacgatgggggatggggtgttggggcggggatttttgtttatcgtggtttgtgtcgggttacgagatggtgcggggatagcgtcgggtgacgttcggagcgtatttgagagtaaagttgaggattggggagtcgtagtcgttcgttacgtg

SEQ ID NO: 27244 - DNA, 630 bp, Artificial Sequence
  chemically treated genomic DNA (Homo sapiens) CpG-island No: 27244
cacgtaacgaacgactacgactccccaatcctcaactttactctcaaatacgctccgaacgtcacccgacgctatccccgcaccatctcgtaacccgacacaaaccacgataaacaaaaatccccgccccaacaccccatcccccatcgtcaacgccgaccccaaccccgacaatacgcgcgccgccgcactcacttataaaacaccgaccaataacgccgaaaaaaaatacccgaaacccgaaaccaacccgaaaccaccgcgaaccaaaacaacgccaaaacccaacaccaaaaaacgcgtccccgaaccgcgcccgcgccccgccgcatctcgacgccctataccgtatctacctcctacgccatcaaactacacccaatacttccgaaacctctcgaaacctacgacgccgataaaaaaaacatacgcgaaaccgccaatccgaaacgcgaaacgccttacccctacgcgtcaactccaaaacttaaccccaaacgcaaattccgacgcataacacctccccgcgcccgacccgcgacgacttccacactttacaatccaaaaaaatactttaatctaactcccaaaaaaattcgatccaaacctaaaacgtcatcttttataaac

SEQ ID NO: 27245 - DNA, 854 bp, Artificial Sequence
  chemically treated genomic DNA (Homo sapiens) CpG-island No: 27245
ggtgtacgtgattcggcgttgtacggtggtgtcggtgttcgattcgttgttttggcgtatgtttacgtagtagtagtcgtaggagttagttcgggatagtaaaggtcgtttttttttggatcgggacggttttttttttcgttatattttggattatttgcgggatttgtagttcgtgttgttcgattattttttcgagcgtagtcggttgtagcgcgaggtcgagtatttcgagttgttagagttcgtgcgtcgtttcggggcgttttagtagttcggttcggggtcgtcgttttcgcggcgcggggtgtataaggagggttcgttgggtgacgagttgttgtcgtttggttattcggagttcgaatagtaggagggcgtttttgtcggggcgtcgtcgtttacgttggagttggttagtcgtagttcgttcgggggcgcggcgggttcgttgtttacgtcgttttagtcgttggacggtagtcggcgttcgggttatattattatcggttatcgcggtttttatattatcgggcgggacgcgtaggcggacgttaagtttcggcgagtggcgcgtattatcgtttgcggaaagacgtcgttggttaaggaggtgtttggggatattttgaacgaaagtcgggatttcgatcgtttttcggagcgttatatttcgcgttattattttaagtttaattttttggagtaggttttcgataagttgttcgagtcgggtttttatatggtggcgtgtagttttacgggtatttgcgtttttgttagtagtatcgattagagcgaggataagatttggattagttatatcgagtacgttttttgtagggagtgagttt

SEQ ID NO: 27246 - DNA, 854 bp, Artificial Sequence
  chemically treated genomic DNA (Homo sapiens) CpG-island No: 27246
aaactcactccctacaaaaaacgtactcgatataactaatccaaatcttatcctcgctctaatcgatactactaacaaaaacgcaaatacccgtaaaactacacgccaccatataaaaacccgactcgaacaacttatcgaaaacctactccaaaaaattaaacttaaaataataacgcgaaatataacgctccgaaaaacgatcgaaatcccgactttcgttcaaaatatccccaaacacctccttaaccaacgacgtctttccgcaaacgataatacgcgccactcgccgaaacttaacgtccgcctacgcgtcccgcccgataatataaaaaccgcgataaccgataataatataacccgaacgccgactaccgtccaacgactaaaacgacgtaaacaacgaacccgccgcgcccccgaacgaactacgactaaccaactccaacgtaaacgacgacgccccgacaaaaacgccctcctactattcgaactccgaataaccaaacgacaacaactcgtcacccaacgaaccctccttatacaccccgcgccgcgaaaacgacgaccccgaaccgaactactaaaacgccccgaaacgacgcacgaactctaacaactcgaaatactcgacctcgcgctacaaccgactacgctcgaaaaaataatcgaacaacacgaactacaaatcccgcaaataatccaaaatataacgaaaaaaaaaaccgtcccgatccaaaaaaaaacgacctttactatcccgaactaactcctacgactactactacgtaaacatacgccaaaacaacgaatcgaacaccgacaccaccgtacaacgccgaatcacgtacacc

SEQ ID NO: 27247 - DNA, 854 bp, Artificial Sequence
  chemically treated genomic DNA (Homo sapiens) CpG-island No: 27247
gagtttattttttgtagaagacgtattcggtgtagttggtttagattttgttttcgttttggtcggtgttgttggtaaaggcgtaggtgttcgtggagttgtacgttattatgtggaagttcgattcggatagtttgtcgaaggtttgttttaggaagttgaatttgaggtaatagcgcgaggtgtagcgtttcgggggacggtcggggtttcggttttcgtttagggtgtttttaaatatttttttggttagcgacgttttttcgtaaacggtgatgcgcgttattcgtcggaatttggcgttcgtttgcgcgtttcgttcgatggtgtaggagtcgcggtagtcgatggtgatgtagttcgagcgtcggttgtcgtttagcgattgggacggcgtgagtagcgggttcgtcgcgttttcggacggattgcggttagttagttttagcgtgggcgacggcgtttcggtagaggcgtttttttgttgttcgggtttcgagtagttaagcggtagtagttcgttatttagcgagttttttttgtgtatttcgcgtcgcgagggcggcggtttcgggtcgggttgttggggcgtttcgaggcggcgtacgagttttggtagttcgaagtattcggtttcgcgttgtagtcggttgcgttcggggaagtagtcgggtagtacgagttgtaagtttcgtaggtaatttaggatgtagcggaagaggaagtcgtttcggtttagaaagaagcggtttttgttgtttcgggttagtttttgcggttgttgttgcgtgaatatgcgttagagtagcgagtcgggtatcgatattatcgtgtagcgtcgggttacgtatatt

SEQ ID NO: 27248 - DNA, 854 bp, Artificial Sequence
  chemically treated genomic DNA (Homo sapiens) CpG-island No: 27248
aatatacgtaacccgacgctacacgataatatcgatacccgactcgctactctaacgcatattcacgcaacaacaaccgcaaaaactaacccgaaacaacaaaaaccgcttctttctaaaccgaaacgacttcctcttccgctacatcctaaattacctacgaaacttacaactcgtactacccgactacttccccgaacgcaaccgactacaacgcgaaaccgaatacttcgaactaccaaaactcgtacgccgcctcgaaacgccccaacaacccgacccgaaaccgccgccctcgcgacgcgaaatacacaaaaaaaactcgctaaataacgaactactaccgcttaactactcgaaacccgaacaacaaaaaaacgcctctaccgaaacgccgtcgcccacgctaaaactaactaaccgcaatccgtccgaaaacgcgacgaacccgctactcacgccgtcccaatcgctaaacgacaaccgacgctcgaactacatcaccatcgactaccgcgactcctacaccatcgaacgaaacgcgcaaacgaacgccaaattccgacgaataacgcgcatcaccgtttacgaaaaaacgtcgctaaccaaaaaaatatttaaaaacaccctaaacgaaaaccgaaaccccgaccgtcccccgaaacgctacacctcgcgctattacctcaaattcaacttcctaaaacaaaccttcgacaaactatccgaatcgaacttccacataataacgtacaactccacgaacacctacgcctttaccaacaacaccgaccaaaacgaaaacaaaatctaaaccaactacaccgaatacgtcttctacaaaaaataaactc

SEQ ID NO: 27249 - DNA, 868 bp, Artificial Sequence
  chemically treated genomic DNA (Homo sapiens) CpG-island No: 27249
acgcgtatatagttgggtacgttttcgggaggtagttgtcggttcgggcgttttgggggtcgggcggcggtcgtgatagcgttagtcgcggggagcggggcgttcgtatagtttggtatcggaggttcgaggacgtaggaagggaagattttagttatattgagtgttgtttttttgggcggattgggagggagcgggttgttcgaggagttgttatcgaggacgttcgaagtttcgttttttgcgcgtagggttcggggttgcgtcggtgttttcgtggggtaaggaggatgcgtattttttttcgtagagcggttgcggttttcggtattgcgcggatttcggtttttgcggtcgttcgtgtcgtgttcgcgttacgggagcgcgttttgtcgtatttggttttagtttttcggggaagtgtaggaaacgcgttttaaattttattatttttcgttcgtttgttttttcgttcggtttttcgttttagatttcgtcgtcgtcgtcgtcgtcgtcgtcgtttgcgtgtggggttcgttcgcgttttatttatacgcgttacgtatagttttgttggtttgtttttatttacgtcgattcgtttttcgtcgagtttagttcgggtattcgaaattattggattaattgtcgttcggatcgtagtagcggtcgggtgatttttacgcgattcgtcgtcgattttcgcgttttgaggttttcgttcgcgtcgttatcgtcggggattacggtgagtaaggcgcgttgttcgtttcgcgcgggggaggggttttgagatttttagatttggggggaaatgagaaggggtaaatcgttaaagggaagtattcgggtgatgttagtaaaaaag

SEQ ID NO: 27250 - DNA, 868 bp, Artificial Sequence
  chemically treated genomic DNA (Homo sapiens) CpG-island No: 27250
cttttttactaacatcacccgaatacttccctttaacgatttaccccttctcatttccccccaaatctaaaaatctcaaaacccctcccccgcgcgaaacgaacaacgcgccttactcaccgtaatccccgacgataacgacgcgaacgaaaacctcaaaacgcgaaaatcgacgacgaatcgcgtaaaaatcacccgaccgctactacgatccgaacgacaattaatccaataatttcgaatacccgaactaaactcgacgaaaaacgaatcgacgtaaataaaaacaaaccaacaaaactatacgtaacgcgtataaataaaacgcgaacgaaccccacacgcaaacgacgacgacgacgacgacgacgacgaaatctaaaacgaaaaaccgaacgaaaaaacaaacgaacgaaaaataataaaatttaaaacgcgtttcctacacttccccgaaaaactaaaaccaaatacgacaaaacgcgctcccgtaacgcgaacacgacacgaacgaccgcaaaaaccgaaatccgcgcaataccgaaaaccgcaaccgctctacgaaaaaaaatacgcatcctccttaccccacgaaaacaccgacgcaaccccgaaccctacgcgcaaaaaacgaaacttcgaacgtcctcgataacaactcctcgaacaacccgctccctcccaatccgcccaaaaaaacaacactcaatataactaaaatcttcccttcctacgtcctcgaacctccgataccaaactatacgaacgccccgctccccgcgactaacgctatcacgaccgccgcccgacccccaaaacgcccgaaccgacaactacctcccgaaaacgtacccaactatatacgcgt

SEQ ID NO: 27251 - DNA, 868 bp, Artificial Sequence
  chemically treated genomic DNA (Homo sapiens) CpG-island No: 27251
tttttttgttggtattattcggatgtttttttttggcgatttgtttttttttatttttttttaaatttagaggttttaaagtttttttttcgcgcgaggcgggtagcgcgttttgtttatcgtggttttcggcggtggcggcgcgggcgggagttttagggcgcgggggtcggcggcgggtcgcgtgggggttattcggtcgttgttgcggttcggacggtagttggtttagtagtttcggatgttcgggttaggttcggcggagagcgagtcggcgtgaatgagagtaaattaatagggttgtgcgtggcgcgtgtgagtaagacgcgagcgggttttatacgtaggcggcggcggcggcggcggcggcggcgaggtttgaggcggggagtcgggcgggggggtaggcgggcgagaagtagtggagtttagggcgcgttttttgtattttttcgagaggttggaattaggtgcggtagggcgcgttttcgtggcgcgggtacggtacgggcggtcgtaggagtcggagttcgcgtagtgtcggagatcgtagtcgttttgcggggggaggtgcgtattttttttgttttacgagggtatcggcgtagtttcggattttgcgcgtagagggcgagatttcgggcgttttcggtgatagtttttcgggtagttcgtttttttttaattcgtttaaaagagtaatatttagtgtgattgggattttttttttttgcgttttcgagttttcggtgttaagttgtgcgggcgtttcgtttttcgcggttggcgttgttacggtcgtcgttcggtttttagagcgttcgagtcggtagttgtttttcggagacgtgtttagttgtgtgcgcgt

SEQ ID NO: 27252 - DNA, 868 bp, Artificial Sequence
  chemically treated genomic DNA (Homo sapiens) CpG-island No: 27252
acgcgcacacaactaaacacgtctccgaaaaacaactaccgactcgaacgctctaaaaaccgaacgacgaccgtaacaacgccaaccgcgaaaaacgaaacgcccgcacaacttaacaccgaaaactcgaaaacgcaaaaaaaaaaaatcccaatcacactaaatattactcttttaaacgaattaaaaaaaaacgaactacccgaaaaactatcaccgaaaacgcccgaaatctcgccctctacgcgcaaaatccgaaactacgccgataccctcgtaaaacaaaaaaaatacgcacctccccccgcaaaacgactacgatctccgacactacgcgaactccgactcctacgaccgcccgtaccgtacccgcgccacgaaaacgcgccctaccgcacctaattccaacctctcgaaaaaatacaaaaaacgcgccctaaactccactacttctcgcccgcctacccccccgcccgactccccgcctcaaacctcgccgccgccgccgccgccgccgccgcctacgtataaaacccgctcgcgtcttactcacacgcgccacgcacaaccctattaatttactctcattcacgccgactcgctctccgccgaacctaacccgaacatccgaaactactaaaccaactaccgtccgaaccgcaacaacgaccgaataacccccacgcgacccgccgccgacccccgcgccctaaaactcccgcccgcgccgccaccgccgaaaaccacgataaacaaaacgcgctacccgcctcgcgcgaaaaaaaaactttaaaacctctaaatttaaaaaaaaataaaaaaaaacaaatcgccaaaaaaaaacatccgaataataccaacaaaaaaa

SEQ ID NO: 27253 - DNA, 727 bp, Artificial Sequence
  chemically treated genomic DNA (Homo sapiens) CpG-island No: 27253
ttcgggtcggggttttattcgtttttttagcgtttcggttgttatcgcgcgggggtcggtcgagtcgtagcgttcggtttttgggggcgacgtttttaggtttcgcgtcggtttttgggagtcgggttcgtgcggcggacggttaggttttttcgttagtaaacggttgtttggggcgtttcgatcgttttttcgttttacggtagaaggcggcggcgcgcgaggggaggggagggtaggtcgggtgattgcgatttcgcgtgtttatttgttggttcgcgaggttgagggagggggcgtcgggggcggggttagagcgcggttggttaatgggggagcgtattcggcggtcggttaaattttttttggaaagtgaagggggttggggtcgaggggaaagttcgaagtttcggagtagcggagggttttggtggcggttagaattattcggggatagttgtaggcgtaggggtaagatcgggggatcggaagacgttagtcgcggtcgcggtcgttttcgttagggacggtaggtttaattttggttgttttttttttttcgggtttcgtcgggttattttttcgttatcgttggttcgatagcgttatttgttggacgtcggtttttacgttcggcgcgtcggggttcgaagttttcggaggttgggattttagtttgggaggggaaggagtttatttattttaggtttagcggttttagagttgg

SEQ ID NO: 27254 - DNA, 727 bp, Artificial Sequence
  chemically treated genomic DNA (Homo sapiens) CpG-island No: 27254
ccaactctaaaaccgctaaacctaaaataaataaactccttcccctcccaaactaaaatcccaacctccgaaaacttcgaaccccgacgcgccgaacgtaaaaaccgacgtccaacaaataacgctatcgaaccaacgataacgaaaaaataacccgacgaaacccgaaaaaaaaaaaacaaccaaaattaaacctaccgtccctaacgaaaacgaccgcgaccgcgactaacgtcttccgatcccccgatcttacccctacgcctacaactatccccgaataattctaaccgccaccaaaaccctccgctactccgaaacttcgaactttcccctcgaccccaacccccttcactttccaaaaaaaatttaaccgaccgccgaatacgctcccccattaaccaaccgcgctctaaccccgcccccgacgccccctccctcaacctcgcgaaccaacaaataaacacgcgaaatcgcaatcacccgacctaccctcccctcccctcgcgcgccgccgccttctaccgtaaaacgaaaaaacgatcgaaacgccccaaacaaccgtttactaacgaaaaaacctaaccgtccgccgcacgaacccgactcccaaaaaccgacgcgaaacctaaaaacgtcgcccccaaaaaccgaacgctacgactcgaccgacccccgcgcgataacaaccgaaacgctaaaaaaacgaataaaaccccgacccgaa

SEQ ID NO: 27255 - DNA, 727 bp, Artificial Sequence
  chemically treated genomic DNA (Homo sapiens) CpG-island No: 27255
ttagttttgaagtcgttggatttggggtgagtgagttttttttttttttagattgaggttttagttttcgagaatttcgggtttcggcgcgtcggacgtggaggtcgacgtttagtaggtggcgttgtcgagttagcgatggcgggagagtggttcggcggggttcgggaagggaggggtagttagggttgggtttatcgtttttggcggaggcggtcgcggtcgcggttggcgtttttcggtttttcgattttgtttttgcgtttgtaattgttttcggatggttttggtcgttattaaagtttttcgttgtttcggagtttcgaatttttttttcgattttagttttttttattttttagggggaatttagtcggtcgtcgaatgcgtttttttattggttagtcgcgttttggtttcgttttcggcgtttttttttttagtttcgcggattagtaggtgagtacgcggagtcgtagttattcggtttgttttttttttttttcgcgcgtcgtcgttttttatcgtgaagcgggagagcgatcgaggcgttttagatagtcgtttgttagcggagggatttgatcgttcgtcgtacgagttcggtttttaaggatcggcgcggggtttaaagacgtcgtttttagaggtcggacgttgcggttcggtcgattttcgcgcggtggtagtcggagcgttagggaaacgagtggagtttcggttcgga

SEQ ID NO: 27256 - DNA, 727 bp, Artificial Sequence
  chemically treated genomic DNA (Homo sapiens) CpG-island No: 27256
tccgaaccgaaactccactcgtttccctaacgctccgactaccaccgcgcgaaaatcgaccgaaccgcaacgtccgacctctaaaaacgacgtctttaaaccccgcgccgatccttaaaaaccgaactcgtacgacgaacgatcaaatccctccgctaacaaacgactatctaaaacgcctcgatcgctctcccgcttcacgataaaaaacgacgacgcgcgaaaaaaaaaaaaaacaaaccgaataactacgactccgcgtactcacctactaatccgcgaaactaaaaaaaaaaacgccgaaaacgaaaccaaaacgcgactaaccaataaaaaaacgcattcgacgaccgactaaattccccctaaaaaataaaaaaaactaaaatcgaaaaaaaaattcgaaactccgaaacaacgaaaaactttaataacgaccaaaaccatccgaaaacaattacaaacgcaaaaacaaaatcgaaaaaccgaaaaacgccaaccgcgaccgcgaccgcctccgccaaaaacgataaacccaaccctaactacccctcccttcccgaaccccgccgaaccactctcccgccatcgctaactcgacaacgccacctactaaacgtcgacctccacgtccgacgcgccgaaacccgaaattctcgaaaactaaaacctcaatctaaaaaaaaaaaaaactcactcaccccaaatccaacgacttcaaaactaa

SEQ ID NO: 27257 - DNA, 940 bp, Artificial Sequence
  chemically treated genomic DNA (Homo sapiens) CpG-island No: 27257
atatgttcgcgttgcggaggggtcgtgaatcgtaattggtgtgcggggtgatcgatatttgttaaagttttagcggaaagaaggcgggcggtgttttggcgttcgtaatatatgacgacgatgtttttgagttttaaggttgggtagtcggcgagagcggcgtatataatattacgtattatttcggtttgacgattaatttcgtggtattggtgtatttcgattgttggtagttttttgcggtgggtaatcgcgttttgcgtagtacggatcgatgacgatgtttatcgcgcggtcgtggtagagcgtgttcggttaaaggttcgttacggattcgtattattaatgttatgatcgagatggacgatggtgacgtcgtgtgaggtcgataacgttttcgttaagttgacgtcgtgttgagtcgtggtcgtcgatgaaaattatacgatcggcggtttagatcgtgattgagtgagtatcgcgtcgacgaggagttggtgtcggtttacggggttcggaatatggtacggtttggtaaggagggtacgttatagcggggtttattacgcgcgggcggggtttagcgggttattcgtaaggttagtatcgttttggtgagatgtgggggcggtatcgtcggtttaggtatttaagacgtcgtgagagtcgcgagttagcgcgtagatcgcgtttgtagtttgtcgtgtagttgtttatgttgtacgcggtattttttgtcgacggttggtttttagatgggttgaaataattttaaaatcgggggaattgtttttaatgatgcggtatatacgtagggttaggggttcgggttgttacggatcgttttttcgtttgatttttaggagatttttttcgagtcgttttcgtagatttagcggcgttgttgtatcgatatcggttgcgattttatgacggcggg

SEQ ID NO: 27258 - DNA, 940 bp, Artificial Sequence
  chemically treated genomic DNA (Homo sapiens) CpG-island No: 27258
cccgccgtcataaaatcgcaaccgatatcgatacaacaacgccgctaaatctacgaaaacgactcgaaaaaaatctcctaaaaatcaaacgaaaaaacgatccgtaacaacccgaacccctaaccctacgtatataccgcatcattaaaaacaattcccccgattttaaaattatttcaacccatctaaaaaccaaccgtcgacaaaaaataccgcgtacaacataaacaactacacgacaaactacaaacgcgatctacgcgctaactcgcgactctcacgacgtcttaaatacctaaaccgacgataccgcccccacatctcaccaaaacgatactaaccttacgaataacccgctaaaccccgcccgcgcgtaataaaccccgctataacgtaccctccttaccaaaccgtaccatattccgaaccccgtaaaccgacaccaactcctcgtcgacgcgatactcactcaatcacgatctaaaccgccgatcgtataattttcatcgacgaccacgactcaacacgacgtcaacttaacgaaaacgttatcgacctcacacgacgtcaccatcgtccatctcgatcataacattaataatacgaatccgtaacgaacctttaaccgaacacgctctaccacgaccgcgcgataaacatcgtcatcgatccgtactacgcaaaacgcgattacccaccgcaaaaaactaccaacaatcgaaatacaccaataccacgaaattaatcgtcaaaccgaaataatacgtaatattatatacgccgctctcgccgactacccaaccttaaaactcaaaaacatcgtcgtcatatattacgaacgccaaaacaccgcccgccttctttccgctaaaactttaacaaatatcgatcaccccgcacaccaattacgattcacgacccctccgcaacgcgaacatat

SEQ ID NO: 27259 - DNA, 940 bp, Artificial Sequence
  chemically treated genomic DNA (Homo sapiens) CpG-island No: 27259
ttcgtcgttatggaatcgtagtcggtatcgatataataacgtcgttgggtttacgagaacgattcgaggaagattttttgggaattaagcgggaaaacgattcgtggtagttcgggtttttggttttgcgtatatgtcgtattattgagaataattttttcggttttgaggttgttttagtttatttggaagttagtcgtcggtaaggagtgtcgcgtgtaatatggataattgtacgataagttgtagacgcgatttgcgcgttagttcgcgatttttacgacgttttgaatgtttgggtcgacggtgtcgtttttatattttattagggcgatattgattttgcgggtgattcgttggatttcgttcgcgcgtggtgggtttcgttgtggcgtattttttttgttaaatcgtgttatgtttcggatttcgtgagtcgatattagtttttcgtcgacgcgatatttatttagttacgatttgaatcgtcgatcgtgtggtttttatcgacgattacggtttagtacgacgttagtttggcggaagcgttgtcggttttatacgacgttattatcgtttatttcgattatggtattggtggtgcggattcgtggcggatttttgatcgggtacgttttgttacgatcgcgcgatggatatcgttatcgattcgtattgcgtagagcgcggttatttatcgtaaagagttgttaatagtcgaaatatattaatgttacggagttgatcgttaggtcgaagtagtacgtgatgttgtatgcgtcgttttcgtcgattatttaattttggaatttagggatatcgtcgttatatgttgcgggcgttaggatatcgttcgtttttttttcgttgggattttggtagatatcgattatttcgtatattagttgcggtttacgattttttcgtaacgcgagtatgt

SEQ ID NO: 27260 - DNA, 940 bp, Artificial Sequence
  chemically treated genomic DNA (Homo sapiens) CpG-island No: 27260
acatactcgcgttacgaaaaaatcgtaaaccgcaactaatatacgaaataatcgatatctaccaaaatcccaacgaaaaaaaaacgaacgatatcctaacgcccgcaacatataacgacgatatccctaaattccaaaattaaataatcgacgaaaacgacgcatacaacatcacgtactacttcgacctaacgatcaactccgtaacattaatatatttcgactattaacaactctttacgataaataaccgcgctctacgcaatacgaatcgataacgatatccatcgcgcgatcgtaacaaaacgtacccgatcaaaaatccgccacgaatccgcaccaccaataccataatcgaaataaacgataataacgtcgtataaaaccgacaacgcttccgccaaactaacgtcgtactaaaccgtaatcgtcgataaaaaccacacgatcgacgattcaaatcgtaactaaataaatatcgcgtcgacgaaaaactaatatcgactcacgaaatccgaaacataacacgatttaacaaaaaaaatacgccacaacgaaacccaccacgcgcgaacgaaatccaacgaatcacccgcaaaatcaatatcgccctaataaaatataaaaacgacaccgtcgacccaaacattcaaaacgtcgtaaaaatcgcgaactaacgcgcaaatcgcgtctacaacttatcgtacaattatccatattacacgcgacactccttaccgacgactaacttccaaataaactaaaacaacctcaaaaccgaaaaaattattctcaataatacgacatatacgcaaaaccaaaaacccgaactaccacgaatcgttttcccgcttaattcccaaaaaatcttcctcgaatcgttctcgtaaacccaacgacgttattatatcgataccgactacgattccataacgacgaa

SEQ ID NO: 27261 - DNA, 1267 bp, Artificial Sequence
  chemically treated genomic DNA (Homo sapiens) CpG-island No: 27261
agtagtcgttggtcgtatagttttcgggtcggtcgcgatttcgttttgcgtcgcgaaggtttttagtttcggggagtcgcgggcgaggggtacgcgtacggacgagatcgtatcgtagcgtacgcgtattggcgggtatttattcgttcgtcgttcgggaggagaaggaaggtatggaaagttttagtcggttcgagagttaggtagtaggtatggtaggaggcggggtaggggtaggtagggtcgcgagggggcgtgcggtcgtcgcgagtcgttttgggtcgcgtttgtagtatcgtttttagtcgcggtcggcgggttgggttggggtcggggcgggggcggtgcggcgggtgcggggttgcggagggggcgtggcggtcgttcgcgggcggagagggggcggggcggcggtaaggcgcgcgggcggggcggggcgcgtcgagggggcgtggcgcggcgtttgcgtagttgttagcgtttttaagttcgggttcgcgttttcggatcgtgttttcgtcgtttgggagtcgttcggcgtagtagtttttaggtttttattgttttcgtcgtttcgttttttcgcgtttcgggaatcggttggttttcgagtcgtattcgtcgattttttaggtatgtttcgttacgagttggttttaattttgaaagttatgtagcgggtaagtgatttttttttagagtcggttttttcgcgcgggcgttttcgttgtcgttaggtcgtcgtttttcgcgcgttttggtcgcgggatttcgggtttttttgtatttttcggaggaggtcggggcggcgggcgggcggcgggcgttcgcgggaagggggcgcgcgtgggtcggtcgggttcggtcgcgtgcgcgcgggaggcgggggtgtgtttgcgcgtgtgcgcggttcgggagggtgtgtttcgtaagcggttcgtcgggcggggggcggggcggatcgagcgggtttcgatttcgatttcggcgtcggttcgcgggagtttagtggaaggttcgcgggaggatacgcgcgggcgtttagttcgatttcggttcgttttcgttagtcgtgaagttgtttcgtcgtcggtttcgtcgtcgtcgtttggttcgtttcgtttcgtcgttcgtcggttgtcgtcgatcgttttcgttttagcgttcgtcggtcgttcggaacgttcgcgtttaataaagcgtttttttaaagtttgtttgtgtcgttgtttgtattttagttttttgtaatcgtttttatgttaaa

SEQ ID NO: 27262 - DNA, 1267 bp, Artificial Sequence
  chemically treated genomic DNA (Homo sapiens) CpG-island No: 27262
tttaacataaaaacgattacaaaaaactaaaatacaaacaacgacacaaacaaactttaaaaaaacgctttattaaacgcgaacgttccgaacgaccgacgaacgctaaaacgaaaacgatcgacgacaaccgacgaacgacgaaacgaaacgaaccaaacgacgacgacgaaaccgacgacgaaacaacttcacgactaacgaaaacgaaccgaaatcgaactaaacgcccgcgcgtatcctcccgcgaaccttccactaaactcccgcgaaccgacgccgaaatcgaaatcgaaacccgctcgatccgccccgccccccgcccgacgaaccgcttacgaaacacaccctcccgaaccgcgcacacgcgcaaacacacccccgcctcccgcgcgcacgcgaccgaacccgaccgacccacgcgcgcccccttcccgcgaacgcccgccgcccgcccgccgccccgacctcctccgaaaaatacaaaaaaacccgaaatcccgcgaccaaaacgcgcgaaaaacgacgacctaacgacaacgaaaacgcccgcgcgaaaaaaccgactctaaaaaaaaatcacttacccgctacataactttcaaaattaaaaccaactcgtaacgaaacatacctaaaaaatcgacgaatacgactcgaaaaccaaccgattcccgaaacgcgaaaaaacgaaacgacgaaaacaataaaaacctaaaaactactacgccgaacgactcccaaacgacgaaaacacgatccgaaaacgcgaacccgaacttaaaaacgctaacaactacgcaaacgccgcgccacgccccctcgacgcgccccgccccgcccgcgcgccttaccgccgccccgccccctctccgcccgcgaacgaccgccacgccccctccgcaaccccgcacccgccgcaccgcccccgccccgaccccaacccaacccgccgaccgcgactaaaaacgatactacaaacgcgacccaaaacgactcgcgacgaccgcacgccccctcgcgaccctacctacccctaccccgcctcctaccatacctactacctaactctcgaaccgactaaaactttccataccttccttctcctcccgaacgacgaacgaataaatacccgccaatacgcgtacgctacgatacgatctcgtccgtacgcgtacccctcgcccgcgactccccgaaactaaaaaccttcgcgacgcaaaacgaaatcgcgaccgacccgaaaactatacgaccaacgactact

SEQ ID NO: 27263 - DNA, 1267 bp, Artificial Sequence
  chemically treated genomic DNA (Homo sapiens) CpG-island No: 27263
tttaatatgagagcgattgtaagagattggaatatagataacggtataaataagttttggaggaacgttttattgggcgcggacgtttcgggcggtcggcgggcgttagagcggaggcggtcggcggtagtcggcgggcggcggagcgggacggattaggcggcggcggcggggtcggcgacgaggtagttttacgattggcggggacgggtcggagtcgggttgggcgttcgcgcgtgttttttcgcggattttttattggattttcgcgggtcggcgtcgggatcggggtcggggttcgttcggttcgtttcgtttttcgttcggcgggtcgtttgcgaggtatattttttcggatcgcgtatacgcgtaggtatattttcgtttttcgcgcgtacgcggtcgggttcggtcggtttacgcgcgtttttttttcgcggacgttcgtcgttcgttcgtcgtttcggtttttttcgaggagtgtaggaaggttcggggtttcgcggttagggcgcgcgggggacggcggtttagcggtagcgggggcgttcgcgcgggaagatcggttttgagggaaggttatttattcgttgtatggtttttaggattaaagttagttcgtagcggggtatgtttggaggatcggcgagtgcggttcggaagttagtcggttttcgggacgcgaaggggcgggacggcggggatagtggggatttagaaattgttgcgtcggacggtttttaggcggcgaaagtacggttcgagagcgcgagttcgggtttaaaggcgttggtagttgcgtagacgtcgcgttacgttttttcggcgcgtttcgtttcgttcgcgcgttttgtcgtcgtttcgtttttttttcgttcgcgggcggtcgttacgtttttttcgtagtttcgtattcgtcgtatcgttttcgtttcgattttagtttagttcgtcggtcgcggttaggggcggtgttgtagacgcggtttagagcggttcgcggcggtcgtacgttttttcgcgattttgtttgtttttatttcgttttttgttatgtttgttatttagttttcgaatcggttggaattttttatgtttttttttttttttcgggcggcgggcgagtgagtgttcgttagtgcgcgtgcgttgcggtgcggtttcgttcgtgcgcgtgtttttcgttcgcgatttttcggagttagggattttcgcggcgtaaggcggggtcgcggtcggttcgggggttgtgcggttaacggttgtt

SEQ ID NO: 27264 - DNA, 1267 bp, Artificial Sequence
  chemically treated genomic DNA (Homo sapiens) CpG-island No: 27264
aacaaccgttaaccgcacaacccccgaaccgaccgcgaccccgccttacgccgcgaaaatccctaactccgaaaaatcgcgaacgaaaaacacgcgcacgaacgaaaccgcaccgcaacgcacgcgcactaacgaacactcactcgcccgccgcccgaaaaaaaaaaaaaaacataaaaaattccaaccgattcgaaaactaaataacaaacataacaaaaaacgaaataaaaacaaacaaaatcgcgaaaaaacgtacgaccgccgcgaaccgctctaaaccgcgtctacaacaccgcccctaaccgcgaccgacgaactaaactaaaatcgaaacgaaaacgatacgacgaatacgaaactacgaaaaaaacgtaacgaccgcccgcgaacgaaaaaaaaacgaaacgacgacaaaacgcgcgaacgaaacgaaacgcgccgaaaaaacgtaacgcgacgtctacgcaactaccaacgcctttaaacccgaactcgcgctctcgaaccgtactttcgccgcctaaaaaccgtccgacgcaacaatttctaaatccccactatccccgccgtcccgccccttcgcgtcccgaaaaccgactaacttccgaaccgcactcgccgatcctccaaacataccccgctacgaactaactttaatcctaaaaaccatacaacgaataaataaccttccctcaaaaccgatcttcccgcgcgaacgcccccgctaccgctaaaccgccgtcccccgcgcgccctaaccgcgaaaccccgaaccttcctacactcctcgaaaaaaaccgaaacgacgaacgaacgacgaacgtccgcgaaaaaaaaacgcgcgtaaaccgaccgaacccgaccgcgtacgcgcgaaaaacgaaaatatacctacgcgtatacgcgatccgaaaaaatatacctcgcaaacgacccgccgaacgaaaaacgaaacgaaccgaacgaaccccgaccccgatcccgacgccgacccgcgaaaatccaataaaaaatccgcgaaaaaacacgcgcgaacgcccaacccgactccgacccgtccccgccaatcgtaaaactacctcgtcgccgaccccgccgccgccgcctaatccgtcccgctccgccgcccgccgactaccgccgaccgcctccgctctaacgcccgccgaccgcccgaaacgtccgcgcccaataaaacgttcctccaaaacttatttataccgttatctatattccaatctcttacaatcgctctcatattaaa

SEQ ID NO: 27265 - DNA, 572 bp, Artificial Sequence
  chemically treated genomic DNA (Homo sapiens) CpG-island No: 27265
gtgggttacgtaagcggagtaggttttaaaggtcgcgttttaaatagtgcgtgggttacgtgagcggagtaggttttaaaggtcgcgttttaaatagtgcgtgggttacgtgagcggagtaggttttaaaggtcgcgttttaaatagtgcgtgggttacgtgagcggagtaggttttaaaggtcgcgttttaaatagtgcgtgggttacgtgagcggagtaggttttaaaggtcgcgttttaaatagtgcgtgggttacgtgagcggagtaggttttaaaggtcgcgttttaaatagtgcgtgggttacgtgagcggagtaggttttaaaggtcgcgttttaaatagtgcgtgggttacgtgagcggagtaggttttaaaggtcgcgttttaaatagtgcgtgggttacgtgagcggagtaggttttaaaggtcgcgttttaaatagtgcgtgggttacgggagcggagtagattttaaaggtcgcgttttaaatagtgtgtgggttacgtgagcggagcgttttttttattgttttcggggtcgtagtttttagtttagtttttagttttg

SEQ ID NO: 27266 - DNA, 572 bp, Artificial Sequence
  chemically treated genomic DNA (Homo sapiens) CpG-island No: 27266
caaaactaaaaactaaactaaaaactacgaccccgaaaacaataaaaaaaacgctccgctcacgtaacccacacactatttaaaacgcgacctttaaaatctactccgctcccgtaacccacgcactatttaaaacgcgacctttaaaacctactccgctcacgtaacccacgcactatttaaaacgcgacctttaaaacctactccgctcacgtaacccacgcactatttaaaacgcgacctttaaaacctactccgctcacgtaacccacgcactatttaaaacgcgacctttaaaacctactccgctcacgtaacccacgcactatttaaaacgcgacctttaaaacctactccgctcacgtaacccacgcactatttaaaacgcgacctttaaaacctactccgctcacgtaacccacgcactatttaaaacgcgacctttaaaacctactccgctcacgtaacccacgcactatttaaaacgcgacctttaaaacctactccgctcacgtaacccacgcactatttaaaacgcgacctttaaaacctactccgcttacgtaacccac

SEQ ID NO: 27267 - DNA, 572 bp, Artificial Sequence
  chemically treated genomic DNA (Homo sapiens) CpG-island No: 27267
tagggttgggagttgagttgggagttgcggtttcgagggtagtggagagggcgtttcgtttacgtggtttatatattgtttaggacgcggtttttagagtttgtttcgttttcgtggtttacgtattgtttaggacgcggtttttagagtttgtttcgtttacgtggtttacgtattgtttaggacgcggtttttagagtttgtttcgtttacgtggtttacgtattgtttaggacgcggtttttagagtttgtttcgtttacgtggtttacgtattgtttaggacgcggtttttagagtttgtttcgtttacgtggtttacgtattgtttaggacgcggtttttagagtttgtttcgtttacgtggtttacgtattgtttaggacgcggtttttagagtttgtttcgtttacgtggtttacgtattgtttaggacgcggtttttagagtttgtttcgtttacgtggtttacgtattgtttaggacgcggtttttagagtttgtttcgtttacgtggtttacgtattgtttaggacgcggtttttagagtttgtttcgtttacgtggtttat

SEQ ID NO: 27268 - DNA, 572 bp, Artificial Sequence
  chemically treated genomic DNA (Homo sapiens) CpG-island No: 27268
ataaaccacgtaaacgaaacaaactctaaaaaccgcgtcctaaacaatacgtaaaccacgtaaacgaaacaaactctaaaaaccgcgtcctaaacaatacgtaaaccacgtaaacgaaacaaactctaaaaaccgcgtcctaaacaatacgtaaaccacgtaaacgaaacaaactctaaaaaccgcgtcctaaacaatacgtaaaccacgtaaacgaaacaaactctaaaaaccgcgtcctaaacaatacgtaaaccacgtaaacgaaacaaactctaaaaaccgcgtcctaaacaatacgtaaaccacgtaaacgaaacaaactctaaaaaccgcgtcctaaacaatacgtaaaccacgtaaacgaaacaaactctaaaaaccgcgtcctaaacaatacgtaaaccacgtaaacgaaacaaactctaaaaaccgcgtcctaaacaatacgtaaaccacgaaaacgaaacaaactctaaaaaccgcgtcctaaacaatatataaaccacgtaaacgaaacgccctctccactaccctcgaaaccgcaactcccaactcaactcccaacccta

SEQ ID NO: 27269 - DNA, 662 bp, Artificial Sequence
  chemically treated genomic DNA (Homo sapiens) CpG-island No: 27269
tcggtatcgttttttaatttattaaattttatttttatttcggcgtttagaggatagtgtatttttcgtcgtagtttgagagggatcggttcgattggttacgtttttttaaattattattttttttcgaaaaagggacgaaagttttaggtttttaaacgagcgttttttcgtttagagatttcggtttgtatatttcgttttgtttttcgcggcgcgggaggagaggtcgttttatataggaagtgtgttttgcgtcgggattttgcgtttaattcgtcggtatttgtttttcgtttttaataggcgagaagtagtcgcgtttatatggttttaggtgtttatatggtagtaaacgggtttttgtttttttgggcgttttagcgcggcgttttttcgtttatatttcggtttagtttcgttggtttcgtttttagttcgtagttaagaggcgagcgcggtcggtgttttcggggttgttaggggtttcgaagtaggcggcgttgattttcggacgtcgttcgtttatattcgtcgtttttgtatttaaggtttcgcgcgattagtaggtagatttttttttcgtattttcgggttagtatcggtatttaagtttcgtcggaatttcgggtcggtttaagatattttagttttttgatgtt

SEQ ID NO: 27270 - DNA, 662 bp, Artificial Sequence
  chemically treated genomic DNA (Homo sapiens) CpG-island No: 27270
aacatcaaaaaactaaaatatcttaaaccgacccgaaattccgacgaaacttaaataccgatactaacccgaaaatacgaaaaaaaaatctacctactaatcgcgcgaaaccttaaatacaaaaacgacgaatataaacgaacgacgtccgaaaatcaacgccgcctacttcgaaacccctaacaaccccgaaaacaccgaccgcgctcgcctcttaactacgaactaaaaacgaaaccaacgaaactaaaccgaaatataaacgaaaaaacgccgcgctaaaacgcccaaaaaaacaaaaacccgtttactaccatataaacacctaaaaccatataaacgcgactacttctcgcctattaaaaacgaaaaacaaataccgacgaattaaacgcaaaatcccgacgcaaaacacacttcctatataaaacgacctctcctcccgcgccgcgaaaaacaaaacgaaatatacaaaccgaaatctctaaacgaaaaaacgctcgtttaaaaacctaaaactttcgtccctttttcgaaaaaaaataataatttaaaaaaacgtaaccaatcgaaccgatccctctcaaactacgacgaaaaatacactatcctctaaacgccgaaataaaaataaaatttaataaattaaaaaacgataccga

SEQ ID NO: 27271 - DNA, 662 bp, Artificial Sequence
  chemically treated genomic DNA (Homo sapiens) CpG-island No: 27271
ggtattagagggttaaggtgttttgggtcggttcggggtttcggcggggtttgggtgtcggtgttggttcgagggtgcggagggaaggtttatttgttggtcgcgcgaggttttgggtgtaaaggcggcgggtgtgagcgggcggcgttcgggagttagcgtcgtttgtttcggggtttttggtagtttcgggggtatcggtcgcgttcgttttttggttacgggttggaggcgaggttagcggggttgggtcgggatgtgggcgggagggcgtcgcgttggggcgtttaggagagtaggggttcgtttattgttatgtgaatatttgaagttatgtggacgcggttgtttttcgtttgttgggggcggagggtaggtatcggcgggttgggcgtaaggtttcggcgtaggatatattttttgtgtggggcggttttttttttcgcgtcgcggggaatagggcggggtgtgtaagtcggggtttttgggcgagggagcgttcgtttggggatttgaggttttcgtttttttttcgggggaaagtggtggtttgaaggagcgtggttaatcgggtcgattttttttaggttacggcgggaggtgtattgttttttggacgtcggaatgggagtggaatttagtgagttggggggcggtgtcga

SEQ ID NO: 27272 - DNA, 662 bp, Artificial Sequence
  chemically treated genomic DNA (Homo sapiens) CpG-island No: 27272
tcgacaccgccccccaactcactaaattccactcccattccgacgtccaaaaaacaatacacctcccgccgtaacctaaaaaaaatcgacccgattaaccacgctccttcaaaccaccactttcccccgaaaaaaaaacgaaaacctcaaatccccaaacgaacgctccctcgcccaaaaaccccgacttacacaccccgccctattccccgcgacgcgaaaaaaaaaaccgccccacacaaaaaatatatcctacgccgaaaccttacgcccaacccgccgatacctaccctccgcccccaacaaacgaaaaacaaccgcgtccacataacttcaaatattcacataacaataaacgaacccctactctcctaaacgccccaacgcgacgccctcccgcccacatcccgacccaaccccgctaacctcgcctccaacccgtaaccaaaaaacgaacgcgaccgatacccccgaaactaccaaaaaccccgaaacaaacgacgctaactcccgaacgccgcccgctcacacccgccgcctttacacccaaaacctcgcgcgaccaacaaataaaccttccctccgcaccctcgaaccaacaccgacacccaaaccccgccgaaaccccgaaccgacccaaaacaccttaaccctctaatacc

SEQ ID NO: 27273 - DNA, 598 bp, Artificial Sequence
  chemically treated genomic DNA (Homo sapiens) CpG-island No: 27273
gtggcgacggcgggcggcgttgcgcggggtgggggtgggggtggtttcgtcgtttttagttcgggcgttcgggtcggcggcggggcgggtcggggtcgcggtttttcgaggttcgtttcggttcgcgcgttcgtttttcggttaggcgcgttttagggcgggtttttttggcggaggtcgcggtcgtttcgtaggggtcgaaagcggttgggttcggggttttttttttttatttttttaatatataggaaataatagagcgttaggtgacggcgcgcggttaatggggaggtttcgggtcgcggcgcgcgggcgggcgggagggcgcgcggcggggcggggcgcgcggcgggggcggggcgttgggggcggggtcgggcgcgcgcgtgtttattcgcgtgcggcggcgtcgaggttggcgcgcgtcgggtagggatcgcgaagatttttatttcgcggtagggtcgtacggggtttttttttgcggtcgttgggcgtcgcgcgttattcgtttagtgttattttggtttgcgttttagggtcgttttgggggtggacgcgagttaattttttgggggagttggtggttcggaatttt

SEQ ID NO: 27274 - DNA, 598 bp, Artificial Sequence
  chemically treated genomic DNA (Homo sapiens) CpG-island No: 27274
aaaattccgaaccaccaactcccccaaaaaattaactcgcgtccacccccaaaacgaccctaaaacgcaaaccaaaataacactaaacgaataacgcgcgacgcccaacgaccgcaaaaaaaaaccccgtacgaccctaccgcgaaataaaaatcttcgcgatccctacccgacgcgcgccaacctcgacgccgccgcacgcgaataaacacgcgcgcgcccgaccccgcccccaacgccccgcccccgccgcgcgccccgccccgccgcgcgccctcccgcccgcccgcgcgccgcgacccgaaacctccccattaaccgcgcgccgtcacctaacgctctattatttcctatatattaaaaaaataaaaaaaaaaaaccccgaacccaaccgctttcgacccctacgaaacgaccgcgacctccgccaaaaaaacccgccctaaaacgcgcctaaccgaaaaacgaacgcgcgaaccgaaacgaacctcgaaaaaccgcgaccccgacccgccccgccgccgacccgaacgcccgaactaaaaacgacgaaaccacccccacccccaccccgcgcaacgccgcccgccgtcgccac

SEQ ID NO: 27275 - DNA, 598 bp, Artificial Sequence
  chemically treated genomic DNA (Homo sapiens) CpG-island No: 27275
gagatttcgggttattaatttttttagaaagttggttcgcgtttatttttaagacggttttgaggcgtaggttaagatggtattgggcgggtggcgcgcggcgtttagcggtcgtagaggagaatttcgtgcgattttgtcgcgaggtgggggttttcgcgatttttattcggcgcgcgttagtttcgacgtcgtcgtacgcgggtgggtacgcgcgcgttcggtttcgtttttagcgtttcgttttcgtcgcgcgtttcgtttcgtcgcgcgttttttcgttcgttcgcgcgtcgcggttcggagtttttttattggtcgcgcgtcgttatttgacgttttgttattttttgtgtgttgggagaatggagagaaaaaatttcgagtttagtcgttttcggtttttgcgaggcggtcgcggttttcgttaggggagttcgttttgaggcgcgtttgatcggggagcgagcgcgcgggtcggagcgagtttcgaggggtcgcggtttcggttcgtttcgtcgtcggttcgggcgttcgagttggaggcggcggagttatttttatttttatttcgcgtagcgtcgttcgtcgtcgttat

SEQ ID NO: 27276 - DNA, 598 bp, Artificial Sequence
  chemically treated genomic DNA (Homo sapiens) CpG-island No: 27276
ataacgacgacgaacgacgctacgcgaaataaaaataaaaataactccgccgcctccaactcgaacgcccgaaccgacgacgaaacgaaccgaaaccgcgacccctcgaaactcgctccgacccgcgcgctcgctccccgatcaaacgcgcctcaaaacgaactcccctaacgaaaaccgcgaccgcctcgcaaaaaccgaaaacgactaaactcgaaattttttctctccattctcccaacacacaaaaaataacaaaacgtcaaataacgacgcgcgaccaataaaaaaactccgaaccgcgacgcgcgaacgaacgaaaaaacgcgcgacgaaacgaaacgcgcgacgaaaacgaaacgctaaaaacgaaaccgaacgcgcgcgtacccacccgcgtacgacgacgtcgaaactaacgcgcgccgaataaaaatcgcgaaaacccccacctcgcgacaaaatcgcacgaaattctcctctacgaccgctaaacgccgcgcgccacccgcccaataccatcttaacctacgcctcaaaaccgtcttaaaaataaacgcgaaccaactttctaaaaaaattaataacccgaaatctc

SEQ ID NO: 27277 - DNA, 643 bp, Artificial Sequence
  chemically treated genomic DNA (Homo sapiens) CpG-island No: 27277
ttttcgtcgcgttcgcgttgtttttttattttggcggtcggagggtcggtatcggtttcgtaggagagttcgggtagcggggtcgggtttcggagcgcggggcgcgggcgcgagtagggcgcgcgggggcgcgggtcgcgcgtttcgggtcgtgcgtttcgcggtcgtcgcgttttcgtttttagcgcgggtttcgcgcgtttcggtcggttcgggggtaggttttgcgtagcgtcgcgtcgggtggggggcgggtttcgcgggttttggagaggcgttcgggcggcgcgggttttcggcgggcgcgggcggcgtcgttgcggtggtttcgtcgttgagtggtgggacgcgatttattggttgtaattttcggcgtttttcgatggtatttaagagagatcgggagggagtcggggagagcgggcggagggcgggcgggcgggcggaggaggggcggcgggagtcgtgcgcgtcggcgggggaggggcgcgggcgggggcgggcgggcgggaggtggggagaggttcggatggaggcggcgggcggtcgcggcgcgtcgggttggggtagggggggttttgtttttagttttcgtttattcgcgtttagttttttacgtacggtgtcgttgttgggggtgagg

SEQ ID NO: 27278 - DNA, 643 bp, Artificial Sequence
  chemically treated genomic DNA (Homo sapiens) CpG-island No: 27278
cctcacccccaacaacgacaccgtacgtaaaaaactaaacgcgaataaacgaaaactaaaaacaaaaccccccctaccccaacccgacgcgccgcgaccgcccgccgcctccatccgaacctctccccacctcccgcccgcccgcccccgcccgcgcccctcccccgccgacgcgcacgactcccgccgcccctcctccgcccgcccgcccgccctccgcccgctctccccgactccctcccgatctctcttaaataccatcgaaaaacgccgaaaattacaaccaataaatcgcgtcccaccactcaacgacgaaaccaccgcaacgacgccgcccgcgcccgccgaaaacccgcgccgcccgaacgcctctccaaaacccgcgaaacccgccccccacccgacgcgacgctacgcaaaacctacccccgaaccgaccgaaacgcgcgaaacccgcgctaaaaacgaaaacgcgacgaccgcgaaacgcacgacccgaaacgcgcgacccgcgcccccgcgcgccctactcgcgcccgcgccccgcgctccgaaacccgaccccgctacccgaactctcctacgaaaccgataccgaccctccgaccgccaaaataaaaaaacaacgcgaacgcgacgaaaa

SEQ ID NO: 27279 - DNA, 643 bp, Artificial Sequence
  chemically treated genomic DNA (Homo sapiens) CpG-island No: 27279
ttttatttttagtagcggtatcgtgcgtggggggttgggcgcgggtgggcgggggttggaggtagagttttttttattttagttcggcgcgtcgcggtcgttcgtcgtttttattcgggtttttttttatttttcgttcgttcgttttcgttcgcgtttttttttcgtcggcgcgtacggttttcgtcgtttttttttcgttcgttcgttcgtttttcgttcgtttttttcggttttttttcggttttttttaagtgttatcgaggggcgtcgggaattgtagttagtaaatcgcgttttattatttagcggcggggttatcgtagcggcgtcgttcgcgttcgtcgggagttcgcgtcgttcgggcgtttttttagggttcgcgaggttcgttttttattcggcgcggcgttgcgtagggtttgttttcgggtcggtcggggcgcgcggggttcgcgttggaggcgaggacgcggcggtcgcggggcgtacggttcggagcgcgcggttcgcgttttcgcgcgttttgttcgcgttcgcgtttcgcgtttcggagttcggtttcgttgttcgggtttttttgcgggatcgatgtcggtttttcggtcgttagggtaaggggatagcgcgggcgcggcggggg

SEQ ID NO: 27280 - DNA, 643 bp, Artificial Sequence
  chemically treated genomic DNA (Homo sapiens) CpG-island No: 27280
cccccgccgcgcccgcgctatccccttaccctaacgaccgaaaaaccgacatcgatcccgcaaaaaaacccgaacaacgaaaccgaactccgaaacgcgaaacgcgaacgcgaacaaaacgcgcgaaaacgcgaaccgcgcgctccgaaccgtacgccccgcgaccgccgcgtcctcgcctccaacgcgaaccccgcgcgccccgaccgacccgaaaacaaaccctacgcaacgccgcgccgaataaaaaacgaacctcgcgaaccctaaaaaaacgcccgaacgacgcgaactcccgacgaacgcgaacgacgccgctacgataaccccgccgctaaataataaaacgcgatttactaactacaattcccgacgcccctcgataacacttaaaaaaaaccgaaaaaaaaccgaaaaaaacgaacgaaaaacgaacgaacgaacgaaaaaaaaacgacgaaaaccgtacgcgccgacgaaaaaaaaacgcgaacgaaaacgaacgaacgaaaaataaaaaaaaacccgaataaaaacgacgaacgaccgcgacgcgccgaactaaaataaaaaaaactctacctccaacccccgcccacccgcgcccaaccccccacgcacgataccgctactaaaaataaaa

SEQ ID NO: 27281 - DNA, 546 bp, Artificial Sequence
  chemically treated genomic DNA (Homo sapiens) CpG-island No: 27281
ggcgagagaggacgttgggttgaaatagaagtgtatcgtttgggatcgaaggttacgggagagttattagcgtttttatatttttcggagggggttaagtaaggttgggaagtcggtttcggtcggttcggcggggagtcgcgcggcggaggattgagttggcgggaagttggttttagacgcgatttttttggcgggagggggaagtaggcggggtaattggtagttcggtttgtattattgggtcggggcgggggtcgcgtaggaagcggtaagtgatatttggaaggggttcgagttagagtattcgcgcggggagagtgggttcgagtagaattttttttggacgggtaaggaattcgtaaggttcgcgacgttttaggttatatgggttgggttgtattatttcggtatcggataaggggtttaggtcgggacgtgcgtagggtcgcggttaggtttattttattagagttattgggtttaatgatggcggtgaatttttgaaatggttcgataatttgtcgatttttgtacgatttaaag

SEQ ID NO: 27282 - DNA, 546 bp, Artificial Sequence
  chemically treated genomic DNA (Homo sapiens) CpG-island No: 27282
ctttaaatcgtacaaaaatcgacaaattatcgaaccatttcaaaaattcaccgccatcattaaacccaataactctaataaaataaacctaaccgcgaccctacgcacgtcccgacctaaaccccttatccgataccgaaataatacaacccaacccatataacctaaaacgtcgcgaaccttacgaattccttacccgtccaaaaaaaattctactcgaacccactctccccgcgcgaatactctaactcgaaccccttccaaatatcacttaccgcttcctacgcgacccccgccccgacccaataatacaaaccgaactaccaattaccccgcctacttccccctcccgccaaaaaaatcgcgtctaaaaccaacttcccgccaactcaatcctccgccgcgcgactccccgccgaaccgaccgaaaccgacttcccaaccttacttaaccccctccgaaaaatataaaaacgctaataactctcccgtaaccttcgatcccaaacgatacacttctatttcaacccaacgtcctctctcgcc

SEQ ID NO: 27283 - DNA, 546 bp, Artificial Sequence
  chemically treated genomic DNA (Homo sapiens) CpG-island No: 27283
ttttaagtcgtataagggtcgatagattatcggattattttagaggtttatcgttattattggatttaatggttttggtgagataaatttggtcgcggttttgcgtacgtttcggtttggattttttattcggtgtcggagtagtataatttagtttatgtaatttgaaacgtcgcggattttacgggttttttgttcgtttagagggggttttgttcgaatttatttttttcgcgcgggtgttttaattcgaattttttttaggtgttatttgtcgttttttgcgcggttttcgtttcggtttagtggtataggtcgagttgttagttatttcgtttatttttttttttcgttaaaggagtcgcgtttggaattagtttttcgttagtttagtttttcgtcgcgcggtttttcgtcggatcggtcggagtcggttttttagttttatttgatttttttcggagaatgtggggacgttggtagttttttcgtggttttcggttttaaacggtgtatttttgttttagtttagcgttttttttcgtt

SEQ ID NO: 27284 - DNA, 546 bp, Artificial Sequence
  chemically treated genomic DNA (Homo sapiens) CpG-island No: 27284
aacgaaaaaaaacgctaaactaaaacaaaaatacaccgtttaaaaccgaaaaccacgaaaaaactaccaacgtccccacattctccgaaaaaaatcaaataaaactaaaaaaccgactccgaccgatccgacgaaaaaccgcgcgacgaaaaactaaactaacgaaaaactaattccaaacgcgactcctttaacgaaaaaaaaaaataaacgaaataactaacaactcgacctataccactaaaccgaaacgaaaaccgcgcaaaaaacgacaaataacacctaaaaaaaattcgaattaaaacacccgcgcgaaaaaaataaattcgaacaaaaccccctctaaacgaacaaaaaacccgtaaaatccgcgacgtttcaaattacataaactaaattatactactccgacaccgaataaaaaatccaaaccgaaacgtacgcaaaaccgcgaccaaatttatctcaccaaaaccattaaatccaataataacgataaacctctaaaataatccgataatctatcgacccttatacgacttaaaa

SEQ ID NO: 27285 - DNA, 511 bp, Artificial Sequence
  chemically treated genomic DNA (Homo sapiens) CpG-island No: 27285
gttgttcgttcgttcggttttttttcggtttgtcgtacgcgcgtggttatttcgaatatagttttatcgggaattttttttcgatttttcgtttagttgggtcggtattcgcgtgcgcggattttaagtcgcggggttttagaggggttgtttattcggcgtttttaggacgttgttgttcgagagacgacggtagtcgttgattggagaatgagtttacgcgtttggtaagaagttgagttgtgattggttaattggagataaacgaggagggggcggggttaggttagtttcgcgttttcgttttcggaagaaattttcgtcggaagtttcgttttttggggagcgggaattttggcgattcgtgttatgggagcgggtttttgttacgtgggttttagcgcgagttgggcggtcggttcggttttatcgaattgtatagggtcgtgtagtcgggggaagttagttttttgttttgagaagtagattttgtatttgtaaaaggttaagt

SEQ ID NO: 27286 - DNA, 511 bp, Artificial Sequence
  chemically treated genomic DNA (Homo sapiens) CpG-island No: 27286
acttaaccttttacaaatacaaaatctacttctcaaaacaaaaaactaacttcccccgactacacgaccctatacaattcgataaaaccgaaccgaccgcccaactcgcgctaaaacccacgtaacaaaaacccgctcccataacacgaatcgccaaaattcccgctccccaaaaaacgaaacttccgacgaaaatttcttccgaaaacgaaaacgcgaaactaacctaaccccgccccctcctcgtttatctccaattaaccaatcacaactcaacttcttaccaaacgcgtaaactcattctccaatcaacgactaccgtcgtctctcgaacaacaacgtcctaaaaacgccgaataaacaacccctctaaaaccccgcgacttaaaatccgcgcacgcgaataccgacccaactaaacgaaaaatcgaaaaaaaattcccgataaaactatattcgaaataaccacgcgcgtacgacaaaccgaaaaaaaaccgaacgaacgaacaac

SEQ ID NO: 27287 - DNA, 511 bp, Artificial Sequence
  chemically treated genomic DNA (Homo sapiens) CpG-island No: 27287
gtttagttttttatagatgtagagtttgttttttagagtagggggttgatttttttcggttatacggttttatgtagttcggtgggatcgggtcgatcgtttagttcgcgttaaagtttacgtaatagaaattcgtttttatgatacgggtcgttagggttttcgttttttagagaacgggattttcggcggaaatttttttcgggagcggaggcgcgggattgatttggtttcgtttttttttcgtttatttttaattgattaattatagtttagttttttgttaggcgcgtaggtttattttttagttagcgattgtcgtcgtttttcgggtaatagcgttttagagacgtcgaatgggtagtttttttgagatttcgcggtttggggttcgcgtacgcgggtgtcggtttagttaggcggagaatcgaggaggggttttcggtaaggttgtattcggggtggttacgcgcgtgcgataggtcgaggaggggtcgggcgggcgggtagt

SEQ ID NO: 27288 - DNA, 511 bp, Artificial Sequence
  chemically treated genomic DNA (Homo sapiens) CpG-island No: 27288
actacccgcccgcccgacccctcctcgacctatcgcacgcgcgtaaccaccccgaatacaaccttaccgaaaacccctcctcgattctccgcctaactaaaccgacacccgcgtacgcgaaccccaaaccgcgaaatctcaaaaaaactacccattcgacgtctctaaaacgctattacccgaaaaacgacgacaatcgctaactaaaaaataaacctacgcgcctaacaaaaaactaaactataattaatcaattaaaaataaacgaaaaaaaaacgaaaccaaatcaatcccgcgcctccgctcccgaaaaaaatttccgccgaaaatcccgttctctaaaaaacgaaaaccctaacgacccgtatcataaaaacgaatttctattacgtaaactttaacgcgaactaaacgatcgacccgatcccaccgaactacataaaaccgtataaccgaaaaaaatcaaccccctactctaaaaaacaaactctacatctataaaaaactaaac

SEQ ID NO: 27289 - DNA, 893 bp, Artificial Sequence
  chemically treated genomic DNA (Homo sapiens) CpG-island No: 27289
cgtttttatcgcgtttttgtgtttttcgcgtttttatcgcggttttgagtttttcgcgtttttatcgcggttttgagtttttcgcgtttttatcgttgttttgagtttttcgtagttatatcgcggttttgtgtttttcgcgtttttatcgcgtttttgtgtttttcgcgtttttatcgcggttttgagttttttacgtttttatcgcggttttgagtttttcgcgtttttatcgttgttttgagtttttcgtagttatatcgcggttttgagtttttcgcgtttttatcgcgtttttgtgtttttcgcgtttttatcgcgtttttgtgtttttcgcgtttttatcgcggttttgagtttttcgcgtttttatcgcggttttgagtttttcgcgtttttatcgttgttttgagtttttcgtatttatatcgcgtttttgtgtttttcgcgtttttatcgcgtttttgtgtttttcgcgtttttatcgcggttttgagtttttcgcgtttttatcgttgttttgagtttttcgtagttatatcgcggttttgagtttttcgcgtttttatcgcgtttttgtgtttttcgcgtttttatcgcgtttttgtgtttttcgcgtttttatcgcggttttgagtttttcgcgtttttatcgcggttttgagtttttcgcgtttttatcgttgttttgagtttttcgtatttatatcgcggttttgtgtttttcgcgtttttatcgcgtttttgtgtttttcgcgtttttatcgcggttttgagtttttcgcgtttttatcgttgttttgagtttttcgtagttatatcgtagttttgagtttttcgcgtttttatcgtagttttgagttttttgcgtggtttgcgttgttttagagttt

SEQ ID NO: 27290 - DNA, 893 bp, Artificial Sequence
  chemically treated genomic DNA (Homo sapiens) CpG-island No: 27290
aaactctaaaacaacgcaaaccacgcaaaaaactcaaaactacgataaaaacgcgaaaaactcaaaactacgatataactacgaaaaactcaaaacaacgataaaaacgcgaaaaactcaaaaccgcgataaaaacgcgaaaaacacaaaaacgcgataaaaacgcgaaaaacacaaaaccgcgatataaatacgaaaaactcaaaacaacgataaaaacgcgaaaaactcaaaaccgcgataaaaacgcgaaaaactcaaaaccgcgataaaaacgcgaaaaacacaaaaacgcgataaaaacgcgaaaaacacaaaaacgcgataaaaacgcgaaaaactcaaaaccgcgatataactacgaaaaactcaaaacaacgataaaaacgcgaaaaactcaaaaccgcgataaaaacgcgaaaaacacaaaaacgcgataaaaacgcgaaaaacacaaaaacgcgatataaatacgaaaaactcaaaacaacgataaaaacgcgaaaaactcaaaaccgcgataaaaacgcgaaaaactcaaaaccgcgataaaaacgcgaaaaacacaaaaacgcgataaaaacgcgaaaaacacaaaaacgcgataaaaacgcgaaaaactcaaaaccgcgatataactacgaaaaactcaaaacaacgataaaaacgcgaaaaactcaaaaccgcgataaaaacgtaaaaaactcaaaaccgcgataaaaacgcgaaaaacacaaaaacgcgataaaaacgcgaaaaacacaaaaccgcgatataactacgaaaaactcaaaacaacgataaaaacgcgaaaaactcaaaaccgcgataaaaacgcgaaaaactcaaaaccgcgataaaaacgcgaaaaacacaaaaacgcgataaaaacg

SEQ ID NO: 27291 - DNA, 893 bp, Artificial Sequence
  chemically treated genomic DNA (Homo sapiens) CpG-island No: 27291
gggttttgaggtagcgtaggttacgtaggaagtttagggttgcggtgggggcgcgggaagtttagggttgcggtgtggttgcgggaagtttagggtagcggtgggggcgcgggaagtttagggtcgcggtgggggcgcgggaagtatagggacgcggtgggggcgcgggaagtatagggtcgcggtgtgggtgcgggaagtttagggtagcggtgggggcgcgggaagtttagggtcgcggtgggggcgcgggaagtttagggtcgcggtgggggcgcgggaagtatagggacgcggtgggggcgcgggaagtatagggacgcggtgggggcgcgggaagtttagggtcgcggtgtggttgcgggaagtttagggtagcggtgggggcgcgggaagtttagggtcgcggtgggggcgcgggaagtatagggacgcggtgggggcgcgggaagtatagggacgcggtgtgggtgcgggaagtttagggtagcggtgggggcgcgggaagtttagggtcgcggtgggggcgcgggaagtttagggtcgcggtgggggcgcgggaagtatagggacgcggtgggggcgcgggaagtatagggacgcggtgggggcgcgggaagtttagggtcgcggtgtggttgcgggaagtttagggtagcggtgggggcgcgggaagtttagggtcgcggtgggggcgtgggaagtttagggtcgcggtgggggcgcgggaagtatagggacgcggtgggggcgcgggaagtatagggtcgcggtgtggttgcgggaagtttagggtagcggtgggggcgcgggaagtttagggtcgcggtgggggcgcgggaagtttagggtcgcggtgggggcgcgggaagtatagggacgcggtgggggcg

SEQ ID NO: 27292 - DNA, 893 bp, Artificial Sequence
  chemically treated genomic DNA (Homo sapiens) CpG-island No: 27292
cgcccccaccgcgtccctatacttcccgcgcccccaccgcgaccctaaacttcccgcgcccccaccgcgaccctaaacttcccgcgcccccaccgctaccctaaacttcccgcaaccacaccgcgaccctatacttcccgcgcccccaccgcgtccctatacttcccgcgcccccaccgcgaccctaaacttcccacgcccccaccgcgaccctaaacttcccgcgcccccaccgctaccctaaacttcccgcaaccacaccgcgaccctaaacttcccgcgcccccaccgcgtccctatacttcccgcgcccccaccgcgtccctatacttcccgcgcccccaccgcgaccctaaacttcccgcgcccccaccgcgaccctaaacttcccgcgcccccaccgctaccctaaacttcccgcacccacaccgcgtccctatacttcccgcgcccccaccgcgtccctatacttcccgcgcccccaccgcgaccctaaacttcccgcgcccccaccgctaccctaaacttcccgcaaccacaccgcgaccctaaacttcccgcgcccccaccgcgtccctatacttcccgcgcccccaccgcgtccctatacttcccgcgcccccaccgcgaccctaaacttcccgcgcccccaccgcgaccctaaacttcccgcgcccccaccgctaccctaaacttcccgcacccacaccgcgaccctatacttcccgcgcccccaccgcgtccctatacttcccgcgcccccaccgcgaccctaaacttcccgcgcccccaccgctaccctaaacttcccgcaaccacaccgcaaccctaaacttcccgcgcccccaccgcaaccctaaacttcctacgtaacctacgctacctcaaaaccc

SEQ ID NO: 27293 - DNA, 696 bp, Artificial Sequence
  chemically treated genomic DNA (Homo sapiens) CpG-island No: 27293
ggtttagtagaagtttcgggcgcgggcgcggcgtttacgcggtcgcgttgtagggttggggtatggcgtggcgggcgcggtcggcgcggggtttatcggatttggggtaggtgacgatttatacgtcgttgggtcgtatcgggaagttggcgattttttttattttttcgcggtagaagggcggtagtcgtacgttatggaattcgaagtatttgttttcgaattttttcggggtgttgggggtttcggtttcgtttttcgttatgtcgtcgtcgtcgtcgtcgtcgtcgtcgtttttcggttcgtagttcgtacgcgttcgcgttcgcgttcgcgttcgcgtttcgtatacgttcgcgttttatcggcgcgcggcggtagtttcgtaggcgtgacgttatggcgtcgtcgacgcgcggcggaggtttcgcgggtatgacgttatggcgtcgttcggtacgcggtcgcggcgttgtacgggcgtgacgttatggcgtcgcggagtcgcgtttttttcgtttcgttttcggtcggggttatttattcgttgtcggggttgatagagattttggttcgcggtttgtagtttttttagtcgtgcgtgcgtttatttcgtttatagtttttgttatttagtaagcgtttaatatagacgtatgagatattttggttggaaggttttgaaaggtagtcgtt

SEQ ID NO: 27294 - DNA, 696 bp, Artificial Sequence
  chemically treated genomic DNA (Homo sapiens) CpG-island No: 27294
aacgactacctttcaaaaccttccaaccaaaatatctcatacgtctatattaaacgcttactaaataacaaaaactataaacgaaataaacgcacgcacgactaaaaaaactacaaaccgcgaaccaaaatctctatcaaccccgacaacgaataaataaccccgaccgaaaacgaaacgaaaaaaacgcgactccgcgacgccataacgtcacgcccgtacaacgccgcgaccgcgtaccgaacgacgccataacgtcatacccgcgaaacctccgccgcgcgtcgacgacgccataacgtcacgcctacgaaactaccgccgcgcgccgataaaacgcgaacgtatacgaaacgcgaacgcgaacgcgaacgcgaacgcgtacgaactacgaaccgaaaaacgacgacgacgacgacgacgacgacgacataacgaaaaacgaaaccgaaacccccaacaccccgaaaaaattcgaaaacaaatacttcgaattccataacgtacgactaccgcccttctaccgcgaaaaaataaaaaaaatcgccaacttcccgatacgacccaacgacgtataaatcgtcacctaccccaaatccgataaaccccgcgccgaccgcgcccgccacgccataccccaaccctacaacgcgaccgcgtaaacgccgcgcccgcgcccgaaacttctactaaacc

SEQ ID NO: 27295 - DNA, 696 bp, Artificial Sequence
  chemically treated genomic DNA (Homo sapiens) CpG-island No: 27295
gacgattattttttagggttttttagttagggtattttatgcgtttgtgttgagcgtttgttgagtgatagaagttatgagcggaatgaacgtacgtacgattgaggaggttgtagatcgcgggttagggtttttgttagtttcggtagcgggtgggtgatttcggtcgggggcggggcggggaggacgcggtttcgcggcgttatgacgttacgttcgtgtagcgtcgcggtcgcgtgtcgggcggcgttatgacgttatattcgcggagttttcgtcgcgcgtcggcggcgttatgacgttacgtttgcggagttgtcgtcgcgcgtcggtggggcgcgagcgtgtgcggggcgcgggcgcgggcgcgggcgcgggcgcgtgcgggttgcgagtcgggaggcggcggcggcgacggcgacggcggcggtatggcggagagcgaggtcgagatttttagtatttcgggggagttcgagagtaagtatttcgagttttatggcgtgcggttgtcgtttttttgtcgcgggaagatggaggagatcgttaatttttcggtgcggtttagcgacgtgtggatcgttatttattttaagttcggtgagtttcgcgtcgatcgcgttcgttacgttatgttttagttttgtagcgcggtcgcgtagacgtcgcgttcgcgttcggggtttttgttgggtt

SEQ ID NO: 27296 - DNA, 696 bp, Artificial Sequence
  chemically treated genomic DNA (Homo sapiens) CpG-island No: 27296
aacccaacaaaaaccccgaacgcgaacgcgacgtctacgcgaccgcgctacaaaactaaaacataacgtaacgaacgcgatcgacgcgaaactcaccgaacttaaaataaataacgatccacacgtcgctaaaccgcaccgaaaaattaacgatctcctccatcttcccgcgacaaaaaaacgacaaccgcacgccataaaactcgaaatacttactctcgaactcccccgaaatactaaaaatctcgacctcgctctccgccataccgccgccgtcgccgtcgccgccgccgcctcccgactcgcaacccgcacgcgcccgcgcccgcgcccgcgcccgcgccccgcacacgctcgcgccccaccgacgcgcgacgacaactccgcaaacgtaacgtcataacgccgccgacgcgcgacgaaaactccgcgaatataacgtcataacgccgcccgacacgcgaccgcgacgctacacgaacgtaacgtcataacgccgcgaaaccgcgtcctccccgccccgcccccgaccgaaatcacccacccgctaccgaaactaacaaaaaccctaacccgcgatctacaacctcctcaatcgtacgtacgttcattccgctcataacttctatcactcaacaaacgctcaacacaaacgcataaaataccctaactaaaaaaccctaaaaaataatcgtc

SEQ ID NO: 27297 - DNA, 500 bp, Artificial Sequence
  chemically treated genomic DNA (Homo sapiens) CpG-island No: 27297
cggcgtatttcggggttcgcggagaggtttagtttttttcgcggttttttagacgcgtttttcgtttggttcgtgtggatcgtttcggttattgtttacgggggaagtttgtttcgacgtattgttttggttatttttaatttttttcggtttttttcggggtatcgcgggggattttacgttaacgtttttttttcgttcgcgttttaagggtcgattgggtaaattgggagattcgtttcgcggggcgatttaatttttcggaatagttttttatcgtttattttcgtagattttcggattttcgttttcggcggagatttagggaatttcgtattttaagtttttttgaatcgtgcggcgtgagtgtgacggttaagagcggatgtagttcgggatcgttcgtattttttcgttagcggaagcgtaggagtcggttggggagggggcgttttagaaagagtagttagaaagttgagacggggaattgaggttatttt

SEQ ID NO: 27298 - DNA, 500 bp, Artificial Sequence
  chemically treated genomic DNA (Homo sapiens) CpG-island No: 27298
aaaataacctcaattccccgtctcaactttctaactactctttctaaaacgccccctccccaaccgactcctacgcttccgctaacgaaaaaatacgaacgatcccgaactacatccgctcttaaccgtcacactcacgccgcacgattcaaaaaaacttaaaatacgaaattccctaaatctccgccgaaaacgaaaatccgaaaatctacgaaaataaacgataaaaaactattccgaaaaattaaatcgccccgcgaaacgaatctcccaatttacccaatcgacccttaaaacgcgaacgaaaaaaaaacgttaacgtaaaatcccccgcgataccccgaaaaaaaccgaaaaaaattaaaaataaccaaaacaatacgtcgaaacaaacttcccccgtaaacaataaccgaaacgatccacacgaaccaaacgaaaaacgcgtctaaaaaaccgcgaaaaaaactaaacctctccgcgaaccccgaaatacgccg

SEQ ID NO: 27299 - DNA, 500 bp, Artificial Sequence
  chemically treated genomic DNA (Homo sapiens) CpG-island No: 27299
aggatgattttagtttttcgttttagttttttagttgttttttttagggcgttttttttttagtcggtttttgcgttttcgttggcgggaaggtgcgggcgatttcgggttgtattcgtttttggtcgttatatttacgtcgtacgatttagaagggtttggggtgcggggttttttgaattttcgtcgggagcgggggttcgggggtttgcgggggtgggcggtggggggttgtttcgaaaagttgggtcgtttcgcggggcgggttttttaatttgtttagtcggtttttggggcgcgggcggaggggggacgttggcgtagggtttttcgcgatatttcgggaagggtcgggggaagttggaaatggttaaaataatgcgtcgggataggtttttttcgtaaataatggtcgggacggtttatacgggttaggcggagggcgcgtttaagggatcgcgggaggggttgggttttttcgcggatttcgaggtgcgtcg

SEQ ID NO: 27300 - DNA, 500 bp, Artificial Sequence
  chemically treated genomic DNA (Homo sapiens) CpG-island No: 27300
cgacgcacctcgaaatccgcgaaaaaacccaacccctcccgcgatcccttaaacgcgccctccgcctaacccgtataaaccgtcccgaccattatttacgaaaaaaacctatcccgacgcattattttaaccatttccaacttcccccgacccttcccgaaatatcgcgaaaaaccctacgccaacgtcccccctccgcccgcgccccaaaaaccgactaaacaaattaaaaaacccgccccgcgaaacgacccaacttttcgaaacaaccccccaccgcccacccccgcaaacccccgaacccccgctcccgacgaaaattcaaaaaaccccgcaccccaaacccttctaaatcgtacgacgtaaatataacgaccaaaaacgaatacaacccgaaatcgcccgcaccttcccgccaacgaaaacgcaaaaaccgactaaaaaaaaaacgccctaaaaaaaacaactaaaaaactaaaacgaaaaactaaaatcatcct

SEQ ID NO: 27301 - DNA, 1045 bp, Artificial Sequence
  chemically treated genomic DNA (Homo sapiens) CpG-island No: 27301
gggcgtttcgggggcggcgcgggagttttcgtaggattaggcgggcgtttcggttggcgcgggcggggggcgtttttttttatttgtggtttcggtttttcggttattttttcgcgcggcggttgtcgggattgagttgattttattcgggtcggtcgggtttgaaagaggaggagcgggcgcggaggggagggggcggggagggcggagggagggaggtttcgcgtagttttttcggttttttgtgcggatatttttcggatttcgcgttcgtattcggttttttaaaagatacggggagtcgtaagcgaggggtgtagttatttgtcgaggcgtttagtgttttcgcgtttttaagatttttaataaaaaaggagcgtttcgtatttttattttcgttcggaggatttaggggtcgggtttatttcgggcgcggggttaagtgtaggcgcggggggggtttttagagtcgttagggcgcggcgcgttcggcgttgggggattgttgggttagaaagtgtttagggagtagttgttgcgttttttttcggttcgtcgttcggagacgtttcgtttcgttttatttcgttttcgcgtttacgtgattagtataggttcgttttcgtttcgtttttcgttatagatttcgttttcgggacgcgagcgagcggcgagcgcgcgtatttttagttatcgttcggcgattttcgcgtacgtacgcgtcgtgttatttttttcgcgtttttcgttttatatttttattttcgttattcgatttaacgtggcgggcgagcgtcgcggcggtagtcgtgataggtattcggcggggggggcggggggggtcgcgagggtgtgcgtaggcgtagattcgggtttcgttttcgtcgtttttttttttgtaaggtgtgttcgggcgaggggaggggttcgcggttcgaatttttgggttatttcgaattataaataaaattttaacgtcgttgttcgcgggttagaaggtagttgtgcgcgaaaaatattttagattttttttaagcgtgaggaa

SEQ ID NO: 27302 - DNA, 1045 bp, Artificial Sequence
  chemically treated genomic DNA (Homo sapiens) CpG-island No: 27302
ttcctcacgcttaaaaaaaatctaaaatatttttcgcgcacaactaccttctaacccgcgaacaacgacgttaaaattttatttataattcgaaataacccaaaaattcgaaccgcgaacccctcccctcgcccgaacacaccttacaaaaaaaaaaacgacgaaaacgaaacccgaatctacgcctacgcacaccctcgcgaccccccccgccccccccgccgaatacctatcacgactaccgccgcgacgctcgcccgccacgttaaatcgaataacgaaaataaaaatataaaacgaaaaacgcgaaaaaaataacacgacgcgtacgtacgcgaaaatcgccgaacgataactaaaaatacgcgcgctcgccgctcgctcgcgtcccgaaaacgaaatctataacgaaaaacgaaacgaaaacgaacctatactaatcacgtaaacgcgaaaacgaaataaaacgaaacgaaacgtctccgaacgacgaaccgaaaaaaaacgcaacaactactccctaaacactttctaacccaacaatcccccaacgccgaacgcgccgcgccctaacgactctaaaaaccccccccgcgcctacacttaaccccgcgcccgaaataaacccgacccctaaatcctccgaacgaaaataaaaatacgaaacgctccttttttattaaaaatcttaaaaacgcgaaaacactaaacgcctcgacaaataactacacccctcgcttacgactccccgtatcttttaaaaaaccgaatacgaacgcgaaatccgaaaaatatccgcacaaaaaaccgaaaaaactacgcgaaacctccctccctccgccctccccgccccctcccctccgcgcccgctcctcctctttcaaacccgaccgacccgaataaaatcaactcaatcccgacaaccgccgcgcgaaaaaataaccgaaaaaccgaaaccacaaataaaaaaaaacgccccccgcccgcgccaaccgaaacgcccgcctaatcctacgaaaactcccgcgccgcccccgaaacgccc

SEQ ID NO: 27303 - DNA, 1045 bp, Artificial Sequence
  chemically treated genomic DNA (Homo sapiens) CpG-island No: 27303
ttttttacgtttgaagaaaatttgaggtgtttttcgcgtatagttgttttttaattcgcgagtaacggcgttaaggttttgtttgtaattcggggtgatttaggagttcgggtcgcgggttttttttttcgttcgggtatattttgtagaggagggggcggcggggacgggattcgggtttgcgtttgcgtatattttcgcggtttttttcgtttttttcgtcgggtatttgttacggttatcgtcgcggcgttcgttcgttacgttaaatcggatggcgggagtaggggtatggggcggggggcgcggggagggtggtacggcgcgtgcgtgcgcgggagtcgtcgagcgataattgggagtgcgcgcgttcgtcgttcgttcgcgtttcggaggcggagtttgtggcggggggcggagcgggggcgggtttatgttagttacgtgggcgcgggggcggggtggggcggggcggggcgttttcgagcggcgggtcgagggagggcgtagtagttgttttttgaatattttttgatttaatagttttttagcgtcggacgcgtcgcgttttggcggttttagggatttttttcgcgtttgtatttagtttcgcgttcgaggtgagttcggtttttaaatttttcgggcgggggtgggggtgcgggacgttttttttttgttgggggttttggaggcgcgaaggtattaggcgtttcggtagatggttgtatttttcgtttgcggtttttcgtgttttttggggggtcgggtgcgggcgcggaattcgggaggtgttcgtataaaaggtcgagaaaattgcgcgaggttttttttttttcgtttttttcgttttttttttttcgcgttcgtttttttttttttaaattcggtcggttcgagtggagttagtttagtttcggtagtcgtcgcgcgaggaaatggtcgaggggtcggagttataggtaaaggggggcgtttttcgttcgcgttagtcggggcgttcgtttggttttgcggaggttttcgcgtcgttttcgaggcgttt

SEQ ID NO: 27304 - DNA, 1045 bp, Artificial Sequence
  chemically treated genomic DNA (Homo sapiens) CpG-island No: 27304
aaacgcctcgaaaacgacgcgaaaacctccgcaaaaccaaacgaacgccccgactaacgcgaacgaaaaacgcccccctttacctataactccgacccctcgaccatttcctcgcgcgacgactaccgaaactaaactaactccactcgaaccgaccgaatttaaaaaaaaaaaaacgaacgcgaaaaaaaaaaaacgaaaaaaacgaaaaaaaaaaaacctcgcgcaattttctcgaccttttatacgaacacctcccgaattccgcgcccgcacccgaccccccaaaaaacacgaaaaaccgcaaacgaaaaatacaaccatctaccgaaacgcctaataccttcgcgcctccaaaacccccaacaaaaaaaaaacgtcccgcacccccacccccgcccgaaaaatttaaaaaccgaactcacctcgaacgcgaaactaaatacaaacgcgaaaaaaatccctaaaaccgccaaaacgcgacgcgtccgacgctaaaaaactattaaatcaaaaaatattcaaaaaacaactactacgccctccctcgacccgccgctcgaaaacgccccgccccgccccaccccgcccccgcgcccacgtaactaacataaacccgcccccgctccgccccccgccacaaactccgcctccgaaacgcgaacgaacgacgaacgcgcgcactcccaattatcgctcgacgactcccgcgcacgcacgcgccgtaccaccctccccgcgccccccgccccatacccctactcccgccatccgatttaacgtaacgaacgaacgccgcgacgataaccgtaacaaatacccgacgaaaaaaacgaaaaaaaccgcgaaaatatacgcaaacgcaaacccgaatcccgtccccgccgccccctcctctacaaaatatacccgaacgaaaaaaaaaacccgcgacccgaactcctaaatcaccccgaattacaaacaaaaccttaacgccgttactcgcgaattaaaaaacaactatacgcgaaaaacacctcaaattttcttcaaacgtaaaaaa

SEQ ID NO: 27305 - DNA, 1332 bp, Artificial Sequence
  chemically treated genomic DNA (Homo sapiens) CpG-island No: 27305
tcgttcgtggagttcgttcgttttcggggagttacgggatcgcgcgcgcggcgtcgggtagtcgggattcggtttcggattaggtgcggagcgggcggggtcggagcggcgggttcgggatatatagatacgtacgcggcgggataaattgacggatagcgttcggggtgggcgagcgcggtttatcgttgggcggagggttcgacgagagttcgggaggcggcgagcgggcgttatattttaaggcgcgattcggcgggcggcgtttcgggcgcggaaaggggagtttcggcgttttttgttcgcgaattcggtcggtcggttcgcgttttttttttcggttgtcgttcggtttgcgcgtgggttttggggttttcgcgcgtttcggtcgtttcgcgtcgtttttcgcgggtcgtttaatttttagcgttgtttcgcgtcgcgttttcggcgtcgtttcggcgttagtatcgtcgggttcggtcgggtttatagcgcgggggttcgggggttcggggcgtttcgtcgttcgcgttttttattttcgttgtaggcgtttttttcgtcgtcgtttttcgttgcgtttagttttttcgttgttattcgtttttgttcgcgcgttttgttttcggttttgcgttttattttcggtttcgttgcgttcggtttcggtttcgcgatttttcggtttttcggtttggggtcgtttttttcgttttcgtcggtcgggttttgtcgttattttttcgatcgttttcgcgttttttttttgtcgtcggggttttcgtcgcgttcgcgtttcggtttttttttcggtttttttgttttttgcggtttcgttcgttttttgttcgcggggttttcgttttcgtcgcggtcgttcgtcggttttttttcgtttttttttgttcgcgttgttttttttttttgcgcgtttttgttcgtttttttcgcggtttttgtttttttttgttttttttttttttatttttcgtgcggttttttttgtttcggatttcggttttcgttttggtcgcgttttcggttcgttcgggagttcgagttttcgtcgttcgcggcgcgtcgagaatttttaattcgcggtacgtcgtttcgttttgcgagattttcgtttttttttatacgtgattcgcgttttattgcggaggtcgcgcgttttttagttcgggagtttcggttgttcgcgggatttcgttttgttcgtttttcggtttaattcggttttaagttttttttcgcggggttcgcggcgcggagtaggggttggggcggggggttgttggtttcgtttttgttttggattttgttcgg

SEQ ID NO: 27306 - DNA, 1332 bp, Artificial Sequence
  chemically treated genomic DNA (Homo sapiens) CpG-island No: 27306
ccgaacaaaatccaaaacaaaaacgaaaccaacaaccccccgccccaacccctactccgcgccgcgaaccccgcgaaaaaaaacttaaaaccgaattaaaccgaaaaacgaacaaaacgaaatcccgcgaacaaccgaaactcccgaactaaaaaacgcgcgacctccgcaataaaacgcgaatcacgtataaaaaaaaacgaaaatctcgcaaaacgaaacgacgtaccgcgaattaaaaattctcgacgcgccgcgaacgacgaaaactcgaactcccgaacgaaccgaaaacgcgaccaaaacgaaaaccgaaatccgaaacaaaaaaaaccgcacgaaaaataaaaaaaaaaaaaacaaaaaaaaacaaaaaccgcgaaaaaaacgaacaaaaacgcgcaaaaaaaaaaaacaacgcgaacaaaaaaaaacgaaaaaaaaccgacgaacgaccgcgacgaaaacgaaaaccccgcgaacaaaaaacgaacgaaaccgcaaaaaacaaaaaaaccgaaaaaaaaaccgaaacgcgaacgcgacgaaaaccccgacgacaaaaaaaaaacgcgaaaacgatcgaaaaaataacgacaaaacccgaccgacgaaaacgaaaaaaacgaccccaaaccgaaaaaccgaaaaatcgcgaaaccgaaaccgaacgcaacgaaaccgaaaataaaacgcaaaaccgaaaacaaaacgcgcgaacaaaaacgaataacaacgaaaaaactaaacgcaacgaaaaacgacgacgaaaaaaacgcctacaacgaaaataaaaaacgcgaacgacgaaacgccccgaacccccgaacccccgcgctataaacccgaccgaacccgacgatactaacgccgaaacgacgccgaaaacgcgacgcgaaacaacgctaaaaattaaacgacccgcgaaaaacgacgcgaaacgaccgaaacgcgcgaaaaccccaaaacccacgcgcaaaccgaacgacaaccgaaaaaaaaaacgcgaaccgaccgaccgaattcgcgaacaaaaaacgccgaaactcccctttccgcgcccgaaacgccgcccgccgaatcgcgccttaaaatataacgcccgctcgccgcctcccgaactctcgtcgaaccctccgcccaacgataaaccgcgctcgcccaccccgaacgctatccgtcaatttatcccgccgcgtacgtatctatatatcccgaacccgccgctccgaccccgcccgctccgcacctaatccgaaaccgaatcccgactacccgacgccgcgcgcgcgatcccgtaactccccgaaaacgaacgaactccacgaacga

SEQ ID NO: 27307 - DNA, 1332 bp, Artificial Sequence
  chemically treated genomic DNA (Homo sapiens) CpG-island No: 27307
tcgggtaggatttagggtaggagcggggttagtagtttttcgttttagtttttgtttcgcgtcgcgggtttcgcgggagggggtttgaggtcgggttaggtcgaggggcgggtagggcggggtttcgcgggtagtcggggttttcgggttggggggcgcgcggttttcgtagtggggcgcgggttacgtgtgaggaggggcgaaagtttcgtaaagcggggcggcgtgtcgcgagttgggagttttcggcgcgtcgcgggcggcgggagttcgggttttcgggcgagtcggggacgcggttaaggcgggggtcggggttcgagatagagggggtcgtacggagagtgggagggggagagatagagaaggataggggtcgcgagggagacggatagagacgcgtaggggagagaggtagcgcgggtagagggaggcggggggaggtcggcgggcgatcgcgacggagacggagatttcgcgggtagagggcgagcggggtcgtaggaggtagggaggtcgggagagggatcgggacgcgagcgcggcggagatttcggcggtaggagagagacgcgagagcggtcggggaggtggcgatagagttcggtcggcgggggcggggagggcgattttaggtcgggaggtcgaggggtcgcggggtcggggtcgagcgtagcggggtcgggagtggagcgtagggtcgggggtagagcgcgcgagtaggagcgggtgatagcgagggagttgggcgtagcgggggacggcggcggggagggcgtttgtagcgggggtggggggcgcgggcggcggggcgtttcgggttttcggattttcgcgttgtgagttcggtcgggttcgacgatgttgacgtcgaggcggcgtcgagggcgcggcgcggggtagcgttgaaagttgggcggttcgcggggagcggcgcgggacggtcgggacgcgcggagattttaagatttacgcgtagatcgagcggtagtcggggaggggagcgcgggtcggtcggtcgagttcgcgggtagggggcgtcgggattttttttttcgcgttcgggacgtcgttcgtcggatcgcgttttgggatgtagcgttcgttcgtcgtttttcggattttcgtcggatttttcgtttagcggtaagtcgcgttcgtttatttcgggcgttgttcgttagtttgtttcgtcgcgtgcgtgtttgtgtgtttcgggttcgtcgtttcggtttcgttcgtttcgtatttgattcggagtcgggtttcggttgttcggcgtcgcgcgcgcggtttcgtgatttttcgggagcgggcgggttttacgggcgg

SEQ ID NO: 27308 - DNA, 1332 bp, Artificial Sequence
  chemically treated genomic DNA (Homo sapiens) CpG-island No: 27308
ccgcccgtaaaacccgcccgctcccgaaaaatcacgaaaccgcgcgcgcgacgccgaacaaccgaaacccgactccgaatcaaatacgaaacgaacgaaaccgaaacgacgaacccgaaacacacaaacacgcacgcgacgaaacaaactaacgaacaacgcccgaaataaacgaacgcgacttaccgctaaacgaaaaatccgacgaaaatccgaaaaacgacgaacgaacgctacatcccaaaacgcgatccgacgaacgacgtcccgaacgcgaaaaaaaaaatcccgacgccccctacccgcgaactcgaccgaccgacccgcgctcccctccccgactaccgctcgatctacgcgtaaatcttaaaatctccgcgcgtcccgaccgtcccgcgccgctccccgcgaaccgcccaactttcaacgctaccccgcgccgcgccctcgacgccgcctcgacgtcaacatcgtcgaacccgaccgaactcacaacgcgaaaatccgaaaacccgaaacgccccgccgcccgcgccccccacccccgctacaaacgccctccccgccgccgtcccccgctacgcccaactccctcgctatcacccgctcctactcgcgcgctctacccccgaccctacgctccactcccgaccccgctacgctcgaccccgaccccgcgacccctcgacctcccgacctaaaatcgccctccccgcccccgccgaccgaactctatcgccacctccccgaccgctctcgcgtctctctcctaccgccgaaatctccgccgcgctcgcgtcccgatccctctcccgacctccctacctcctacgaccccgctcgccctctacccgcgaaatctccgtctccgtcgcgatcgcccgccgacctccccccgcctccctctacccgcgctacctctctcccctacgcgtctctatccgtctccctcgcgacccctatccttctctatctctccccctcccactctccgtacgaccccctctatctcgaaccccgacccccgccttaaccgcgtccccgactcgcccgaaaacccgaactcccgccgcccgcgacgcgccgaaaactcccaactcgcgacacgccgccccgctttacgaaactttcgcccctcctcacacgtaacccgcgccccactacgaaaaccgcgcgccccccaacccgaaaaccccgactacccgcgaaaccccgccctacccgcccctcgacctaacccgacctcaaaccccctcccgcgaaacccgcgacgcgaaacaaaaactaaaacgaaaaactactaaccccgctcctaccctaaatcctacccga

SEQ ID NO: 27309 - DNA, 627 bp, Artificial Sequence
  chemically treated genomic DNA (Homo sapiens) CpG-island No: 27309
attgaggtttttcgtgtcgtcgttttagtcgaaggtttttttggcggtatttagtcggaagtcgtagaattaaaatttacggtcgaagtttcgaaggtttttcgagtggaggagattttttagcgtatgattaggaatcgggcgtagatgttcgcgaattagagtaagtagggttcgttttttttcgagaaggagtgcgtttttatttttgtttcggttattagggttaaggttcgcggtttcgaggacgacgacgtttaggtttagtattcgcgtaaacgtcgtttttagcgttttatttagtagttgtagtagtagttgaatacgtttacgtagtagacgagggaggtgatttagtagacgttggtcgttatcgtggacgttattaagttggatgttatcgagttttattatagcgatagggttaatttttatttcgaatatttgtagattaggaagaagatcgaggagaagcgtaagattttgtgttgtattacgtcgtaggcgttttagtggtacgtttagtacgttatttatacgggtttttattttttggacggtaagtcgtttagtaagttttatattttcgtgatcgtattttttttttttttggcggagtttttgaag

SEQ ID NO: 27310 - DNA, 627 bp, Artificial Sequence
  chemically treated genomic DNA (Homo sapiens) CpG-island No: 27310
cttcaaaaactccgccaaaaaaaaaaaaaatacgatcacgaaaatataaaacttactaaacgacttaccgtccaaaaaataaaaacccgtataaataacgtactaaacgtaccactaaaacgcctacgacgtaatacaacacaaaatcttacgcttctcctcgatcttcttcctaatctacaaatattcgaaataaaaattaaccctatcgctataataaaactcgataacatccaacttaataacgtccacgataacgaccaacgtctactaaatcacctccctcgtctactacgtaaacgtattcaactactactacaactactaaataaaacgctaaaaacgacgtttacgcgaatactaaacctaaacgtcgtcgtcctcgaaaccgcgaaccttaaccctaataaccgaaacaaaaataaaaacgcactccttctcgaaaaaaaacgaaccctacttactctaattcgcgaacatctacgcccgattcctaatcatacgctaaaaaatctcctccactcgaaaaaccttcgaaacttcgaccgtaaattttaattctacgacttccgactaaataccgccaaaaaaaccttcgactaaaacgacgacacgaaaaacctcaat

SEQ ID NO: 27311 - DNA, 627 bp, Artificial Sequence
  chemically treated genomic DNA (Homo sapiens) CpG-island No: 27311
ttttaggggtttcgttagggagggagggggtgcgattacggggatgtggagtttgttgagcggtttgtcgtttaggaggtaggagttcgtgtaggtgacgtattgggcgtattattggggcgtttgcggcgtgatatagtataggattttgcgttttttttcgattttttttttgatttgtaggtattcgaagtaggggttggttttgtcgttgtggtagggttcgatggtatttagtttgatggcgtttacgatggcggttagcgtttgttggattatttttttcgtttgttgcgtggacgtgtttagttgttgttgtagttgttgggtggagcgttgaaagcggcgtttgcgcggatgttgggtttgggcgtcgtcgttttcggagtcgcgggttttggttttggtgatcggggtaggggtgggggcgtattttttttcggaggggggcgggttttgtttgttttggttcgcgagtatttgcgttcggtttttggttatgcgttgagggattttttttattcggggggttttcggggtttcggtcgtgggttttggttttgcggttttcggttggatgtcgttaggagggttttcggttggggcggcggtacgggaggttttagt

SEQ ID NO: 27312 - DNA, 627 bp, Artificial Sequence
  chemically treated genomic DNA (Homo sapiens) CpG-island No: 27312
actaaaacctcccgtaccgccgccccaaccgaaaaccctcctaacgacatccaaccgaaaaccgcaaaaccaaaacccacgaccgaaaccccgaaaaccccccgaataaaaaaaatccctcaacgcataaccaaaaaccgaacgcaaatactcgcgaaccaaaacaaacaaaacccgcccccctccgaaaaaaaatacgcccccacccctaccccgatcaccaaaaccaaaacccgcgactccgaaaacgacgacgcccaaacccaacatccgcgcaaacgccgctttcaacgctccacccaacaactacaacaacaactaaacacgtccacgcaacaaacgaaaaaaataatccaacaaacgctaaccgccatcgtaaacgccatcaaactaaataccatcgaaccctaccacaacgacaaaaccaacccctacttcgaatacctacaaatcaaaaaaaaaatcgaaaaaaaacgcaaaatcctatactatatcacgccgcaaacgccccaataatacgcccaatacgtcacctacacgaactcctacctcctaaacgacaaaccgctcaacaaactccacatccccgtaatcgcaccccctccctccctaacgaaacccctaaaa

SEQ ID NO: 27313 - DNA, 540 bp, Artificial Sequence
  chemically treated genomic DNA (Homo sapiens) CpG-island No: 27313
acgcgttatttttcggcggttgggttttaggtaggaagtttttgattggcggagtcgtagaagtatcgggtgaaaagagttttattggttgcgtatcggagttcgggcgtagttagtgtcgtacggtaaaatggcggtttttagttgttttgggacgtttgggttcggggagataaatttcgatttggaagagatcgttgattatgtgggtcgtattggaggtgttcgcggggcgggtttattgttattttcggttataggaagtttgtgtttcgtacgataatatggcggcgtttagttgtatgaaggcggaaattttgtgattttcggttcgtagtggggtttgcggtgggagtgggaaggaaggcggagggaattatgcgaggttttgagaattgcggcgagggtcgtttcgagagacggtttttgaggtgggggtcggacggtgcggggattagaggcgggggcggggatatagagggagaggtattggggagagttgggcgttgagtttgaggggaaagttgtggtatttttttg

SEQ ID NO: 27314 - DNA, 540 bp, Artificial Sequence
  chemically treated genomic DNA (Homo sapiens) CpG-island No: 27314
caaaaaaataccacaactttcccctcaaactcaacgcccaactctccccaatacctctccctctatatccccgcccccgcctctaatccccgcaccgtccgacccccacctcaaaaaccgtctctcgaaacgaccctcgccgcaattctcaaaacctcgcataattccctccgccttccttcccactcccaccgcaaaccccactacgaaccgaaaatcacaaaatttccgccttcatacaactaaacgccgccatattatcgtacgaaacacaaacttcctataaccgaaaataacaataaacccgccccgcgaacacctccaatacgacccacataatcaacgatctcttccaaatcgaaatttatctccccgaacccaaacgtcccaaaacaactaaaaaccgccattttaccgtacgacactaactacgcccgaactccgatacgcaaccaataaaactcttttcacccgatacttctacgactccgccaatcaaaaacttcctacctaaaacccaaccgccgaaaaataacgcgt

SEQ ID NO: 27315 - DNA, 540 bp, Artificial Sequence
  chemically treated genomic DNA (Homo sapiens) CpG-island No: 27315
taggaaggtattatagttttttttttagatttagcgtttagttttttttaatatttttttttttatattttcgttttcgtttttgattttcgtatcgttcggtttttattttagaaatcgtttttcgaggcgattttcgtcgtaatttttagaatttcgtatggtttttttcgtttttttttttatttttatcgtaggttttattacggatcggaagttatagagttttcgtttttatgtaattaagcgtcgttatattgtcgtacggaatataggttttttgtggtcggaggtgatagtaggttcgtttcgcgaatatttttagtgcggtttatatagttagcggttttttttaggtcggagtttgttttttcgaatttaggcgttttaaagtagttgggggtcgttattttgtcgtacggtattggttacgttcggatttcggtgcgtagttagtggagttttttttattcggtgtttttacgatttcgttaattagaaattttttgtttggggtttaatcgtcggagagtagcgcgt

SEQ ID NO: 27316 - DNA, 540 bp, Artificial Sequence
  chemically treated genomic DNA (Homo sapiens) CpG-island No: 27316
acgcgctactctccgacgattaaaccccaaacaaaaaatttctaattaacgaaatcgtaaaaacaccgaataaaaaaaactccactaactacgcaccgaaatccgaacgtaaccaataccgtacgacaaaataacgacccccaactactttaaaacgcctaaattcgaaaaaacaaactccgacctaaaaaaaaccgctaactatataaaccgcactaaaaatattcgcgaaacgaacctactatcacctccgaccacaaaaaacctatattccgtacgacaatataacgacgcttaattacataaaaacgaaaactctataacttccgatccgtaataaaacctacgataaaaataaaaaaaaaaacgaaaaaaaccatacgaaattctaaaaattacgacgaaaatcgcctcgaaaaacgatttctaaaataaaaaccgaacgatacgaaaatcaaaaacgaaaacgaaaatataaaaaaaaaaatattaaaaaaaactaaacgctaaatctaaaaaaaaaactataataccttccta

SEQ ID NO: 27317 - DNA, 550 bp, Artificial Sequence
  chemically treated genomic DNA (Homo sapiens) CpG-island No: 27317
ggttttcggcgtcgtttggggtgcgtggcgggcgcggggggcggcggtcgggttagcgggtcgttcggcggggaagtttagggagttaggtagcggtttagggcggcggcggggagtaggaaggttcgggtcggggggaaaggtcggatttgttcggcggaagaaatatagatggcggcggcgtagcgttatttcgggtcgggagtaggtagttagtagttttgtttttatcgcggttcgttcgtcgtcgttaaatattcggatgcgtcgtttaagcgttagacgcggagttgggaaaagggaggtagaggaggcggaggtagaggtagaggtagaggtagagttcgagttcggtgtcgagattaagcgatagatcggcggggttgggtttcgtaaagtcggttcggcgagttttttcgatattcgagtcggggaggaaaagtagcgatttttcgttcgtattttcgggagtcgtattttagattggttcggtagttaggggtttaggagtagatttcgaggtaggttttgtttagttttcgacgagggt

SEQ ID NO: 27318 - DNA, 550 bp, Artificial Sequence
  chemically treated genomic DNA (Homo sapiens) CpG-island No: 27318
accctcgtcgaaaactaaacaaaacctacctcgaaatctactcctaaacccctaactaccgaaccaatctaaaatacgactcccgaaaatacgaacgaaaaatcgctacttttcctccccgactcgaatatcgaaaaaactcgccgaaccgactttacgaaacccaaccccgccgatctatcgcttaatctcgacaccgaactcgaactctacctctacctctacctctacctccgcctcctctacctcccttttcccaactccgcgtctaacgcttaaacgacgcatccgaatatttaacgacgacgaacgaaccgcgataaaaacaaaactactaactacctactcccgacccgaaataacgctacgccgccgccatctatatttcttccgccgaacaaatccgacctttccccccgacccgaaccttcctactccccgccgccgccctaaaccgctacctaactccctaaacttccccgccgaacgacccgctaacccgaccgccgccccccgcgcccgccacgcaccccaaacgacgccgaaaacc

SEQ ID NO: 27319 - DNA, 550 bp, Artificial Sequence
  chemically treated genomic DNA (Homo sapiens) CpG-island No: 27319
gttttcgtcggaggttgagtaaagtttgtttcgggatttgtttttgagtttttgattatcgggttagtttggagtgcggttttcggggatgcgagcgaggagtcgttgtttttttttttcggttcgggtgtcgggagagttcgtcgagtcggttttgcgaggtttagtttcgtcggtttgtcgtttggtttcggtatcgggttcgggttttgtttttgtttttgtttttgttttcgttttttttgtttttttttttttagtttcgcgtttggcgtttgggcggcgtattcgggtatttagcggcggcgggcggatcgcggtgaggatagggttgttggttgtttgttttcggttcggaatggcgttgcgtcgtcgttatttgtgtttttttcgtcgagtaaattcgattttttttttcggttcgggtttttttgtttttcgtcgtcgttttgggtcgttgtttggttttttgggttttttcgtcgggcggttcgttggttcggtcgtcgtttttcgcgttcgttacgtattttaaacggcgtcgaggatt

SEQ ID NO: 27320 - DNA, 550 bp, Artificial Sequence
  chemically treated genomic DNA (Homo sapiens) CpG-island No: 27320
aatcctcgacgccgtttaaaatacgtaacgaacgcgaaaaacgacgaccgaaccaacgaaccgcccgacgaaaaaacccaaaaaaccaaacaacgacccaaaacgacgacgaaaaacaaaaaaacccgaaccgaaaaaaaaaatcgaatttactcgacgaaaaaaacacaaataacgacgacgcaacgccattccgaaccgaaaacaaacaaccaacaaccctatcctcaccgcgatccgcccgccgccgctaaatacccgaatacgccgcccaaacgccaaacgcgaaactaaaaaaaaaaaaacaaaaaaaacgaaaacaaaaacaaaaacaaaaacaaaacccgaacccgataccgaaaccaaacgacaaaccgacgaaactaaacctcgcaaaaccgactcgacgaactctcccgacacccgaaccgaaaaaaaaaaacaacgactcctcgctcgcatccccgaaaaccgcactccaaactaacccgataatcaaaaactcaaaaacaaatcccgaaacaaactttactcaacctccgacgaaaac

SEQ ID NO: 27321 - DNA, 632 bp, Artificial Sequence
  chemically treated genomic DNA (Homo sapiens) CpG-island No: 27321
atttagatcgacgtgaggcggtacgaggcgagatttagatagcggcgtagaaagtgcgtcgtcgtttttgtggtttttaggagtcgtcgttggcgttgttttgttgcgttggtagcgtcgcgattttttgggttagtcgatcgcggtagggttttacgtcgttggttaattcgcggtttagcgtgttttgttgtattagttcgggttcgtcgtcgcgtttttttcgtagttatttagaaggtgtttgtaggaggcgtagtagtcgttttgggtgtacgtgtttcggtttgggcgtttatcggtagtcgtcggtcgtttacgataagttgtagggttacgcggggcgggagggtcggtcgtggattagttgtaagtttgcgttttgtagaattagaggttttgaggatcgttttaagggcgtaatgtttttgttttttgcgtcgcgtacggggtttagggtcgcgggttattagaagcggtagtaggagtggatggaggtggtatcgggcgtatttaaggtttaggtttacggtcgcgttttttatggtcgtttgtttttttttttttttttttattttcgtttttatattagtttagttttgtcgttgttgggagtttatcgttttaggtta

SEQ ID NO: 27322 - DNA, 632 bp, Artificial Sequence
  chemically treated genomic DNA (Homo sapiens) CpG-island No: 27322
taacctaaaacgataaactcccaacaacgacaaaactaaactaatataaaaacgaaaataaaaaaaaaaaaaaaaaaacaaacgaccataaaaaacgcgaccgtaaacctaaaccttaaatacgcccgataccacctccatccactcctactaccgcttctaataacccgcgaccctaaaccccgtacgcgacgcaaaaaacaaaaacattacgcccttaaaacgatcctcaaaacctctaattctacaaaacgcaaacttacaactaatccacgaccgaccctcccgccccgcgtaaccctacaacttatcgtaaacgaccgacgactaccgataaacgcccaaaccgaaacacgtacacccaaaacgactactacgcctcctacaaacaccttctaaataactacgaaaaaaacgcgacgacgaacccgaactaatacaacaaaacacgctaaaccgcgaattaaccaacgacgtaaaaccctaccgcgatcgactaacccaaaaaatcgcgacgctaccaacgcaacaaaacaacgccaacgacgactcctaaaaaccacaaaaacgacgacgcactttctacgccgctatctaaatctcgcctcgtaccgcctcacgtcgatctaaat

SEQ ID NO: 27323 - DNA, 632 bp, Artificial Sequence
  chemically treated genomic DNA (Homo sapiens) CpG-island No: 27323
tggtttagggcgatgagtttttagtagcggtaaggttaagttgatatgagagcggaggtggagggaaggaggaaggaataggcggttataaagagcgcggtcgtgagtttagattttgggtgcgttcggtgttatttttatttatttttattgtcgtttttggtagttcgcggttttgaatttcgtgcgcgacgtagagaataaggatattgcgtttttggggcggtttttagagtttttgattttgtagaacgtagatttgtagttggtttacggtcggttttttcgtttcgcgtggttttatagtttgtcgtgggcggtcggcgattatcggtaggcgtttaagtcgaaatacgtgtatttagagcggttgttgcgttttttatagatattttttggatgattgcggaagaagcgcggcggcggattcgggttggtgtagtaggatacgttgagtcgcgggttggttaacggcgtggagttttatcgcgatcggttagtttagggggtcgcggcgttgttagcgtagtagggtaacgttagcggcggtttttgggagttataggggcggcgacgtattttttgcgtcgttgtttggatttcgtttcgtgtcgttttacgtcggtttgggt

SEQ ID NO: 27324 - DNA, 632 bp, Artificial Sequence
  chemically treated genomic DNA (Homo sapiens) CpG-island No: 27324
acccaaaccgacgtaaaacgacacgaaacgaaatccaaacaacgacgcaaaaaatacgtcgccgcccctataactcccaaaaaccgccgctaacgttaccctactacgctaacaacgccgcgaccccctaaactaaccgatcgcgataaaactccacgccgttaaccaacccgcgactcaacgtatcctactacaccaacccgaatccgccgccgcgcttcttccgcaatcatccaaaaaatatctataaaaaacgcaacaaccgctctaaatacacgtatttcgacttaaacgcctaccgataatcgccgaccgcccacgacaaactataaaaccacgcgaaacgaaaaaaccgaccgtaaaccaactacaaatctacgttctacaaaatcaaaaactctaaaaaccgccccaaaaacgcaatatccttattctctacgtcgcgcacgaaattcaaaaccgcgaactaccaaaaacgacaataaaaataaataaaaataacaccgaacgcacccaaaatctaaactcacgaccgcgctctttataaccgcctattccttcctccttccctccacctccgctctcatatcaacttaaccttaccgctactaaaaactcatcgccctaaacca

SEQ ID NO: 27325 - DNA, 1020 bp, Artificial Sequence
  chemically treated genomic DNA (Homo sapiens) CpG-island No: 27325
gttacgttttttacggtttataggaggcgtattgggtcgtagggttcgggcgcgggacgtggcgcgggtttttgcgggagggtatttgttcgtttcgttgattaggcgtttttcgtaggtatttggtcgtgcggtattcgttgcgttcgcgcgttttgcgtacgtcgcgtaacgttcgcgtcgtagtggggttggtgtggttgttggcggcgtttttttcggcgttttattttagttattacggtatcgtgcgttacggcgcgttggagttttgcgtgttcgtttgggaggacgcgcgtcgtcgcgttttggacgtggttattttcgttgtcggttatttgttgttcgtggttgtggtgagtttggtttacgggcgtacgttgcgttttttgtgggtcgtcgtgggtttcgcgggcgcggcggcggtcgaggcgcggcggagggcgacgggtcgcgcggggcgcgttatgttggcggtggtcgcgttttacgcgttttgttggggttcgtattacgcgtttattttgtgtttttggtacggtcgtttcgtttttagttcggttatttacgtttgtcgtttggttttatattgtttggtttacgttaatttttgttttaattcgttcgtttacgcgttcgtttcgcgttattttcgcgcgcgttttcgtcgtttgtggtcgtgcggtcgtcgacgtcgttatcgtgttcgtcgcgttttgcgtcgcgttcgtttcgcgttttcgggtttattcggttgtttcggagacgttcggtttagcgggaggttgttggttggtggcggttagggttcggagtttagggagggattcgtttacggcggagaggttgttcgaggatcggaataaattttgtcgtttggatttcgtttgtgttcgtttgttttattttcgtttttcgaaggcgggacgttatcgggttagggatggggtaatgttacgagttttttgaggggcgttgagtggagcgatttgttttcgttttatagcggagtattagttt

SEQ ID NO: 27326 - DNA, 1020 bp, Artificial Sequence
  chemically treated genomic DNA (Homo sapiens) CpG-island No: 27326
aaactaatactccgctataaaacgaaaacaaatcgctccactcaacgcccctcaaaaaactcgtaacattaccccatccctaacccgataacgtcccgccttcgaaaaacgaaaataaaacaaacgaacacaaacgaaatccaaacgacaaaatttattccgatcctcgaacaacctctccgccgtaaacgaatccctccctaaactccgaaccctaaccgccaccaaccaacaacctcccgctaaaccgaacgtctccgaaacaaccgaataaacccgaaaacgcgaaacgaacgcgacgcaaaacgcgacgaacacgataacgacgtcgacgaccgcacgaccacaaacgacgaaaacgcgcgcgaaaataacgcgaaacgaacgcgtaaacgaacgaattaaaacaaaaattaacgtaaaccaaacaatataaaaccaaacgacaaacgtaaataaccgaactaaaaacgaaacgaccgtaccaaaaacacaaaataaacgcgtaatacgaaccccaacaaaacgcgtaaaacgcgaccaccgccaacataacgcgccccgcgcgacccgtcgccctccgccgcgcctcgaccgccgccgcgcccgcgaaacccacgacgacccacaaaaaacgcaacgtacgcccgtaaaccaaactcaccacaaccacgaacaacaaataaccgacaacgaaaataaccacgtccaaaacgcgacgacgcgcgtcctcccaaacgaacacgcaaaactccaacgcgccgtaacgcacgataccgtaataactaaaataaaacgccgaaaaaaacgccgccaacaaccacaccaaccccactacgacgcgaacgttacgcgacgtacgcaaaacgcgcgaacgcaacgaataccgcacgaccaaatacctacgaaaaacgcctaatcaacgaaacgaacaaataccctcccgcaaaaacccgcgccacgtcccgcgcccgaaccctacgacccaatacgcctcctataaaccgtaaaaaacgtaac

SEQ ID NO: 27327 - DNA, 1020 bp, Artificial Sequence
  chemically treated genomic DNA (Homo sapiens) CpG-island No: 27327
gggttggtgtttcgttgtggagcggggataagtcgttttatttaacgttttttagagagttcgtggtattgttttatttttggttcggtggcgtttcgttttcggagaacgggagtgagatagacggatataggcggagtttaggcggtagggtttatttcggttttcgggtagttttttcgtcgtggacgggtttttttttgggtttcgggttttggtcgttattagttagtagtttttcgttaggtcgggcgttttcggggtagtcgggtgggttcgaggacgcggggcggacgcgacgtaaggcgcggcgggtacggtggcggcgtcggcggtcgtacggttataggcggcggaagcgcgcgcggaagtggcgcgaggcgagcgcgtagacgagcgggttgaggtaggagttggcgtaggttaggtagtgtgaggttaggcggtaggcgtaggtggtcgggttgaaggcgaagcggtcgtattagaagtataggatgagcgcgtggtgcggattttagtagagcgcgtagagcgcggttatcgttagtatggcgcgtttcgcgcggttcgtcgtttttcgtcgcgtttcggtcgtcgtcgcgttcgcgggatttacggcggtttataggaagcgtagcgtgcgttcgtaggttaggtttattatagttacgggtagtaggtagtcggtagcgaaggtggttacgtttagggcgcggcggcgcgcgtttttttaggcgggtacgtagagttttagcgcgtcgtagcgtacggtgtcgtagtagttgaggtagggcgtcgagaagagcgtcgttagtagttatattagttttattgcggcgcgggcgttacgcggcgtgcgtagggcgcgcgagcgtagcgggtgtcgtacggttaggtatttgcggagggcgtttggttagcggggcgggtaggtgttttttcgtaggggttcgcgttacgtttcgcgttcgggttttgcggtttagtgcgttttttgtgaatcgtgggggacgtggt

SEQ ID NO: 27328 - DNA, 1020 bp, Artificial Sequence
  chemically treated genomic DNA (Homo sapiens) CpG-island No: 27328
accacgtcccccacgattcacaaaaaacgcactaaaccgcaaaacccgaacgcgaaacgtaacgcgaacccctacgaaaaaacacctacccgccccgctaaccaaacgccctccgcaaatacctaaccgtacgacacccgctacgctcgcgcgccctacgcacgccgcgtaacgcccgcgccgcaataaaactaatataactactaacgacgctcttctcgacgccctacctcaactactacgacaccgtacgctacgacgcgctaaaactctacgtacccgcctaaaaaaacgcgcgccgccgcgccctaaacgtaaccaccttcgctaccgactacctactacccgtaactataataaacctaacctacgaacgcacgctacgcttcctataaaccgccgtaaatcccgcgaacgcgacgacgaccgaaacgcgacgaaaaacgacgaaccgcgcgaaacgcgccatactaacgataaccgcgctctacgcgctctactaaaatccgcaccacgcgctcatcctatacttctaatacgaccgcttcgccttcaacccgaccacctacgcctaccgcctaacctcacactacctaacctacgccaactcctacctcaacccgctcgtctacgcgctcgcctcgcgccacttccgcgcgcgcttccgccgcctataaccgtacgaccgccgacgccgccaccgtacccgccgcgccttacgtcgcgtccgccccgcgtcctcgaacccacccgactaccccgaaaacgcccgacctaacgaaaaactactaactaataacgaccaaaacccgaaacccaaaaaaaaacccgtccacgacgaaaaaactacccgaaaaccgaaataaaccctaccgcctaaactccgcctatatccgtctatctcactcccgttctccgaaaacgaaacgccaccgaaccaaaaataaaacaataccacgaactctctaaaaaacgttaaataaaacgacttatccccgctccacaacgaaacaccaaccc

SEQ ID NO: 27329 - DNA, 708 bp, Artificial Sequence
  chemically treated genomic DNA (Homo sapiens) CpG-island No: 27329
ggggatttcggttgagggtcgggggcgattaaagcgcggttattggttttttgaggtttcgtttttcgttcgggttgtttcgtttcgggttttcgcgtcgttcgcgtcgtttatcgtgtatttttttgttcgtgggttcgagtcgtcggtggggtttggtagcgcgttttagtcggttagcgggtattttgtagcgtagttcgtcgcgcggtttcgtattttgttgttataggacgtgtaagtagcgtagcggcgattgggtttcgtcggacgttcggttcgagaggttcgcgtcgtcgtcgtttagcgtagattcgaagttagcgaaggagaagaggtttttagcgttagttagcggtttcggcgttatcgcgtattcgtttttcgagttcgagtggtttgagcgcggttcgtcgttcgcgttttcggcggcggttgttatggtaacggtttcgcgcgggtttggtcgtttgagtttcgttttcgatcgattaacggatttattttttttcgttttgagtcgtgttgttagcgagttggcgggcgggtagggttcgtaattacggtaatcgagcgggggcgggtttaggtcgagatagagcggcgaattaatgattatttttttagtttaaatcggttttaaaattaatcggaaagggagggtatagtataagtaggataattggatagggttttcggtaacgtgat

SEQ ID NO: 27330 - DNA, 708 bp, Artificial Sequence
  chemically treated genomic DNA (Homo sapiens) CpG-island No: 27330
atcacgttaccgaaaaccctatccaattatcctacttatactataccctccctttccgattaattttaaaaccgatttaaactaaaaaaataatcattaattcgccgctctatctcgacctaaacccgcccccgctcgattaccgtaattacgaaccctacccgcccgccaactcgctaacaacacgactcaaaacgaaaaaaaataaatccgttaatcgatcgaaaacgaaactcaaacgaccaaacccgcgcgaaaccgttaccataacaaccgccgccgaaaacgcgaacgacgaaccgcgctcaaaccactcgaactcgaaaaacgaatacgcgataacgccgaaaccgctaactaacgctaaaaacctcttctccttcgctaacttcgaatctacgctaaacgacgacgacgcgaacctctcgaaccgaacgtccgacgaaacccaatcgccgctacgctacttacacgtcctataacaacaaaatacgaaaccgcgcgacgaactacgctacaaaatacccgctaaccgactaaaacgcgctaccaaaccccaccgacgactcgaacccacgaacaaaaaaatacacgataaacgacgcgaacgacgcgaaaacccgaaacgaaacaacccgaacgaaaaacgaaacctcaaaaaaccaataaccgcgctttaatcgcccccgaccctcaaccgaaatcccc

SEQ ID NO: 27331 - DNA, 708 bp, Artificial Sequence
  chemically treated genomic DNA (Homo sapiens) CpG-island No: 27331
gttacgttgtcggaaattttgtttaattattttgtttgtattgtgtttttttttttcgattggttttgggatcggtttaagttggaagggtagttattggttcgtcgttttgtttcggtttgagttcgttttcgttcggttgtcgtggttgcgggttttgttcgttcgttagttcgttgatagtacgatttagggcggagggaagtaggttcgttggtcggtcgggaacgaggtttaggcggttaggttcgcgcggagtcgttgttatggtagtcgtcgtcggggacgcggacgacgagtcgcgtttaggttattcgagttcggagggcgagtgcgcggtggcgtcggagtcgttgattgacgttgagggttttttttttttcgttgatttcgggtttgcgttgggcggcggcggcgcgggtttttcgggtcgggcgttcggcggggtttagtcgtcgttgcgttatttgtacgttttgtggtagtaggatgcggagtcgcgcgacgagttgcgttgtaagatattcgttggtcggttgaggcgcgttgttaggttttatcggcggttcgggtttacgggtaaggaggtgtacggtgagcggcgcgagcggcgcgggggttcggggcggggtagttcgggcgaggggcggggttttagaggattagtggtcgcgttttggtcgttttcgatttttagtcggggttttt

SEQ ID NO: 27332 - DNA, 708 bp, Artificial Sequence
  chemically treated genomic DNA (Homo sapiens) CpG-island No: 27332
aaaaaccccgactaaaaatcgaaaacgaccaaaacgcgaccactaatcctctaaaaccccgcccctcgcccgaactaccccgccccgaacccccgcgccgctcgcgccgctcaccgtacacctccttacccgtaaacccgaaccgccgataaaacctaacaacgcgcctcaaccgaccaacgaatatcttacaacgcaactcgtcgcgcgactccgcatcctactaccacaaaacgtacaaataacgcaacgacgactaaaccccgccgaacgcccgacccgaaaaacccgcgccgccgccgcccaacgcaaacccgaaatcaacgaaaaaaaaaaaaccctcaacgtcaatcaacgactccgacgccaccgcgcactcgccctccgaactcgaataacctaaacgcgactcgtcgtccgcgtccccgacgacgactaccataacaacgactccgcgcgaacctaaccgcctaaacctcgttcccgaccgaccaacgaacctacttccctccgccctaaatcgtactatcaacgaactaacgaacgaacaaaacccgcaaccacgacaaccgaacgaaaacgaactcaaaccgaaacaaaacgacgaaccaataactacccttccaacttaaaccgatcccaaaaccaatcgaaaaaaaaaaacacaatacaaacaaaataattaaacaaaatttccgacaacgtaac

SEQ ID NO: 27333 - DNA, 851 bp, Artificial Sequence
  chemically treated genomic DNA (Homo sapiens) CpG-island No: 27333
cgcgttttgttcgcgtttcgtcgtttttcggttcgttttttcgttgcgttttagtagttttcgggaaatcgcggtcgttcggcggttgtatcgtttttttttttgttcgtttatcgcgcgcgcgcgttgatgttgtgagttcggtcgcgtcgtcgtttatttggtttgtttcgtcgggtttcggtatcgtcgttaggtttagggcgttgcgggagcgcgtaggcgcgttgtcgtcgtcgttatcgtcgtcgtcgtcgatcggatttgaggcgattgcggttttttcggtaacgttaggaaattatttttaaattaagttttgtttaggtcgacgtagtcgttattgtcggcgcgtggcgacgtcgcgggtcgcgtcgatacgtttattatggcgttaaaaagcgtcgacgtcggtatgcggcgcgaggttcggggaggcggggcgtcggggttggggggattcgttgttgttgcgcgtcgacgtttatcggggtcgggtttggggcggggcgagggttattgggatttcgcggcgttttaagggttttgagtttcgcggggttttcggcggatcggtcggttcgggagggaaacggaaggaaggcgtgggaatattttttcgcgggggtggtcgggcgggtttcgcgagggcgttattttaggggagtgggtggggcggataggataaatttttttggtttcgagaaaacgacgcgtttttttcgtttaaaggtttttttttcgtttaggaatcgcgttttttatttgtttttttacgatattcggggatagatatcggattttgtttattttggtagtttaaatttttggtatcggttttggtgtttaat

SEQ ID NO: 27334 - DNA, 851 bp, Artificial Sequence
  chemically treated genomic DNA (Homo sapiens) CpG-island No: 27334
attaaacaccaaaaccgataccaaaaatttaaactaccaaaataaacaaaatccgatatctatccccgaatatcgtaaaaaaacaaataaaaaacgcgattcctaaacgaaaaaaaaacctttaaacgaaaaaaacgcgtcgttttctcgaaaccaaaaaaatttatcctatccgccccacccactcccctaaaataacgccctcgcgaaacccgcccgaccacccccgcgaaaaaatattcccacgccttccttccgtttccctcccgaaccgaccgatccgccgaaaaccccgcgaaactcaaaacccttaaaacgccgcgaaatcccaataaccctcgccccgccccaaacccgaccccgataaacgtcgacgcgcaacaacaacgaatccccccaaccccgacgccccgcctccccgaacctcgcgccgcataccgacgtcgacgctttttaacgccataataaacgtatcgacgcgacccgcgacgtcgccacgcgccgacaataacgactacgtcgacctaaacaaaacttaatttaaaaataatttcctaacgttaccgaaaaaaccgcaatcgcctcaaatccgatcgacgacgacgacgataacgacgacgacaacgcgcctacgcgctcccgcaacgccctaaacctaacgacgataccgaaacccgacgaaacaaaccaaataaacgacgacgcgaccgaactcacaacatcaacgcgcgcgcgcgataaacgaacaaaaaaaaaaacgatacaaccgccgaacgaccgcgatttcccgaaaactactaaaacgcaacgaaaaaacgaaccgaaaaacgacgaaacgcgaacaaaacgcg

SEQ ID NO: 27335 - DNA, 851 bp, Artificial Sequence
  chemically treated genomic DNA (Homo sapiens) CpG-island No: 27335
attagatattagagtcggtgttaggagtttaggttattaagatgaataagattcggtgtttattttcgggtgtcgtaaagaaataagtaaaagacgcggtttttgagcgggggaggggtttttgggcgaaggaggcgcgtcgttttttcgaagttagagaaatttgttttgttcgttttatttatttttttaagatggcgttttcgcgaaattcgttcggttattttcgcgagggaatatttttacgtttttttttcgtttttttttcgggtcggtcgattcgtcggggatttcgcggagtttaaggtttttgaggcgtcgcgggattttagtggttttcgtttcgttttaaattcgatttcggtgggcgtcgacgcgtagtagtagcgggtttttttaatttcggcgtttcgttttttcgggtttcgcgtcgtatgtcggcgtcggcgttttttgacgttatagtgggcgtgtcggcgcgattcgcgacgtcgttacgcgtcgataatggcggttgcgtcggtttgagtagggtttagtttagaagtaattttttgacgttgtcgagggagtcgtagtcgttttagattcggtcggcggcggcggcggtggcggcggcggtagcgcgtttgcgcgttttcgtagcgttttggatttagcggcggtgtcgaggttcggcggagtaagttaggtgggcggcggcgcggtcgagtttatagtattagcgcgcgcgcgcggtgggcgggtagagaggggggcggtgtagtcgtcgagcggtcgcgatttttcggggattgttggggcgtagcggggaggcgggtcggggggcggcggggcgcgagtagagcgcg

SEQ ID NO: 27336 - DNA, 851 bp, Artificial Sequence
  chemically treated genomic DNA (Homo sapiens) CpG-island No: 27336
cgcgctctactcgcgccccgccgccccccgacccgcctccccgctacgccccaacaatccccgaaaaatcgcgaccgctcgacgactacaccgcccccctctctacccgcccaccgcgcgcgcgcgctaatactataaactcgaccgcgccgccgcccacctaacttactccgccgaacctcgacaccgccgctaaatccaaaacgctacgaaaacgcgcaaacgcgctaccgccgccgccaccgccgccgccgccgaccgaatctaaaacgactacgactccctcgacaacgtcaaaaaattacttctaaactaaaccctactcaaaccgacgcaaccgccattatcgacgcgtaacgacgtcgcgaatcgcgccgacacgcccactataacgtcaaaaaacgccgacgccgacatacgacgcgaaacccgaaaaaacgaaacgccgaaattaaaaaaacccgctactactacgcgtcgacgcccaccgaaatcgaatttaaaacgaaacgaaaaccactaaaatcccgcgacgcctcaaaaaccttaaactccgcgaaatccccgacgaatcgaccgacccgaaaaaaaaacgaaaaaaaaacgtaaaaatattccctcgcgaaaataaccgaacgaatttcgcgaaaacgccatcttaaaaaaataaataaaacgaacaaaacaaatttctctaacttcgaaaaaacgacgcgcctccttcgcccaaaaacccctcccccgctcaaaaaccgcgtcttttacttatttctttacgacacccgaaaataaacaccgaatcttattcatcttaataacctaaactcctaacaccgactctaatatctaat

SEQ ID NO: 27337 - DNA, 1022 bp, Artificial Sequence
  chemically treated genomic DNA (Homo sapiens) CpG-island No: 27337
gtcgagagcgggcggcgtcggcggcggtatcggttcgcgggtagttggagttcggcgttgagttttgtttagcgcgattcggatcgacggacgcgtagagattttgtcgggattcgttttttagtcggcgttcggggagtcgtcggtcggttttatttttcgttcgggagtcgggtagggcgagaaggtagcgcgagtggcggtggcgattttcgtcggggtttttgcgacgagcggtgattagtagcgttcgtagtcgcggtttcgttttttattcggacgtggttaagcggcggcggttacgattttcggtttttcgggatcgttcggttgcgttttgggcgtatttgcgcgtttggtttcgcgtttcgcggagagggcgatgggtttcggttaggattgagcgtttttttttttttttttagtttcgtttggtatttttttttttgtttcgagggcgagttacggtttgcgtcgtcgatttttttttcggtgttttcggttcgtcgttttttcgcgtttttttttttcggattcgttttcggggttattatggtcgcggttatcgttagcggtttgattcgttagaagcggtaggcgcgggagtagtattgggatcggtcgtttgttagtaggaggcggagtagttttagtaagaatcgcgggttttgtaacggtaatttggtggatattttttttaaagtgcgtattttcggttttaagaagcgtaggttgcggcgttaaggtttgtgggggttatggtcgggagatgcgtttcgggtcgtttttttttcgtttaaacggagtttttttaggttttttttttttttcggttttttcggtttatttcggtttcggttttttttttgagtattttgggtgtcgtcgcggggattttggagttcgttgtcgggtaatttgtagtcgtcgagaagtgtagtcgttagagatggtaagttggttgtttttcgtcggcggtttttgtttttcgcgtttttgtaggttgggttttgggaaatttg

SEQ ID NO: 27338 - DNA, 1022 bp, Artificial Sequence
  chemically treated genomic DNA (Homo sapiens) CpG-island No: 27338
caaatttcccaaaacccaacctacaaaaacgcgaaaaacaaaaaccgccgacgaaaaacaaccaacttaccatctctaacgactacacttctcgacgactacaaattacccgacaacgaactccaaaatccccgcgacgacacccaaaatactcaaaaaaaaaaccgaaaccgaaataaaccgaaaaaaccgaaaaaaaaaaaaaacctaaaaaaactccgtttaaacgaaaaaaaaacgacccgaaacgcatctcccgaccataacccccacaaaccttaacgccgcaacctacgcttcttaaaaccgaaaatacgcactttaaaaaaaatatccaccaaattaccgttacaaaacccgcgattcttactaaaactactccgcctcctactaacaaacgaccgatcccaatactactcccgcgcctaccgcttctaacgaatcaaaccgctaacgataaccgcgaccataataaccccgaaaacgaatccgaaaaaaaaaaacgcgaaaaaacgacgaaccgaaaacaccgaaaaaaaaatcgacgacgcaaaccgtaactcgccctcgaaacaaaaaaaaaaataccaaacgaaactaaaaaaaaaaaaaaaaacgctcaatcctaaccgaaacccatcgccctctccgcgaaacgcgaaaccaaacgcgcaaatacgcccaaaacgcaaccgaacgatcccgaaaaaccgaaaatcgtaaccgccgccgcttaaccacgtccgaataaaaaacgaaaccgcgactacgaacgctactaatcaccgctcgtcgcaaaaaccccgacgaaaatcgccaccgccactcgcgctaccttctcgccctacccgactcccgaacgaaaaataaaaccgaccgacgactccccgaacgccgactaaaaaacgaatcccgacaaaatctctacgcgtccgtcgatccgaatcgcgctaaacaaaactcaacgccgaactccaactacccgcgaaccgataccgccgccgacgccgcccgctctcgac

SEQ ID NO: 27339 - DNA, 1022 bp, Artificial Sequence
  chemically treated genomic DNA (Homo sapiens) CpG-island No: 27339
taggttttttagagtttagtttgtagggacgcggagggtaggagtcgtcggcgaggagtagttaatttgttatttttggcggttgtatttttcggcggttataggttgttcgatagcggattttagggttttcgcgacggtatttagagtgtttagaagggaggtcggggtcggggtgggtcgggaaaatcgagggagggaaggagtttggagaagtttcgtttaggcggggagggggcgattcggggcgtatttttcgattatgatttttatagattttggcgtcgtaatttgcgttttttgaggtcgaagatgcgtattttggagaagatatttattaggttgtcgttgtagagttcgcggtttttgttggggttgtttcgttttttgttggtagacggtcggttttagtgttgttttcgcgtttgtcgtttttggcggattaagtcgttagcgatggtcgcggttatggtggtttcgggaacgggttcggggagggagggcgcgggaggacggcgagtcgggggtatcggaggggaagtcggcggcgtagatcgtggttcgttttcggggtagaggagagggtgttaggcgggattggggagaggggaaggggcgtttagttttgatcgggatttatcgtttttttcgcggggcgcggggttaggcgcgtagatgcgtttagggcgtagtcggacgatttcgggaagtcggaggtcgtggtcgtcgtcgtttggttacgttcgagtggagagcgggatcgcggttgcgggcgttgttggttatcgttcgtcgtaggaatttcggcgggggtcgttatcgttattcgcgttgttttttcgttttgttcggttttcgggcgggaggtagagtcggtcggcggtttttcgggcgtcggttggagggcgggtttcggtagggtttttgcgcgttcgtcggttcgggtcgcgttgggtaggatttagcgtcgggttttagttgttcgcgggtcggtgtcgtcgtcggcgtcgttcgttttcggt

SEQ ID NO: 27340 - DNA, 1022 bp, Artificial Sequence
  chemically treated genomic DNA (Homo sapiens) CpG-island No: 27340
accgaaaacgaacgacgccgacgacgacaccgacccgcgaacaactaaaacccgacgctaaatcctacccaacgcgacccgaaccgacgaacgcgcaaaaaccctaccgaaacccgccctccaaccgacgcccgaaaaaccgccgaccgactctacctcccgcccgaaaaccgaacaaaacgaaaaaacaacgcgaataacgataacgacccccgccgaaattcctacgacgaacgataaccaacaacgcccgcaaccgcgatcccgctctccactcgaacgtaaccaaacgacgacgaccacgacctccgacttcccgaaatcgtccgactacgccctaaacgcatctacgcgcctaaccccgcgccccgcgaaaaaaacgataaatcccgatcaaaactaaacgccccttcccctctccccaatcccgcctaacaccctctcctctaccccgaaaacgaaccacgatctacgccgccgacttcccctccgatacccccgactcgccgtcctcccgcgccctccctccccgaacccgttcccgaaaccaccataaccgcgaccatcgctaacgacttaatccgccaaaaacgacaaacgcgaaaacaacactaaaaccgaccgtctaccaacaaaaaacgaaacaaccccaacaaaaaccgcgaactctacaacgacaacctaataaatatcttctccaaaatacgcatcttcgacctcaaaaaacgcaaattacgacgccaaaatctataaaaatcataatcgaaaaatacgccccgaatcgccccctccccgcctaaacgaaacttctccaaactccttccctccctcgattttcccgacccaccccgaccccgacctcccttctaaacactctaaataccgtcgcgaaaaccctaaaatccgctatcgaacaacctataaccgccgaaaaatacaaccgccaaaaataacaaattaactactcctcgccgacgactcctaccctccgcgtccctacaaactaaactctaaaaaaccta

SEQ ID NO: 27341 - DNA, 725 bp, Artificial Sequence
  chemically treated genomic DNA (Homo sapiens) CpG-island No: 27341
gcgaaaaaagacggagcgcgagtaacgtgatagacgtaggcggggatgtcgaggcggaatagcggcgggggcgttaatattagaacggacgcgcggaaataagatagaatagtgcggcgggcgagagggatacggaatatatatgggaaaatatgagagagcggggcggcgaatgacgagttaatttaaattcgcggcggtggcgcggggcgcgaatacgaggtcgtatttaatgatttgtaatattattgcgtcggtagcggcggggggtgattattcgcgtaatataaggcgattgattagggcgtagattaggggtagcggattggggaaaaaacggcgcgttttacgggggtatagaagggggagtaaatgacgcgaaggcgataaagaagggggaattcggggaaggcggcgtaaaagaaggggcggggagtaattagggtcgagggacgattaggtgtcggtattcgcggcgacgcgagagaggggaaaggcggggagattatggaagggtggatcgaggggtaacgcgttcgttcgttcggttatcgttacgggttttttaatacggggtaaaaaaggcgggtcggcggtttttttacgtaaagtttcgttaacgggttttcgcgttttttttgggaatcggttaatatttcggatcggtagttttagttttttttttaataaaaagaggggggttcgtcggcgaaaaaaaaaaaggg

SEQ ID NO: 27342 - DNA, 725 bp, Artificial Sequence
  chemically treated genomic DNA (Homo sapiens) CpG-island No: 27342
ccctttttttttttcgccgacgaacccccctctttttattaaaaaaaaaactaaaactaccgatccgaaatattaaccgattcccaaaaaaaacgcgaaaacccgttaacgaaactttacgtaaaaaaaccgccgacccgccttttttaccccgtattaaaaaacccgtaacgataaccgaacgaacgaacgcgttacccctcgatccacccttccataatctccccgcctttcccctctctcgcgtcgccgcgaataccgacacctaatcgtccctcgaccctaattactccccgccccttcttttacgccgccttccccgaattcccccttctttatcgccttcgcgtcatttactcccccttctatacccccgtaaaacgcgccgttttttccccaatccgctacccctaatctacgccctaatcaatcgccttatattacgcgaataatcaccccccgccgctaccgacgcaataatattacaaatcattaaatacgacctcgtattcgcgccccgcgccaccgccgcgaatttaaattaactcgtcattcgccgccccgctctctcatattttcccatatatattccgtatccctctcgcccgccgcactattctatcttatttccgcgcgtccgttctaatattaacgcccccgccgctattccgcctcgacatccccgcctacgtctatcacgttactcgcgctccgtcttttttcgc

SEQ ID NO: 27343 - DNA, 725 bp, Artificial Sequence
  chemically treated genomic DNA (Homo sapiens) CpG-island No: 27343
ttttttttttttttcgtcggcgggtttttttttttttgttggggggggggttggggttgtcggttcggggtgttggtcggtttttagggggggcgcgggggttcgttggcggggttttgcgtgggggggtcgtcggttcgttttttttgtttcgtgttggggggttcgtagcgatggtcgggcgggcgggcgcgttatttttcggtttatttttttatggttttttcgttttttttttttttcgcgtcgtcgcgggtgtcggtatttggtcgtttttcggttttgattatttttcgtttttttttttgcgtcgtttttttcgggtttttttttttttgtcgttttcgcgttatttgtttttttttttgtattttcgtggggcgcgtcgttttttttttagttcgttgtttttggtttacgttttggttaatcgttttatgttgcgcgggtggttatttttcgtcgttatcggcgtagtggtattgtaagttattagatgcggtttcgtgttcgcgtttcgcgttatcgtcgcgagtttggattggttcgttattcgtcgtttcgtttttttatgtttttttatatatgtttcgtgtttttttcgttcgtcgtattgttttgttttgttttcgcgcgttcgttttggtgttggcgttttcgtcgttgtttcgtttcggtattttcgtttgcgtttattacgttgttcgcgtttcgttttttttcgt

SEQ ID NO: 27344 - DNA, 725 bp, Artificial Sequence
  chemically treated genomic DNA (Homo sapiens) CpG-island No: 27344
acgaaaaaaaacgaaacgcgaacaacgtaataaacgcaaacgaaaataccgaaacgaaacaacgacgaaaacgccaacaccaaaacgaacgcgcgaaaacaaaacaaaacaatacgacgaacgaaaaaaacacgaaacatatataaaaaaacataaaaaaacgaaacgacgaataacgaaccaatccaaactcgcgacgataacgcgaaacgcgaacacgaaaccgcatctaataacttacaataccactacgccgataacgacgaaaaataaccacccgcgcaacataaaacgattaaccaaaacgtaaaccaaaaacaacgaactaaaaaaaaaacgacgcgccccacgaaaatacaaaaaaaaaaacaaataacgcgaaaacgacaaaaaaaaaaaaacccgaaaaaaacgacgcaaaaaaaaaaacgaaaaataatcaaaaccgaaaaacgaccaaataccgacacccgcgacgacgcgaaaaaaaaaaaaaacgaaaaaaccataaaaaaataaaccgaaaaataacgcgcccgcccgcccgaccatcgctacgaaccccccaacacgaaacaaaaaaaacgaaccgacgacccccccacgcaaaaccccgccaacgaacccccgcgccccccctaaaaaccgaccaacaccccgaaccgacaaccccaaccccccccccaacaaaaaaaaaaaaacccgccgacgaaaaaaaaaaaaaa

SEQ ID NO: 27345 - DNA, 958 bp, Artificial Sequence
  chemically treated genomic DNA (Homo sapiens) CpG-island No: 27345
ttttatgtttatgcgttttttgtttattcgtttattgtttaattcgcgttttatgtttattcgtttgttgtttatttcgcgtttttagtgtattcgtttagtttcgagcgttcgcggagtcgagtggagagtagcggtcgtagcgcggcgttaggttcgggttgggttggtcggcgcgaattttcgggggcgtttgggcggttaggtcgggtggcggttgcgtacgtaggagtattttttgagtttagtcgttcggtcggtttgattcgcgggtgatcggatacgagtaacgcgtgcgtttcgatttgtgttttgcgcggggtcgggcggggatcggtcgggggcgtcgcgcgttcggtcgggttgattgtcgggggcgattttcgcggggtaaggcgggggcgcgggagtagcgcgtagttgcggggttattttatttgagcgttttgaggttagggtcggggtttgaggatacggcgttgggtttcgggggacgcgggtttacgtcggcgttcgagcgttattttttcgtttttcgtcggtttacgtagtttcggggttcggtacgtgaagtgtcggcgcgaggttgtttaggttatcgtatgggtcgggcgataaataatcgtataggatatataatattttggattgttataagtttttcgtaggaaaagataaataatatttgaggcgttgcggcgcggttttttcgggttgaataaaaattaggaggtggggggcggtggggcgaagtaaataatagaatcgaagaattgtcgtacggagtttgggtcggcggagaaaattagatgtagtttttttttttttggtgattattcgtgggggtttttttcggtggaaatgagcgatatatatattatattatatattacgtttaaattttgtttttgaaagcgataggtagttgtttttttgggtaagaggcgtatttttttag

SEQ ID NO: 27346 - DNA, 958 bp, Artificial Sequence
  chemically treated genomic DNA (Homo sapiens) CpG-island No: 27346
ctaaaaaaatacgcctcttacccaaaaaaacaactacctatcgctttcaaaaacaaaatttaaacgtaatatataatataatatatatatcgctcatttccaccgaaaaaaacccccacgaataatcaccaaaaaaaaaaaaactacatctaattttctccgccgacccaaactccgtacgacaattcttcgattctattatttacttcgccccaccgccccccacctcctaatttttattcaacccgaaaaaaccgcgccgcaacgcctcaaatattatttatcttttcctacgaaaaacttataacaatccaaaatattatatatcctatacgattatttatcgcccgacccatacgataacctaaacaacctcgcgccgacacttcacgtaccgaaccccgaaactacgtaaaccgacgaaaaacgaaaaaataacgctcgaacgccgacgtaaacccgcgtcccccgaaacccaacgccgtatcctcaaaccccgaccctaacctcaaaacgctcaaataaaataaccccgcaactacgcgctactcccgcgcccccgccttaccccgcgaaaatcgcccccgacaatcaacccgaccgaacgcgcgacgcccccgaccgatccccgcccgaccccgcgcaaaacacaaatcgaaacgcacgcgttactcgtatccgatcacccgcgaatcaaaccgaccgaacgactaaactcaaaaaatactcctacgtacgcaaccgccacccgacctaaccgcccaaacgcccccgaaaattcgcgccgaccaacccaacccgaacctaacgccgcgctacgaccgctactctccactcgactccgcgaacgctcgaaactaaacgaatacactaaaaacgcgaaataaacaacaaacgaataaacataaaacgcgaattaaacaataaacgaataaacaaaaaacgcataaacataaaa

SEQ ID NO: 27347 - DNA, 958 bp, Artificial Sequence
  chemically treated genomic DNA (Homo sapiens) CpG-island No: 27347
ttggggaaatgcgttttttatttagagaggtagttgtttatcgtttttaaggataaagtttgaacgtagtgtgtggtgtggtgtgtgtgtcgtttatttttatcgggagaaatttttacggatagttattaaagggaaggagattgtatttgatttttttcgtcggtttaggtttcgtgcggtaatttttcggttttgttgtttatttcgttttatcgttttttattttttagtttttgtttagttcggggaagtcgcgtcgtagcgttttagatgttatttatttttttttgcgaggggtttgtgatagtttagggtgttgtgtattttgtgcgattgtttatcgttcggtttatgcggtggtttgagtagtttcgcgtcggtattttacgtatcgaatttcgggattacgtgagtcggcggagggcggggaggtggcgttcgggcgtcggcgtgaattcgcgtttttcggagtttagcgtcgtgtttttaggtttcggttttgattttagggcgtttaggtggaatggtttcgtagttgcgcgttgttttcgcgttttcgttttgtttcgcggaaatcgttttcgatagttaattcgatcgggcgcgcggcgttttcggtcggttttcgttcgatttcgcgtagggtatagatcggggcgtacgcgttattcgtattcggttattcgcgggttaggtcggtcgagcggttgggtttagggggtatttttacgtgcgtagtcgttattcggtttggtcgtttagacgttttcgggggttcgcgtcggttagtttagttcgagtttggcgtcgcgttgcggtcgttgttttttattcggtttcgcgggcgttcggggttgggcgggtgtattgggggcgcggggtgggtagtaggcgggtggatatggggcgcgggttggatagtgagcgggtggatagggggcgtatggatatgggg

SEQ ID NO: 27348 - DNA, 958 bp, Artificial Sequence
  chemically treated genomic DNA (Homo sapiens) CpG-island No: 27348
ccccatatccatacgccccctatccacccgctcactatccaacccgcgccccatatccacccgcctactacccaccccgcgcccccaatacacccgcccaaccccgaacgcccgcgaaaccgaataaaaaacaacgaccgcaacgcgacgccaaactcgaactaaactaaccgacgcgaacccccgaaaacgtctaaacgaccaaaccgaataacgactacgcacgtaaaaataccccctaaacccaaccgctcgaccgacctaacccgcgaataaccgaatacgaataacgcgtacgccccgatctataccctacgcgaaatcgaacgaaaaccgaccgaaaacgccgcgcgcccgatcgaattaactatcgaaaacgatttccgcgaaacaaaacgaaaacgcgaaaacaacgcgcaactacgaaaccattccacctaaacgccctaaaatcaaaaccgaaacctaaaaacacgacgctaaactccgaaaaacgcgaattcacgccgacgcccgaacgccacctccccgccctccgccgactcacgtaatcccgaaattcgatacgtaaaataccgacgcgaaactactcaaaccaccgcataaaccgaacgataaacaatcgcacaaaatacacaacaccctaaactatcacaaacccctcgcaaaaaaaaataaataacatctaaaacgctacgacgcgacttccccgaactaaacaaaaactaaaaaataaaaaacgataaaacgaaataaacaacaaaaccgaaaaattaccgcacgaaacctaaaccgacgaaaaaaatcaaatacaatctccttccctttaataactatccgtaaaaatttctcccgataaaaataaacgacacacacaccacaccacacactacgttcaaactttatccttaaaaacgataaacaactacctctctaaataaaaaacgcatttccccaa

SEQ ID NO: 27349 - DNA, 595 bp, Artificial Sequence
  chemically treated genomic DNA (Homo sapiens) CpG-island No: 27349
tatgcgtacggcgtgatagtgatggatgaaggtaggtgagacggtatgaggggtatcggagaagcgcgagtgaggtacgggagaggggtgtataggagagacgtgggaggtggagcgaggaggtcgtgcgagatggacgaacgtgagagtggaggcggtggagggatgaagtagaaggtagggataggagatagggggagtgagggttgtatgcggcgggaggtgagtgagagttgttgatatgtacgagtgagtggagattgagcgcggggtaggtgtagttcggtgtgagggagaggagcggggagtaggcgcggaggcgcgagaaggtagggtgcgggcgtgtgttggggaatagtaaggggcggggtattggggcggaggtcgaggttagaacgggagttttgcggcggagtaggggagggggatgatggagattaagggaggtacgtgtgagagcggcgtgggttcgtgcgtcgtgtcgcggagggtgattgtcgttttagttagggagggggttaagtgtggaggcggaggaggcgggtcgtaaagaagagaaagagtttcgagagtagatgttaagcgaaggcgagtg

SEQ ID NO: 27350 - DNA, 595 bp, Artificial Sequence
  chemically treated genomic DNA (Homo sapiens) CpG-island No: 27350
cactcgccttcgcttaacatctactctcgaaactctttctcttctttacgacccgcctcctccgcctccacacttaaccccctccctaactaaaacgacaatcaccctccgcgacacgacgcacgaacccacgccgctctcacacgtacctcccttaatctccatcatccccctcccctactccgccgcaaaactcccgttctaacctcgacctccgccccaataccccgccccttactattccccaacacacgcccgcaccctaccttctcgcgcctccgcgcctactccccgctcctctccctcacaccgaactacacctaccccgcgctcaatctccactcactcgtacatatcaacaactctcactcacctcccgccgcatacaaccctcactccccctatctcctatccctaccttctacttcatccctccaccgcctccactctcacgttcgtccatctcgcacgacctcctcgctccacctcccacgtctctcctatacacccctctcccgtacctcactcgcgcttctccgatacccctcataccgtctcacctaccttcatccatcactatcacgccgtacgcata

SEQ ID NO: 27351 - DNA, 595 bp, Artificial Sequence
  chemically treated genomic DNA (Homo sapiens) CpG-island No: 27351
tattcgttttcgtttaatatttattttcgaaatttttttttttttttgcgattcgtttttttcgtttttatatttagttttttttttggttgaggcggtagttatttttcgcggtacggcgtacgagtttacgtcgtttttatacgtgttttttttgatttttattattttttttttttatttcgtcgtagaattttcgttttgatttcggttttcgttttagtgtttcgttttttattattttttaatatacgttcgtattttgttttttcgcgttttcgcgtttatttttcgttttttttttttatatcggattgtatttatttcgcgtttaatttttatttattcgtgtatgttaataatttttatttatttttcgtcgtatataatttttattttttttattttttatttttgttttttattttatttttttatcgtttttatttttacgttcgtttatttcgtacgattttttcgttttattttttacgttttttttatatatttttttttcgtattttattcgcgttttttcggtattttttatatcgttttatttatttttatttattattgttacgtcgtgcgtata

SEQ ID NO: 27352 - DNA, 595 bp, Artificial Sequence
  chemically treated genomic DNA (Homo sapiens) CpG-island No: 27352
tatacgcacgacgtaacaataataaataaaaataaataaaacgatataaaaaataccgaaaaaacgcgaataaaatacgaaaaaaaaatatataaaaaaaacgtaaaaaataaaacgaaaaaatcgtacgaaataaacgaacgtaaaaataaaaacgataaaaaaataaaataaaaaacaaaaataaaaaataaaaaaaataaaaattatatacgacgaaaaataaataaaaattattaacatacacgaataaataaaaattaaacgcgaaataaatacaatccgatataaaaaaaaaaaacgaaaaataaacgcgaaaacgcgaaaaaacaaaatacgaacgtatattaaaaaataataaaaaacgaaacactaaaacgaaaaccgaaatcaaaacgaaaattctacgacgaaataaaaaaaaaaaataataaaaatcaaaaaaaacacgtataaaaacgacgtaaactcgtacgccgtaccgcgaaaaataactaccgcctcaaccaaaaaaaaaactaaatataaaaacgaaaaaaacgaatcgcaaaaaaaaaaaaaaatttcgaaaataaatattaaacgaaaacgaata

SEQ ID NO: 27353 - DNA, 772 bp, Artificial Sequence
  chemically treated genomic DNA (Homo sapiens) CpG-island No: 27353
  misc_feature (45)..(45): n is either a, c, g or t
ttatggttcggttaggcgggggttacggaggtcgaggcgacgttnatttggtttttaggtttttttcgcggcggcggcggcgggggcgcggtagtttttttagttcgtttgttcgagcgcgagtagttagcgagttgtacgtacgcgcggggtttttgggcgcgcgggtttcgcgttcgatcgtcgttgtttgttgcggttcgcgagttcgatacgggtgggcgtgttcgggagggggcggggagttcggttcgcgcggttttatttagcgcggaggggtcgcgtcgggcgcgttcgcgttttgcgtgtagttacgcgcgtttttcgttttcgcggagtagaaggggtggtttgtggttagtacgcgtttacgggttttgtttttaaattcgttgttagtttgttttcgtttttttttttttcgtttacggtcggtcgcggtttcgttagcggaaattcggttttttcgggattcggtttttgtagggagggggtcgtcgcgggagcgcgtttcggtttttcgggttttcggagttaatgcggaattcgtttttagcggtgggggtttgttcggggaagtcggtttttcgtttgtcgatttagttttgttttgcggtttcggtaaatagagaggtcggcggagattcggggttcgttgttatcgcgggtgtttgtgattcgggaagttttcgtttcgagggtaagcgggggtttagggatttggagtttagaaggtttttcgtataagtgaatttttaagttatttcggggt

SEQ ID NO: 27354 - DNA, 772 bp, Artificial Sequence
  chemically treated genomic DNA (Homo sapiens) CpG-island No: 27354
  misc_feature (728)..(728): n is either a, c, g or t
accccgaaataacttaaaaattcacttatacgaaaaaccttctaaactccaaatccctaaacccccgcttaccctcgaaacgaaaacttcccgaatcacaaacacccgcgataacaacgaaccccgaatctccgccgacctctctatttaccgaaaccgcaaaacaaaactaaatcgacaaacgaaaaaccgacttccccgaacaaacccccaccgctaaaaacgaattccgcattaactccgaaaacccgaaaaaccgaaacgcgctcccgcgacgaccccctccctacaaaaaccgaatcccgaaaaaaccgaatttccgctaacgaaaccgcgaccgaccgtaaacgaaaaaaaaaaaaacgaaaacaaactaacaacgaatttaaaaacaaaacccgtaaacgcgtactaaccacaaaccaccccttctactccgcgaaaacgaaaaacgcgcgtaactacacgcaaaacgcgaacgcgcccgacgcgacccctccgcgctaaataaaaccgcgcgaaccgaactccccgccccctcccgaacacgcccacccgtatcgaactcgcgaaccgcaacaaacaacgacgatcgaacgcgaaacccgcgcgcccaaaaaccccgcgcgtacgtacaactcgctaactactcgcgctcgaacaaacgaactaaaaaaactaccgcgcccccgccgccgccgccgcgaaaaaaacctaaaaaccaaatnaacgtcgcctcgacctccgtaacccccgcctaaccgaaccataa

SEQ ID NO: 27355 - DNA, 772 bp, Artificial Sequence
  chemically treated genomic DNA (Homo sapiens) CpG-island No: 27355
  misc_feature (728)..(728): n is either a, c, g or t
gtttcggggtagtttgagaatttatttatgcgaagaattttttggattttaggtttttgagttttcgtttgttttcggggcgggaatttttcggattataggtattcgcggtggtagcgggtttcgggttttcgtcgatttttttgtttgtcggggtcgtagggtagggttaggtcggtaggcggagagtcggttttttcgggtagatttttatcgttgggggcgggtttcgtattggtttcgaagattcgaggggtcgaggcgcgttttcgcggcggttttttttttgtagggatcgaatttcggaaaagtcgggttttcgttggcggggtcgcggtcggtcgtgggcggggaggggaggagcgggggtagattggtagcggatttgagggtaggattcgtgggcgcgtgttggttatagattattttttttatttcgcgggagcgaggggcgcgcgtggttgtacgtagggcgcgagcgcgttcggcgcggttttttcgcgttgggtggggtcgcgcgggtcgggtttttcgttttttttcggatacgtttattcgtgtcgggttcgcgagtcgtaataggtagcggcggtcgagcgcgaggttcgcgcgtttagaggtttcgcgcgtgcgtgtagttcgttggttgttcgcgttcgggtaggcgggttgaggaggttgtcgcgttttcgtcgtcgtcgtcgcgggggaagtttgggagttagatnggcgtcgtttcggttttcgtaattttcgtttagtcgggttatgg

SEQ ID NO: 27356 - DNA, 772 bp, Artificial Sequence
  chemically treated genomic DNA (Homo sapiens) CpG-island No: 27356
  misc_feature (45)..(45): n is either a, c, g or t
ccataacccgactaaacgaaaattacgaaaaccgaaacgacgccnatctaactcccaaacttcccccgcgacgacgacgacgaaaacgcgacaacctcctcaacccgcctacccgaacgcgaacaaccaacgaactacacgcacgcgcgaaacctctaaacgcgcgaacctcgcgctcgaccgccgctacctattacgactcgcgaacccgacacgaataaacgtatccgaaaaaaaacgaaaaacccgacccgcgcgaccccacccaacgcgaaaaaaccgcgccgaacgcgctcgcgccctacgtacaaccacgcgcgcccctcgctcccgcgaaataaaaaaaataatctataaccaacacgcgcccacgaatcctaccctcaaatccgctaccaatctacccccgctcctcccctccccgcccacgaccgaccgcgaccccgccaacgaaaacccgacttttccgaaattcgatccctacaaaaaaaaaaccgccgcgaaaacgcgcctcgacccctcgaatcttcgaaaccaatacgaaacccgcccccaacgataaaaatctacccgaaaaaaccgactctccgcctaccgacctaaccctaccctacgaccccgacaaacaaaaaaatcgacgaaaacccgaaacccgctaccaccgcgaatacctataatccgaaaaattcccgccccgaaaacaaacgaaaactcaaaaacctaaaatccaaaaaattcttcgcataaataaattctcaaactaccccgaaac

SEQ ID NO: 27357 - DNA, 563 bp, Artificial Sequence
  chemically treated genomic DNA (Homo sapiens) CpG-island No: 27357
cgttattttagtcgtaggaaggcgcgcgattaattcggaagttggggttagttttagggtttatttgtcggaattttcggtggcgtcgtatgttacgttttttttggttgggaggcgacgcgtatttaggtatattcgttgtcgtgcgttgggcgacgggattcgtcgtagacgtatttttttttagtggtttttcggcgttttggtcgcgaggttttttgggagttgtagtgcgtaggtttcggtttttgcgggttttgcgcgtcgttacggtttcgaaggtcggcggcgggtcggagggcggggttgcgaggagggttggtattttttcgagggagtgttttttgcgttttatttgcgggagcgaaggtttttaagtttttcggttcggtttttcggttagattttcgaacgtttacgtttttagggagtttcgagagatttattttttcggcggtttcgcgttgcgggcgttaagcgggaggttggagtcgatgtttgggataaaatagtgtttgattgtttgttcgtttattttcggtttaggttcggatgaatgggtt

SEQ ID NO: 27358 - DNA, 563 bp, Artificial Sequence
  chemically treated genomic DNA (Homo sapiens) CpG-island No: 27358
aacccattcatccgaacctaaaccgaaaataaacgaacaaacaatcaaacactattttatcccaaacatcgactccaacctcccgcttaacgcccgcaacgcgaaaccgccgaaaaaataaatctctcgaaactccctaaaaacgtaaacgttcgaaaatctaaccgaaaaaccgaaccgaaaaacttaaaaaccttcgctcccgcaaataaaacgcaaaaaacactccctcgaaaaaataccaaccctcctcgcaaccccgccctccgacccgccgccgaccttcgaaaccgtaacgacgcgcaaaacccgcaaaaaccgaaacctacgcactacaactcccaaaaaacctcgcgaccaaaacgccgaaaaaccactaaaaaaaaatacgtctacgacgaatcccgtcgcccaacgcacgacaacgaatatacctaaatacgcgtcgcctcccaaccaaaaaaaacgtaacatacgacgccaccgaaaattccgacaaataaaccctaaaactaaccccaacttccgaattaatcgcgcgccttcctacgactaaaataacg

SEQ ID NO: 27359 - DNA, 563 bp, Artificial Sequence
  chemically treated genomic DNA (Homo sapiens) CpG-island No: 27359
agtttatttattcgggtttgggtcgggggtgggcgggtagataattagatattgttttattttaggtatcggttttagtttttcgtttggcgttcgtaacgcggggtcgtcggggaaatgagtttttcgggattttttgggagcgtaagcgttcgaggatttgatcggagggtcgggtcggaaagtttgagagttttcgttttcgtaggtgaggcgtagaaaatattttttcggggaagtgttagtttttttcgtagtttcgtttttcggttcgtcgtcggttttcggggtcgtagcggcgcgtagggttcgtagagatcgagatttgcgtattataatttttaggaggtttcgcgattagaacgtcgaggggttattagagaaaggtgcgtttgcggcgaatttcgtcgtttagcgtacggtagcgggtgtgtttgagtgcgcgtcgttttttaattagagaggacgtggtatacggcgttatcggaagtttcggtaagtgggttttgaggttggttttagttttcgggttggtcgcgcgtttttttgcggttaagatggcg

SEQ ID NO: 27360 - DNA, 563 bp, Artificial Sequence
  chemically treated genomic DNA (Homo sapiens) CpG-island No: 27360
cgccatcttaaccgcaaaaaaacgcgcgaccaacccgaaaactaaaaccaacctcaaaacccacttaccgaaacttccgataacgccgtataccacgtcctctctaattaaaaaacgacgcgcactcaaacacacccgctaccgtacgctaaacgacgaaattcgccgcaaacgcacctttctctaataacccctcgacgttctaatcgcgaaacctcctaaaaattataatacgcaaatctcgatctctacgaaccctacgcgccgctacgaccccgaaaaccgacgacgaaccgaaaaacgaaactacgaaaaaaactaacacttccccgaaaaaatattttctacgcctcacctacgaaaacgaaaactctcaaactttccgacccgaccctccgatcaaatcctcgaacgcttacgctcccaaaaaatcccgaaaaactcatttccccgacgaccccgcgttacgaacgccaaacgaaaaactaaaaccgatacctaaaataaaacaatatctaattatctacccgcccacccccgacccaaacccgaataaataaact

SEQ ID NO: 27361 - DNA, 507 bp, Artificial Sequence
  chemically treated genomic DNA (Homo sapiens) CpG-island No: 27361
gagggtcgaagttaaattttttttagtggcggtgtatgcgttttatatggttttttcggtttgggaaaggaatgagaagtttttatgattttttcgcgagaagggaagtttttatgttacgttagagattagagattttggcgtcgagcgataggtgtcggaataaataggcgatgagaaatcgcggacgcggaattattttttgggtaggattttcggcggaaaagcgggttgtttcggaaatttagagtcgggtttttttcgggtttttgtcgggtttttttttgcggtttttgggttgttgagatttttgtgaagatggtttgcgttgtcgcgcggttttcggtcgattaggataggtgggttttgaggcggtgggtttttcgaaaggaaggggtttgttgtggtgttgtaggtgttatatcgcgttttttcgtttcgcggtttttagaatggtttaattagatttaattcgttttgtacgggtttcgcgtttttttttggtag

SEQ ID NO: 27362 - DNA, 507 bp, Artificial Sequence
  chemically treated genomic DNA (Homo sapiens) CpG-island No: 27362
ctaccaaaaaaaaacgcgaaacccgtacaaaacgaattaaatctaattaaaccattctaaaaaccgcgaaacgaaaaaacgcgatataacacctacaacaccacaacaaaccccttcctttcgaaaaacccaccgcctcaaaacccacctatcctaatcgaccgaaaaccgcgcgacaacgcaaaccatcttcacaaaaatctcaacaacccaaaaaccgcaaaaaaaaacccgacaaaaacccgaaaaaaacccgactctaaatttccgaaacaacccgcttttccgccgaaaatcctacccaaaaaataattccgcgtccgcgatttctcatcgcctatttattccgacacctatcgctcgacgccaaaatctctaatctctaacgtaacataaaaacttcccttctcgcgaaaaaatcataaaaacttctcattcctttcccaaaccgaaaaaaccatataaaacgcatacaccgccactaaaaaaaatttaacttcgaccctc

SEQ ID NO: 27363 - DNA, 507 bp, Artificial Sequence
  chemically treated genomic DNA (Homo sapiens) CpG-island No: 27363
ttgttagggagaggcgcggggttcgtatagagcgagttggatttagttagattattttggaggtcgcggagcggagaagcgcggtgtagtatttgtagtattatagtaagtttttttttttcggaggatttatcgttttagaatttatttgttttggtcggtcggggatcgcgcggtagcgtaagttatttttataagagttttaataatttaggagtcgtagggagaaattcggtagaaattcgggaggaattcggttttgagttttcgagatagttcgttttttcgtcggaagttttgtttaagaaatggtttcgcgttcgcgattttttatcgtttgtttgtttcggtatttgtcgttcggcgttaggatttttagtttttgacgtggtatgaagattttttttttcgcgagagaattatgaaagttttttattttttttttaagtcgggaagattatgtggggcgtatgtatcgttattaaaaagggtttaatttcgattttt

SEQ ID NO: 27364 - DNA, 507 bp, Artificial Sequence
  chemically treated genomic DNA (Homo sapiens) CpG-island No: 27364
aaaaatcgaaattaaaccctttttaataacgatacatacgccccacataatcttcccgacttaaaaaaaaaataaaaaactttcataattctctcgcgaaaaaaaaaatcttcataccacgtcaaaaactaaaaatcctaacgccgaacgacaaataccgaaacaaacaaacgataaaaaatcgcgaacgcgaaaccatttcttaaacaaaacttccgacgaaaaaacgaactatctcgaaaactcaaaaccgaattcctcccgaatttctaccgaatttctccctacgactcctaaattattaaaactcttataaaaataacttacgctaccgcgcgatccccgaccgaccaaaacaaataaattctaaaacgataaatcctccgaaaaaaaaaaacttactataatactacaaatactacaccgcgcttctccgctccgcgacctccaaaataatctaactaaatccaactcgctctatacgaaccccgcgcctctccctaacaa

SEQ ID NO: 27365 - DNA, 552 bp, Artificial Sequence
  chemically treated genomic DNA (Homo sapiens) CpG-island No: 27365
agttttcgttaaggaggcgcgtttatagtttcggaagaagggcggagatttacgagggttaagagtgacgggggattaatatatatacgatcgaggtattggtatgtaagttcggattaagttttatgatttatttatacgcgatattataagagttatattcgtttagttagaggttaggggtaagcggtggagtattaacggtcgattatttagtttatagtattatttagagacgtagaagtcgtaggataatttgaattaaagacgataaggcgtttcgcggggtttaggcgttattaatttagtcgcggagttacgtttcgcgtcgttgttagggcgtcggtagaggttcgatttttcgattttaggcggtcgagtttgggcgtacggaggggcggggtttggggcggggttttcgggatttattttttattcgtgatcggcgtttttgcgtgtagggatttgggttgcgttggggcggggttgcgttttggaaaggttaaaatttgaaagtgtggtattaataagtataataattatgggtgtaat

SEQ ID NO: 27366 - DNA, 552 bp, Artificial Sequence
  chemically treated genomic DNA (Homo sapiens) CpG-island No: 27366
attacacccataattattatacttattaataccacactttcaaattttaacctttccaaaacgcaaccccgccccaacgcaacccaaatccctacacgcaaaaacgccgatcacgaataaaaaataaatcccgaaaaccccgccccaaaccccgcccctccgtacgcccaaactcgaccgcctaaaatcgaaaaatcgaacctctaccgacgccctaacaacgacgcgaaacgtaactccgcgactaaattaataacgcctaaaccccgcgaaacgccttatcgtctttaattcaaattatcctacgacttctacgtctctaaataatactataaactaaataatcgaccgttaatactccaccgcttacccctaacctctaactaaacgaatataactcttataatatcgcgtataaataaatcataaaacttaatccgaacttacataccaatacctcgatcgtatatatattaatcccccgtcactcttaaccctcgtaaatctccgcccttcttccgaaactataaacgcgcctccttaacgaaaact

SEQ ID NO: 27367 - DNA, 552 bp, Artificial Sequence
  chemically treated genomic DNA (Homo sapiens) CpG-island No: 27367
attgtatttataattattatatttgttgatgttatatttttaggttttaatttttttaaagcgtagtttcgttttagcgtagtttaagtttttgtacgtagaggcgtcgattacgggtgggaggtggatttcggaggtttcgttttaggtttcgttttttcgtgcgtttaagttcgatcgtttgaaatcggggaatcgggtttttgtcggcgttttggtagcggcgcggggcgtggtttcgcggttggattggtggcgtttgggtttcgcgaagcgttttgtcgtttttggtttaagttgttttgcgatttttgcgtttttgagtggtgttgtggattaggtgatcggtcgttgatgttttatcgtttatttttagtttttggttggacgagtgtagtttttgtagtgtcgcgtgtaggtagattatgaggtttggttcgaatttgtatgttaatatttcggtcgtgtgtgtattagtttttcgttatttttggttttcgtgggttttcgtttttttttcggagttgtgggcgcgtttttttggcggaggtt

SEQ ID NO: 27368 - DNA, 552 bp, Artificial Sequence
  chemically treated genomic DNA (Homo sapiens) CpG-island No: 27368
aacctccgccaaaaaaacgcgcccacaactccgaaaaaaaaacgaaaacccacgaaaaccaaaaataacgaaaaactaatacacacacgaccgaaatattaacatacaaattcgaaccaaacctcataatctacctacacgcgacactacaaaaactacactcgtccaaccaaaaactaaaaataaacgataaaacatcaacgaccgatcacctaatccacaacaccactcaaaaacgcaaaaatcgcaaaacaacttaaaccaaaaacgacaaaacgcttcgcgaaacccaaacgccaccaatccaaccgcgaaaccacgccccgcgccgctaccaaaacgccgacaaaaacccgattccccgatttcaaacgatcgaacttaaacgcacgaaaaaacgaaacctaaaacgaaacctccgaaatccacctcccacccgtaatcgacgcctctacgtacaaaaacttaaactacgctaaaacgaaactacgctttaaaaaaattaaaacctaaaaatataacatcaacaaatataataattataaatacaat

SEQ ID NO: 27369 - DNA, 1061 bp, Artificial Sequence
  chemically treated genomic DNA (Homo sapiens) CpG-island No: 27369
ttcgttacgtatacggttagggttatagtcgttagtagtacggcgtcgaaaaggatggcggttagggtttttttggggtcgtaatttttttcgcgtttttgtaaggatacgatcgaggaggggtcggcgttgatcgtggataggagttcggcgttcgtcgtttgtcgggtttgtacggtttagcggggtacgttgatttttatttttatgttgtcgattatttcgtttatttgaaggatttcgcgttttagttttcgtaggttcgcgacgtcgaagtcgtttttcgtttcgagtcgtaggttgcgggtgtttagcgcgcgcgtcgttacgtcggaggaggcgttagttatatttgtgcgtattagcggtcgtcgcggcgcgtgtagcgggaacgcggcgtttagttttagcgcgcgtcgtatgttcgtttttagtaggtttaggtagttcgagaaggttatttagagtcgttcgaattcggcgcgttcgtcggcggttaggtttcggtcgcgtagtatagtagttagtcgggcgtaggtggatatcgttagtttttgcgttttttggcgcgttttttgtagtttttgtcgtaggttttgcgagttcgtcgagttatcgacggttagtattaggtggtggtagtacgtagtcgttttgttgagttcgtttagtagcgttttgtatttttttttcgttatcgcggtgggtttcggttgggttcggtcgttcgcgttcgttagttttttttttagcgcggtaggatgtggttaatttttatttcggttttgggtcgcgcggtacgaacgttttttatggttcgtgattcgttcggcgttatcgttaacgtttacggagttcgttcgggattttcgacgtgcgtttttgcggacggggcgcgtagagggagtttcgttagcggtttttcgttttttcgtttattttttttaggcgtatttcgagttatacgtcgtgtttttgtatcgttttggtttttacggtggttttttgcgaagttgagggtgcggtttttatttttcgtgggtgttaatttcggggtaagt

SEQ ID NO: 27370 - DNA, 1061 bp, Artificial Sequence
  chemically treated genomic DNA (Homo sapiens) CpG-island No: 27370
acttaccccgaaattaacacccacgaaaaataaaaaccgcaccctcaacttcgcaaaaaaccaccgtaaaaaccaaaacgatacaaaaacacgacgtataactcgaaatacgcctaaaaaaaataaacgaaaaaacgaaaaaccgctaacgaaactccctctacgcgccccgtccgcaaaaacgcacgtcgaaaatcccgaacgaactccgtaaacgttaacgataacgccgaacgaatcacgaaccataaaaaacgttcgtaccgcgcgacccaaaaccgaaataaaaattaaccacatcctaccgcgctaaaaaaaaaactaacgaacgcgaacgaccgaacccaaccgaaacccaccgcgataacgaaaaaaaaatacaaaacgctactaaacgaactcaacaaaacgactacgtactaccaccacctaatactaaccgtcgataactcgacgaactcgcaaaacctacgacaaaaactacaaaaaacgcgccaaaaaacgcaaaaactaacgatatccacctacgcccgactaactactatactacgcgaccgaaacctaaccgccgacgaacgcgccgaattcgaacgactctaaataaccttctcgaactacctaaacctactaaaaacgaacatacgacgcgcgctaaaactaaacgccgcgttcccgctacacgcgccgcgacgaccgctaatacgcacaaatataactaacgcctcctccgacgtaacgacgcgcgcgctaaacacccgcaacctacgactcgaaacgaaaaacgacttcgacgtcgcgaacctacgaaaactaaaacgcgaaatccttcaaataaacgaaataatcgacaacataaaaataaaaatcaacgtaccccgctaaaccgtacaaacccgacaaacgacgaacgccgaactcctatccacgatcaacgccgacccctcctcgatcgtatccttacaaaaacgcgaaaaaaattacgaccccaaaaaaaccctaaccgccatccttttcgacgccgtactactaacgactataaccctaaccgtatacgtaacgaa

SEQ ID NO: 27371 - DNA, 1061 bp, Artificial Sequence
  chemically treated genomic DNA (Homo sapiens) CpG-island No: 27371
gtttgtttcggagttggtatttacggaggatggggatcgtatttttagtttcgtagggagttatcgtggaggttagggcggtgtagagatacgacgtgtgattcggagtgcgtttggggaggatggacgagggagcgggggatcgttaacggggttttttttgcgcgtttcgttcgtagaggcgtacgtcgagggtttcgggcgggtttcgtggacgttggcggtagcgtcgagcgagttacggattatgaagagcgttcgtgtcgcgcggtttaaggtcgggatgggggttagttatattttgtcgcgttgagggggaggttaacgggcgcgggcggtcgggtttagtcggagtttatcgcgatggcgagggaggagtgtaaggcgttgttggacgggtttaataagacgattgcgtgttattattatttggtgttgatcgtcggtggttcggcggattcgtagaatttgcggtaggagttgtaaaagacgcgttagaaggcgtaggagttggcggtgtttatttgcgttcggttgattgttgtgttgcgcgatcggggtttggtcgtcgacgagcgcgtcgagttcgagcggttttgggtggttttttcgggttgtttggatttgttggaagcggatatgcgacgcgcgttggagttgggcgtcgcgttttcgttgtacgcgtcgcggcggtcgttggtgcgtataggtgtggttggcgtttttttcggcgtggcggcgcgcgcgttgagtattcgtagtttgcggttcgaggcggagggcgatttcgacgtcgcggatttgcgggagttggagcgcgaggttttttaggtgggcgagatgatcgataatatggagatgaaggttaacgtgtttcgttggatcgtgtaagttcggtaggcggcgggcgtcgagtttttgtttacggttagcgtcggttttttttcggtcgtgtttttgtaggagcgcggggggggttgcgattttaggaaggttttggtcgttatttttttcggcgtcgtgttgttggcggttgtggttttagtcgtgtgcgtggcgaa

SEQ ID NO: 27372 - DNA, 1061 bp, Artificial Sequence
  chemically treated genomic DNA (Homo sapiens) CpG-island No: 27372
ttcgccacgcacacgactaaaaccacaaccgccaacaacacgacgccgaaaaaaataacgaccaaaaccttcctaaaatcgcaaccccccccgcgctcctacaaaaacacgaccgaaaaaaaaccgacgctaaccgtaaacaaaaactcgacgcccgccgcctaccgaacttacacgatccaacgaaacacgttaaccttcatctccatattatcgatcatctcgcccacctaaaaaacctcgcgctccaactcccgcaaatccgcgacgtcgaaatcgccctccgcctcgaaccgcaaactacgaatactcaacgcgcgcgccgccacgccgaaaaaaacgccaaccacacctatacgcaccaacgaccgccgcgacgcgtacaacgaaaacgcgacgcccaactccaacgcgcgtcgcatatccgcttccaacaaatccaaacaacccgaaaaaaccacccaaaaccgctcgaactcgacgcgctcgtcgacgaccaaaccccgatcgcgcaacacaacaatcaaccgaacgcaaataaacaccgccaactcctacgccttctaacgcgtcttttacaactcctaccgcaaattctacgaatccgccgaaccaccgacgatcaacaccaaataataataacacgcaatcgtcttattaaacccgtccaacaacgccttacactcctccctcgccatcgcgataaactccgactaaacccgaccgcccgcgcccgttaacctccccctcaacgcgacaaaatataactaacccccatcccgaccttaaaccgcgcgacacgaacgctcttcataatccgtaactcgctcgacgctaccgccaacgtccacgaaacccgcccgaaaccctcgacgtacgcctctacgaacgaaacgcgcaaaaaaaaccccgttaacgatcccccgctccctcgtccatcctccccaaacgcactccgaatcacacgtcgtatctctacaccgccctaacctccacgataactccctacgaaactaaaaatacgatccccatcctccgtaaataccaactccgaaacaaac

SEQ ID NO: 27373 - DNA, 1014 bp, Artificial Sequence
  chemically treated genomic DNA (Homo sapiens) CpG-island No: 27373
gtaattcgaggggttgggcgtcgtcggggttaggtgtttttgtcgcgttgcgtttacgttggtcggtgtttttaagcgttaattttatttttagtgttagttcggtttttagtttcgttttttacgttttgggtacgcgtagttgcgggcgtggggcggggttagttggagtaggaagcgtagggagtcgtttgagtttcgttttcggttgggttggattttatgattgttttgcgtatacgttattttgggaaacgacggttttttattgggttagttgtggcgcggtttcgttttacggcggagtaaggggtgggttatagggttagatcgtcgcgcgagggtggtgggtatcgaggttttagtagcggacgagggaggtgtcgtcgtcgtttaggatgggttgggaatgaagcgatgtagttttttaagtaagtgttttcgcgttggtttttttttgcgttttttttttcgcgggatggttgcgtttcggggcgcggcggtcgggcggggttcggagagtgaggggggaggggttttttgtttttcggagttcgttttcgggttcgttaggtggtttcgcgtcgttttagttttcgcgtttttaggtgggtgttcggtgcgtagtcggcgcgttttgtttatttcgtttttcgggtttggaggaggggagcggtcggcgcggagaatgtatttttcgagtttcgttgcgtcgatatcggcgggtgtggtcggggtgtcgggttcggcggttcggatttggcggggcgcggggcggtcgtcgcgcggtttttcggaggtttagggtttgttggaggggagcggcgggtgggggttcgagtcgcgcgcgtagcggttgtggttttcggggggtgatgagggcgcggagcggggaatttttggttgtcggtttttcgtagggcgggggggtttttgtatttttataggtaaagattgttaaaggaaaatttttaagtatcgagagatgtttcggattttgagtttgtttcgttt

SEQ ID NO: 27374 - DNA, 1014 bp, Artificial Sequence
  chemically treated genomic DNA (Homo sapiens) CpG-island No: 27374
aaacgaaacaaactcaaaatccgaaacatctctcgatacttaaaaattttcctttaacaatctttacctataaaaatacaaaaacccccccgccctacgaaaaaccgacaaccaaaaattccccgctccgcgccctcatcaccccccgaaaaccacaaccgctacgcgcgcgactcgaacccccacccgccgctcccctccaacaaaccctaaacctccgaaaaaccgcgcgacgaccgccccgcgccccgccaaatccgaaccgccgaacccgacaccccgaccacacccgccgatatcgacgcaacgaaactcgaaaaatacattctccgcgccgaccgctcccctcctccaaacccgaaaaacgaaataaacaaaacgcgccgactacgcaccgaacacccacctaaaaacgcgaaaactaaaacgacgcgaaaccacctaacgaacccgaaaacgaactccgaaaaacaaaaaacccctcccccctcactctccgaaccccgcccgaccgccgcgccccgaaacgcaaccatcccgcgaaaaaaaaaacgcaaaaaaaaaccaacgcgaaaacacttacttaaaaaactacatcgcttcattcccaacccatcctaaacgacgacgacacctccctcgtccgctactaaaacctcgatacccaccaccctcgcgcgacgatctaaccctataacccaccccttactccgccgtaaaacgaaaccgcgccacaactaacccaataaaaaaccgtcgtttcccaaaataacgtatacgcaaaacaatcataaaatccaacccaaccgaaaacgaaactcaaacgactccctacgcttcctactccaactaaccccgccccacgcccgcaactacgcgtacccaaaacgtaaaaaacgaaactaaaaaccgaactaacactaaaaataaaattaacgcttaaaaacaccgaccaacgtaaacgcaacgcgacaaaaacacctaaccccgacgacgcccaacccctcgaattac

SEQ ID NO: 27375 - DNA, 1014 bp, Artificial Sequence
  chemically treated genomic DNA (Homo sapiens) CpG-island No: 27375
agacggaatagatttagaattcggaatatttttcggtgtttaagagtttttttttaataatttttatttgtgggaatgtagagattttttcgttttgcgagaggtcggtagttagggatttttcgtttcgcgtttttattatttttcggaaattataatcgttgcgcgcgcggttcggatttttattcgtcgtttttttttagtagattttaggttttcgggaaatcgcgcggcgatcgtttcgcgtttcgttagattcgaatcgtcggattcggtatttcggttatattcgtcggtgtcgacgtagcgaggttcggagggtgtatttttcgcgtcgatcgttttttttttttagattcgaggggcggagtgggtagggcgcgtcggttgcgtatcgggtatttatttggggacgcgggggttggggcggcgcggggttatttggcggattcgggagcggatttcggagagtagggagtttttttttttttatttttcgggtttcgttcggtcgtcgcgtttcgaggcgtagttatttcgcgggaggggaggcgtaggaggaggttagcgcgaggatatttatttaaaaggttatatcgttttatttttagtttattttgggcgacggcggtatttttttcgttcgttgttgggatttcgatgtttattattttcgcgcggcgatttggttttatagtttattttttatttcgtcgtggggcggagtcgcgttatagttgatttaatgagaaatcgtcgttttttagagtgacgtgtacgtagagtaattatggagtttagtttagtcgggggcggggtttaggcggttttttacgttttttattttagttggtttcgttttacgttcgtaattgcgcgtgtttagaacgtgaggggcggggttgggagtcgggttgatattagaggtggggttagcgtttggaagtatcgattaacgtgagcgtaacgcggtagggatatttgatttcggcggcgtttagtttttcggattgt

SEQ ID NO: 27376 - DNA, 1014 bp, Artificial Sequence
  chemically treated genomic DNA (Homo sapiens) CpG-island No: 27376
acaatccgaaaaactaaacgccgccgaaatcaaatatccctaccgcgttacgctcacgttaatcgatacttccaaacgctaaccccacctctaatatcaacccgactcccaaccccgcccctcacgttctaaacacgcgcaattacgaacgtaaaacgaaaccaactaaaataaaaaacgtaaaaaaccgcctaaaccccgcccccgactaaactaaactccataattactctacgtacacgtcactctaaaaaacgacgatttctcattaaatcaactataacgcgactccgccccacgacgaaataaaaaataaactataaaaccaaatcgccgcgcgaaaataataaacatcgaaatcccaacaacgaacgaaaaaaataccgccgtcgcccaaaataaactaaaaataaaacgatataaccttttaaataaatatcctcgcgctaacctcctcctacgcctcccctcccgcgaaataactacgcctcgaaacgcgacgaccgaacgaaacccgaaaaataaaaaaaaaaaaactccctactctccgaaatccgctcccgaatccgccaaataaccccgcgccgccccaacccccgcgtccccaaataaatacccgatacgcaaccgacgcgccctacccactccgcccctcgaatctaaaaaaaaaaaacgatcgacgcgaaaaatacaccctccgaacctcgctacgtcgacaccgacgaatataaccgaaataccgaatccgacgattcgaatctaacgaaacgcgaaacgatcgccgcgcgatttcccgaaaacctaaaatctactaaaaaaaaacgacgaataaaaatccgaaccgcgcgcgcaacgattataatttccgaaaaataataaaaacgcgaaacgaaaaatccctaactaccgacctctcgcaaaacgaaaaaatctctacattcccacaaataaaaattattaaaaaaaaactcttaaacaccgaaaaatattccgaattctaaatctattccgtct

SEQ ID NO: 27377 - DNA, 783 bp, Artificial Sequence
  chemically treated genomic DNA (Homo sapiens) CpG-island No: 27377
  misc_feature (82)..(82): n is either a, c, g or t
  misc_feature (106)..(106): n is either a, c, g or t
  misc_feature (280)..(280): n is either a, c, g or t
  misc_feature (302)..(302): n is either a, c, g or t
  misc_feature (321)..(321): n is either a, c, g or t
  misc_feature (327)..(327): n is either a, c, g or t
  misc_feature (397)..(397): n is either a, c, g or t
  misc_feature (428)..(429): n is either a, c, g or t
  misc_feature (437)..(437): n is either a, c, g or t
  misc_feature (499)..(499): n is either a, c, g or t
  misc_feature (526)..(526): n is either a, c, g or t
  misc_feature (532)..(532): n is either a, c, g or t
  misc_feature (547)..(547): n is either a, c, g or t
  misc_feature (555)..(555): n is either a, c, g or t
  misc_feature (595)..(595): n is either a, c, g or t
  misc_feature (600)..(600): n is either a, c, g or t
  misc_feature (620)..(620): n is either a, c, g or t
  misc_feature (624)..(624): n is either a, c, g or t
  misc_feature (629)..(630): n is either a, c, g or t
  misc_feature (690)..(690): n is either a, c, g or t
  misc_feature (731)..(731): n is either a, c, g or t
  misc_feature (756)..(757): n is either a, c, g or t
  misc_feature (766)..(766): n is either a, c, g or t
ttcgttcgcgcgtcgttcgcgtcgtcggggcgcgttcgcggggggtttcggggcggggggggggggggggggggcggggggnttcggcggcgggcgtttcgtcggncgtcgcggtcgtcgcgtcgtcgttcgtcgcgcgttcgtcgtcgcgtcgggggtcgcgggcggcggcgcgggttcggcggcgtcgtcgggtttcggcgcgcgcgcggcgcgtcgcggcgcgtcgtttcgtcgcgtcgttcggcgtcgcgtcgcgcgcgtcgcgggcgtcggcgtncgtcgtcgcgcgcgcgtcgggntcgcggcggcgcgggcggnggggtncgtcgtttcggtttcgcgcgggttcgggcggttcgcgcgcgcgcggcgcggcgcgttcgcgcgcgtcgtncggcgtttcgttcgcggtttattttcgtcgnngggttttngtcggtcggttcgcgcggcggcgcgttcgcgtcgcgttcgtcgtcgtcgcgcggtcgcgcgngcgcgcggtcgcgtttcggcgtcgcgntcgggngcgggtcggtttcgncggttttncgggcgcgtcgtttcggtcgtcgtttcgtcggggcggcgngtcgngtcgcgtcgggggtcgtcgngggncgcgnntcggtcgcgcggcggcgtcggcgcgtcgcgcgtacgcggcgggtcgtcgcgcgttcgcgncggtcgatttcgtcgcggcgcggtcgttcggcgtcgttttncgcggcgcggcgcggttttcgcgtnnggtcgcggngttcgttcgcgcgttcg

SEQ ID NO: 27378 - DNA, 783 bp, Artificial Sequence
  chemically treated genomic DNA (Homo sapiens) CpG-island No: 27378
  misc_feature (18)..(18): n is either a, c, g or t
  misc_feature (27)..(28): n is either a, c, g or t
  misc_feature (53)..(53): n is either a, c, g or t
  misc_feature (94)..(94): n is either a, c, g or t
  misc_feature (154)..(155): n is either a, c, g or t
  misc_feature (160)..(160): n is either a, c, g or t
  misc_feature (164)..(164): n is either a, c, g or t
  misc_feature (184)..(184): n is either a, c, g or t
  misc_feature (189)..(189): n is either a, c, g or t
  misc_feature (229)..(229): n is either a, c, g or t
  misc_feature (237)..(237): n is either a, c, g or t
  misc_feature (252)..(252): n is either a, c, g or t
  misc_feature (258)..(258): n is either a, c, g or t
  misc_feature (285)..(285): n is either a, c, g or t
  misc_feature (347)..(347): n is either a, c, g or t
  misc_feature (355)..(356): n is either a, c, g or t
  misc_feature (387)..(387): n is either a, c, g or t
  misc_feature (457)..(457): n is either a, c, g or t
  misc_feature (463)..(463): n is either a, c, g or t
  misc_feature (482)..(482): n is either a, c, g or t
  misc_feature (504)..(504): n is either a, c, g or t
  misc_feature (678)..(678): n is either a, c, g or t
  misc_feature (702)..(702): n is either a, c, g or t
cgaacgcgcgaacgaacnccgcgaccnnacgcgaaaaccgcgccgcgccgcgnaaaacgacgccgaacgaccgcgccgcgacgaaatcgaccgncgcgaacgcgcgacgacccgccgcgtacgcgcgacgcgccgacgccgccgcgcgaccganncgcgncccncgacgacccccgacgcgacncgacncgccgccccgacgaaacgacgaccgaaacgacgcgcccgnaaaaccgncgaaaccgacccgcncccgancgcgacgccgaaacgcgaccgcgcgcncgcgcgaccgcgcgacgacgacgaacgcgacgcgaacgcgccgccgcgcgaaccgaccgacnaaaacccnncgacgaaaataaaccgcgaacgaaacgccgnacgacgcgcgcgaacgcgccgcgccgcgcgcgcgcgaaccgcccgaacccgcgcgaaaccgaaacgacgnaccccnccgcccgcgccgccgcgancccgacgcgcgcgcgacgacgnacgccgacgcccgcgacgcgcgcgacgcgacgccgaacgacgcgacgaaacgacgcgccgcgacgcgccgcgcgcgcgccgaaacccgacgacgccgccgaacccgcgccgccgcccgcgacccccgacgcgacgacgaacgcgcgacgaacgacgacgcgacgaccgcgacgnccgacgaaacgcccgccgccgaanccccccgccccccccccccccccccccgccccgaaaccccccgcgaacgcgccccgacgacgcgaacgacgcgcgaacgaa

SEQ ID NO: 27379 - DNA, 783 bp, Artificial Sequence
  chemically treated genomic DNA (Homo sapiens) CpG-island No: 27379
  misc_feature (18)..(18): n is either a, c, g or t
  misc_feature (27)..(28): n is either a, c, g or t
  misc_feature (53)..(53): n is either a, c, g or t
  misc_feature (94)..(94): n is either a, c, g or t
  misc_feature (154)..(155): n is either a, c, g or t
  misc_feature (160)..(160): n is either a, c, g or t
  misc_feature (164)..(164): n is either a, c, g or t
  misc_feature (184)..(184): n is either a, c, g or t
  misc_feature (189)..(189): n is either a, c, g or t
  misc_feature (229)..(229): n is either a, c, g or t
  misc_feature (237)..(237): n is either a, c, g or t
  misc_feature (252)..(252): n is either a, c, g or t
  misc_feature (258)..(258): n is either a, c, g or t
  misc_feature (285)..(285): n is either a, c, g or t
  misc_feature (347)..(347): n is either a, c, g or t
  misc_feature (355)..(356): n is either a, c, g or t
  misc_feature (387)..(387): n is either a, c, g or t
  misc_feature (457)..(457): n is either a, c, g or t
  misc_feature (463)..(463): n is either a, c, g or t
  misc_feature (482)..(482): n is either a, c, g or t
  misc_feature (504)..(504): n is either a, c, g or t
  misc_feature (678)..(678): n is either a, c, g or t
  misc_feature (702)..(702): n is either a, c, g or t
cgggcgcgcgggcgggtntcgcggttnngcgcgggggtcgcgtcgcgtcgcgnggggcggcgtcgggcggtcgcgtcgcggcggggtcggtcgncgcgggcgcgcggcggttcgtcgcgtgcgcgcggcgcgtcggcgtcgtcgcgcggtcggnncgcgntttncggcggttttcggcgcggtncggtncgtcgtttcggcggggcggcggtcggggcggcgcgttcgnggggtcgncggggtcggttcgtnttcggncgcggcgtcggggcgcggtcgcgcgtncgcgcggtcgcgcggcggcggcgggcgcggcgcgggcgcgtcgtcgcgcgggtcggtcggtnggggtttnncggcgggggtgggtcgcgggcggggcgtcgngcggcgcgcgcgggcgcgtcgcgtcgcgcgcgcgcgggtcgttcgggttcgcgcggggtcggggcggcgngttttntcgttcgcgtcgtcgcggnttcggcgcgcgcgcggcggcgngcgtcggcgttcgcggcgcgcgcggcgcggcgtcgggcggcgcggcggggcggcgcgtcgcggcgcgtcgcgcgcgcgtcggggttcggcggcgtcgtcgggttcgcgtcgtcgttcgcggttttcggcgcggcggcgggcgcgcggcgggcggcggcgcggcggtcgcggcgntcggcggggcgttcgtcgtcgggntttttcgtttttttttttttttttttcgtttcggggtttttcgcgggcgcgtttcggcggcgcgggcggcgcgcgggcggg

SEQ ID NO: 27380 - DNA, 783 bp, Artificial Sequence
  chemically treated genomic DNA (Homo sapiens) CpG-island No: 27380
  misc_feature (82)..(82): n is either a, c, g or t
  misc_feature (106)..(106): n is either a, c, g or t
  misc_feature (280)..(280): n is either a, c, g or t
  misc_feature (302)..(302): n is either a, c, g or t
  misc_feature (321)..(321): n is either a, c, g or t
  misc_feature (327)..(327): n is either a, c, g or t
  misc_feature (397)..(397): n is either a, c, g or t
  misc_feature (428)..(429): n is either a, c, g or t
  misc_feature (437)..(437): n is either a, c, g or t
  misc_feature (499)..(499): n is either a, c, g or t
  misc_feature (526)..(526): n is either a, c, g or t
  misc_feature (532)..(532): n is either a, c, g or t
  misc_feature (547)..(547): n is either a, c, g or t
  misc_feature (555)..(555): n is either a, c, g or t
  misc_feature (595)..(595): n is either a, c, g or t
  misc_feature (600)..(600): n is either a, c, g or t
  misc_feature (620)..(620): n is either a, c, g or t
  misc_feature (624)..(624): n is either a, c, g or t
  misc_feature (629)..(630): n is either a, c, g or t
  misc_feature (690)..(690): n is either a, c, g or t
  misc_feature (731)..(731): n is either a, c, g or t
  misc_feature (756)..(757): n is either a, c, g or t
  misc_feature (766)..(766): n is either a, c, g or t
cccgcccgcgcgccgcccgcgccgccgaaacgcgcccgcgaaaaaccccgaaacgaaaaaaaaaaaaaaaaaaacgaaaaancccgacgacgaacgccccgccgancgccgcgaccgccgcgccgccgcccgccgcgcgcccgccgccgcgccgaaaaccgcgaacgacgacgcgaacccgacgacgccgccgaaccccgacgcgcgcgcgacgcgccgcgacgcgccgccccgccgcgccgcccgacgccgcgccgcgcgcgccgcgaacgccgacgcncgccgccgcgcgcgcgccgaanccgcgacgacgcgaacganaaaacncgccgccccgaccccgcgcgaacccgaacgacccgcgcgcgcgcgacgcgacgcgcccgcgcgcgccgcncgacgccccgcccgcgacccacccccgccgnnaaaccccnaccgaccgacccgcgcgacgacgcgcccgcgccgcgcccgccgccgccgcgcgaccgcgcgnacgcgcgaccgcgccccgacgccgcgnccgaanacgaaccgaccccgncgaccccncgaacgcgccgccccgaccgccgccccgccgaaacgacgnaccgnaccgcgccgaaaaccgccgnaaancgcgnnccgaccgcgcgacgacgccgacgcgccgcgcgcacgcgacgaaccgccgcgcgcccgcgncgaccgaccccgccgcgacgcgaccgcccgacgccgccccncgcgacgcgacgcgacccccgcgcnnaaccgcganacccgcccgcgcgcccg

SEQ ID NO: 27381 - DNA, 878 bp, Artificial Sequence
  chemically treated genomic DNA (Homo sapiens) CpG-island No: 27381
  misc_feature (3)..(5): n is either a, c, g or t
  misc_feature (10)..(10): n is either a, c, g or t
  misc_feature (14)..(15): n is either a, c, g or t
  misc_feature (45)..(46): n is either a, c, g or t
  misc_feature (50)..(51): n is either a, c, g or t
  misc_feature (58)..(58): n is either a, c, g or t
  misc_feature (98)..(98): n is either a, c, g or t
  misc_feature (105)..(105): n is either a, c, g or t
  misc_feature (107)..(108): n is either a, c, g or t
  misc_feature (123)..(123): n is either a, c, g or t
  misc_feature (181)..(182): n is either a, c, g or t
  misc_feature (185)..(185): n is either a, c, g or t
  misc_feature (208)..(208): n is either a, c, g or t
  misc_feature (215)..(215): n is either a, c, g or t
  misc_feature (237)..(237): n is either a, c, g or t
  misc_feature (283)..(283): n is either a, c, g or t
  misc_feature (303)..(303): n is either a, c, g or t
  misc_feature (323)..(323): n is either a, c, g or t
  misc_feature (326)..(326): n is either a, c, g or t
  misc_feature (378)..(378): n is either a, c, g or t
  misc_feature (391)..(391): n is either a, c, g or t
  misc_feature (431)..(431): n is either a, c, g or t
  misc_feature (443)..(443): n is either a, c, g or t
  misc_feature (450)..(450): n is either a, c, g or t
  misc_feature (473)..(473): n is either a, c, g or t
  misc_feature (485)..(485): n is either a, c, g or t
  misc_feature (501)..(501): n is either a, c, g or t
  misc_feature (527)..(527): n is either a, c, g or t
  misc_feature (541)..(542): n is either a, c, g or t
  misc_feature (558)..(558): n is either a, c, g or t
  misc_feature (604)..(604): n is either a, c, g or t
  misc_feature (610)..(611): n is either a, c, g or t
  misc_feature (631)..(631): n is either a, c, g or t
  misc_feature (641)..(641): n is either a, c, g or t
  misc_feature (647)..(647): n is either a, c, g or t
  misc_feature (656)..(656): n is either a, c, g or t
  misc_feature (658)..(658): n is either a, c, g or t
  misc_feature (663)..(663): n is either a, c, g or t
  misc_feature (665)..(665): n is either a, c, g or t
  misc_feature (677)..(677): n is either a, c, g or t
  misc_feature (685)..(687): n is either a, c, g or t
  misc_feature (689)..(689): n is either a, c, g or t
  misc_feature (691)..(691): n is either a, c, g or t
  misc_feature (693)..(693): n is either a, c, g or t
  misc_feature (695)..(696): n is either a, c, g or t
  misc_feature (720)..(721): n is either a, c, g or t
  misc_feature (723)..(723): n is either a, c, g or t
  misc_feature (755)..(755): n is either a, c, g or t
  misc_feature (774)..(775): n is either a, c, g or t
  misc_feature (786)..(786): n is either a, c, g or t
  misc_feature (794)..(794): n is either a, c, g or t
  misc_feature (831)..(831): n is either a, c, g or t
  misc_feature (833)..(833): n is either a, c, g or t
  misc_feature (835)..(835): n is either a, c, g or t
  misc_feature (844)..(845): n is either a, c, g or t
  misc_feature (847)..(847): n is either a, c, g or t
  misc_feature (850)..(850): n is either a, c, g or t
  misc_feature (853)..(853): n is either a, c, g or t
  misc_feature (856)..(856): n is either a, c, g or t
  misc_feature (858)..(858): n is either a, c, g or t
  misc_feature (870)..(870): n is either a, c, g or t
  misc_feature (877)..(877): n is either a, c, g or t
cgnnngcggngcgnngcgcgggggcgcggggggcgcggggcgcgnngcgnnggggcgncggcgcggtcgtcggcgttcggcgcgcggcgggggcgcgntcgtttngnngggcgcggcgggggngcgcgcgtcgcgggggcgggcgcgttcgcgcggggggggcgttttcggcgtttcgcgnnggncgcggtcgttttttttttttcgngcgcgtnggcgcgttttcggtcgggcggncggcgcggggcgtttcgcggtcgtcgtttcgttcgtcgtcgcgcgnggttcgcgttcgcgggcggngcggcgttttttcgcggttncgncgtcggcgcgtcggggcgcgggtcgtcggcgcgtcgtcggtcgcgcgcggtngcgtcggggtcgngtttcggtcgcgcggggggcgcgcgcgcgcgcggcgtcgnttcgcgtttcgngtcgggnaggggcggggtaggggtcgggtntcggcgcgtttncgcgtttcgggcgggnggcggcggcgtcgcgtcgttcgcggngcgcgcgcgcggtnnttcgtttcgttttcgngttttcgtcggtcgcgcggggcggtcgcgcgcgtcgcgcgcgcggngcgcgnngcgcggggtcgtcggggttngtcggttttncggttngcgcggggngnggggngngcggggcggcgncgcgcgtnnngngngngnnggcgcggcgcgcggtcgcgcgcgnntncgcgcgcggcgttcgcgcggtttcgcggcgtngcgcgttcgcgtcgtcgtnngcgtttcgggncgttcgtntcgtttcggcggcgggtcggcgcgggtcgcgcggggntngntcgtcggtnngngtngtnggntnggcgacgcggtnttcggtnt

SEQ ID NO: 27382 - DNA, 878 bp, Artificial Sequence
  chemically treated genomic DNA (Homo sapiens) CpG-island No: 27382
  misc_feature (2)..(2): n is either a, c, g or t
  misc_feature (9)..(9): n is either a, c, g or t
  misc_feature (21)..(21): n is either a, c, g or t
  misc_feature (23)..(23): n is either a, c, g or t
  misc_feature (26)..(26): n is either a, c, g or t
  misc_feature (29)..(29): n is either a, c, g or t
  misc_feature (32)..(32): n is either a, c, g or t
  misc_feature (34)..(35): n is either a, c, g or t
  misc_feature (44)..(44): n is either a, c, g or t
  misc_feature (46)..(46): n is either a, c, g or t
  misc_feature (48)..(48): n is either a, c, g or t
  misc_feature (85)..(85): n is either a, c, g or t
  misc_feature (93)..(93): n is either a, c, g or t
  misc_feature (104)..(105): n is either a, c, g or t
  misc_feature (124)..(124): n is either a, c, g or t
  misc_feature (156)..(156): n is either a, c, g or t
  misc_feature (158)..(159): n is either a, c, g or t
  misc_feature (183)..(184): n is either a, c, g or t
  misc_feature (186)..(186): n is either a, c, g or t
  misc_feature (188)..(188): n is either a, c, g or t
  misc_feature (190)..(190): n is either a, c, g or t
  misc_feature (192)..(194): n is either a, c, g or t
  misc_feature (202)..(202): n is either a, c, g or t
  misc_feature (214)..(214): n is either a, c, g or t
  misc_feature (216)..(216): n is either a, c, g or t
  misc_feature (221)..(221): n is either a, c, g or t
  misc_feature (223)..(223): n is either a, c, g or t
  misc_feature (232)..(232): n is either a, c, g or t
  misc_feature (238)..(238): n is either a, c, g or t
  misc_feature (248)..(248): n is either a, c, g or t
  misc_feature (268)..(269): n is either a, c, g or t
  misc_feature (275)..(275): n is either a, c, g or t
  misc_feature (321)..(321): n is either a, c, g or t
  misc_feature (337)..(338): n is either a, c, g or t
  misc_feature (352)..(352): n is either a, c, g or t
  misc_feature (378)..(378): n is either a, c, g or t
  misc_feature (394)..(394): n is either a, c, g or t
  misc_feature (406)..(406): n is either a, c, g or t
  misc_feature (429)..(429): n is either a, c, g or t
  misc_feature (436)..(436): n is either a, c, g or t
  misc_feature (448)..(448): n is either a, c, g or t
  misc_feature (488)..(488): n is either a, c, g or t
  misc_feature (501)..(501): n is either a, c, g or t
  misc_feature (553)..(553): n is either a, c, g or t
  misc_feature (556)..(556): n is either a, c, g or t
  misc_feature (576)..(576): n is either a, c, g or t
  misc_feature (596)..(596): n is either a, c, g or t
  misc_feature (642)..(642): n is either a, c, g or t
  misc_feature (664)..(664): n is either a, c, g or t
  misc_feature (671)..(671): n is either a, c, g or t
  misc_feature (694)..(694): n is either a, c, g or t
  misc_feature (697)..(698): n is either a, c, g or t
  misc_feature (756)..(756): n is either a, c, g or t
  misc_feature (771)..(772): n is either a, c, g or t
  misc_feature (774)..(774): n is either a, c, g or t
  misc_feature (781)..(781): n is either a, c, g or t
  misc_feature (821)..(821): n is either a, c, g or t
  misc_feature (828)..(829): n is either a, c, g or t
  misc_feature (833)..(834): n is either a, c, g or t
  misc_feature (864)..(865): n is either a, c, g or t
  misc_feature (869)..(869): n is either a, c, g or t
  misc_feature (874)..(876): n is either a, c, g or t
anaccgaanaccgcgtcgccnanccnacnacncnnaccgacgancnanccccgcgcgacccgcgccgacccgccgccgaaacganacgaacgncccgaaacgcnnacgacgacgcgaacgcgcnacgccgcgaaaccgcgcgaacgccgcgcgcgnanncgcgcgcgaccgcgcgccgcgccnncncncncnnnacgcgcgncgccgccccgcncnccccncnccccgcgcnaaccgnaaaaccgacnaaccccgacgaccccgcgcnncgcgcnccgcgcgcgcgacgcgcgcgaccgccccgcgcgaccgacgaaaacncgaaaacgaaacgaannaccgcgcgcgcgcnccgcgaacgacgcgacgccgccgccncccgcccgaaacgcgnaaacgcgccganacccgacccctaccccgcccctncccgacncgaaacgcgaancgacgccgcgcgcgcgcgcgccccccgcgcgaccgaaacncgaccccgacgcnaccgcgcgcgaccgacgacgcgccgacgacccgcgccccgacgcgccgacgncgnaaccgcgaaaaaacgccgcnccgcccgcgaacgcgaaccncgcgcgacgacgaacgaaacgacgaccgcgaaacgccccgcgccgnccgcccgaccgaaaacgcgccnacgcgcncgaaaaaaaaaaaacgaccgcgnccnncgcgaaacgccgaaaacgccccccccgcgcgaacgcgcccgcccccgcgacgcgcgcncccccgccgcgcccnncnaaacgancgcgcccccgccgcgcgccgaacgccgacgaccgcgccgncgccccnncgcnncgcgccccgcgccccccgcgcccccgcgcnncgcnccgcnnncg

SEQ ID NO: 27383 - DNA, 878 bp, Artificial Sequence
  chemically treated genomic DNA (Homo sapiens) CpG-island No: 27383
  misc_feature (2)..(2): n is either a, c, g or t
  misc_feature (9)..(9): n is either a, c, g or t
  misc_feature (21)..(21): n is either a, c, g or t
  misc_feature (23)..(23): n is either a, c, g or t
  misc_feature (26)..(26): n is either a, c, g or t
  misc_feature (29)..(29): n is either a, c, g or t
  misc_feature (32)..(32): n is either a, c, g or t
  misc_feature (34)..(35): n is either a, c, g or t
  misc_feature (44)..(44): n is either a, c, g or t
  misc_feature (46)..(46): n is either a, c, g or t
  misc_feature (48)..(48): n is either a, c, g or t
  misc_feature (85)..(85): n is either a, c, g or t
  misc_feature (93)..(93): n is either a, c, g or t
  misc_feature (104)..(105): n is either a, c, g or t
  misc_feature (124)..(124): n is either a, c, g or t
  misc_feature (156)..(156): n is either a, c, g or t
  misc_feature (158)..(159): n is either a, c, g or t
  misc_feature (183)..(184): n is either a, c, g or t
  misc_feature (186)..(186): n is either a, c, g or t
  misc_feature (188)..(188): n is either a, c, g or t
  misc_feature (190)..(190): n is either a, c, g or t
  misc_feature (192)..(194): n is either a, c, g or t
  misc_feature (202)..(202): n is either a, c, g or t
  misc_feature (214)..(214): n is either a, c, g or t
  misc_feature (216)..(216): n is either a, c, g or t
  misc_feature (221)..(221): n is either a, c, g or t
  misc_feature (223)..(223): n is either a, c, g or t
  misc_feature (232)..(232): n is either a, c, g or t
  misc_feature (238)..(238): n is either a, c, g or t
  misc_feature (248)..(248): n is either a, c, g or t
  misc_feature (268)..(269): n is either a, c, g or t
  misc_feature (275)..(275): n is either a, c, g or t
  misc_feature (321)..(321): n is either a, c, g or t
  misc_feature (337)..(338): n is either a, c, g or t
  misc_feature (352)..(352): n is either a, c, g or t
  misc_feature (378)..(378): n is either a, c, g or t
  misc_feature (394)..(394): n is either a, c, g or t
  misc_feature (406)..(406): n is either a, c, g or t
  misc_feature (429)..(429): n is either a, c, g or t
  misc_feature (436)..(436): n is either a, c, g or t
  misc_feature (448)..(448): n is either a, c, g or t
  misc_feature (488)..(488): n is either a, c, g or t
  misc_feature (501)..(501): n is either a, c, g or t
  misc_feature (553)..(553): n is either a, c, g or t
  misc_feature (556)..(556): n is either a, c, g or t
  misc_feature (576)..(576): n is either a, c, g or t
  misc_feature (596)..(596): n is either a, c, g or t
  misc_feature (642)..(642): n is either a, c, g or t
  misc_feature (664)..(664): n is either a, c, g or t
  misc_feature (671)..(671): n is either a, c, g or t
  misc_feature (694)..(694): n is either a, c, g or t
  misc_feature (697)..(698): n is either a, c, g or t
  misc_feature (756)..(756): n is either a, c, g or t
  misc_feature (771)..(772): n is either a, c, g or t
  misc_feature (774)..(774): n is either a, c, g or t
  misc_feature (781)..(781): n is either a, c, g or t
  misc_feature (821)..(821): n is either a, c, g or t
  misc_feature (828)..(829): n is either a, c, g or t
  misc_feature (833)..(834): n is either a, c, g or t
  misc_feature (864)..(865): n is either a, c, g or t
  misc_feature (869)..(869): n is either a, c, g or t
  misc_feature (874)..(876): n is either a, c, g or t
gngtcgggngtcgcgtcgttngnttngtngtntnngtcggcggntngntttcgcgcggttcgcgtcggttcgtcgtcggggcggngcgggcgnttcggggcgtnngcggcggcgcgggcgcgtngcgtcgcggggtcgcgcgggcgtcgcgcgcgngnncgcgcgcggtcgcgcgtcgcgttnntntntntnnngcgcgcgncgtcgtttcgtntnttttntntttcgcgtnggtcgnggggtcggtnggtttcggcggtttcgcgtnncgcgtntcgcgcgcgcggcgcgcgcggtcgtttcgcgcggtcggcgggggtncgggggcggggcgggnngtcgcgcgcgcgtntcgcgggcggcgcggcgtcgtcgttnttcgttcggggcgcgngggcgcgtcggngttcggtttttgtttcgtttttnttcggtncggggcgcgggncggcgtcgcgcgcgcgcgcgtttttcgcgcggtcggggtncggtttcggcgtngtcgcgcgcggtcggcggcgcgtcggcggttcgcgtttcggcgcgtcggcgncgnggtcgcgggggggcgtcgtntcgttcgcgggcgcgggttncgcgcggcggcgggcggggcggcggtcgcggggcgtttcgcgtcgntcgttcggtcgggggcgcgttngcgcgtncgggggggggggggcggtcgcgnttnncgcggggcgtcgggggcgtttttttcgcgcgggcgcgttcgttttcgcggcgcgcgtnttttcgtcgcgtttnntngggcggncgcgttttcgtcgcgcgtcgggcgtcggcggtcgcgtcgncgttttnncgtnncgcgtttcgcgtttttcgcgttttcgcgtnncgtntcgtnnncg

SEQ ID NO: 27384 - DNA, 878 bp, Artificial Sequence
  chemically treated genomic DNA (Homo sapiens) CpG-island No: 27384
  misc_feature (3)..(5): n is either a, c, g or t
  misc_feature (10)..(10): n is either a, c, g or t
  misc_feature (14)..(15): n is either a, c, g or t
  misc_feature (45)..(46): n is either a, c, g or t
  misc_feature (50)..(51): n is either a, c, g or t
  misc_feature (58)..(58): n is either a, c, g or t
  misc_feature (98)..(98): n is either a, c, g or t
  misc_feature (105)..(105): n is either a, c, g or t
  misc_feature (107)..(108): n is either a, c, g or t
  misc_feature (123)..(123): n is either a, c, g or t
  misc_feature (181)..(182): n is either a, c, g or t
  misc_feature (185)..(185): n is either a, c, g or t
  misc_feature (208)..(208): n is either a, c, g or t
  misc_feature (215)..(215): n is either a, c, g or t
  misc_feature (237)..(237): n is either a, c, g or t
  misc_feature (283)..(283): n is either a, c, g or t
  misc_feature (303)..(303): n is either a, c, g or t
  misc_feature (323)..(323): n is either a, c, g or t
  misc_feature (326)..(326): n is either a, c, g or t
  misc_feature (378)..(378): n is either a, c, g or t
  misc_feature (391)..(391): n is either a, c, g or t
  misc_feature (431)..(431): n is either a, c, g or t
  misc_feature (443)..(443): n is either a, c, g or t
  misc_feature (450)..(450): n is either a, c, g or t
  misc_feature (473)..(473): n is either a, c, g or t
  misc_feature (485)..(485): n is either a, c, g or t
  misc_feature (501)..(501): n is either a, c, g or t
  misc_feature (527)..(527): n is either a, c, g or t
  misc_feature (541)..(542): n is either a, c, g or t
  misc_feature (558)..(558): n is either a, c, g or t
  misc_feature (604)..(604): n is either a, c, g or t
  misc_feature (610)..(611): n is either a, c, g or t
  misc_feature (631)..(631): n is either a, c, g or t
  misc_feature (641)..(641): n is either a, c, g or t
  misc_feature (647)..(647): n is either a, c, g or t
  misc_feature (656)..(656): n is either a, c, g or t
  misc_feature (658)..(658): n is either a, c, g or t
  misc_feature (663)..(663): n is either a, c, g or t
  misc_feature (665)..(665): n is either a, c, g or t
  misc_feature (677)..(677): n is either a, c, g or t
  misc_feature (685)..(687): n is either a, c, g or t
  misc_feature (689)..(689): n is either a, c, g or t
  misc_feature (691)..(691): n is either a, c, g or t
  misc_feature (693)..(693): n is either a, c, g or t
  misc_feature (695)..(696): n is either a, c, g or t
  misc_feature (720)..(721): n is either a, c, g or t
  misc_feature (723)..(723): n is either a, c, g or t
  misc_feature (755)..(755): n is either a, c, g or t
  misc_feature (774)..(775): n is either a, c, g or t
  misc_feature (786)..(786): n is either a, c, g or t
  misc_feature (794)..(794): n is either a, c, g or t
  misc_feature (831)..(831): n is either a, c, g or t
  misc_feature (833)..(833): n is either a, c, g or t
  misc_feature (835)..(835): n is either a, c, g or t
  misc_feature (844)..(845): n is either a, c, g or t
  misc_feature (847)..(847): n is either a, c, g or t
  misc_feature (850)..(850): n is either a, c, g or t
  misc_feature (853)..(853): n is either a, c, g or t
  misc_feature (856)..(856): n is either a, c, g or t
  misc_feature (858)..(858): n is either a, c, g or t
  misc_feature (870)..(870): n is either a, c, g or t
  misc_feature (877)..(877): n is either a, c, g or t
cgnnnacganacgnnacgcgaaaacgcgaaaaacgcgaaacgcgnnacgnnaaaacgncgacgcgaccgccgacgcccgacgcgcgacgaaaacgcgnccgcccnannaaacgcgacgaaaanacgcgcgccgcgaaaacgaacgcgcccgcgcgaaaaaaacgcccccgacgccccgcgnnaancgcgaccgcccccccccccccgnacgcgcnaacgcgcccccgaccgaacgancgacgcgaaacgccccgcgaccgccgccccgcccgccgccgcgcgnaacccgcgcccgcgaacganacgacgcccccccgcgaccncgncgccgacgcgccgaaacgcgaaccgccgacgcgccgccgaccgcgcgcgacnacgccgaaaccgnaccccgaccgcgcgaaaaacgcgcgcgcgcgcgacgccgncccgcgccccgnaccgaanaaaaacgaaacaaaaaccgaacnccgacgcgcccncgcgccccgaacgaanaacgacgacgccgcgccgcccgcganacgcgcgcgcgacnncccgccccgcccccgnacccccgccgaccgcgcgaaacgaccgcgcgcgccgcgcgcgcganacgcgnnacgcgaaaccgccgaaaccnaccgaccccncgaccnacgcgaaananaaaananacgaaacgacgncgcgcgcnnnanananannaacgcgacgcgcgaccgcgcgcgnncncgcgcgcgacgcccgcgcgaccccgcgacgcnacgcgcccgcgccgccgcnnacgccccgaancgcccgcnccgccccgacgacgaaccgacgcgaaccgcgcgaaancnanccgccgacnnanacnacnaancnaacgacgcgacncccgacnc

SEQ ID NO: 27385 - DNA, 665 bp, Artificial Sequence
  chemically treated genomic DNA (Homo sapiens) CpG-island No: 27385
  misc_feature (39)..(39): n is either a, c, g or t
  misc_feature (45)..(45): n is either a, c, g or t
  misc_feature (54)..(54): n is either a, c, g or t
  misc_feature (194)..(194): n is either a, c, g or t
  misc_feature (200)..(200): n is either a, c, g or t
  misc_feature (228)..(228): n is either a, c, g or t
  misc_feature (283)..(283): n is either a, c, g or t
  misc_feature (377)..(377): n is either a, c, g or t
  misc_feature (402)..(402): n is either a, c, g or t
  misc_feature (476)..(476): n is either a, c, g or t
  misc_feature (486)..(486): n is either a, c, g or t
  misc_feature (509)..(509): n is either a, c, g or t
  misc_feature (558)..(558): n is either a, c, g or t
  misc_feature (561)..(561): n is either a, c, g or t
  misc_feature (590)..(590): n is either a, c, g or t
  misc_feature (592)..(593): n is either a, c, g or t
  misc_feature (605)..(605): n is either a, c, g or t
  misc_feature (635)..(635): n is either a, c, g or t
gtttttttcgtcgcgcgtttcgcgcggggcggcgggcgngcgttngcgcggttnttcgtttcgttcgcgttttcgtttcgcgtcgtttttttcgcgcggcggttttttcgtttcgcgttcgcgtttcgtcgtttttttcgcgggggggtggttcgtttcgcgtagcgttttttttttttttcgtttttttgttnggggtnggcgcgttttttttttttttcgtcgggngggggttcgtttttttttttcggtcgcgcggggtttttcgtttcgttttttcgtncggggcgtttttcgttttttcgtcgcgcgggggggttcgtttttttttttttcgcggcgtcgcgtcgttttttcgcgttcgtcgtggggcgcgngggtttcgcgtcgtcgtcgcggcgngtttttcgcgttcggtcgtcgcgtcggtcggtcgcgcggcgttttcgcgtttcgttcgcgcgcgcgcggcgcgncgcgttcgtntcgtcgtttttcgcgtcggcggngcgcgcgttcgttcggtcgcgttcgcgcgtttcgcgtcggcgtcgtttngtngcgttcgttttcgcgcgcgcggcgcgttntnngcgtcggggttnttgcggcgttttcgcgttttttcgcgcggngtcgtcggcgtttcgtcgtcgttcgtattt

SEQ ID NO: 27386 - DNA, 665 bp, Artificial Sequence
  chemically treated genomic DNA (Homo sapiens) CpG-island No: 27386
  misc_feature (31)..(31): n is either a, c, g or t
  misc_feature (61)..(61): n is either a, c, g or t
  misc_feature (73)..(74): n is either a, c, g or t
  misc_feature (76)..(76): n is either a, c, g or t
  misc_feature (105)..(105): n is either a, c, g or t
  misc_feature (108)..(108): n is either a, c, g or t
  misc_feature (157)..(157): n is either a, c, g or t
  misc_feature (180)..(180): n is either a, c, g or t
  misc_feature (190)..(190): n is either a, c, g or t
  misc_feature (264)..(264): n is either a, c, g or t
  misc_feature (289)..(289): n is either a, c, g or t
  misc_feature (383)..(383): n is either a, c, g or t
  misc_feature (438)..(438): n is either a, c, g or t
  misc_feature (466)..(466): n is either a, c, g or t
  misc_feature (472)..(472): n is either a, c, g or t
  misc_feature (612)..(612): n is either a, c, g or t
  misc_feature (621)..(621): n is either a, c, g or t
  misc_feature (627)..(627): n is either a, c, g or t
aaatacgaacgacgacgaaacgccgacgacnccgcgcgaaaaaacgcgaaaacgccgcaanaaccccgacgcnnanaacgcgccgcgcgcgcgaaaacgaacgcnacnaaacgacgccgacgcgaaacgcgcgaacgcgaccgaacgaacgcgcgcnccgccgacgcgaaaaacgacganacgaacgcgncgcgccgcgcgcgcgcgaacgaaacgcgaaaacgccgcgcgaccgaccgacgcgacgaccgaacgcgaaaaacncgccgcgacgacgacgcgaaacccncgcgccccacgacgaacgcgaaaaaacgacgcgacgccgcgaaaaaaaaaaaaacgaacccccccgcgcgacgaaaaaacgaaaaacgccccgnacgaaaaaacgaaacgaaaaaccccgcgcgaccgaaaaaaaaaaacgaacccccncccgacgaaaaaaaaaaaaaacgcgccnaccccnaacaaaaaaacgaaaaaaaaaaaaaacgctacgcgaaacgaaccacccccccgcgaaaaaaacgacgaaacgcgaacgcgaaacgaaaaaaccgccgcgcgaaaaaaacgacgcgaaacgaaaacgcgaacgaaacgaanaaccgcgcnaacgcncgcccgccgccccgcgcgaaacgcgcgacgaaaaaaac

SEQ ID NO: 27387 - DNA, 665 bp, Artificial Sequence
  chemically treated genomic DNA (Homo sapiens) CpG-island No: 27387
  misc_feature (31)..(31): n is either a, c, g or t
  misc_feature (61)..(61): n is either a, c, g or t
  misc_feature (73)..(74): n is either a, c, g or t
  misc_feature (76)..(76): n is either a, c, g or t
  misc_feature (105)..(105): n is either a, c, g or t
  misc_feature (108)..(108): n is either a, c, g or t
  misc_feature (157)..(157): n is either a, c, g or t
  misc_feature (180)..(180): n is either a, c, g or t
  misc_feature (190)..(190): n is either a, c, g or t
  misc_feature (264)..(264): n is either a, c, g or t
  misc_feature (289)..(289): n is either a, c, g or t
  misc_feature (383)..(383): n is either a, c, g or t
  misc_feature (438)..(438): n is either a, c, g or t
  misc_feature (466)..(466): n is either a, c, g or t
  misc_feature (472)..(472): n is either a, c, g or t
  misc_feature (612)..(612): n is either a, c, g or t
  misc_feature (621)..(621): n is either a, c, g or t
  misc_feature (627)..(627): n is either a, c, g or t
gggtgcgggcggcggcggggcgtcggcggtntcgcgcggggggacgcgggggcgtcgtagnggtttcggcgtnngnggcgcgtcgcgcgcgcgggggcgagcgtngtngggcggcgtcggcgcggggcgcgcgggcgcggtcgggcgggcgcgcgtntcgtcggcgcggggggcggcggngcgggcgcgncgcgtcgcgcgcgcgcgggcggggcgcgggggcgtcgcgcggtcggtcggcgcggcggtcgggcgcggggggtncgtcgcggcggcggcgcggggtttncgcgttttacggcgggcgcgggggggcggcgcggcgtcgcggggggggggggggcgggttttttcgcgcggcgggggggcggggggcgtttcgngcgggggggcggggcggggggtttcgcgcggtcggggggggagggcgggtttttnttcggcgggaggagaggggggcgcgttngttttnaataagagggcggggggggggggaggcgttacgcggagcgggttattttttcgcggaggagacggcggggcgcgggcgcggggcgggggggtcgtcgcgcggggggggcggcgcggggcgggggcgcgggcggggcgggnggtcgcgtnggcgtncgttcgtcgtttcgcgcggggcgcgcggcggggggggt

SEQ ID NO: 27388 - DNA, 665 bp, Artificial Sequence
  chemically treated genomic DNA (Homo sapiens) CpG-island No: 27388
  misc_feature (39)..(39): n is either a, c, g or t
  misc_feature (45)..(45): n is either a, c, g or t
  misc_feature (54)..(54): n is either a, c, g or t
  misc_feature (194)..(194): n is either a, c, g or t
  misc_feature (200)..(200): n is either a, c, g or t
  misc_feature (228)..(228): n is either a, c, g or t
  misc_feature (283)..(283): n is either a, c, g or t
  misc_feature (377)..(377): n is either a, c, g or t
  misc_feature (402)..(402): n is either a, c, g or t
  misc_feature (476)..(476): n is either a, c, g or t
  misc_feature (486)..(486): n is either a, c, g or t
  misc_feature (509)..(509): n is either a, c, g or t
  misc_feature (558)..(558): n is either a, c, g or t
  misc_feature (561)..(561): n is either a, c, g or t
  misc_feature (590)..(590): n is either a, c, g or t
  misc_feature (592)..(593): n is either a, c, g or t
  misc_feature (605)..(605): n is either a, c, g or t
  misc_feature (635)..(635): n is either a, c, g or t
accccccccgccgcgcgccccgcgcgaaacgacgaacgnacgccnacgcgaccncccgccccgcccgcgcccccgccccgcgccgccccccccgcgcgacgacccccccgccccgcgcccgcgccccgccgtctcctccgcgaaaaaataacccgctccgcgtaacgcctccccccccccccgccctcttattnaaaacnaacgcgcccccctctcctcccgccgaanaaaaacccgccctccccccccgaccgcgcgaaaccccccgccccgcccccccgcncgaaacgccccccgcccccccgccgcgcgaaaaaacccgccccccccccccccgcgacgccgcgccgcccccccgcgcccgccgtaaaacgcgnaaaccccgcgccgccgccgcgacgnaccccccgcgcccgaccgccgcgccgaccgaccgcgcgacgcccccgcgccccgcccgcgcgcgcgcgacgcgncgcgcccgcnccgccgccccccgcgccgacganacgcgcgcccgcccgaccgcgcccgcgcgccccgcgccgacgccgcccnacnacgctcgcccccgcgcgcgcgacgcgccncnnacgccgaaaccnctacgacgcccccgcgtccccccgcgcganaccgccgacgccccgccgccgcccgcaccc

SEQ ID NO: 27389 - DNA, 754 bp, Artificial Sequence
  chemically treated genomic DNA (Homo sapiens) CpG-island No: 27389
  misc_feature (70)..(70): n is either a, c, g or t
  misc_feature (77)..(77): n is either a, c, g or t
  misc_feature (288)..(288): n is either a, c, g or t
  misc_feature (369)..(369): n is either a, c, g or t
  misc_feature (378)..(378): n is either a, c, g or t
  misc_feature (396)..(397): n is either a, c, g or t
  misc_feature (465)..(465): n is either a, c, g or t
  misc_feature (522)..(522): n is either a, c, g or t
  misc_feature (556)..(557): n is either a, c, g or t
  misc_feature (561)..(561): n is either a, c, g or t
  misc_feature (566)..(566): n is either a, c, g or t
  misc_feature (623)..(623): n is either a, c, g or t
  misc_feature (625)..(625): n is either a, c, g or t
  misc_feature (627)..(627): n is either a, c, g or t
  misc_feature (642)..(642): n is either a, c, g or t
  misc_feature (651)..(651): n is either a, c, g or t
  misc_feature (655)..(655): n is either a, c, g or t
  misc_feature (673)..(673): n is either a, c, g or t
  misc_feature (720)..(720): n is either a, c, g or t
  misc_feature (724)..(724): n is either a, c, g or t
  misc_feature (731)..(731): n is either a, c, g or t
  misc_feature (733)..(733): n is either a, c, g or t
  misc_feature (749)..(749): n is either a, c, g or t
gtcgttttcggtcgcggggggcggggggggtcgtcgttttcggtcgcgtttttcgcgcgcggttcgcgtngcgcggnggcgggggcgcgcgttcgttcggtttcgcggttttcgttttcgcggcgcggttcgttttttcgttttcgcgtttcgtttttcgtttcgcgcgcgcggtttttcgcgttttttttcgcgtcgtcgcgttcgttttttcgcgcgcgttcgttcgttcgcggtttcgcgtttttcgcgtttcggcgtcgcgtttcgttttcgtcgttttcgggncgcgcgcgttcgcgtcgtcgcggtcgtcgttcgcgcgtcgcgcggttcgtcgcggtcgtcgcggttcgcgcggttcgtttngtttcgttntttcgttttttcggcggnncgcgcgcgttcggcgcgtttcgtttcgcgtcgtcggggcgttcgcgttcgcgcggcgtcgtttcgttngtcgggcgttttttcgcggttttcgtcgtttcgtcgtcgtttcgcgcgtcgggtcgncgcgttcgggttcgcgcggcgggcgcgcgtcggnngcgngggtngtcgttcgtcgtcggtcgtcgcgtcgacgtcgcgtcgcgcgttcggttcgcggtttngngngcggcgttcgttcgncggcgtttncgtnttggggttttcgcgtttngcgcgtcgcgttttcgcgtttcgtcgtttttcgttttcgtttcgcgncgtngcgcggntnggcgggcgttcggttngtttt

SEQ ID NO: 27390 - DNA, 754 bp, Artificial Sequence
  chemically treated genomic DNA (Homo sapiens) CpG-island No: 27390
  misc_feature (6)..(6): n is either a, c, g or t
  misc_feature (22)..(22): n is either a, c, g or t
  misc_feature (24)..(24): n is either a, c, g or t
  misc_feature (31)..(31): n is either a, c, g or t
  misc_feature (35)..(35): n is either a, c, g or t
  misc_feature (82)..(82): n is either a, c, g or t
  misc_feature (100)..(100): n is either a, c, g or t
  misc_feature (104)..(104): n is either a, c, g or t
  misc_feature (113)..(113): n is either a, c, g or t
  misc_feature (128)..(128): n is either a, c, g or t
  misc_feature (130)..(130): n is either a, c, g or t
  misc_feature (132)..(132): n is either a, c, g or t
  misc_feature (189)..(189): n is either a, c, g or t
  misc_feature (194)..(194): n is either a, c, g or t
  misc_feature (198)..(199): n is either a, c, g or t
  misc_feature (233)..(233): n is either a, c, g or t
  misc_feature (290)..(290): n is either a, c, g or t
  misc_feature (358)..(359): n is either a, c, g or t
  misc_feature (377)..(377): n is either a, c, g or t
  misc_feature (386)..(386): n is either a, c, g or t
  misc_feature (467)..(467): n is either a, c, g or t
  misc_feature (678)..(678): n is either a, c, g or t
  misc_feature (685)..(685): n is either a, c, g or t
aaaacnaaccgaacgcccgccnanccgcgcnacgncgcgaaacgaaaacgaaaaacgacgaaacgcgaaaacgcgacgcgcnaaacgcgaaaaccccaanacgnaaacgccgncgaacgaacgccgcncncnaaaccgcgaaccgaacgcgcgacgcgacgtcgacgcgacgaccgacgacgaacgacnacccncgcnnccgacgcgcgcccgccgcgcgaacccgaacgcgncgacccgacgcgcgaaacgacgacgaaacgacgaaaaccgcgaaaaaacgcccgacnaacgaaacgacgccgcgcgaacgcgaacgccccgacgacgcgaaacgaaacgcgccgaacgcgcgcgnnccgccgaaaaaacgaaanaacgaaacnaaacgaaccgcgcgaaccgcgacgaccgcgacgaaccgcgcgacgcgcgaacgacgaccgcgacgacgcgaacgcgcgcgncccgaaaacgacgaaaacgaaacgcgacgccgaaacgcgaaaaacgcgaaaccgcgaacgaacgaacgcgcgcgaaaaaacgaacgcgacgacgcgaaaaaaaacgcgaaaaaccgcgcgcgcgaaacgaaaaacgaaacgcgaaaacgaaaaaacgaaccgcgccgcgaaaacgaaaaccgcgaaaccgaacgaacgcgcgcccccgccnccgcgcnacgcgaaccgcgcgcgaaaaacgcgaccgaaaacgacgaccccccccgccccccgcgaccgaaaacgac

SEQ ID NO: 27391 - DNA, 754 bp, Artificial Sequence
  chemically treated genomic DNA (Homo sapiens) CpG-island No: 27391
  misc_feature (6)..(6): n is either a, c, g or t
  misc_feature (22)..(22): n is either a, c, g or t
  misc_feature (24)..(24): n is either a, c, g or t
  misc_feature (31)..(31): n is either a, c, g or t
  misc_feature (35)..(35): n is either a, c, g or t
  misc_feature (82)..(82): n is either a, c, g or t
  misc_feature (100)..(100): n is either a, c, g or t
  misc_feature (104)..(104): n is either a, c, g or t
  misc_feature (113)..(113): n is either a, c, g or t
  misc_feature (128)..(128): n is either a, c, g or t
  misc_feature (130)..(130): n is either a, c, g or t
  misc_feature (132)..(132): n is either a, c, g or t
  misc_feature (189)..(189): n is either a, c, g or t
  misc_feature (194)..(194): n is either a, c, g or t
  misc_feature (198)..(199): n is either a, c, g or t
  misc_feature (233)..(233): n is either a, c, g or t
  misc_feature (290)..(290): n is either a, c, g or t
  misc_feature (358)..(359): n is either a, c, g or t
  misc_feature (377)..(377): n is either a, c, g or t
  misc_feature (386)..(386): n is either a, c, g or t
  misc_feature (467)..(467): n is either a, c, g or t
  misc_feature (678)..(678): n is either a, c, g or t
  misc_feature (685)..(685): n is either a, c, g or t
ggggtnggtcgggcgttcgttngntcgcgtngcgncgcgggacgggggcgaggggcggcggggcgcgggggcgcggcgcgtngggcgcgggggttttagngcgngggcgtcgncgagcgggcgtcgtntntngggtcgcgggtcgggcgcgcggcgcggcgtcggcgcggcggtcggcggcgggcggtngtttncgtnntcggcgcgcgttcgtcgcgcgggttcgagcgcgncggttcggcgcgcggggcggcggcggagcggcgagggtcgcggaggggcgttcggtnggcggggcggcgtcgcgcgggcgcgggcgtttcggcggcgcggggcggggcgcgtcgggcgcgcgcgnntcgtcgggggggcggggnggcggggtngggcgagtcgcgcgggtcgcggcggtcgcggcgggtcgcgcggcgcgcgggcggcggtcgcggcggcgcgggcgcgcgcgnttcgggggcggcgggggcggggcgcggcgtcgaggcgcggggggcgcggggtcgcgggcgggcgggcgcgcgcgggggggcgggcgcggcggcgcgggggggggcgcggggggtcgcgcgcgcggggcggggggcggggcgcgggggcgggggggcgggtcgcgtcgcgggggcgggggtcgcggggtcgggcgggcgcgcgttttcgttntcgcgtngcgcgggtcgcgcgcggggggcgcggtcgggggcggcggtttttttcgtttttcgcggtcgggggcggt

SEQ ID NO: 27392 - DNA, 754 bp, Artificial Sequence
  chemically treated genomic DNA (Homo sapiens) CpG-island No: 27392
  misc_feature (70)..(70): n is either a, c, g or t
  misc_feature (77)..(77): n is either a, c, g or t
  misc_feature (288)..(288): n is either a, c, g or t
  misc_feature (369)..(369): n is either a, c, g or t
  misc_feature (378)..(378): n is either a, c, g or t
  misc_feature (396)..(397): n is either a, c, g or t
  misc_feature (465)..(465): n is either a, c, g or t
  misc_feature (522)..(522): n is either a, c, g or t
  misc_feature (556)..(557): n is either a, c, g or t
  misc_feature (561)..(561): n is either a, c, g or t
  misc_feature (566)..(566): n is either a, c, g or t
  misc_feature (623)..(623): n is either a, c, g or t
  misc_feature (625)..(625): n is either a, c, g or t
  misc_feature (627)..(627): n is either a, c, g or t
  misc_feature (642)..(642): n is either a, c, g or t
  misc_feature (651)..(651): n is either a, c, g or t
  misc_feature (655)..(655): n is either a, c, g or t
  misc_feature (673)..(673): n is either a, c, g or t
  misc_feature (720)..(720): n is either a, c, g or t
  misc_feature (724)..(724): n is either a, c, g or t
  misc_feature (731)..(731): n is either a, c, g or t
  misc_feature (733)..(733): n is either a, c, g or t
  misc_feature (749)..(749): n is either a, c, g or t
accgcccccgaccgcgaaaaacgaaaaaaaccgccgcccccgaccgcgccccccgcgcgcgacccgcgcnacgcganaacgaaaacgcgcgcccgcccgaccccgcgacccccgcccccgcgacgcgacccgcccccccgcccccgcgccccgccccccgccccgcgcgcgcgaccccccgcgcccccccccgcgccgccgcgcccgcccccccgcgcgcgcccgcccgcccgcgaccccgcgccccccgcgcctcgacgccgcgccccgcccccgccgcccccgaancgcgcgcgcccgcgccgccgcgaccgccgcccgcgcgccgcgcgacccgccgcgaccgccgcgacccgcgcgactcgcccnaccccgccnccccgcccccccgacganncgcgcgcgcccgacgcgccccgccccgcgccgccgaaacgcccgcgcccgcgcgacgccgccccgccnaccgaacgcccctccgcgaccctcgccgctccgccgccgccccgcgcgccgaaccgncgcgctcgaacccgcgcgacgaacgcgcgccgannacgnaaacnaccgcccgccgccgaccgccgcgccgacgccgcgccgcgcgcccgacccgcgacccnananacgacgcccgctcgncgacgcccncgcnctaaaacccccgcgcccnacgcgccgcgcccccgcgccccgccgcccctcgcccccgtcccgcgncgcnacgcgancnaacgaacgcccgaccnacccc

SEQ ID NO: 27393 - DNA, 691 bp, Artificial Sequence
  chemically treated genomic DNA (Homo sapiens) CpG-island No: 27393
  misc_feature (62)..(62): n is either a, c, g or t
  misc_feature (65)..(65): n is either a, c, g or t
  misc_feature (91)..(91): n is either a, c, g or t
  misc_feature (145)..(145): n is either a, c, g or t
  misc_feature (323)..(323): n is either a, c, g or t
  misc_feature (376)..(376): n is either a, c, g or t
  misc_feature (378)..(378): n is either a, c, g or t
  misc_feature (381)..(381): n is either a, c, g or t
  misc_feature (388)..(388): n is either a, c, g or t
  misc_feature (397)..(399): n is either a, c, g or t
  misc_feature (408)..(408): n is either a, c, g or t
  misc_feature (444)..(444): n is either a, c, g or t
  misc_feature (463)..(463): n is either a, c, g or t
  misc_feature (513)..(513): n is either a, c, g or t
  misc_feature (515)..(515): n is either a, c, g or t
  misc_feature (521)..(521): n is either a, c, g or t
  misc_feature (557)..(557): n is either a, c, g or t
  misc_feature (562)..(562): n is either a, c, g or t
  misc_feature (583)..(583): n is either a, c, g or t
  misc_feature (587)..(587): n is either a, c, g or t
  misc_feature (603)..(603): n is either a, c, g or t
  misc_feature (605)..(605): n is either a, c, g or t
  misc_feature (608)..(609): n is either a, c, g or t
  misc_feature (635)..(635): n is either a, c, g or t
  misc_feature (640)..(640): n is either a, c, g or t
  misc_feature (672)..(672): n is either a, c, g or t
  misc_feature (676)..(676): n is either a, c, g or t
gcgggcgcggcgggggttcggtcgttcgttcggcgtcggcggcgcggcggcgcgcggcgggnggntttcggcgcgggggcgtcggcgcgtncggtcgcgtcggttcggcgtcggtcgtcgcgcggtcgcgggcgcggggttcgtngcggggcgggcggttcggggggcggggcgttttcgcgtttcgttcgtcggtcgcgcggcgcgcgggcgggcggggtcgcgcgcgtcgcggcgcgtcgcgcgtcgcgtcggcgtcgcgcgcgcgcgcggcgcggcgttcgcggcgggcgcgcgggggcgcggtcgcgcgtcggtcggtntcgtcgcgcgggcggggcgcgggtcggtcgcggcgcgcgggcgcgtttcgggngnggngcgcgtncggcggggnnnggcgcggtnggcggtcgcgtcgcgcggcggttcgcggtttcggtngcgcgggcgtcgcggggtntttcggggcggcggcgcgcggcggcggtcgcgcgtcggatcgtcgcgttngnggcgtncggggcggcggcgtcgcggggcggcgcgcggttcgncgcgngggtcggggtcgcgttcgcgncgtncgcggggcggcgtttngncgnntttcgcgcgcggcgtcgacgcgcgtntcgtnggcgtcggttcgcgcgggcggggcggcgcggntcgncgcgcgcgcgggcgt

SEQ ID NO: 27394 - DNA, 691 bp, Artificial Sequence
  chemically treated genomic DNA (Homo sapiens) CpG-island No: 27394
  misc_feature (16)..(16): n is either a, c, g or t
  misc_feature (20)..(20): n is either a, c, g or t
  misc_feature (52)..(52): n is either a, c, g or t
  misc_feature (57)..(57): n is either a, c, g or t
  misc_feature (83)..(84): n is either a, c, g or t
  misc_feature (87)..(87): n is either a, c, g or t
  misc_feature (89)..(89): n is either a, c, g or t
  misc_feature (105)..(105): n is either a, c, g or t
  misc_feature (109)..(109): n is either a, c, g or t
  misc_feature (130)..(130): n is either a, c, g or t
  misc_feature (135)..(135): n is either a, c, g or t
  misc_feature (171)..(171): n is either a, c, g or t
  misc_feature (177)..(177): n is either a, c, g or t
  misc_feature (179)..(179): n is either a, c, g or t
  misc_feature (229)..(229): n is either a, c, g or t
  misc_feature (248)..(248): n is either a, c, g or t
  misc_feature (284)..(284): n is either a, c, g or t
  misc_feature (293)..(295): n is either a, c, g or t
  misc_feature (304)..(304): n is either a, c, g or t
  misc_feature (311)..(311): n is either a, c, g or t
  misc_feature (314)..(314): n is either a, c, g or t
  misc_feature (316)..(316): n is either a, c, g or t
  misc_feature (369)..(369): n is either a, c, g or t
  misc_feature (547)..(547): n is either a, c, g or t
  misc_feature (601)..(601): n is either a, c, g or t
  misc_feature (627)..(627): n is either a, c, g or t
  misc_feature (630)..(630): n is either a, c, g or t
acgcccgcgcgcgcgncganccgcgccgccccgcccgcgcgaaccgacgccnacganacgcgcgtcgacgccgcgcgcgaaanncgncnaaacgccgccccgcgnacgncgcgaacgcgaccccgacccncgcgncgaaccgcgcgccgccccgcgacgccgccgccccgnacgccncnaacgcgacgatccgacgcgcgaccgccgccgcgcgccgccgccccgaaanaccccgcgacgcccgcgcnaccgaaaccgcgaaccgccgcgcgacgcgaccgccnaccgcgccnnnccccgccgnacgcgcnccncncccgaaacgcgcccgcgcgccgcgaccgacccgcgccccgcccgcgcgacganaccgaccgacgcgcgaccgcgcccccgcgcgcccgccgcgaacgccgcgccgcgcgcgcgcgcgacgccgacgcgacgcgcgacgcgccgcgacgcgcgcgaccccgcccgcccgcgcgccgcgcgaccgacgaacgaaacgcgaaaacgccccgccccccgaaccgcccgccccgcnacgaaccccgcgcccgcgaccgcgcgacgaccgacgccgaaccgacgcgaccgnacgcgccgacgcccccgcgccgaaanccncccgccgcgcgccgccgcgccgccgacgccgaacgaacgaccgaacccccgccgcgcccgc

SEQ ID NO: 27395 - DNA, 691 bp, Artificial Sequence
  chemically treated genomic DNA (Homo sapiens) CpG-island No: 27395
  misc_feature (16)..(16): n is either a, c, g or t
  misc_feature (20)..(20): n is either a, c, g or t
  misc_feature (52)..(52): n is either a, c, g or t
  misc_feature (57)..(57): n is either a, c, g or t
  misc_feature (83)..(84): n is either a, c, g or t
  misc_feature (87)..(87): n is either a, c, g or t
  misc_feature (89)..(89): n is either a, c, g or t
  misc_feature (105)..(105): n is either a, c, g or t
  misc_feature (109)..(109): n is either a, c, g or t
  misc_feature (130)..(130): n is either a, c, g or t
  misc_feature (135)..(135): n is either a, c, g or t
  misc_feature (171)..(171): n is either a, c, g or t
  misc_feature (177)..(177): n is either a, c, g or t
  misc_feature (179)..(179): n is either a, c, g or t
  misc_feature (229)..(229): n is either a, c, g or t
  misc_feature (248)..(248): n is either a, c, g or t
  misc_feature (284)..(284): n is either a, c, g or t
  misc_feature (293)..(295): n is either a, c, g or t
  misc_feature (304)..(304): n is either a, c, g or t
  misc_feature (311)..(311): n is either a, c, g or t
  misc_feature (314)..(314): n is either a, c, g or t
  misc_feature (316)..(316): n is either a, c, g or t
  misc_feature (369)..(369): n is either a, c, g or t
  misc_feature (547)..(547): n is either a, c, g or t
  misc_feature (601)..(601): n is either a, c, g or t
  misc_feature (627)..(627): n is either a, c, g or t
  misc_feature (630)..(630): n is either a, c, g or t
gcgttcgcgcgcgcgncggntcgcgtcgtttcgttcgcgcgggtcggcgttngcggngcgcgcgtcggcgtcgcgcgcggggnncgntngggcgtcgtttcgcgngcgncgcgggcgcggtttcggtttncgcgncgggtcgcgcgtcgtttcgcggcgtcgtcgtttcgngcgttntnggcgcggcggttcggcgcgcggtcgtcgtcgcgcgtcgtcgtttcggggngtttcgcggcgttcgcgtngtcggggtcgcgggtcgtcgcgcggcgcggtcgttngtcgcgttnnntttcgtcgngcgcgtnttntnttcggggcgcgttcgcgcgtcgcggtcggttcgcgtttcgttcgcgcggcggngtcggtcggcgcgcggtcgcgttttcgcgcgttcgtcgcgggcgtcgcgtcgcgcgcgcgcgcggcgtcggcgcggcgcgcggcgcgtcgcggcgcgcgcggtttcgttcgttcgcgcgtcgcgcggtcggcgggcggggcgcgggggcgtttcgtttttcgggtcgttcgtttcgtngcgggtttcgcgttcgcggtcgcgcggcggtcggcgtcgggtcggcgcggtcgngcgcgtcggcgttttcgcgtcggggnttnttcgtcgcgcgtcgtcgcgtcgtcggcgtcgggcgggcggtcgggttttcgtcgcgttcgt

SEQ ID NO: 27396 - DNA, 691 bp, Artificial Sequence
  chemically treated genomic DNA (Homo sapiens) CpG-island No: 27396
  misc_feature (62)..(62): n is either a, c, g or t
  misc_feature (65)..(65): n is either a, c, g or t
  misc_feature (91)..(91): n is either a, c, g or t
  misc_feature (145)..(145): n is either a, c, g or t
  misc_feature (323)..(323): n is either a, c, g or t
  misc_feature (376)..(376): n is either a, c, g or t
  misc_feature (378)..(378): n is either a, c, g or t
  misc_feature (381)..(381): n is either a, c, g or t
  misc_feature (388)..(388): n is either a, c, g or t
  misc_feature (397)..(399): n is either a, c, g or t
  misc_feature (408)..(408): n is either a, c, g or t
  misc_feature (444)..(444): n is either a, c, g or t
  misc_feature (463)..(463): n is either a, c, g or t
  misc_feature (513)..(513): n is either a, c, g or t
  misc_feature (515)..(515): n is either a, c, g or t
  misc_feature (521)..(521): n is either a, c, g or t
  misc_feature (557)..(557): n is either a, c, g or t
  misc_feature (562)..(562): n is either a, c, g or t
  misc_feature (583)..(583): n is either a, c, g or t
  misc_feature (587)..(587): n is either a, c, g or t
  misc_feature (603)..(603): n is either a, c, g or t
  misc_feature (605)..(605): n is either a, c, g or t
  misc_feature (608)..(609): n is either a, c, g or t
  misc_feature (635)..(635): n is either a, c, g or t
  misc_feature (640)..(640): n is either a, c, g or t
  misc_feature (672)..(672): n is either a, c, g or t
  misc_feature (676)..(676): n is either a, c, g or t
acgaacgcgacgaaaacccgaccgcccgcccgacgccgacgacgcgacgacgcgcgacgaanaanccccgacgcgaaaacgccgacgcgcncgaccgcgccgacccgacgccgaccgccgcgcgaccgcgaacgcgaaacccgcnacgaaacgaacgacccgaaaaacgaaacgcccccgcgccccgcccgccgaccgcgcgacgcgcgaacgaacgaaaccgcgcgcgccgcgacgcgccgcgcgccgcgccgacgccgcgcgcgcgcgcgacgcgacgcccgcgacgaacgcgcgaaaacgcgaccgcgcgccgaccgacnccgccgcgcgaacgaaacgcgaaccgaccgcgacgcgcgaacgcgccccgaananaanacgcgcncgacgaaannnaacgcgacnaacgaccgcgccgcgcgacgacccgcgaccccgacnacgcgaacgccgcgaaacnccccgaaacgacgacgcgcgacgacgaccgcgcgccgaaccgccgcgccnanaacgcncgaaacgacgacgccgcgaaacgacgcgcgacccgncgcgnaaaccgaaaccgcgcccgcgncgcncgcgaaacgacgcccnancgnnccccgcgcgcgacgccgacgcgcgcnccgcnaacgccgacccgcgcgaacgaaacgacgcganccgncgcgcgcgcgaacgc

SEQ ID NO: 27397 - DNA, 761 bp, Artificial Sequence
  chemically treated genomic DNA (Homo sapiens) CpG-island No: 27397
  misc_feature (38)..(38): n is either a, c, g or t
  misc_feature (40)..(40): n is either a, c, g or t
  misc_feature (78)..(78): n is either a, c, g or t
  misc_feature (121)..(121): n is either a, c, g or t
  misc_feature (127)..(127): n is either a, c, g or t
  misc_feature (133)..(133): n is either a, c, g or t
  misc_feature (182)..(182): n is either a, c, g or t
  misc_feature (213)..(213): n is either a, c, g or t
  misc_feature (266)..(266): n is either a, c, g or t
  misc_feature (333)..(333): n is either a, c, g or t
  misc_feature (343)..(343): n is either a, c, g or t
  misc_feature (360)..(360): n is either a, c, g or t
  misc_feature (362)..(362): n is either a, c, g or t
  misc_feature (374)..(374): n is either a, c, g or t
  misc_feature (389)..(389): n is either a, c, g or t
  misc_feature (434)..(437): n is either a, c, g or t
  misc_feature (457)..(457): n is either a, c, g or t
  misc_feature (492)..(492): n is either a, c, g or t
  misc_feature (496)..(496): n is either a, c, g or t
  misc_feature (505)..(505): n is either a, c, g or t
  misc_feature (512)..(512): n is either a, c, g or t
  misc_feature (521)..(521): n is either a, c, g or t
  misc_feature (523)..(523): n is either a, c, g or t
  misc_feature (527)..(527): n is either a, c, g or t
  misc_feature (530)..(530): n is either a, c, g or t
  misc_feature (566)..(566): n is either a, c, g or t
  misc_feature (585)..(585): n is either a, c, g or t
  misc_feature (592)..(592): n is either a, c, g or t
  misc_feature (605)..(605): n is either a, c, g or t
  misc_feature (618)..(618): n is either a, c, g or t
  misc_feature (692)..(692): n is either a, c, g or t
  misc_feature (706)..(706): n is either a, c, g or t
  misc_feature (710)..(710): n is either a, c, g or t
  misc_feature (714)..(715): n is either a, c, g or t
  misc_feature (740)..(741): n is either a, c, g or t
  misc_feature (747)..(747): n is either a, c, g or t
  misc_feature (759)..(759): n is either a, c, g or t
gcggtcggggcgcggggggggggggggggcggtcgcgntngcgcgcgcggcgcgcgcgggggcggggggcggtcgcgngcggggggggcgtcgcggcggtcggcggcggcgggggcggggncggttncgtcgntcggcgcggcggtcgcgcgcgcgtcgtcgggcgggtcggcgcgggggtnggcgcgggggcgcgttcgggcggttcggttncgcggttcggggggggcgggcgcgcgcgcggggcgggggggcgcggggtcgtngcggcgcgcggtcggtcgcgggggggggggggcggggcgtcggggtcgggcggcgcgtttcgggggngggcgcgggngcggcgggggcggcggngngggggggggggncgggtcgcggtcgtngcgcgggagggagaaaagagggaaacggaatagaagagatcgcgnnnncggcgggggggcgggcggtngcgcggcgcggcggggcgcgcgcgtttcgcgggtnggtncgcgggggnggggggnggcggggtngnggtncgntttcgcggcggtttcggcgcgcggtcgtcgggcgtngcggttcggggcggggcgncggcggncgggcgggcgggngggggcggcgggnggggcggtcgcgggcgtcgcgggcgtcgcgcgcgcgtcgcgatacggcggcggacgtcggcgtcggtcggcgtngcgtcgggcgggancggncggnnggggcgcggtcggggcggcgcgcgnngggcgncggcgcgcgcgngg

SEQ ID NO: 27398 - DNA, 761 bp, Artificial Sequence
  chemically treated genomic DNA (Homo sapiens) CpG-island No: 27398
  misc_feature (3)..(3): n is either a, c, g or t
  misc_feature (15)..(15): n is either a, c, g or t
  misc_feature (21)..(22): n is either a, c, g or t
  misc_feature (47)..(48): n is either a, c, g or t
  misc_feature (52)..(52): n is either a, c, g or t
  misc_feature (56)..(56): n is either a, c, g or t
  misc_feature (70)..(70): n is either a, c, g or t
  misc_feature (144)..(144): n is either a, c, g or t
  misc_feature (157)..(157): n is either a, c, g or t
  misc_feature (170)..(170): n is either a, c, g or t
  misc_feature (177)..(177): n is either a, c, g or t
  misc_feature (196)..(196): n is either a, c, g or t
  misc_feature (232)..(232): n is either a, c, g or t
  misc_feature (235)..(235): n is either a, c, g or t
  misc_feature (239)..(239): n is either a, c, g or t
  misc_feature (241)..(241): n is either a, c, g or t
  misc_feature (250)..(250): n is either a, c, g or t
  misc_feature (257)..(257): n is either a, c, g or t
  misc_feature (266)..(266): n is either a, c, g or t
  misc_feature (270)..(270): n is either a, c, g or t
  misc_feature (305)..(305): n is either a, c, g or t
  misc_feature (325)..(328): n is either a, c, g or t
  misc_feature (373)..(373): n is either a, c, g or t
  misc_feature (388)..(388): n is either a, c, g or t
  misc_feature (400)..(400): n is either a, c, g or t
  misc_feature (402)..(402): n is either a, c, g or t
  misc_feature (419)..(419): n is either a, c, g or t
  misc_feature (429)..(429): n is either a, c, g or t
  misc_feature (496)..(496): n is either a, c, g or t
  misc_feature (549)..(549): n is either a, c, g or t
  misc_feature (580)..(580): n is either a, c, g or t
  misc_feature (629)..(629): n is either a, c, g or t
  misc_feature (635)..(635): n is either a, c, g or t
  misc_feature (641)..(641): n is either a, c, g or t
  misc_feature (684)..(684): n is either a, c, g or t
  misc_feature (722)..(722): n is either a, c, g or t
  misc_feature (724)..(724): n is either a, c, g or t
ccncgcgcgcgccgncgcccnncgcgcgccgccccgaccgcgccccnnccgnccgntcccgcccgacgcnacgccgaccgacgccgacgtccgccgccgtatcgcgacgcgcgcgcgacgcccgcgacgcccgcgaccgccccncccgccgcccccncccgcccgcccgnccgccgncgccccgccccgaaccgcnacgcccgacgaccgcgcgccgaaaccgccgcgaaancgnaccncnaccccgccnccccccncccccgcgnaccnacccgcgaaacgcgcgcgccccgccgcgccgcgcnaccgcccgcccccccgccgnnnncgcgatctcttctattccgtttccctcttttctccctcccgcgcnacgaccgcgacccgncccccccccccncnccgccgcccccgccgcncccgcgcccncccccgaaacgcgccgcccgaccccgacgccccgcccccccccccccgcgaccgaccgcgcgccgcnacgaccccgcgcccccccgccccgcgcgcgcgcccgccccccccgaaccgcgnaaccgaaccgcccgaacgcgcccccgcgccnacccccgcgccgacccgcccgacgacgcgcgcgcgaccgccgcgccgancgacgnaaccgnccccgcccccgccgccgccgaccgccgcgacgccccccccgcncgcgaccgccccccgcccccgcgcgcgccgcgcgcgcnancgcgaccgccccccccccccccccgcgccccgaccgc

SEQ ID NO: 27399 - DNA, 761 bp, Artificial Sequence
  chemically treated genomic DNA (Homo sapiens) CpG-island No: 27399
  misc_feature (3)..(3): n is either a, c, g or t
  misc_feature (15)..(15): n is either a, c, g or t
  misc_feature (21)..(22): n is either a, c, g or t
  misc_feature (47)..(48): n is either a, c, g or t
  misc_feature (52)..(52): n is either a, c, g or t
  misc_feature (56)..(56): n is either a, c, g or t
  misc_feature (70)..(70): n is either a, c, g or t
  misc_feature (144)..(144): n is either a, c, g or t
  misc_feature (157)..(157): n is either a, c, g or t
  misc_feature (170)..(170): n is either a, c, g or t
  misc_feature (177)..(177): n is either a, c, g or t
  misc_feature (196)..(196): n is either a, c, g or t
  misc_feature (232)..(232): n is either a, c, g or t
  misc_feature (235)..(235): n is either a, c, g or t
  misc_feature (239)..(239): n is either a, c, g or t
  misc_feature (241)..(241): n is either a, c, g or t
  misc_feature (250)..(250): n is either a, c, g or t
  misc_feature (257)..(257): n is either a, c, g or t
  misc_feature (266)..(266): n is either a, c, g or t
  misc_feature (270)..(270): n is either a, c, g or t
  misc_feature (305)..(305): n is either a, c, g or t
  misc_feature (325)..(328): n is either a, c, g or t
  misc_feature (373)..(373): n is either a, c, g or t
  misc_feature (388)..(388): n is either a, c, g or t
  misc_feature (400)..(400): n is either a, c, g or t
  misc_feature (402)..(402): n is either a, c, g or t
  misc_feature (419)..(419): n is either a, c, g or t
  misc_feature (429)..(429): n is either a, c, g or t
  misc_feature (496)..(496): n is either a, c, g or t
  misc_feature (549)..(549): n is either a, c, g or t
  misc_feature (580)..(580): n is either a, c, g or t
  misc_feature (629)..(629): n is either a, c, g or t
  misc_feature (635)..(635): n is either a, c, g or t
  misc_feature (641)..(641): n is either a, c, g or t
  misc_feature (684)..(684): n is either a, c, g or t
  misc_feature (722)..(722): n is either a, c, g or t
  misc_feature (724)..(724): n is either a, c, g or t
ttncgcgcgcgtcgncgtttnncgcgcgtcgtttcggtcgcgttttnntcgntcgntttcgttcggcgtngcgtcggtcggcgtcggcgttcgtcgtcgtgtcgcggcgcgcgcgcggcgttcgcggcgttcgcggtcgttttnttcgtcgtttttnttcgttcgttcgntcgtcgncgtttcgtttcgggtcgtngcgttcggcggtcgcgcgtcggggtcgtcgcggggncgngttntngtttcgttnttttttnttttcgcgngttngttcgcggggcgcgcgcgtttcgtcgcgtcgcgtngtcgttcgttttttcgtcgnnnncgcggttttttttgtttcgttttttttttttttttttttcgcgtngcggtcgcggttcgntttttttttttntntcgtcgttttcgtcgtnttcgcgtttnttttcggggcgcgtcgttcggtttcggcgtttcgttttttttttttcgcggtcggtcgcgcgtcgtngcggtttcgcgttttttcgtttcgcgcgcgcgttcgtttttttcgggtcgcgnggtcgggtcgttcgggcgcgttttcgcgttngttttcgcgtcggttcgttcggcggcgcgcgcgcggtcgtcgcgtcggncggcgnggtcgntttcgttttcgtcgtcgtcggtcgtcgcggcgtttttttcgtncgcggtcgtttttcgttttcgcgcgcgtcgcgcgcgtngncgcggtcgtttttttttttttttcgcgtttcggtcgt

SEQ ID NO: 27400 - DNA, 761 bp, Artificial Sequence
  chemically treated genomic DNA (Homo sapiens) CpG-island No: 27400
  misc_feature (38)..(38): n is either a, c, g or t
  misc_feature (40)..(40): n is either a, c, g or t
  misc_feature (78)..(78): n is either a, c, g or t
  misc_feature (121)..(121): n is either a, c, g or t
  misc_feature (127)..(127): n is either a, c, g or t
  misc_feature (133)..(133): n is either a, c, g or t
  misc_feature (182)..(182): n is either a, c, g or t
  misc_feature (213)..(213): n is either a, c, g or t
  misc_feature (266)..(266): n is either a, c, g or t
  misc_feature (333)..(333): n is either a, c, g or t
  misc_feature (343)..(343): n is either a, c, g or t
  misc_feature (360)..(360): n is either a, c, g or t
  misc_feature (362)..(362): n is either a, c, g or t
  misc_feature (374)..(374): n is either a, c, g or t
  misc_feature (389)..(389): n is either a, c, g or t
  misc_feature (434)..(437): n is either a, c, g or t
  misc_feature (457)..(457): n is either a, c, g or t
  misc_feature (492)..(492): n is either a, c, g or t
  misc_feature (496)..(496): n is either a, c, g or t
  misc_feature (505)..(505): n is either a, c, g or t
  misc_feature (512)..(512): n is either a, c, g or t
  misc_feature (521)..(521): n is either a, c, g or t
  misc_feature (523)..(523): n is either a, c, g or t
  misc_feature (527)..(527): n is either a, c, g or t
  misc_feature (530)..(530): n is either a, c, g or t
  misc_feature (566)..(566): n is either a, c, g or t
  misc_feature (585)..(585): n is either a, c, g or t
  misc_feature (592)..(592): n is either a, c, g or t
  misc_feature (605)..(605): n is either a, c, g or t
  misc_feature (618)..(618): n is either a, c, g or t
  misc_feature (692)..(692): n is either a, c, g or t
  misc_feature (706)..(706): n is either a, c, g or t
  misc_feature (710)..(710): n is either a, c, g or t
  misc_feature (714)..(715): n is either a, c, g or t
  misc_feature (740)..(741): n is either a, c, g or t
  misc_feature (747)..(747): n is either a, c, g or t
  misc_feature (759)..(759): n is either a, c, g or t
acgaccgaaacgcgaaaaaaaaaaaaaaacgaccgcgncnacgcgcgcgacgcgcgcgaaaacgaaaaacgaccgcgnacgaaaaaaacgccgcgacgaccgacgacgacgaaaacgaaancgaccncgccgnccgacgcgacgaccgcgcgcgcgccgccgaacgaaccgacgcgaaaacnaacgcgaaaacgcgcccgaacgacccgaccncgcgacccgaaaaaaacgaacgcgcgcgcgaaacgaaaaaacgcgaaaccgcnacgacgcgcgaccgaccgcgaaaaaaaaaaaacgaaacgccgaaaccgaacgacgcgccccgaaaanaaacgcgaanacgacgaaaacgacgananaaaaaaaaaaancgaaccgcgaccgcnacgcgaaaaaaaaaaaaaaaaaaaacgaaacaaaaaaaaccgcgnnnncgacgaaaaaacgaacgacnacgcgacgcgacgaaacgcgcgcgccccgcgaacnaacncgcgaaaanaaaaaanaacgaaacnanaacncgnccccgcgacgaccccgacgcgcgaccgccgaacgcnacgacccgaaacgaaacgncgacgancgaacgaacgaanaaaaacgacgaanaaaacgaccgcgaacgccgcgaacgccgcgcgcgcgccgcgacacgacgacgaacgccgacgccgaccgacgcnacgccgaacgaaancgancgannaaaacgcgaccgaaacgacgcgcgnnaaacgncgacgcgcgcgnaa

SEQ ID NO: 27401 - DNA, 691 bp, Artificial Sequence
  chemically treated genomic DNA (Homo sapiens) CpG-island No: 27401
  misc_feature (44)..(44): n is either a, c, g or t
  misc_feature (90)..(90): n is either a, c, g or t
  misc_feature (145)..(146): n is either a, c, g or t
  misc_feature (341)..(341): n is either a, c, g or t
  misc_feature (368)..(368): n is either a, c, g or t
  misc_feature (393)..(393): n is either a, c, g or t
  misc_feature (428)..(428): n is either a, c, g or t
  misc_feature (538)..(538): n is either a, c, g or t
  misc_feature (578)..(578): n is either a, c, g or t
  misc_feature (653)..(653): n is either a, c, g or t
  misc_feature (667)..(667): n is either a, c, g or t
gggacgcgggggcggcgtcggggcgggggggggggggcgggggnggcgggcggggcggtcggggggggggggggcgcgggggggcgcgtngttcggcgcgcgcgcggcggtcgcgcgggcgggggcggggtcggggttcgtcgtnnggttcgcgtttcgcgcgcggcgggggggggtcgttcgcgggggggcgggcggcggggcggcggcggttcgcgcggcggtcgcgcgggcgggcgggggggcggtcgcggtcggttcggcgtcggcggcgcggggggcgtcgcgggcgggcgttcggcggggcgggcggggggggcggcgcgcgcggttcgtcggtngggggcgcggcgtcgggaggcggcgtnggggtcgcgttcgcgcggggggggngcgcgcgggtcgcgggcgggggcgcgggcggcgtncgttcggttcgcgtcggtcggggttcgcgcgggcgcggcgcggggcgcgcgcggcgcggtcgcgcgcggcggcggcgggcgcgcggcggcgcggggcgcgggcggcgcgncggcggcggtcgggtcgtcgtcgtcgtcgcgcgggcgcgngcggcgcgcggggcgggcgcggggcgcgcggcgcggcgggcgcggcgggcgcgcgcgcggcgcgggtttcggttngggcggcgggcggncgcgcggcgtcgcgcgggggcggg

SEQ ID NO: 27402 - DNA, 691 bp, Artificial Sequence
  chemically treated genomic DNA (Homo sapiens) CpG-island No: 27402
  misc_feature (25)..(25): n is either a, c, g or t
  misc_feature (39)..(39): n is either a, c, g or t
  misc_feature (114)..(114): n is either a, c, g or t
  misc_feature (154)..(154): n is either a, c, g or t
  misc_feature (264)..(264): n is either a, c, g or t
  misc_feature (299)..(299): n is either a, c, g or t
  misc_feature (324)..(324): n is either a, c, g or t
  misc_feature (351)..(351): n is either a, c, g or t
  misc_feature (546)..(547): n is either a, c, g or t
  misc_feature (602)..(602): n is either a, c, g or t
  misc_feature (648)..(648): n is either a, c, g or t
cccgcccccgcgcgacgccgcgcgnccgcccgccgcccnaaccgaaacccgcgccgcgcgcgcgcccgccgcgcccgccgcgccgcgcgccccgcgcccgccccgcgcgccgcncgcgcccgcgcgacgacgacgacgacccgaccgccgccgncgcgccgcccgcgccccgcgccgccgcgcgcccgccgccgccgcgcgcgaccgcgccgcgcgcgccccgcgccgcgcccgcgcgaaccccgaccgacgcgaaccgaacgnacgccgcccgcgcccccgcccgcgacccgcgcgcnccccccccgcgcgaacgcgaccccnacgccgcctcccgacgccgcgcccccnaccgacgaaccgcgcgcgccgccccccccgcccgccccgccgaacgcccgcccgcgacgccccccgcgccgccgacgccgaaccgaccgcgaccgcccccccgcccgcccgcgcgaccgccgcgcgaaccgccgccgccccgccgcccgcccccccgcgaacgacccccccccgccgcgcgcgaaacgcgaaccnnacgacgaaccccgaccccgcccccgcccgcgcgaccgccgcgcgcgcgccgaacnacgcgcccccccgcgccccccccccccccgaccgccccgcccgccncccccgcccccccccccccgccccgacgccgcccccgcgtccc

SEQ ID NO: 27403 - DNA, 691 bp, Artificial Sequence
  chemically treated genomic DNA (Homo sapiens) CpG-island No: 27403
  misc_feature (25)..(25): n is either a, c, g or t
  misc_feature (39)..(39): n is either a, c, g or t
  misc_feature (114)..(114): n is either a, c, g or t
  misc_feature (154)..(154): n is either a, c, g or t
  misc_feature (264)..(264): n is either a, c, g or t
  misc_feature (299)..(299): n is either a, c, g or t
  misc_feature (324)..(324): n is either a, c, g or t
  misc_feature (351)..(351): n is either a, c, g or t
  misc_feature (546)..(547): n is either a, c, g or t
  misc_feature (602)..(602): n is either a, c, g or t
  misc_feature (648)..(648): n is either a, c, g or t
ttcgttttcgcgcggcgtcgcgcgntcgttcgtcgtttnggtcggggttcgcgtcgcgcgcgcgttcgtcgcgttcgtcgcgtcgcgcgtttcgcgttcgtttcgcgcgtcgtncgcgttcgcgcggcggcggcggcggttcggtcgtcgtcgncgcgtcgttcgcgtttcgcgtcgtcgcgcgttcgtcgtcgtcgcgcgcggtcgcgtcgcgcgcgtttcgcgtcgcgttcgcgcgggtttcggtcggcgcgggtcgggcgngcgtcgttcgcgttttcgttcgcggttcgcgcgtntttttttcgcgcgggcgcggttttngcgtcgtttttcggcgtcgcgtttttngtcggcgggtcgcgcgcgtcgtttttttcgttcgtttcgtcgggcgttcgttcgcggcgtttttcgcgtcgtcggcgtcgggtcggtcgcggtcgttttttcgttcgttcgcgcggtcgtcgcgcgggtcgtcgtcgtttcgtcgttcgttttttcgcgggcggttttttttcgtcgcgcgcggggcgcgggttnngcggcgggtttcggtttcgttttcgttcgcgcggtcgtcgcgcgcgcgtcgggtngcgcgttttttcgcgtttttttttttttcggtcgtttcgttcgttnttttcgttttttttttttcgtttcggcgtcgttttcgcgtttt

SEQ ID NO: 27404 - DNA, 691 bp, Artificial Sequence
  chemically treated genomic DNA (Homo sapiens) CpG-island No: 27404
  misc_feature (44)..(44): n is either a, c, g or t
  misc_feature (90)..(90): n is either a, c, g or t
  misc_feature (145)..(146): n is either a, c, g or t
  misc_feature (341)..(341): n is either a, c, g or t
  misc_feature (368)..(368): n is either a, c, g or t
  misc_feature (393)..(393): n is either a, c, g or t
  misc_feature (428)..(428): n is either a, c, g or t
  misc_feature (538)..(538): n is either a, c, g or t
  misc_feature (578)..(578): n is either a, c, g or t
  misc_feature (653)..(653): n is either a, c, g or t
  misc_feature (667)..(667): n is either a, c, g or t
aaaacgcgaaaacgacgccgaaacgaaaaaaaaaaaacgaaaanaacgaacgaaacgaccgaaaaaaaaaaaaacgcgaaaaaacgcgcnacccgacgcgcgcgcgacgaccgcgcgaacgaaaacgaaaccgaaacccgccgcnnaacccgcgccccgcgcgcgacgaaaaaaaaccgcccgcgaaaaaacgaacgacgaaacgacgacgacccgcgcgacgaccgcgcgaacgaacgaaaaaacgaccgcgaccgacccgacgccgacgacgcgaaaaacgccgcgaacgaacgcccgacgaaacgaacgaaaaaaacgacgcgcgcgacccgccgacnaaaaacgcgacgccgaaaaacgacgcnaaaaccgcgcccgcgcgaaaaaaanacgcgcgaaccgcgaacgaaaacgcgaacgacgcncgcccgacccgcgccgaccgaaacccgcgcgaacgcgacgcgaaacgcgcgcgacgcgaccgcgcgcgacgacgacgaacgcgcgacgacgcgaaacgcgaacgacgcgncgacgacgaccgaaccgccgccgccgccgcgcgaacgcgnacgacgcgcgaaacgaacgcgaaacgcgcgacgcgacgaacgcgacgaacgcgcgcgcgacgcgaaccccgaccnaaacgacgaacgancgcgcgacgccgcgcgaaaacgaa

SEQ ID NO: 27405 - DNA, 706 bp, Artificial Sequence
  chemically treated genomic DNA (Homo sapiens) CpG-island No: 27405
  misc_feature (52)..(52): n is either a, c, g or t
  misc_feature (348)..(348): n is either a, c, g or t
  misc_feature (384)..(384): n is either a, c, g or t
  misc_feature (400)..(400): n is either a, c, g or t
  misc_feature (435)..(435): n is either a, c, g or t
  misc_feature (452)..(452): n is either a, c, g or t
  misc_feature (573)..(573): n is either a, c, g or t
  misc_feature (645)..(645): n is either a, c, g or t
  misc_feature (687)..(687): n is either a, c, g or t
tcgtcgcggggggggaggggtaagatttcgcgggggtagcgagggtagtaanacgatagtagtagagtcggtatcgggcgaggacgagaggagcgagagtacgacgcgcgtcgtaaggagtagcgcgacgacgcggtcggtaggattacgcggtaggatagattcgtacgcggacgcgcgtagagcgcgtttcgacggtaaaaaggagcgagcgagcgaggataggagatacggcggagtcgtcgtcgcgaggatcgcgagagacgcgagtagtagcgatatacgtaatcgtattaattagaggaggtaagtttaggagagataacgcgagtacggggagattcgtantataataggatagtacgcgcgagcgcgtaggcgagncgtcgagtacgagggnagagagtaaagttagatacggaggagttttagcgngaaagagagcgcgtatnacgttcgcggcgatatacgggcgataggcgatacggatcgattagcgcgagcgcgaagacgcgaacgcgtcgcgaaatcgtcgcgtaaaatcgtcgcgaatattcgtagacgaatcgttanagaagagacgcgcggcgcgtatacgacgtaagatagagacgatttagcgagcgtataatacgagggtaagtngtatagtagcgttagagagcgaagggacgggcgggtatcgangacggcgatacgattaagt

SEQ ID NO: 27406 - DNA, 706 bp, Artificial Sequence
  chemically treated genomic DNA (Homo sapiens) CpG-island No: 27406
  misc_feature (20)..(20): n is either a, c, g or t
  misc_feature (62)..(62): n is either a, c, g or t
  misc_feature (134)..(134): n is either a, c, g or t
  misc_feature (255)..(255): n is either a, c, g or t
  misc_feature (272)..(272): n is either a, c, g or t
  misc_feature (307)..(307): n is either a, c, g or t
  misc_feature (323)..(323): n is either a, c, g or t
  misc_feature (359)..(359): n is either a, c, g or t
  misc_feature (655)..(655): n is either a, c, g or t
acttaatcgtatcgccgtcntcgatacccgcccgtcccttcgctctctaacgctactatacnacttaccctcgtattatacgctcgctaaatcgtctctatcttacgtcgtatacgcgccgcgcgtctcttctntaacgattcgtctacgaatattcgcgacgattttacgcgacgatttcgcgacgcgttcgcgtcttcgcgctcgcgctaatcgatccgtatcgcctatcgcccgtatatcgccgcgaacgtnatacgcgctctctttcncgctaaaactcctccgtatctaactttactctctnccctcgtactcgacgnctcgcctacgcgctcgcgcgtactatcctattatantacgaatctccccgtactcgcgttatctctcctaaacttacctcctctaattaatacgattacgtatatcgctactactcgcgtctctcgcgatcctcgcgacgacgactccgccgtatctcctatcctcgctcgctcgctcctttttaccgtcgaaacgcgctctacgcgcgtccgcgtacgaatctatcctaccgcgtaatcctaccgaccgcgtcgtcgcgctactccttacgacgcgcgtcgtactctcgctcctctcgtcctcgcccgataccgactctactactatcgtnttactaccctcgctacccccgcgaaatcttacccctccccccccgcgacga

SEQ ID NO: 27407 - DNA, 706 bp, Artificial Sequence
  chemically treated genomic DNA (Homo sapiens) CpG-island No: 27407
  misc_feature (20)..(20): n is either a, c, g or t
  misc_feature (62)..(62): n is either a, c, g or t
  misc_feature (134)..(134): n is either a, c, g or t
  misc_feature (255)..(255): n is either a, c, g or t
  misc_feature (272)..(272): n is either a, c, g or t
  misc_feature (307)..(307): n is either a, c, g or t
  misc_feature (323)..(323): n is either a, c, g or t
  misc_feature (359)..(359): n is either a, c, g or t
  misc_feature (655)..(655): n is either a, c, g or t
gtttggtcgtgtcgtcgttntcggtgttcgttcgttttttcgttttttggcgttgttgtgtngtttgttttcgtgttgtgcgttcgttgggtcgtttttgttttgcgtcgtgtgcgcgtcgcgcgttttttttntggcggttcgtttgcgggtgttcgcggcggttttgcgcggcggtttcgcggcgcgttcgcgttttcgcgttcgcgttggtcggttcgtgtcgtttgtcgttcgtgtgtcgtcgcgggcgtngtgcgcgtttttttttncgttggggttttttcgtgtttggttttgttttttnttttcgtgttcggcgnttcgtttgcgcgttcgcgcgtgttgttttgttgtgntgcgggttttttcgtgttcgcgttgttttttttgggtttgttttttttggttggtgcggttgcgtgtgtcgttgttgttcgcgtttttcgcggttttcgcggcggcggtttcgtcgtgttttttgttttcgttcgttcgtttttttttgtcgtcggggcgcgttttgcgcgcgttcgcgtgcgggtttgttttgtcgcgtggttttgtcggtcgcgtcgtcgcgttgttttttgcggcgcgcgtcgtgttttcgtttttttcgttttcgttcggtgtcggttttgttgttgtcgtnttgttgttttcgttgttttcgcggggttttgttttttttttttcgcggcgg

SEQ ID NO: 27408 - DNA, 706 bp, Artificial Sequence
  chemically treated genomic DNA (Homo sapiens) CpG-island No: 27408
  misc_feature (52)..(52): n is either a, c, g or t
  misc_feature (348)..(348): n is either a, c, g or t
  misc_feature (384)..(384): n is either a, c, g or t
  misc_feature (400)..(400): n is either a, c, g or t
  misc_feature (435)..(435): n is either a, c, g or t
  misc_feature (452)..(452): n is either a, c, g or t
  misc_feature (573)..(573): n is either a, c, g or t
  misc_feature (645)..(645): n is either a, c, g or t
  misc_feature (687)..(687): n is either a, c, g or t
ccgccgcgaaaaaaaaaaaacaaaaccccgcgaaaacaacgaaaacaacaanacgacaacaacaaaaccgacaccgaacgaaaacgaaaaaaacgaaaacacgacgcgcgccgcaaaaaacaacgcgacgacgcgaccgacaaaaccacgcgacaaaacaaacccgcacgcgaacgcgcgcaaaacgcgccccgacgacaaaaaaaaacgaacgaacgaaaacaaaaaacacgacgaaaccgccgccgcgaaaaccgcgaaaaacgcgaacaacaacgacacacgcaaccgcaccaaccaaaaaaaacaaacccaaaaaaaacaacgcgaacacgaaaaaacccgcancacaacaaaacaacacgcgcgaacgcgcaaacgaancgccgaacacgaaaanaaaaaacaaaaccaaacacgaaaaaaccccaacgnaaaaaaaaacgcgcacnacgcccgcgacgacacacgaacgacaaacgacacgaaccgaccaacgcgaacgcgaaaacgcgaacgcgccgcgaaaccgccgcgcaaaaccgccgcgaacacccgcaaacgaaccgccanaaaaaaaacgcgcgacgcgcacacgacgcaaaacaaaaacgacccaacgaacgcacaacacgaaaacaaacnacacaacaacgccaaaaaacgaaaaaacgaacgaacaccganaacgacgacacgaccaaac

SEQ ID NO: 27409 - DNA, 663 bp, Artificial Sequence
  chemically treated genomic DNA (Homo sapiens) CpG-island No: 27409
cgagtcgacggcgagatataacgtagtaacgaattacgcgataattattatttataaaacgaatttttttttacgcgaatagacgtttaattttcgaattttaaatcgtttaatcgtacgaacgaaggggggcgagaaagaaggggagagtaataaatatatagaagattagtatcgcggaatcggagagagaaagggtagggataaaagagcgaaagcgagcggatataagtcgcgggcgagagagcgcgtaaaacgacggagtaaaggaagaagaaaagtagtatagtcgcgaaagagacgataggggtagaaacgtagatttttattcgtacggtagagtcgtagaggtataataatcgttcgcggattaatcgtaattagacgttttcgtcgatattatattataaagagcgtataataataaaaacgaatagattcggatagacgcgcggagcgtatttataatataagttattacgcgggacgggatatatataaacgcgagattaataaagagatcgattagcgcgcgaaatcgatatagttaataatacgaataaagagggaggaaggtagttcgcgacggaatacgagagaagaagagagcgacgtaaatacgagacggcgtcgagcggagtaaggataggcgggtaagaacgt

SEQ ID NO: 27410 - DNA, 663 bp, Artificial Sequence
  chemically treated genomic DNA (Homo sapiens) CpG-island No: 27410
acgttcttacccgcctatccttactccgctcgacgccgtctcgtatttacgtcgctctcttcttctctcgtattccgtcgcgaactaccttcctccctctttattcgtattattaactatatcgatttcgcgcgctaatcgatctctttattaatctcgcgtttatatatatcccgtcccgcgtaataacttatattataaatacgctccgcgcgtctatccgaatctattcgtttttattattatacgctctttataatataatatcgacgaaaacgtctaattacgattaatccgcgaacgattattatacctctacgactctaccgtacgaataaaaatctacgtttctacccctatcgtctctttcgcgactatactacttttcttcttcctttactccgtcgttttacgcgctctctcgcccgcgacttatatccgctcgctttcgctcttttatccctaccctttctctctccgattccgcgatactaatcttctatatatttattactctccccttctttctcgccccccttcgttcgtacgattaaacgatttaaaattcgaaaattaaacgtctattcgcgtaaaaaaaaattcgttttataaataataattatcgcgtaattcgttactacgttatatctcgccgtcgactcg

SEQ ID NO: 27411 - DNA, 663 bp, Artificial Sequence
  chemically treated genomic DNA (Homo sapiens) CpG-island No: 27411
gcgtttttgttcgtttgtttttgtttcgttcggcgtcgtttcgtgtttgcgtcgttttttttttttttcgtgtttcgtcgcgggttgtttttttttttttttgttcgtgttgttggttgtgtcggtttcgcgcgttggtcggtttttttgttggtttcgcgtttgtgtgtgtttcgtttcgcgtggtggtttgtgttgtgggtgcgtttcgcgcgtttgttcgggtttgttcgtttttgttgttgtgcgttttttgtggtgtggtgtcggcgggggcgtttggttgcggttggttcgcgggcggttgttgtgtttttgcggttttgtcgtgcgggtgggggtttgcgtttttgtttttgtcgtttttttcgcggttgtgttgttttttttttttttttgtttcgtcgttttgcgcgttttttcgttcgcggtttgtgttcgttcgttttcgtttttttgtttttgtttttttttttttcggtttcgcggtgttggttttttgtgtgtttgttgttttttttttttttttcgttttttttcgttcgtgcggttgggcggtttggggttcgggggttgggcgtttgttcgcgtgggggggggttcgttttgtgggtggtggttgtcgcgtggttcgttgttgcgttgtgtttcgtcgtcggttcg

SEQ ID NO: 27412 - DNA, 663 bp, Artificial Sequence
  chemically treated genomic DNA (Homo sapiens) CpG-island No: 27412
cgaaccgacgacgaaacacaacgcaacaacgaaccacgcgacaaccaccacccacaaaacgaacccccccccacgcgaacaaacgcccaacccccgaaccccaaaccgcccaaccgcacgaacgaaaaaaaacgaaaaaaaaaaaaaaaacaacaaacacacaaaaaaccaacaccgcgaaaccgaaaaaaaaaaaaacaaaaacaaaaaaacgaaaacgaacgaacacaaaccgcgaacgaaaaaacgcgcaaaacgacgaaacaaaaaaaaaaaaaaaacaacacaaccgcgaaaaaaacgacaaaaacaaaaacgcaaacccccacccgcacgacaaaaccgcaaaaacacaacaaccgcccgcgaaccaaccgcaaccaaacgcccccgccgacaccacaccacaaaaaacgcacaacaacaaaaacgaacaaacccgaacaaacgcgcgaaacgcacccacaacacaaaccaccacgcgaaacgaaacacacacaaacgcgaaaccaacaaaaaaaccgaccaacgcgcgaaaccgacacaaccaacaacacgaacaaaaaaaaaaaaaaacaacccgcgacgaaacacgaaaaaaaaaaaaaacgacgcaaacacgaaacgacgccgaacgaaacaaaaacaaacgaacaaaaacgc

SEQ ID NO: 27413 - DNA, 612 bp, Artificial Sequence
  chemically treated genomic DNA (Homo sapiens) CpG-island No: 27413
  misc_feature (318)..(318): n is either a, c, g or t
  misc_feature (603)..(603): n is either a, c, g or t
aggtcggcggaaacgatagtattcgcgcgtatcgttcgcgggggcggggagcgttatttcgcgtttcgtcgagttacgaatcgcggttcgttatcggttttttatcgggagattattcgatatataaacgttcggtcgttcgtaaatcgcgtaatcggaatacgtataacgagatttagcgaggcgcgttattcgtcgttcgatcgatacgagtcgacgagatcgaagcgcgcgcgattcgtatttaacgataaaaataaaaggagaaggaatcgatatattcgttcgaagaatagattcgcgtaatcggcgacgatncgtagaacgcgaaagatacgcgaatatacggtagcggtaaacgcgagtattatcgcgttaatttcgatttaagcgataatcgacgagataaaaattatcgttcgtcgacgtcgatacggcgattagagagggcgaaattagaagtacgcggttattagatacggaagttatcgtttattcgatcgcggcgagcgaagaagtatcgataagatattagatagtatatacgcgatttaaagaagttagagcgacggaatagagacgtacgagtatcgtagtacgaangtaatatat

SEQ ID NO: 27414 - DNA, 612 bp, Artificial Sequence
  chemically treated genomic DNA (Homo sapiens) CpG-island No: 27414
  misc_feature (10)..(10): n is either a, c, g or t
  misc_feature (295)..(295): n is either a, c, g or t
atatattacnttcgtactacgatactcgtacgtctctattccgtcgctctaacttctttaaatcgcgtatatactatctaatatcttatcgatacttcttcgctcgccgcgatcgaataaacgataacttccgtatctaataaccgcgtacttctaatttcgccctctctaatcgccgtatcgacgtcgacgaacgataatttttatctcgtcgattatcgcttaaatcgaaattaacgcgataatactcgcgtttaccgctaccgtatattcgcgtatctttcgcgttctacgnatcgtcgccgattacgcgaatctattcttcgaacgaatatatcgattccttctccttttatttttatcgttaaatacgaatcgcgcgcgcttcgatctcgtcgactcgtatcgatcgaacgacgaataacgcgcctcgctaaatctcgttatacgtattccgattacgcgatttacgaacgaccgaacgtttatatatcgaataatctcccgataaaaaaccgataacgaaccgcgattcgtaactcgacgaaacgcgaaataacgctccccgcccccgcgaacgatacgcgcgaatactatcgtttccgccgacct

SEQ ID NO: 27415 - DNA, 612 bp, Artificial Sequence
  chemically treated genomic DNA (Homo sapiens) CpG-island No: 27415
  misc_feature (10)..(10): n is either a, c, g or t
  misc_feature (295)..(295): n is either a, c, g or t
gtgtgttgtnttcgtgttgcggtgttcgtgcgtttttgtttcgtcgttttggtttttttgggtcgcgtgtgtgttgtttggtgttttgtcggtgttttttcgttcgtcgcggtcgggtgggcggtggttttcgtgtttggtggtcgcgtgtttttggtttcgttttttttggtcgtcgtgtcggcgtcggcgggcggtggtttttgtttcgtcggttgtcgtttgggtcggggttggcgcggtggtgttcgcgtttgtcgttgtcgtgtgttcgcgtgtttttcgcgttttgcgngtcgtcgtcggttgcgcgggtttgtttttcgggcgggtgtgtcggttttttttttttttgtttttgtcgttgggtgcgggtcgcgcgcgtttcggtttcgtcggttcgtgtcggtcgggcggcgggtggcgcgtttcgttgggtttcgttgtgcgtgtttcggttgcgcggtttgcgggcggtcgggcgtttgtgtgtcgggtggtttttcggtggggggtcggtggcgggtcgcggttcgtggttcggcggggcgcggggtggcgtttttcgttttcgcgggcggtgcgcgcgggtgttgtcgttttcgtcggttt

SEQ ID NO: 27416 - DNA, 612 bp, Artificial Sequence
  chemically treated genomic DNA (Homo sapiens) CpG-island No: 27416
  misc_feature (318)..(318): n is either a, c, g or t
  misc_feature (603)..(603): n is either a, c, g or t
aaaccgacgaaaacgacaacacccgcgcgcaccgcccgcgaaaacgaaaaacgccaccccgcgccccgccgaaccacgaaccgcgacccgccaccgaccccccaccgaaaaaccacccgacacacaaacgcccgaccgcccgcaaaccgcgcaaccgaaacacgcacaacgaaacccaacgaaacgcgccacccgccgcccgaccgacacgaaccgacgaaaccgaaacgcgcgcgacccgcacccaacgacaaaaacaaaaaaaaaaaaaaccgacacacccgcccgaaaaacaaacccgcgcaaccgacgacgacncgcaaaacgcgaaaaacacgcgaacacacgacaacgacaaacgcgaacaccaccgcgccaaccccgacccaaacgacaaccgacgaaacaaaaaccaccgcccgccgacgccgacacgacgaccaaaaaaaacgaaaccaaaaacacgcgaccaccaaacacgaaaaccaccgcccacccgaccgcgacgaacgaaaaaacaccgacaaaacaccaaacaacacacacgcgacccaaaaaaaccaaaacgacgaaacaaaaacgcacgaacaccgcaacacgaanacaacacac

SEQ ID NO: 27417 - DNA, 599 bp, Artificial Sequence
  chemically treated genomic DNA (Homo sapiens) CpG-island No: 27417
  misc_feature (127)..(127): n is either a, c, g or t
  misc_feature (235)..(235): n is either a, c, g or t
  misc_feature (426)..(426): n is either a, c, g or t
atcgcgcgggggggagagagatatatatatttttaaataataacgatcggggggagaaataaatatatagcgggtcgacgaagaagatacgacgcggaggcggttaaaagagcggcggcgaggaggnaaggaagaagaaagtttagaggaagagtagaggcgaagataaacgcgagcggaacgaggaacgggtatacgatataaaagataataaggaagcgaagatatacggagnggagagtagcgaaggagagagtaatatagcgtaaagtaacgatagtaaataagtatcgatagggcgcgttagtcgaatagaagtagggagtatagtagttagcgttaagatacgagtagaatatatagcgcgcggcgggagagataagatatatcgagacgagggagagtaaataacgatacgacgatagnagagagaagagtaataataacgagtaatacggacgttaacgcgcgagagagtcgatagagaagaattcgtagagaatacgtcgcgagattagagcggtataggagtagagcggagagcgggtagaagtatataggagagcggaattagtagatcggtagacgcgacggttacg

SEQ ID NO: 27418 - DNA, 599 bp, Artificial Sequence
  chemically treated genomic DNA (Homo sapiens) CpG-island No: 27418
  misc_feature (174)..(174): n is either a, c, g or t
  misc_feature (365)..(365): n is either a, c, g or t
  misc_feature (473)..(473): n is either a, c, g or t
cgtaaccgtcgcgtctaccgatctactaattccgctctcctatatacttctacccgctctccgctctactcctataccgctctaatctcgcgacgtattctctacgaattcttctctatcgactctctcgcgcgttaacgtccgtattactcgttattattactcttctctctnctatcgtcgtatcgttatttactctccctcgtctcgatatatcttatctctcccgccgcgcgctatatattctactcgtatcttaacgctaactactatactccctacttctattcgactaacgcgccctatcgatacttatttactatcgttactttacgctatattactctctccttcgctactctccnctccgtatatcttcgcttccttattatcttttatatcgtatacccgttcctcgttccgctcgcgtttatcttcgcctctactcttcctctaaactttcttcttccttncctcctcgccgccgctcttttaaccgcctccgcgtcgtatcttcttcgtcgacccgctatatatttatttctccccccgatcgttattatttaaaaatatatatatctctctcccccccgcgcgat

SEQ ID NO: 27419 - DNA, 599 bp, Artificial Sequence
  chemically treated genomic DNA (Homo sapiens) CpG-island No: 27419
  misc_feature (174)..(174): n is either a, c, g or t
  misc_feature (365)..(365): n is either a, c, g or t
  misc_feature (473)..(473): n is either a, c, g or t
cgtggtcgtcgcgtttgtcggtttgttggtttcgtttttttgtgtgtttttgttcgtttttcgttttgtttttgtgtcgttttggtttcgcggcgtgttttttgcgggtttttttttgtcggttttttcgcgcgttggcgttcgtgttgttcgttgttgttgtttttttttttnttgtcgtcgtgtcgttgtttgttttttttcgtttcggtgtgttttgtttttttcgtcgcgcgttgtgtgttttgttcgtgttttggcgttggttgttgtgttttttgtttttgttcggttggcgcgttttgtcggtgtttgtttgttgtcgttgttttgcgttgtgttgttttttttttcgttgttttttntttcgtgtgttttcgtttttttgttgttttttgtgtcgtgtgttcgtttttcgtttcgttcgcgtttgttttcgtttttgttttttttttgggttttttttttttttnttttttcgtcgtcgtttttttggtcgttttcgcgtcgtgtttttttcgtcggttcgttgtgtgtttgttttttttttcggtcgttgttgtttgggggtgtgtgtgtttttttttttttcgcgcggt

SEQ ID NO: 27420 - DNA, 599 bp, Artificial Sequence
  chemically treated genomic DNA (Homo sapiens) CpG-island No: 27420
  misc_feature (127)..(127): n is either a, c, g or t
  misc_feature (235)..(235): n is either a, c, g or t
  misc_feature (426)..(426): n is either a, c, g or t
accgcgcgaaaaaaaaaaaaacacacacacccccaaacaacaacgaccgaaaaaaaaaacaaacacacaacgaaccgacgaaaaaaacacgacgcgaaaacgaccaaaaaaacgacgacgaaaaaanaaaaaaaaaaaaaacccaaaaaaaaaacaaaaacgaaaacaaacgcgaacgaaacgaaaaacgaacacacgacacaaaaaacaacaaaaaaacgaaaacacacgaaanaaaaaacaacgaaaaaaaaaacaacacaacgcaaaacaacgacaacaaacaaacaccgacaaaacgcgccaaccgaacaaaaacaaaaaacacaacaaccaacgccaaaacacgaacaaaacacacaacgcgcgacgaaaaaaacaaaacacaccgaaacgaaaaaaaacaaacaacgacacgacgacaanaaaaaaaaaaacaacaacaacgaacaacacgaacgccaacgcgcgaaaaaaccgacaaaaaaaaacccgcaaaaaacacgccgcgaaaccaaaacgacacaaaaacaaaacgaaaaacgaacaaaaacacacaaaaaaacgaaaccaacaaaccgacaaacgcgacgaccacg

SEQ ID NO: 27421 - DNA, 530 bp, Artificial Sequence
  chemically treated genomic DNA (Homo sapiens) CpG-island No: 27421
  misc_feature (210)..(210): n is either a, c, g or t
  misc_feature (274)..(274): n is either a, c, g or t
  misc_feature (345)..(345): n is either a, c, g or t
  misc_feature (421)..(421): n is either a, c, g or t
gtagacgagcggacggttagaggagatcgagtaacgataaggggcggtaaaaagaaagcgaggggaatagaaagggcgacgagaagtagggggaggggtaggagacgtaggtaaagtaagggagaaagaaggtaagaagagaaggaaaaggagagcggagggagcgagatagggcgaagacgagaggaagtagaggataagaggagtatnacggcggagagacgagaggaaggagaggaggaatatataattagagagagggaagagaagacgnagtacgatatatagaagaaagagcgaaggcgagaggaaagaagtaaggggaggagataaacgggagagggngagagatagcgggagagggaagtaggggaaggaataaaagaaaagagaacgataaagtagaaaggagaataagagnagcgataggaaggaggggcggagggagaagagaaaggaggacgtaggaaacggaacgatagagaggggcgtaggattcgtagagaggcgaaggaaaagaagtcggaaag

SEQ ID NO: 27422 - DNA, 530 bp, Artificial Sequence
  chemically treated genomic DNA (Homo sapiens) CpG-island No: 27422
  misc_feature (110)..(110): n is either a, c, g or t
  misc_feature (186)..(186): n is either a, c, g or t
  misc_feature (257)..(257): n is either a, c, g or t
  misc_feature (321)..(321): n is either a, c, g or t
ctttccgacttcttttccttcgcctctctacgaatcctacgcccctctctatcgttccgtttcctacgtcctcctttctcttctccctccgcccctccttcctatcgctnctcttattctcctttctactttatcgttctcttttcttttattccttcccctacttccctctcccgctatctctcnccctctcccgtttatctcctccccttacttctttcctctcgccttcgctctttcttctatatatcgtactncgtcttctcttccctctctctaattatatattcctcctctccttcctctcgtctctccgccgtnatactcctcttatcctctacttcctctcgtcttcgccctatctcgctccctccgctctccttttccttctcttcttaccttctttctcccttactttacctacgtctcctacccctccccctacttctcgtcgccctttctattcccctcgctttctttttaccgccccttatcgttactcgatctcctctaaccgtccgctcgtctac

SEQ ID NO: 27423 - DNA, 530 bp, Artificial Sequence
  chemically treated genomic DNA (Homo sapiens) CpG-island No: 27423
  misc_feature (110)..(110): n is either a, c, g or t
  misc_feature (186)..(186): n is either a, c, g or t
  misc_feature (257)..(257): n is either a, c, g or t
  misc_feature (321)..(321): n is either a, c, g or t
tttttcggttttttttttttcgtttttttgcgggttttgcgtttttttttgtcgtttcgttttttgcgtttttttttttttttttttttcgttttttttttttgtcgttntttttgtttttttttttgttttgtcgttttttttttttttgtttttttttttgtttttttttttcgttgttttttnttttttttcgtttgttttttttttttgttttttttttttcgttttcgtttttttttttgtgtgtcgtgttncgtttttttttttttttttttggttgtgtgtttttttttttttttttttcgttttttcgtcgtngtgttttttttgttttttgttttttttcgttttcgttttgtttcgtttttttcgttttttttttttttttttttttgtttttttttttttttgttttgtttgcgttttttgtttttttttttgtttttcgtcgttttttttgtttttttcgttttttttttgtcgttttttgtcgttgttcggttttttttggtcgttcgttcgtttgt

SEQ ID NO: 27424 - DNA, 530 bp, Artificial Sequence
  chemically treated genomic DNA (Homo sapiens) CpG-island No: 27424
  misc_feature (210)..(210): n is either a, c, g or t
  misc_feature (274)..(274): n is either a, c, g or t
  misc_feature (345)..(345): n is either a, c, g or t
  misc_feature (421)..(421): n is either a, c, g or t
acaaacgaacgaacgaccaaaaaaaaccgaacaacgacaaaaaacgacaaaaaaaaaacgaaaaaaacaaaaaaaacgacgaaaaacaaaaaaaaaaacaaaaaacgcaaacaaaacaaaaaaaaaaaaaaacaaaaaaaaaaaaaaaaaaaaaacgaaaaaaacgaaacaaaacgaaaacgaaaaaaaacaaaaaacaaaaaaaacacnacgacgaaaaaacgaaaaaaaaaaaaaaaaaaacacacaaccaaaaaaaaaaaaaaaaaaacgnaacacgacacacaaaaaaaaaaacgaaaacgaaaaaaaaaaaacaaaaaaaaaaaacaaacgaaaaaaaanaaaaaacaacgaaaaaaaaaaacaaaaaaaaaaacaaaaaaaaaaaaaacgacaaaacaaaaaaaaaaacaaaaanaacgacaaaaaaaaaaaacgaaaaaaaaaaaaaaaaaaaaacgcaaaaaacgaaacgacaaaaaaaaacgcaaaacccgcaaaaaaacgaaaaaaaaaaaaccgaaaaa

SEQ ID NO: 27425 - DNA, 626 bp, Artificial Sequence
  chemically treated genomic DNA (Homo sapiens) CpG-island No: 27425
  misc_feature (22)..(22): n is either a, c, g or t
  misc_feature (295)..(295): n is either a, c, g or t
cgtcgtcggagcgataaatttntcgggtcgggcggggggcggggggggttttttttcgtcgttaacgtttaggtcgttcgttacggtcgttaagttaaaattcgtacgttattagttttacgttttttcgcgacgtatatcgtttaattcgtcgttacgatcgcgtatttagcgtttttcgtttcgcgcgacgagtcgaacgcgcgagtaagggtttttatttatcgttagtttacgaggatcgcgttattatcgtcgattttattataatacgacgggcggtatcgtacgatanatttttatacgttttcggggcgcgagcgtacgtatataattcgtacgtagtatcgcgtaagttttcgtcgttttacggcgggatacgataagataagagcgcgggtagcgtcggcgtatattcgtcgtcgttcgtaatattcgtataattagcggacgatacgcgagagcgcgtagaatcgagcgcgttacgcgttcgtttagaacgtagttcgttttaacgtaaatattcgcgtatcggattataatatttatcgggcggttttatcgattattaagtcgacgcgatacgggaggcggtttttcgatagaacgcgtatcggagtcggttt

SEQ ID NO: 27426 - DNA, 626 bp, Artificial Sequence
  chemically treated genomic DNA (Homo sapiens) CpG-island No: 27426
  misc_feature (332)..(332): n is either a, c, g or t
  misc_feature (605)..(605): n is either a, c, g or t
aaaccgactccgatacgcgttctatcgaaaaaccgcctcccgtatcgcgtcgacttaataatcgataaaaccgcccgataaatattataatccgatacgcgaatatttacgttaaaacgaactacgttctaaacgaacgcgtaacgcgctcgattctacgcgctctcgcgtatcgtccgctaattatacgaatattacgaacgacgacgaatatacgccgacgctacccgcgctcttatcttatcgtatcccgccgtaaaacgacgaaaacttacgcgatactacgtacgaattatatacgtacgctcgcgccccgaaaacgtataaaaatntatcgtacgataccgcccgtcgtattataataaaatcgacgataataacgcgatcctcgtaaactaacgataaataaaaacccttactcgcgcgttcgactcgtcgcgcgaaacgaaaaacgctaaatacgcgatcgtaacgacgaattaaacgatatacgtcgcgaaaaaacgtaaaactaataacgtacgaattttaacttaacgaccgtaacgaacgacctaaacgttaacgacgaaaaaaaaccccccccgccccccgcccgacccganaaatttatcgctccgacgacg

SEQ ID NO: 27427 - DNA, 626 bp, Artificial Sequence
  chemically treated genomic DNA (Homo sapiens) CpG-island No: 27427
  misc_feature (332)..(332): n is either a, c, g or t
  misc_feature (605)..(605): n is either a, c, g or t
gggtcggtttcggtgcgcgttttgtcggggggtcgtttttcgtgtcgcgtcggtttggtggtcggtggggtcgttcggtgggtgttgtggttcggtgcgcgggtgtttgcgttggggcgggttgcgttttgggcgggcgcgtggcgcgttcggttttgcgcgttttcgcgtgtcgttcgttggttgtgcgggtgttgcgggcggcggcgggtgtgcgtcggcgttgttcgcgtttttgttttgtcgtgtttcgtcgtggggcggcgggggtttgcgcggtgttgcgtgcgggttgtgtgcgtgcgttcgcgtttcgggggcgtgtgggggtntgtcgtgcggtgtcgttcgtcgtgttgtggtggggtcggcggtggtggcgcggttttcgtgggttggcggtgggtgggggtttttgttcgcgcgttcggttcgtcgcgcggggcggggggcgttgggtgcgcggtcgtggcggcgggttgggcggtgtgcgtcgcgggggggcgtggggttggtggcgtgcgggttttggtttggcggtcgtggcgggcggtttgggcgttggcggcgggggggggtttttttcgtttttcgttcggttcggngggtttgtcgtttcggcggcg

SEQ ID NO: 27428 - DNA, 626 bp, Artificial Sequence
  chemically treated genomic DNA (Homo sapiens) CpG-island No: 27428
  misc_feature (22)..(22): n is either a, c, g or t
  misc_feature (295)..(295): n is either a, c, g or t
cgccgccgaaacgacaaacccnccgaaccgaacgaaaaacgaaaaaaacccccccccgccgccaacgcccaaaccgcccgccacgaccgccaaaccaaaacccgcacgccaccaaccccacgcccccccgcgacgcacaccgcccaacccgccgccacgaccgcgcacccaacgccccccgccccgcgcgacgaaccgaacgcgcgaacaaaaacccccacccaccgccaacccacgaaaaccgcgccaccaccgccgaccccaccacaacacgacgaacgacaccgcacgacanacccccacacgcccccgaaacgcgaacgcacgcacacaacccgcacgcaacaccgcgcaaacccccgccgccccacgacgaaacacgacaaaacaaaaacgcgaacaacgccgacgcacacccgccgccgcccgcaacacccgcacaaccaacgaacgacacgcgaaaacgcgcaaaaccgaacgcgccacgcgcccgcccaaaacgcaacccgccccaacgcaaacacccgcgcaccgaaccacaacacccaccgaacgaccccaccgaccaccaaaccgacgcgacacgaaaaacgaccccccgacaaaacgcgcaccgaaaccgaccc

SEQ ID NO: 27429 - DNA, 564 bp, Artificial Sequence
  chemically treated genomic DNA (Homo sapiens) CpG-island No: 27429
  misc_feature (340)..(340): n is either a, c, g or t
ggggcgggaggaggaaaatcgtcgcgataggggcgggggggcgggcggggggtcgcgcgggcggggaggcgaagataaggcgcgttaacgcggagcgttagagcgcggacgggcgtatcgaaaggtcggcggataggcgatagcgaggcgcggcgtcgaggcgggcgcgggtagcgcggacgaggtaagacgtcggagggcggcgcggggagagagcgcgcgggaaggggagggagcgggagggggagtagcggcgcgtcgaggaggttaaggggcgtcgcgcgggtcggggagcggtcgcgacgcggtagagcgagcggcgcgcggcggagcggtcgtncggcgacgcgaggaggcgggaggcggaggagcgtaagcgcgcgcggagggggagcgaggagggagcgagaggtaggatagcgagcggacgcgcgagcggaggtagttacgatacgagggatcggcggcgaggcggcgaggagggaggcgaggggaggagcggcggagtaggcgggcgggaggtacgggtcggggacgaggggaggcggtagaggcgcggcgcgt

SEQ ID NO: 27430 - DNA, 564 bp, Artificial Sequence
  chemically treated genomic DNA (Homo sapiens) CpG-island No: 27430
  misc_feature (225)..(225): n is either a, c, g or t
acgcgccgcgcctctaccgcctcccctcgtccccgacccgtacctcccgcccgcctactccgccgctcctcccctcgcctccctcctcgccgcctcgccgccgatccctcgtatcgtaactacctccgctcgcgcgtccgctcgctatcctacctctcgctccctcctcgctccccctccgcgcgcgcttacgctcctccgcctcccgcctcctcgcgtcgccgnacgaccgctccgccgcgcgccgctcgctctaccgcgtcgcgaccgctccccgacccgcgcgacgccccttaacctcctcgacgcgccgctactccccctcccgctccctccccttcccgcgcgctctctccccgcgccgccctccgacgtcttacctcgtccgcgctacccgcgcccgcctcgacgccgcgcctcgctatcgcctatccgccgacctttcgatacgcccgtccgcgctctaacgctccgcgttaacgcgccttatcttcgcctccccgcccgcgcgaccccccgcccgcccccccgcccctatcgcgacgattttcctcctcccgcccc

SEQ ID NO: 27431 - DNA, 564 bp, Artificial Sequence
  chemically treated genomic DNA (Homo sapiens) CpG-island No: 27431
  misc_feature (225)..(225): n is either a, c, g or t
gcgcgtcgcgtttttgtcgttttttttcgttttcggttcgtgtttttcgttcgtttgtttcgtcgttttttttttcgttttttttttcgtcgtttcgtcgtcggtttttcgtgtcgtggttgttttcgttcgcgcgttcgttcgttgttttgtttttcgtttttttttcgtttttttttcgcgcgcgtttgcgttttttcgtttttcgttttttcgcgtcgtcgngcggtcgtttcgtcgcgcgtcgttcgttttgtcgcgtcgcggtcgtttttcggttcgcgcggcgttttttggttttttcggcgcgtcgttgttttttttttcgttttttttttttttcgcgcgtttttttttcgcgtcgtttttcggcgttttgtttcgttcgcgttgttcgcgttcgtttcggcgtcgcgtttcgttgtcgtttgttcgtcggtttttcggtgcgttcgttcgcgttttggcgtttcgcgttggcgcgttttgttttcgttttttcgttcgcgcggtttttcgttcgttttttcgtttttgtcgcggcggttttttttttttcgtttt

SEQ ID NO: 27432 - DNA, 564 bp, Artificial Sequence
  chemically treated genomic DNA (Homo sapiens) CpG-island No: 27432
  misc_feature (340)..(340): n is either a, c, g or t
aaaacgaaaaaaaaaaaaccgccgcgacaaaaacgaaaaaacgaacgaaaaaccgcgcgaacgaaaaaacgaaaacaaaacgcgccaacgcgaaacgccaaaacgcgaacgaacgcaccgaaaaaccgacgaacaaacgacaacgaaacgcgacgccgaaacgaacgcgaacaacgcgaacgaaacaaaacgccgaaaaacgacgcgaaaaaaaaacgcgcgaaaaaaaaaaaaaacgaaaaaaaaaacaacgacgcgccgaaaaaaccaaaaaacgccgcgcgaaccgaaaaacgaccgcgacgcgacaaaacgaacgacgcgcgacgaaacgaccgcncgacgacgcgaaaaaacgaaaaacgaaaaaacgcaaacgcgcgcgaaaaaaaaacgaaaaaaaaacgaaaaacaaaacaacgaacgaacgcgcgaacgaaaacaaccacgacacgaaaaaccgacgacgaaacgacgaaaaaaaaaacgaaaaaaaaaacgacgaaacaaacgaacgaaaaacacgaaccgaaaacgaaaaaaaacgacaaaaacgcgacgcgc

SEQ ID NO: 27433 - DNA, 558 bp, Artificial Sequence
  chemically treated genomic DNA (Homo sapiens) CpG-island No: 27433
  misc_feature (30)..(30): n is either a, c, g or t
  misc_feature (508)..(508): n is either a, c, g or t
cgaaagcgcgtcggtagtttatttagattngaattttatcgttagcgcggcgcgtcgcgtagcgcgtcgcgagtcggaagggttcgatcgagcgaatcgacgcgaacggtagttatatttagttatcggcgtttcgtcggtacgtcggcgggtcgcggaggacgaatcgatcgatcgagatagcgtcgatagaagggaagggacgggaagtcgaagtacgcggcggtatattagagataaaatagattaaacgttttttcgcgttcggtaggtcgagggcggcgttagagttcggggaagtagcgtagcggtatagtagcgtcgattcgttatttaacgttagtagaagagggggcggagaaggagggagaagtacgggtcgcgggcggagcgcgaaggggttaatacgcgtagttcgagtttcgagtagtatagagatttaggtagcggttaggaaggatcgaatagaaaagcgcgcggagtataggagcggatagtagagagtttntagataagatatagcgacgtcgttaggaagtagattacgtataggcgacg

SEQ ID NO: 27434 - DNA, 558 bp, Artificial Sequence
  chemically treated genomic DNA (Homo sapiens) CpG-island No: 27434
  misc_feature (51)..(51): n is either a, c, g or t
  misc_feature (529)..(529): n is either a, c, g or t
cgtcgcctatacgtaatctacttcctaacgacgtcgctatatcttatctanaaactctctactatccgctcctatactccgcgcgcttttctattcgatccttcctaaccgctacctaaatctctatactactcgaaactcgaactacgcgtattaaccccttcgcgctccgcccgcgacccgtacttctccctccttctccgccccctcttctactaacgttaaataacgaatcgacgctactataccgctacgctacttccccgaactctaacgccgccctcgacctaccgaacgcgaaaaaacgtttaatctattttatctctaatataccgccgcgtacttcgacttcccgtcccttcccttctatcgacgctatctcgatcgatcgattcgtcctccgcgacccgccgacgtaccgacgaaacgccgataactaaatataactaccgttcgcgtcgattcgctcgatcgaacccttccgactcgcgacgcgctacgcgacgcgccgcgctaacgataaaattcnaatctaaataaactaccgacgcgctttcg

SEQ ID NO: 27435 - DNA, 558 bp, Artificial Sequence
  chemically treated genomic DNA (Homo sapiens) CpG-island No: 27435
  misc_feature (51)..(51): n is either a, c, g or t
  misc_feature (529)..(529): n is either a, c, g or t
cgtcgtttgtgcgtggtttgttttttggcggcgtcgttgtgttttgtttgngggttttttgttgttcgtttttgtgtttcgcgcgtttttttgttcggttttttttggtcgttgtttgggtttttgtgttgttcggggttcgggttgcgcgtgttggttttttcgcgtttcgttcgcggttcgtgttttttttttttttttcgtttttttttttgttggcgttgggtggcgggtcggcgttgttgtgtcgttgcgttgttttttcgggttttggcgtcgttttcggtttgtcgggcgcgggggggcgtttggtttgttttgtttttggtgtgtcgtcgcgtgtttcggtttttcgtttttttttttttgtcggcgttgtttcggtcggtcggttcgtttttcgcggttcgtcggcgtgtcggcggggcgtcggtggttgggtgtggttgtcgttcgcgtcggttcgttcggtcgggttttttcggttcgcggcgcgttgcgcggcgcgtcgcgttggcggtggggtttnggtttgggtgggttgtcggcgcgttttcg

SEQ ID NO: 27436 - DNA, 558 bp, Artificial Sequence
  chemically treated genomic DNA (Homo sapiens) CpG-island No: 27436
  misc_feature (30)..(30): n is either a, c, g or t
  misc_feature (508)..(508): n is either a, c, g or t
cgaaaacgcgccgacaacccacccaaaccnaaaccccaccgccaacgcgacgcgccgcgcaacgcgccgcgaaccgaaaaaacccgaccgaacgaaccgacgcgaacgacaaccacacccaaccaccgacgccccgccgacacgccgacgaaccgcgaaaaacgaaccgaccgaccgaaacaacgccgacaaaaaaaaaaaaacgaaaaaccgaaacacgcgacgacacaccaaaaacaaaacaaaccaaacgcccccccgcgcccgacaaaccgaaaacgacgccaaaacccgaaaaaacaacgcaacgacacaacaacgccgacccgccacccaacgccaacaaaaaaaaaaacgaaaaaaaaaaaaaaaacacgaaccgcgaacgaaacgcgaaaaaaccaacacgcgcaacccgaaccccgaacaacacaaaaacccaaacaacgaccaaaaaaaaccgaacaaaaaaacgcgcgaaacacaaaaacgaacaacaaaaaacccncaaacaaaacacaacgacgccgccaaaaaacaaaccacgcacaaacgacg

SEQ ID NO: 27437 - DNA, 526 bp, Artificial Sequence
  chemically treated genomic DNA (Homo sapiens) CpG-island No: 27437
cgtaagtcggagacgttcgttttttttttcgcgcggaggaaattttacgggtaagaagtcggggtggcgggaaaggagtacgcggtatcgcggggaggtagagaaggtttgttagggattagtcgggttcggggagagtagggatacgcgggtcgtcggatcgaggaggtcgaggtgacgaggaaaatttttcggcgcggagtcgggattgggcgttttcggcgggttacggttgtttttggtttagtatagtttgcgtttcggttttaatcgggttaggtagggagttaggagagagggtaaatcgcggttcgtatttgtttgagatcgggtgattagtaattggtaatagtttttgttaggcggcgggttttgttttatagttttaaagagagttttcggtagttacgacgttattttgggacgttatcgtcgtcgttaagataattaggaaggggcggggtttggttggggttaaggggttaaaattttagtttaaattgaattacgtttatgagttggtaga

SEQ ID NO: 27438 - DNA, 526 bp, Artificial Sequence
  chemically treated genomic DNA (Homo sapiens) CpG-island No: 27438
tctaccaactcataaacgtaattcaatttaaactaaaattttaaccccttaaccccaaccaaaccccgccccttcctaattatcttaacgacgacgataacgtcccaaaataacgtcgtaactaccgaaaactctctttaaaactataaaacaaaacccgccgcctaacaaaaactattaccaattactaatcacccgatctcaaacaaatacgaaccgcgatttaccctctctcctaactccctacctaacccgattaaaaccgaaacgcaaactatactaaaccaaaaacaaccgtaacccgccgaaaacgcccaatcccgactccgcgccgaaaaattttcctcgtcacctcgacctcctcgatccgacgacccgcgtatccctactctccccgaacccgactaatccctaacaaaccttctctacctccccgcgataccgcgtactcctttcccgccaccccgacttcttacccgtaaaatttcctccgcgcgaaaaaaaaaacgaacgtctccgacttacg

SEQ ID NO: 27439 - DNA, 526 bp, Artificial Sequence
  chemically treated genomic DNA (Homo sapiens) CpG-island No: 27439
tttgttagtttataagcgtggtttaatttaaattagggttttggttttttgattttaattaagtttcgtttttttttggttgttttagcgacggcggtggcgttttaagatggcgtcgtggttgtcggagattttttttgaaattgtaggataaggttcgtcgtttagtaaagattattattagttattggttattcggttttaggtaagtgcgagtcgcggtttatttttttttttaattttttatttggttcggttggggtcgggacgtaggttgtgttaggttaagagtaatcgtagttcgtcggaagcgtttagtttcggtttcgcgtcgggagatttttttcgttatttcggttttttcggttcgacggttcgcgtgtttttgtttttttcgagttcggttagtttttggtaagttttttttgttttttcgcggtgtcgcgtgtttttttttcgttatttcggttttttattcgtagagtttttttcgcgcgaagaggaaaacgggcgttttcggtttgcg

SEQ ID NO: 27440 - DNA, 526 bp, Artificial Sequence
  chemically treated genomic DNA (Homo sapiens) CpG-island No: 27440
cgcaaaccgaaaacgcccgttttcctcttcgcgcgaaaaaaactctacgaataaaaaaccgaaataacgaaaaaaaaacacgcgacaccgcgaaaaaacaaaaaaaacttaccaaaaactaaccgaactcgaaaaaaacaaaaacacgcgaaccgtcgaaccgaaaaaaccgaaataacgaaaaaaatctcccgacgcgaaaccgaaactaaacgcttccgacgaactacgattactcttaacctaacacaacctacgtcccgaccccaaccgaaccaaataaaaaattaaaaaaaaaaataaaccgcgactcgcacttacctaaaaccgaataaccaataactaataataatctttactaaacgacgaaccttatcctacaatttcaaaaaaaatctccgacaaccacgacgccatcttaaaacgccaccgccgtcgctaaaacaaccaaaaaaaaacgaaacttaattaaaatcaaaaaaccaaaaccctaatttaaattaaaccacgcttataaactaacaaa

SEQ ID NO: 27441 - DNA, 525 bp, Artificial Sequence
  chemically treated genomic DNA (Homo sapiens) CpG-island No: 27441
  misc_feature (7)..(7): n is either a, c, g or t
  misc_feature (37)..(37): n is either a, c, g or t
  misc_feature (68)..(68): n is either a, c, g or t
  misc_feature (75)..(75): n is either a, c, g or t
  misc_feature (91)..(91): n is either a, c, g or t
  misc_feature (96)..(96): n is either a, c, g or t
  misc_feature (99)..(99): n is either a, c, g or t
  misc_feature (101)..(101): n is either a, c, g or t
  misc_feature (118)..(118): n is either a, c, g or t
  misc_feature (121)..(121): n is either a, c, g or t
  misc_feature (129)..(129): n is either a, c, g or t
  misc_feature (139)..(139): n is either a, c, g or t
  misc_feature (144)..(144): n is either a, c, g or t
  misc_feature (191)..(193): n is either a, c, g or t
  misc_feature (215)..(216): n is either a, c, g or t
  misc_feature (223)..(224): n is either a, c, g or t
  misc_feature (226)..(226): n is either a, c, g or t
  misc_feature (235)..(235): n is either a, c, g or t
  misc_feature (247)..(248): n is either a, c, g or t
  misc_feature (297)..(298): n is either a, c, g or t
  misc_feature (338)..(338): n is either a, c, g or t
  misc_feature (357)..(357): n is either a, c, g or t
  misc_feature (359)..(359): n is either a, c, g or t
  misc_feature (375)..(375): n is either a, c, g or t
  misc_feature (426)..(427): n is either a, c, g or t
  misc_feature (455)..(456): n is either a, c, g or t
gggtgtnggggtcgcggtgggggggtgtcggtggttnggtcgcgcgcgtttttcgcggggcgagcggngcgcgtnggtgtcggtgtcgcgntcgtnttngnggcggggggtggggtgnggncgcggggngttcgcggtntcggnttgtgtttttcgcgggggggtcggggggtggtgggtgggggtgtggnnngggggcggggggcggtgcgttnnggcggtnntngtgcgtggngggtggggtggnnggtgtgtcgcgcgtcgcgcgtcgtggtttgcggttttggtggcgcgttnnggtggtggggtcggcgtcgcgcgttcgcgcgcggggggtngggtcgtggggcgggtggngnggcgcgggggtggggngtgtagttgtgggcgcgcggttttcggtgcgagtcgcgcggtcgcgttttnncggtttgttgttttttcgtttcgttcgnncgtttcgggcgtcgtttgtttggagcgcgtcgttcgcggagtatgtttcgttcgtatataattataata

SEQ ID NO: 27442 - DNA, 525 bp, Artificial Sequence
  chemically treated genomic DNA (Homo sapiens) CpG-island No: 27442
  misc_feature (70)..(71): n is either a, c, g or t
  misc_feature (99)..(100): n is either a, c, g or t
  misc_feature (151)..(151): n is either a, c, g or t
  misc_feature (167)..(167): n is either a, c, g or t
  misc_feature (169)..(169): n is either a, c, g or t
  misc_feature (188)..(188): n is either a, c, g or t
  misc_feature (228)..(229): n is either a, c, g or t
  misc_feature (278)..(279): n is either a, c, g or t
  misc_feature (291)..(291): n is either a, c, g or t
  misc_feature (300)..(300): n is either a, c, g or t
  misc_feature (302)..(303): n is either a, c, g or t
  misc_feature (310)..(311): n is either a, c, g or t
  misc_feature (333)..(335): n is either a, c, g or t
  misc_feature (382)..(382): n is either a, c, g or t
  misc_feature (387)..(387): n is either a, c, g or t
  misc_feature (397)..(397): n is either a, c, g or t
  misc_feature (405)..(405): n is either a, c, g or t
  misc_feature (408)..(408): n is either a, c, g or t
  misc_feature (425)..(425): n is either a, c, g or t
  misc_feature (427)..(427): n is either a, c, g or t
  misc_feature (430)..(430): n is either a, c, g or t
  misc_feature (435)..(435): n is either a, c, g or t
  misc_feature (451)..(451): n is either a, c, g or t
  misc_feature (458)..(458): n is either a, c, g or t
  misc_feature (489)..(489): n is either a, c, g or t
  misc_feature (519)..(519): n is either a, c, g or t
tattataattatatacgaacgaaacatactccgcgaacgacgcgctccaaacaaacgacgcccgaaacgnncgaacgaaacgaaaaaacaacaaaccgnnaaaacgcgaccgcgcgactcgcaccgaaaaccgcgcgcccacaactacacnccccacccccgcgccncnccacccgccccacgacccnaccccccgcgcgcgaacgcgcgacgccgaccccaccaccnnaacgcgccaccaaaaccgcaaaccacgacgcgcgacgcgcgacacaccnnccaccccacccnccacgcacnannaccgccnnaacgcaccgccccccgcccccnnnccacacccccacccaccaccccccgacccccccgcgaaaaacacaanccganaccgcgaacnccccgcgnccncaccccaccccccgccncnaanacgancgcgacaccgacaccnacgcgcnccgctcgccccgcgaaaaacgcgcgcgaccnaaccaccgacacccccccaccgcgaccccnacaccc

SEQ ID NO: 27443 - DNA, 525 bp, Artificial Sequence
  chemically treated genomic DNA (Homo sapiens) CpG-island No: 27443
  misc_feature (70)..(71): n is either a, c, g or t
  misc_feature (99)..(100): n is either a, c, g or t
  misc_feature (151)..(151): n is either a, c, g or t
  misc_feature (167)..(167): n is either a, c, g or t
  misc_feature (169)..(169): n is either a, c, g or t
  misc_feature (188)..(188): n is either a, c, g or t
  misc_feature (228)..(229): n is either a, c, g or t
  misc_feature (278)..(279): n is either a, c, g or t
  misc_feature (291)..(291): n is either a, c, g or t
  misc_feature (300)..(300): n is either a, c, g or t
  misc_feature (302)..(303): n is either a, c, g or t
  misc_feature (310)..(311): n is either a, c, g or t
  misc_feature (333)..(335): n is either a, c, g or t
  misc_feature (382)..(382): n is either a, c, g or t
  misc_feature (387)..(387): n is either a, c, g or t
  misc_feature (397)..(397): n is either a, c, g or t
  misc_feature (405)..(405): n is either a, c, g or t
  misc_feature (408)..(408): n is either a, c, g or t
  misc_feature (425)..(425): n is either a, c, g or t
  misc_feature (427)..(427): n is either a, c, g or t
  misc_feature (430)..(430): n is either a, c, g or t
  misc_feature (435)..(435): n is either a, c, g or t
  misc_feature (451)..(451): n is either a, c, g or t
  misc_feature (458)..(458): n is either a, c, g or t
  misc_feature (489)..(489): n is either a, c, g or t
  misc_feature (519)..(519): n is either a, c, g or t
tgttatggttatgtgcgagcggagtatgtttcgcgggcgacgcgttttaagtaggcggcgttcggggcgnncgggcggggcggaaggataataagtcgnnggggcgcgatcgcgcgattcgtatcgaaggtcgcgcgtttataattgtatnttttattttcgcgttntnttattcgttttacggtttngtttttcgcgcgcgagcgcgcggcgtcggttttattattnnagcgcgttattagaatcgtaaattacggcgcgcggcgcgcgatatattnnttattttatttnttacgtatnannatcgttnnggcgtatcgtttttcgtttttnnnttatatttttatttattatttttcgattttttcgcgggaggtatagntcggngtcgcgggtntttcgcgnttntattttatttttcgttntnaangcgancgcggtatcggtattngcgcgtntcgttcgtttcgcggggagcgcgcgcggttnggttatcgatatttttttatcgcggttttnatattt

SEQ ID NO: 27444 - DNA, 525 bp, Artificial Sequence
  chemically treated genomic DNA (Homo sapiens) CpG-island No: 27444
  misc_feature (7)..(7): n is either a, c, g or t
  misc_feature (37)..(37): n is either a, c, g or t
  misc_feature (68)..(68): n is either a, c, g or t
  misc_feature (75)..(75): n is either a, c, g or t
  misc_feature (91)..(91): n is either a, c, g or t
  misc_feature (96)..(96): n is either a, c, g or t
  misc_feature (99)..(99): n is either a, c, g or t
  misc_feature (101)..(101): n is either a, c, g or t
  misc_feature (118)..(118): n is either a, c, g or t
  misc_feature (121)..(121): n is either a, c, g or t
  misc_feature (129)..(129): n is either a, c, g or t
  misc_feature (139)..(139): n is either a, c, g or t
  misc_feature (144)..(144): n is either a, c, g or t
  misc_feature (191)..(193): n is either a, c, g or t
  misc_feature (215)..(216): n is either a, c, g or t
  misc_feature (223)..(224): n is either a, c, g or t
  misc_feature (226)..(226): n is either a, c, g or t
  misc_feature (235)..(235): n is either a, c, g or t
  misc_feature (247)..(248): n is either a, c, g or t
  misc_feature (297)..(298): n is either a, c, g or t
  misc_feature (338)..(338): n is either a, c, g or t
  misc_feature (357)..(357): n is either a, c, g or t
  misc_feature (359)..(359): n is either a, c, g or t
  misc_feature (375)..(375): n is either a, c, g or t
  misc_feature (426)..(427): n is either a, c, g or t
  misc_feature (455)..(456): n is either a, c, g or t
aaatatnaaaaccgcgataaaaaaatatcgataaccnaaccgcgcgcgctccccgcgaaacgaacganacgcgcnaataccgataccgcgntcgcnttnanaacgaaaaataaaatanaancgcgaaanacccgcgacnccganctatacctcccgcgaaaaaatcgaaaaataataaataaaaatataannnaaaaacgaaaaacgatacgccnnaacgatnntnatacgtaanaaataaaataannaatatatcgcgcgccgcgcgccgtaatttacgattctaataacgcgctnnaataataaaaccgacgccgcgcgctcgcgcgcgaaaaacnaaaccgtaaaacgaataananaacgcgaaaataaaanatacaattataaacgcgcgaccttcgatacgaatcgcgcgatcgcgccccnncgacttattatccttccgccccgcccgnncgccccgaacgccgcctacttaaaacgcgtcgcccgcgaaacatactccgctcgcacataaccataaca

SEQ ID NO: 27445 - DNA, 757 bp, Artificial Sequence
  chemically treated genomic DNA (Homo sapiens) CpG-island No: 27445
  misc_feature (6)..(6): n is either a, c, g or t
  misc_feature (27)..(27): n is either a, c, g or t
  misc_feature (30)..(30): n is either a, c, g or t
  misc_feature (37)..(37): n is either a, c, g or t
  misc_feature (43)..(43): n is either a, c, g or t
  misc_feature (57)..(57): n is either a, c, g or t
  misc_feature (61)..(61): n is either a, c, g or t
  misc_feature (112)..(113): n is either a, c, g or t
  misc_feature (143)..(143): n is either a, c, g or t
  misc_feature (157)..(157): n is either a, c, g or t
  misc_feature (178)..(178): n is either a, c, g or t
  misc_feature (233)..(233): n is either a, c, g or t
  misc_feature (245)..(245): n is either a, c, g or t
  misc_feature (271)..(271): n is either a, c, g or t
  misc_feature (290)..(290): n is either a, c, g or t
  misc_feature (293)..(294): n is either a, c, g or t
  misc_feature (355)..(355): n is either a, c, g or t
  misc_feature (357)..(357): n is either a, c, g or t
  misc_feature (366)..(366): n is either a, c, g or t
  misc_feature (377)..(377): n is either a, c, g or t
  misc_feature (394)..(394): n is either a, c, g or t
  misc_feature (431)..(432): n is either a, c, g or t
  misc_feature (450)..(450): n is either a, c, g or t
  misc_feature (456)..(456): n is either a, c, g or t
  misc_feature (508)..(508): n is either a, c, g or t
  misc_feature (513)..(513): n is either a, c, g or t
  misc_feature (626)..(626): n is either a, c, g or t
  misc_feature (630)..(630): n is either a, c, g or t
  misc_feature (703)..(703): n is either a, c, g or t
  misc_feature (745)..(745): n is either a, c, g or t
  misc_feature (751)..(752): n is either a, c, g or t
gaaagncgggggcgggtgggtggttgntgngagtcgncggtangaggcgaggggcgngagnggtaagagggggggtgaagggtcgggggggggggggttggtggtgggggtnngagttgaggcgtgggtttgggggggggagnggggtgggtttcgncgcgtgggggcggtcgggggngggtggggggggggcgagggatatgatataagtatggtaggtgagggtgagtggngggtcggtgagngggagatttagtaaacgttcgtatgngggcgagcggggggggggntgnngggcggtcgcgggtttcgaatcgcggaggagcgggaggggggcggggtcggtgtggcgatngntgacggcgntgtgagaggangggggaggtgaggtggnttgcgcgggcgtgggggtgagagtgtgtggtgagggnngtggggggtgaggttaangtagtntgtgcgcgatagtcgtacgagcgggtaggtagagggaagaggtagggggagncggtngagtggtgttggggggtggtgggggtggtggtggggggagggggtcgacgacgcgaggcgggggggggagagagggggaggcgggggcggtgaaaaggaagggagattaggtntggntggtagtgagggagggaggtgggtggtgcgttatcgtgcgattacgatgtttggcggcggggcgtgtgttcgnaagaggaggcgggtggtgggggggcgagtcgggggggcgggnggaagnnacggt

SEQ ID NO: 27446 - DNA, 757 bp, Artificial Sequence
  chemically treated genomic DNA (Homo sapiens) CpG-island No: 27446
  misc_feature (6)..(7): n is either a, c, g or t
  misc_feature (13)..(13): n is either a, c, g or t
  misc_feature (55)..(55): n is either a, c, g or t
  misc_feature (128)..(128): n is either a, c, g or t
  misc_feature (132)..(132): n is either a, c, g or t
  misc_feature (245)..(245): n is either a, c, g or t
  misc_feature (250)..(250): n is either a, c, g or t
  misc_feature (302)..(302): n is either a, c, g or t
  misc_feature (308)..(308): n is either a, c, g or t
  misc_feature (326)..(327): n is either a, c, g or t
  misc_feature (364)..(364): n is either a, c, g or t
  misc_feature (381)..(381): n is either a, c, g or t
  misc_feature (392)..(392): n is either a, c, g or t
  misc_feature (401)..(401): n is either a, c, g or t
  misc_feature (403)..(403): n is either a, c, g or t
  misc_feature (464)..(465): n is either a, c, g or t
  misc_feature (468)..(468): n is either a, c, g or t
  misc_feature (487)..(487): n is either a, c, g or t
  misc_feature (513)..(513): n is either a, c, g or t
  misc_feature (525)..(525): n is either a, c, g or t
  misc_feature (580)..(580): n is either a, c, g or t
  misc_feature (601)..(601): n is either a, c, g or t
  misc_feature (615)..(615): n is either a, c, g or t
  misc_feature (645)..(646): n is either a, c, g or t
  misc_feature (697)..(697): n is either a, c, g or t
  misc_feature (701)..(701): n is either a, c, g or t
  misc_feature (715)..(715): n is either a, c, g or t
  misc_feature (721)..(721): n is either a, c, g or t
  misc_feature (728)..(728): n is either a, c, g or t
  misc_feature (731)..(731): n is either a, c, g or t
  misc_feature (752)..(752): n is either a, c, g or t
accgtnncttccncccgcccccccgactcgcccccccaccacccgcctcctcttncgaacacacgccccgccgccaaacatcgtaatcgcacgataacgcaccacccacctccctccctcactaccanccanacctaatctcccttccttttcaccgcccccgcctccccctctctcccccccccgcctcgcgtcgtcgaccccctccccccaccaccacccccaccaccccccaacaccactcnaccgnctccccctacctcttccctctacctacccgctcgtacgactatcgcgcacanactacnttaacctcaccccccacnnccctcaccacacactctcacccccacgcccgcgcaanccacctcacctcccccntcctctcacancgccgtcancnatcgccacaccgaccccgcccccctcccgctcctccgcgattcgaaacccgcgaccgcccnncanccccccccccgctcgcccncatacgaacgtttactaaatctcccnctcaccgacccnccactcaccctcacctaccatacttatatcatatccctcgccccccccccacccncccccgaccgcccccacgcgncgaaacccaccccnctcccccccccaaacccacgcctcaactcnnacccccaccaccaacccccccccccccgacccttcaccccccctcttaccnctcncgcccctcgcctcntaccgncgactcncancaaccacccacccgcccccgnctttc

SEQ ID NO: 27447 - DNA, 757 bp, Artificial Sequence
  chemically treated genomic DNA (Homo sapiens) CpG-island No: 27447
  misc_feature (6)..(7): n is either a, c, g or t
  misc_feature (13)..(13): n is either a, c, g or t
  misc_feature (55)..(55): n is either a, c, g or t
  misc_feature (128)..(128): n is either a, c, g or t
  misc_feature (132)..(132): n is either a, c, g or t
  misc_feature (245)..(245): n is either a, c, g or t
  misc_feature (250)..(250): n is either a, c, g or t
  misc_feature (302)..(302): n is either a, c, g or t
  misc_feature (308)..(308): n is either a, c, g or t
  misc_feature (326)..(327): n is either a, c, g or t
  misc_feature (364)..(364): n is either a, c, g or t
  misc_feature (381)..(381): n is either a, c, g or t
  misc_feature (392)..(392): n is either a, c, g or t
  misc_feature (401)..(401): n is either a, c, g or t
  misc_feature (403)..(403): n is either a, c, g or t
  misc_feature (464)..(465): n is either a, c, g or t
  misc_feature (468)..(468): n is either a, c, g or t
  misc_feature (487)..(487): n is either a, c, g or t
  misc_feature (513)..(513): n is either a, c, g or t
  misc_feature (525)..(525): n is either a, c, g or t
  misc_feature (580)..(580): n is either a, c, g or t
  misc_feature (601)..(601): n is either a, c, g or t
  misc_feature (615)..(615): n is either a, c, g or t
  misc_feature (645)..(646): n is either a, c, g or t
  misc_feature (697)..(697): n is either a, c, g or t
  misc_feature (701)..(701): n is either a, c, g or t
  misc_feature (715)..(715): n is either a, c, g or t
  misc_feature (721)..(721): n is either a, c, g or t
  misc_feature (728)..(728): n is either a, c, g or t
  misc_feature (731)..(731): n is either a, c, g or t
  misc_feature (752)..(752): n is either a, c, g or t
gtcgtnntttttnttcgttttttcggttcgtttttttattattcgtttttttttncgggtatacgtttcgtcgttagatatcgtagtcgtacgataacgtattatttattttttttttttattattanttanatttaatttttttttttttttatcgttttcgtttttttttttttttttttttcgtttcgcgtcgtcggttttttttttttattattatttttattattttttagtattatttnatcgnttttttttattttttttttttgtttgttcgttcgtgcggttgtcgcgtatanattgtnttaattttattttttatnntttttattatatatttttatttttacgttcgcgtagnttattttattttttttntttttttatancgtcgttantnatcgttatatcggtttcgtttttttttcgttttttcgcggttcggagttcgcggtcgtttnntantttttttttcgttcgtttntatgcgagcgtttattgggttttttntttatcggtttnttatttatttttatttattatatttgtattatgtttttcgttttttttttatttnttttcggtcgtttttacgcgncggggtttattttntttttttttttaaatttacgttttaatttnnatttttattattagttttttttttttcgattttttatttttttttttattntttncgtttttcgttttntgtcgncgatttntantagttatttattcgttttcgnttttt

SEQ ID NO: 27448 - DNA, 757 bp, Artificial Sequence
  chemically treated genomic DNA (Homo sapiens) CpG-island No: 27448
  misc_feature (6)..(6): n is either a, c, g or t
  misc_feature (27)..(27): n is either a, c, g or t
  misc_feature (30)..(30): n is either a, c, g or t
  misc_feature (37)..(37): n is either a, c, g or t
  misc_feature (43)..(43): n is either a, c, g or t
  misc_feature (57)..(57): n is either a, c, g or t
  misc_feature (61)..(61): n is either a, c, g or t
  misc_feature (112)..(113): n is either a, c, g or t
  misc_feature (143)..(143): n is either a, c, g or t
  misc_feature (157)..(157): n is either a, c, g or t
  misc_feature (178)..(178): n is either a, c, g or t
  misc_feature (233)..(233): n is either a, c, g or t
  misc_feature (245)..(245): n is either a, c, g or t
  misc_feature (271)..(271): n is either a, c, g or t
  misc_feature (290)..(290): n is either a, c, g or t
  misc_feature (293)..(294): n is either a, c, g or t
  misc_feature (355)..(355): n is either a, c, g or t
  misc_feature (357)..(357): n is either a, c, g or t
  misc_feature (366)..(366): n is either a, c, g or t
  misc_feature (377)..(377): n is either a, c, g or t
  misc_feature (394)..(394): n is either a, c, g or t
  misc_feature (431)..(432): n is either a, c, g or t
  misc_feature (450)..(450): n is either a, c, g or t
  misc_feature (456)..(456): n is either a, c, g or t
  misc_feature (508)..(508): n is either a, c, g or t
  misc_feature (513)..(513): n is either a, c, g or t
  misc_feature (626)..(626): n is either a, c, g or t
  misc_feature (630)..(630): n is either a, c, g or t
  misc_feature (703)..(703): n is either a, c, g or t
  misc_feature (745)..(745): n is either a, c, g or t
  misc_feature (751)..(752): n is either a, c, g or t
aaaaancgaaaacgaataaataactantanaaatcgncgacanaaaacgaaaaacgnaaanaataaaaaaaaaaataaaaaatcgaaaaaaaaaaaactaataataaaaatnnaaattaaaacgtaaatttaaaaaaaaaaanaaaataaaccccgncgcgtaaaaacgaccgaaaanaaataaaaaaaaaacgaaaaacataatacaaatataataaataaaaataaataanaaaccgataaanaaaaaacccaataaacgctcgcatanaaacgaacgaaaaaaaaantannaaacgaccgcgaactccgaaccgcgaaaaaacgaaaaaaaaacgaaaccgatataacgatnantaacgacgntataaaaaaanaaaaaaaataaaataanctacgcgaacgtaaaaataaaaatatataataaaaannataaaaaataaaattaanacaatntatacgcgacaaccgcacgaacgaacaaacaaaaaaaaaaaataaaaaaaancgatnaaataatactaaaaaataataaaaataataataaaaaaaaaaaaccgacgacgcgaaacgaaaaaaaaaaaaaaaaaaaaacgaaaacgataaaaaaaaaaaaaaattaaatntaantaataataaaaaaaaaaaataaataatacgttatcgtacgactacgatatctaacgacgaaacgtatacccgnaaaaaaaaacgaataataaaaaaacgaaccgaaaaaacgaanaaaaannacgac

SEQ ID NO: 27449 - DNA, 712 bp, Artificial Sequence
  chemically treated genomic DNA (Homo sapiens) CpG-island No: 27449
  misc_feature (12)..(12): n is either a, c, g or t
  misc_feature (33)..(34): n is either a, c, g or t
  misc_feature (214)..(214): n is either a, c, g or t
  misc_feature (241)..(241): n is either a, c, g or t
  misc_feature (408)..(408): n is either a, c, g or t
  misc_feature (411)..(411): n is either a, c, g or t
  misc_feature (455)..(455): n is either a, c, g or t
  misc_feature (501)..(501): n is either a, c, g or t
  misc_feature (527)..(527): n is either a, c, g or t
  misc_feature (529)..(529): n is either a, c, g or t
  misc_feature (543)..(543): n is either a, c, g or t
  misc_feature (577)..(577): n is either a, c, g or t
  misc_feature (598)..(598): n is either a, c, g or t
  misc_feature (678)..(678): n is either a, c, g or t
  misc_feature (698)..(698): n is either a, c, g or t
gcgggggcgggngggcgggggggcggggtcggnncggggggggggcggcggggtcgcgggtcggggggtcgcgcgttcgggcggttcggcgggggtttcgtcgcggggcggggtttcgggggcgtcgtcggcgcggcgggggggcggcgggcgcggcgcggcgggggcgtcgcgggggcgggcgcgcgcggggcgtcggtcgcggggcgggggntcggcgcgcggcgcgggggcgcggcgngtcggggcggggcggcggcggttcggcgttcggggcgcggggcggggcgtcggcggggcgcgcggcggcgggggttcgcggcgcgcgcgggggggggggttcggcgcgcggtcgcgggggggggttcggggcggcggggcgggacggcgcgcggggggcggggcggncgngcgggcgggcggttcgggcggggggcgagggcggggcggagcgncggcgcggagcggcgcgggcggcgggtcggcggggcgcgcgcggtngcggcggcggcgcgcggagcgggcgngngcggggcgggcggnggcgtcgcggagcggtcgggcgcggcgggcgggnggtataggggggagcgcgttncggcggcgcgggggcgcgcgcgcgcgcgcgcgcgcgggcggcggtcggggggtcgcgcggaggacggcggcggcgggcgncggcgcgggcggggcgggtngcgggcgcgcgcga

SEQ ID NO: 27450 - DNA, 712 bp, Artificial Sequence
  chemically treated genomic DNA (Homo sapiens) CpG-island No: 27450
  misc_feature (15)..(15): n is either a, c, g or t
  misc_feature (35)..(35): n is either a, c, g or t
  misc_feature (115)..(115): n is either a, c, g or t
  misc_feature (136)..(136): n is either a, c, g or t
  misc_feature (170)..(170): n is either a, c, g or t
  misc_feature (184)..(184): n is either a, c, g or t
  misc_feature (186)..(186): n is either a, c, g or t
  misc_feature (212)..(212): n is either a, c, g or t
  misc_feature (258)..(258): n is either a, c, g or t
  misc_feature (302)..(302): n is either a, c, g or t
  misc_feature (305)..(305): n is either a, c, g or t
  misc_feature (472)..(472): n is either a, c, g or t
  misc_feature (499)..(499): n is either a, c, g or t
  misc_feature (679)..(680): n is either a, c, g or t
  misc_feature (701)..(701): n is either a, c, g or t
tcgcgcgcgcccgcnacccgccccgcccgcgccgncgcccgccgccgccgtcctccgcgcgaccccccgaccgccgcccgcgcgcgcgcgcgcgcgcgcgcccccgcgccgccgnaacgcgctcccccctataccncccgcccgccgcgcccgaccgctccgcgacgccnccgcccgccccgcncncgcccgctccgcgcgccgccgccgcnaccgcgcgcgccccgccgacccgccgcccgcgccgctccgcgccgncgctccgccccgccctcgccccccgcccgaaccgcccgcccgcncgnccgccccgccccccgcgcgccgtcccgccccgccgccccgaacccccccccgcgaccgcgcgccgaacccccccccccgcgcgcgccgcgaacccccgccgccgcgcgccccgccgacgccccgccccgcgccccgaacgccgaaccgccgccgccccgccccgacncgccgcgcccccgcgccgcgcgccgancccccgccccgcgaccgacgccccgcgcgcgcccgcccccgcgacgcccccgccgcgccgcgcccgccgcccccccgccgcgccgacgacgcccccgaaaccccgccccgcgacgaaacccccgccgaaccgcccgaacgcgcgaccccccgacccgcgaccccgccgccccccccccgnnccgaccccgcccccccgcccncccgcccccgc

SEQ ID NO: 27451 - DNA, 712 bp, Artificial Sequence
  chemically treated genomic DNA (Homo sapiens) CpG-island No: 27451
  misc_feature (15)..(15): n is either a, c, g or t
  misc_feature (35)..(35): n is either a, c, g or t
  misc_feature (115)..(115): n is either a, c, g or t
  misc_feature (136)..(136): n is either a, c, g or t
  misc_feature (170)..(170): n is either a, c, g or t
  misc_feature (184)..(184): n is either a, c, g or t
  misc_feature (186)..(186): n is either a, c, g or t
  misc_feature (212)..(212): n is either a, c, g or t
  misc_feature (258)..(258): n is either a, c, g or t
  misc_feature (302)..(302): n is either a, c, g or t
  misc_feature (305)..(305): n is either a, c, g or t
  misc_feature (472)..(472): n is either a, c, g or t
  misc_feature (499)..(499): n is either a, c, g or t
  misc_feature (679)..(680): n is either a, c, g or t
  misc_feature (701)..(701): n is either a, c, g or t
tcgcgcgcgttcgtngttcgtttcgttcgcgtcgncgttcgtcgtcgtcgtttttcgcgcggtttttcggtcgtcgttcgcgcgcgcgcgcgcgcgcgcgttttcgcgtcgtcgnggcgcgtttttttttgtgttnttcgttcgtcgcgttcggtcgtttcgcggcgttntcgttcgtttcgtntncgttcgtttcgcgcgtcgtcgtcgtngtcgcgcgcgtttcgtcggttcgtcgttcgcgtcgtttcgcgtcgncgtttcgtttcgttttcgtttttcgttcgggtcgttcgttcgtncgntcgtttcgtttttcgcgcgtcgtttcgtttcgtcgtttcgggttttttttcgcggtcgcgcgtcgggttttttttttcgcgcgcgtcgcgggttttcgtcgtcgcgcgtttcgtcggcgtttcgtttcgcgtttcgggcgtcgggtcgtcgtcgtttcgtttcggtncgtcgcgttttcgcgtcgcgcgtcggnttttcgtttcgcggtcggcgtttcgcgcgcgttcgttttcgcggcgttttcgtcgcgtcgcgttcgtcgttttttcgtcgcgtcggcggcgttttcggggtttcgtttcgcggcggggttttcgtcgggtcgttcgggcgcgcggtttttcggttcgcggtttcgtcgtttttttttcgnntcggtttcgttttttcgtttnttcgttttcgt

SEQ ID NO: 27452 - DNA, 712 bp, Artificial Sequence
  chemically treated genomic DNA (Homo sapiens) CpG-island No: 27452
  misc_feature (12)..(12): n is either a, c, g or t
  misc_feature (33)..(34): n is either a, c, g or t
  misc_feature (214)..(214): n is either a, c, g or t
  misc_feature (241)..(241): n is either a, c, g or t
  misc_feature (408)..(408): n is either a, c, g or t
  misc_feature (411)..(411): n is either a, c, g or t
  misc_feature (455)..(455): n is either a, c, g or t
  misc_feature (501)..(501): n is either a, c, g or t
  misc_feature (527)..(527): n is either a, c, g or t
  misc_feature (529)..(529): n is either a, c, g or t
  misc_feature (543)..(543): n is either a, c, g or t
  misc_feature (577)..(577): n is either a, c, g or t
  misc_feature (598)..(598): n is either a, c, g or t
  misc_feature (678)..(678): n is either a, c, g or t
  misc_feature (698)..(698): n is either a, c, g or t
acgaaaacgaanaaacgaaaaaacgaaaccganncgaaaaaaaaacgacgaaaccgcgaaccgaaaaaccgcgcgcccgaacgacccgacgaaaaccccgccgcgaaacgaaaccccgaaaacgccgccgacgcgacgaaaaaacgacgaacgcgacgcgacgaaaacgccgcgaaaacgaacgcgcgcgaaacgccgaccgcgaaacgaaaanccgacgcgcgacgcgaaaacgcgacgnaccgaaacgaaacgacgacgacccgacgcccgaaacgcgaaacgaaacgccgacgaaacgcgcgacgacgaaaacccgcgacgcgcgcgaaaaaaaaaacccgacgcgcgaccgcgaaaaaaaacccgaaacgacgaaacgaaacgacgcgcgaaaaacgaaacgancgnacgaacgaacgacccgaacgaaaaacgaaaacgaaacgaaacgncgacgcgaaacgacgcgaacgacgaaccgacgaaacgcgcgcgacnacgacgacgacgcgcgaaacgaacgnanacgaaacgaacganaacgccgcgaaacgaccgaacgcgacgaacgaanaacacaaaaaaaaacgcgccncgacgacgcgaaaacgcgcgcgcgcgcgcgcgcgcgaacgacgaccgaaaaaccgcgcgaaaaacgacgacgacgaacgncgacgcgaacgaaacgaacnacgaacgcgcgcga

SEQ ID NO: 27453 - DNA, 668 bp, Artificial Sequence
  chemically treated genomic DNA (Homo sapiens) CpG-island No: 27453
  misc_feature (29)..(29): n is either a, c, g or t
  misc_feature (71)..(71): n is either a, c, g or t
  misc_feature (74)..(74): n is either a, c, g or t
  misc_feature (80)..(80): n is either a, c, g or t
  misc_feature (120)..(120): n is either a, c, g or t
  misc_feature (131)..(131): n is either a, c, g or t
  misc_feature (219)..(219): n is either a, c, g or t
  misc_feature (232)..(232): n is either a, c, g or t
  misc_feature (260)..(260): n is either a, c, g or t
  misc_feature (318)..(318): n is either a, c, g or t
  misc_feature (429)..(429): n is either a, c, g or t
  misc_feature (463)..(464): n is either a, c, g or t
  misc_feature (471)..(472): n is either a, c, g or t
  misc_feature (493)..(494): n is either a, c, g or t
  misc_feature (547)..(548): n is either a, c, g or t
  misc_feature (557)..(557): n is either a, c, g or t
gcgtttcggcgcggcgcggggggcgcgtngtcgggggcgggtcggggttcgcgcggcggcgcgcggcgcgncgncgggtngggggggcggggggggcgggggcggttcgcgggcggtcgnggggggggggncgcgcgtcgtttcgcgttttcgggggggcgcgcgggcgtcgcggcgcgcggtcgggcgcgcgtcgcggggggtcgtcgcggtcggggncggcgcgggtttncgtcgggtcgcggcggggcgcgggcgtncggcgggcgcgcgtcggggcggcggggcgggtcggcgcggcgggcgcggcgcggcgtnggcggtcgcgcggggggtcgggcgcggcgggggttcggggcgcgggtcgggcgggcgtcgggacgaagaatagagaagaaagaatattttttttggggggggggggggatnaattttcgggggagaggagaaagaatattttttnngggcggnnggggcggttaagaatataatnncgcggggcggcggcgcggggggtcgcgcgggcgcggggggcgtaggcgggcgnngcgggcgtngcggcggcgcgcgtggggtgggcggcggcggggcggcgcggggtcggcgcggtcgggcgcgttcgtcgcggggcggggcggggcggggggtcgcgcgcggcggggcggcgt

SEQ ID NO: 27454 - DNA, 668 bp, Artificial Sequence
  chemically treated genomic DNA (Homo sapiens) CpG-island No: 27454
  misc_feature (112)..(112): n is either a, c, g or t
  misc_feature (121)..(122): n is either a, c, g or t
  misc_feature (175)..(176): n is either a, c, g or t
  misc_feature (197)..(198): n is either a, c, g or t
  misc_feature (205)..(206): n is either a, c, g or t
  misc_feature (240)..(240): n is either a, c, g or t
  misc_feature (351)..(351): n is either a, c, g or t
  misc_feature (409)..(409): n is either a, c, g or t
  misc_feature (437)..(437): n is either a, c, g or t
  misc_feature (450)..(450): n is either a, c, g or t
  misc_feature (538)..(538): n is either a, c, g or t
  misc_feature (549)..(549): n is either a, c, g or t
  misc_feature (589)..(589): n is either a, c, g or t
  misc_feature (595)..(595): n is either a, c, g or t
  misc_feature (598)..(598): n is either a, c, g or t
  misc_feature (640)..(640): n is either a, c, g or t
acgccgccccgccgcgcgcgaccccccgccccgccccgccccgcgacgaacgcgcccgaccgcgccgaccccgcgccgccccgccgccgcccaccccacgcgcgccgccgcnacgcccgcnncgcccgcctacgccccccgcgcccgcgcgaccccccgcgccgccgccccgcgnnattatattcttaaccgccccnnccgcccnnaaaaaatattctttctcctctcccccgaaaattnatccccccccccccccaaaaaaaatattctttcttctctattcttcgtcccgacgcccgcccgacccgcgccccgaacccccgccgcgcccgaccccccgcgcgaccgccnacgccgcgccgcgcccgccgcgccgacccgccccgccgccccgacgcgcgcccgccgnacgcccgcgccccgccgcgacccgacgnaaacccgcgccgnccccgaccgcgacgaccccccgcgacgcgcgcccgaccgcgcgccgcgacgcccgcgcgcccccccgaaaacgcgaaacgacgcgcgnccccccccccncgaccgcccgcgaaccgcccccgccccccccgcccccccnacccgncgncgcgccgcgcgccgccgcgcgaaccccgacccgcccccgacnacgcgccccccgcgccgcgccgaaacgc

SEQ ID NO: 27455 - DNA, 668 bp, Artificial Sequence
  chemically treated genomic DNA (Homo sapiens) CpG-island No: 27455
  misc_feature (112)..(112): n is either a, c, g or t
  misc_feature (121)..(122): n is either a, c, g or t
  misc_feature (175)..(176): n is either a, c, g or t
  misc_feature (197)..(198): n is either a, c, g or t
  misc_feature (205)..(206): n is either a, c, g or t
  misc_feature (240)..(240): n is either a, c, g or t
  misc_feature (351)..(351): n is either a, c, g or t
  misc_feature (409)..(409): n is either a, c, g or t
  misc_feature (437)..(437): n is either a, c, g or t
  misc_feature (450)..(450): n is either a, c, g or t
  misc_feature (538)..(538): n is either a, c, g or t
  misc_feature (549)..(549): n is either a, c, g or t
  misc_feature (589)..(589): n is either a, c, g or t
  misc_feature (595)..(595): n is either a, c, g or t
  misc_feature (598)..(598): n is either a, c, g or t
  misc_feature (640)..(640): n is either a, c, g or t
gcgtcgtttcgtcgcgcgcggtttttcgtttcgtttcgtttcgcggcgggcgcgttcggtcgcgtcggtttcgcgtcgtttcgtcgtcgtttattttacgcgcgtcgtcgtngcgttcgtnncgttcgtttgcgtttttcgcgttcgcgcggtttttcgcgtcgtcgtttcgcgnngttgtgtttttggtcgttttnntcgtttnnaaaaaatatttttttttttttttttcgggggttngtttttttttttttttaaaaaaaatatttttttttttttgtttttcgtttcggcgttcgttcggttcgcgtttcgggttttcgtcgcgttcggtttttcgcgcggtcgttngcgtcgcgtcgcgttcgtcgcgtcggttcgtttcgtcgtttcggcgcgcgttcgtcgngcgttcgcgtttcgtcgcggttcggcgngggttcgcgtcgntttcggtcgcggcggtttttcgcggcgcgcgttcggtcgcgcgtcgcggcgttcgcgcgttttttcgggggcgcggggcggcgcgcgnttttttttttncggtcgttcgcgggtcgttttcgtttttttcgtttttttngttcgncgncgcgtcgcgcgtcgtcgcgcgggtttcggttcgttttcggtngcgcgtttttcgcgtcgcgtcggggcgt

SEQ ID NO: 27456 - DNA, 668 bp, Artificial Sequence
  chemically treated genomic DNA (Homo sapiens) CpG-island No: 27456
  misc_feature (29)..(29): n is either a, c, g or t
  misc_feature (71)..(71): n is either a, c, g or t
  misc_feature (74)..(74): n is either a, c, g or t
  misc_feature (80)..(80): n is either a, c, g or t
  misc_feature (120)..(120): n is either a, c, g or t
  misc_feature (131)..(131): n is either a, c, g or t
  misc_feature (219)..(219): n is either a, c, g or t
  misc_feature (232)..(232): n is either a, c, g or t
  misc_feature (260)..(260): n is either a, c, g or t
  misc_feature (318)..(318): n is either a, c, g or t
  misc_feature (429)..(429): n is either a, c, g or t
  misc_feature (463)..(464): n is either a, c, g or t
  misc_feature (471)..(472): n is either a, c, g or t
  misc_feature (493)..(494): n is either a, c, g or t
  misc_feature (547)..(548): n is either a, c, g or t
  misc_feature (557)..(557): n is either a, c, g or t
acgccccgacgcgacgcgaaaaacgcgcnaccgaaaacgaaccgaaacccgcgcgacgacgcgcgacgcgncgncgaacnaaaaaaacgaaaaaaacgaaaacgacccgcgaacgaccgnaaaaaaaaaancgcgcgccgccccgcgcccccgaaaaaacgcgcgaacgccgcgacgcgcgaccgaacgcgcgccgcgaaaaaccgccgcgaccgaaancgacgcgaacccncgccgaaccgcgacgaaacgcgaacgcncgacgaacgcgcgccgaaacgacgaaacgaaccgacgcgacgaacgcgacgcgacgcnaacgaccgcgcgaaaaaccgaacgcgacgaaaacccgaaacgcgaaccgaacgaacgccgaaacgaaaaacaaaaaaaaaaaaatattttttttaaaaaaaaaaaaaaacnaacccccgaaaaaaaaaaaaaaaaatattttttnnaaacgannaaaacgaccaaaaacacaacnncgcgaaacgacgacgcgaaaaaccgcgcgaacgcgaaaaacgcaaacgaacgnnacgaacgcnacgacgacgcgcgtaaaataaacgacgacgaaacgacgcgaaaccgacgcgaccgaacgcgcccgccgcgaaacgaaacgaaacgaaaaaccgcgcgcgacgaaacgacgc

SEQ ID NO: 27457 - DNA, 630 bp, Artificial Sequence
  chemically treated genomic DNA (Homo sapiens) CpG-island No: 27457
  misc_feature (98)..(98): n is either a, c, g or t
  misc_feature (152)..(152): n is either a, c, g or t
  misc_feature (160)..(160): n is either a, c, g or t
  misc_feature (238)..(238): n is either a, c, g or t
  misc_feature (243)..(243): n is either a, c, g or t
  misc_feature (277)..(277): n is either a, c, g or t
  misc_feature (294)..(294): n is either a, c, g or t
  misc_feature (312)..(312): n is either a, c, g or t
  misc_feature (372)..(372): n is either a, c, g or t
  misc_feature (455)..(455): n is either a, c, g or t
  misc_feature (575)..(575): n is either a, c, g or t
  misc_feature (609)..(609): n is either a, c, g or t
  misc_feature (612)..(612): n is either a, c, g or t
  misc_feature (626)..(626): n is either a, c, g or t
cgcggcgtttttcgtcgttcgcgttcgcgcgcgcgggggttcgtcggtttcgtcgttcgttttcgcgcggcgggcgcgcgtcgtttttcgttcgcgtnttcgttcggcgcggcgtcgggcgttcgcggtcgggtttcgttcgttcgttcggntttttcgncggtttttcgttttcggcgtcggtcgtcgtttcgtttcgcgggttttcggttcggtttttcgtcggtcgttcgttcgntcggntcgcgcggggcgcgcgcgggcgcgtcggtttcgnttttttcgtttcgcgtngcgtcgcgcgcgcgtttncgtcgcgcgcgttcgcgcgcgcgcgttcgtagtttcgtcgcgcggcggtcgggtcggggngtcgtcgggcggcggtcgcggcgcgcgtcggggggaggggagcggcgcgcggcgcggcggcggcgcggttcggcgggtcgttngggggcgcggggcgcggttcgcggtcggggcggggttcggcggggcgtttttcgtcgggtacgtcgcgcgttttcgcgggcggcgcgcgcgggcgcggcgcgcggtcgtcgcgtcgcggngtcgggcgcgttcgcgcggtcgggcgcgcgtttnggntcggtcgggcgcgncggg

SEQ ID NO: 27458 - DNA, 630 bp, Artificial Sequence
  chemically treated genomic DNA (Homo sapiens) CpG-island No: 27458
  misc_feature (5)..(5): n is either a, c, g or t
  misc_feature (19)..(19): n is either a, c, g or t
  misc_feature (22)..(22): n is either a, c, g or t
  misc_feature (56)..(56): n is either a, c, g or t
  misc_feature (176)..(176): n is either a, c, g or t
  misc_feature (259)..(259): n is either a, c, g or t
  misc_feature (319)..(319): n is either a, c, g or t
  misc_feature (337)..(337): n is either a, c, g or t
  misc_feature (354)..(354): n is either a, c, g or t
  misc_feature (388)..(388): n is either a, c, g or t
  misc_feature (393)..(393): n is either a, c, g or t
  misc_feature (471)..(471): n is either a, c, g or t
  misc_feature (479)..(479): n is either a, c, g or t
  misc_feature (533)..(533): n is either a, c, g or t
cccgncgcgcccgaccganccnaaacgcgcgcccgaccgcgcgaacgcgcccgacnccgcgacgcgacgaccgcgcgccgcgcccgcgcgcgccgcccgcgaaaacgcgcgacgtacccgacgaaaaacgccccgccgaaccccgccccgaccgcgaaccgcgccccgcgcccccnaacgacccgccgaaccgcgccgccgccgcgccgcgcgccgctcccctccccccgacgcgcgccgcgaccgccgcccgacgacnccccgacccgaccgccgcgcgacgaaactacgaacgcgcgcgcgcgaacgcgcgcgacgnaaacgcgcgcgcgacgcnacgcgaaacgaaaaaancgaaaccgacgcgcccgcgcgcgccccgcgcganccgancgaacgaacgaccgacgaaaaaccgaaccgaaaacccgcgaaacgaaacgacgaccgacgccgaaaacgaaaaaccgncgaaaaanccgaacgaacgaacgaaacccgaccgcgaacgcccgacgccgcgccgaacgaanacgcgaacgaaaaacgacgcgcgcccgccgcgcgaaaacgaacgacgaaaccgacgaacccccgcgcgcgcgaacgcgaacgacgaaaaacgccgcg

SEQ ID NO: 27459 - DNA, 630 bp, Artificial Sequence
  chemically treated genomic DNA (Homo sapiens) CpG-island No: 27459
  misc_feature (5)..(5): n is either a, c, g or t
  misc_feature (19)..(19): n is either a, c, g or t
  misc_feature (22)..(22): n is either a, c, g or t
  misc_feature (56)..(56): n is either a, c, g or t
  misc_feature (176)..(176): n is either a, c, g or t
  misc_feature (259)..(259): n is either a, c, g or t
  misc_feature (319)..(319): n is either a, c, g or t
  misc_feature (337)..(337): n is either a, c, g or t
  misc_feature (354)..(354): n is either a, c, g or t
  misc_feature (388)..(388): n is either a, c, g or t
  misc_feature (393)..(393): n is either a, c, g or t
  misc_feature (471)..(471): n is either a, c, g or t
  misc_feature (479)..(479): n is either a, c, g or t
  misc_feature (533)..(533): n is either a, c, g or t
ttcgncgcgttcggtcggnttngggcgcgcgttcggtcgcgcgggcgcgttcggtntcgcggcgcggcggtcgcgcgtcgcgttcgcgcgcgtcgttcgcgggggcgcgcggcgtgttcggcggggggcgtttcgtcgggtttcgtttcggtcgcgggtcgcgtttcgcgtttttnggcggttcgtcgggtcgcgtcgtcgtcgcgtcgcgcgtcgttttttttttttcggcgcgcgtcgcggtcgtcgttcggcggtntttcggttcggtcgtcgcgcggcggggttgcgggcgcgcgcgcgcgggcgcgcgcggcgngggcgcgcgcgcggcgtngcgcggggcgggggggncggggtcggcgcgttcgcgcgcgtttcgcgcggntcggncgggcgggcggtcggcggggggtcgggtcgggggttcgcggggcggggcggcggtcggcgtcgggggcggggggtcgncggggggntcgggcgggcgggcggggttcggtcgcgggcgttcggcgtcgcgtcgggcgggngcgcgggcggggggcggcgcgcgttcgtcgcgcgggggcgggcggcggggtcggcgggttttcgcgcgcgcgggcgcgggcggcggggggcgtcgcg

SEQ ID NO: 27460 - DNA, 630 bp, Artificial Sequence
  chemically treated genomic DNA (Homo sapiens) CpG-island No: 27460
  misc_feature (98)..(98): n is either a, c, g or t
  misc_feature (152)..(152): n is either a, c, g or t
  misc_feature (160)..(160): n is either a, c, g or t
  misc_feature (238)..(238): n is either a, c, g or t
  misc_feature (243)..(243): n is either a, c, g or t
  misc_feature (277)..(277): n is either a, c, g or t
  misc_feature (294)..(294): n is either a, c, g or t
  misc_feature (312)..(312): n is either a, c, g or t
  misc_feature (372)..(372): n is either a, c, g or t
  misc_feature (455)..(455): n is either a, c, g or t
  misc_feature (575)..(575): n is either a, c, g or t
  misc_feature (609)..(609): n is either a, c, g or t
  misc_feature (612)..(612): n is either a, c, g or t
  misc_feature (626)..(626): n is either a, c, g or t
cgcgacgccccccgccgcccgcgcccgcgcgcgcgaaaacccgccgaccccgccgcccgcccccgcgcgacgaacgcgcgccgccccccgcccgcgcncccgcccgacgcgacgccgaacgcccgcgaccgaaccccgcccgcccgcccganccccccgncgaccccccgcccccgacgccgaccgccgccccgccccgcgaacccccgacccgaccccccgccgaccgcccgcccgnccganccgcgcgaaacgcgcgcgaacgcgccgaccccgncccccccgccccgcgcnacgccgcgcgcgcgcccncgccgcgcgcgcccgcgcgcgcgcgcccgcaaccccgccgcgcgacgaccgaaccgaaanaccgccgaacgacgaccgcgacgcgcgccgaaaaaaaaaaaacgacgcgcgacgcgacgacgacgcgacccgacgaaccgccnaaaaacgcgaaacgcgacccgcgaccgaaacgaaacccgacgaaacgccccccgccgaacacgccgcgcgcccccgcgaacgacgcgcgcgaacgcgacgcgcgaccgccgcgccgcganaccgaacgcgcccgcgcgaccgaacgcgcgcccnaanccgaccgaacgcgncgaa

SEQ ID NO: 27461 - DNA, 626 bp, Artificial Sequence
  chemically treated genomic DNA (Homo sapiens) CpG-island No: 27461
  misc_feature (1)..(1): n is either a, c, g or t
  misc_feature (6)..(7): n is either a, c, g or t
  misc_feature (128)..(128): n is either a, c, g or t
  misc_feature (270)..(270): n is either a, c, g or t
  misc_feature (349)..(349): n is either a, c, g or t
  misc_feature (376)..(376): n is either a, c, g or t
  misc_feature (569)..(569): n is either a, c, g or t
  misc_feature (619)..(619): n is either a, c, g or t
ncgcgnngggtcgtcgcgttcgtttcgcgggggggcgcgcggcgcgtcgcgcgtcggcggggtcgcgtcggggggcggcgggggtggtggcggtgtgcgtggtcgggcggtttcgcgttcgttcgcgngcgggcggggtcgcggttcggcggtcggcgggtcggtcgggcgtcggcgttcgcgcgcgcgcgcgggcgggcggcgcgtcgcgtcgggcggcggttcgtcgtcgcgcgtcggggtcgcgggcggtgtcgggtttcgtcgcgngcgggggtcggtcgtcggcgtcgcgtcgtcgcgtcggcgttcgcgggttcgcggcgtcgcggcgtcgggggcgtcggtncggggcgtcggtcgcgcggggcggggnggtcgcgggggcggggggcgggcgcgcggcgcgcgggggcgcggtcgggggtcgttcggggcggcggcggggcgggggcgcgggcgtcggcgcgggttcgcgtcggggggggcgcgtcggtcgtcgtcgcggggcggggggcgcggcgcggcgtcgcggtcggggcggcggggggtcggcgcgggcggcgggngggcgcggcggcggggcgttcggtcgtcgcgcgcgggggtcgggtagcgngaggtcg

SEQ ID NO: 27462 - DNA, 626 bp, Artificial Sequence
  chemically treated genomic DNA (Homo sapiens) CpG-island No: 27462
  misc_feature (8)..(8): n is either a, c, g or t
  misc_feature (58)..(58): n is either a, c, g or t
  misc_feature (251)..(251): n is either a, c, g or t
  misc_feature (278)..(278): n is either a, c, g or t
  misc_feature (357)..(357): n is either a, c, g or t
  misc_feature (499)..(499): n is either a, c, g or t
  misc_feature (620)..(621): n is either a, c, g or t
  misc_feature (626)..(626): n is either a, c, g or t
cgacctcncgctacccgacccccgcgcgcgacgaccgaacgccccgccgccgcgcccncccgccgcccgcgccgaccccccgccgccccgaccgcgacgccgcgccgcgccccccgccccgcgacgacgaccgacgcgccccccccgacgcgaacccgcgccgacgcccgcgcccccgccccgccgccgccccgaacgacccccgaccgcgcccccgcgcgccgcgcgcccgccccccgcccccgcgaccnccccgccccgcgcgaccgacgccccgnaccgacgcccccgacgccgcgacgccgcgaacccgcgaacgccgacgcgacgacgcgacgccgacgaccgacccccgcncgcgacgaaacccgacaccgcccgcgaccccgacgcgcgacgacgaaccgccgcccgacgcgacgcgccgcccgcccgcgcgcgcgcgcgaacgccgacgcccgaccgacccgccgaccgccgaaccgcgaccccgcccgcncgcgaacgaacgcgaaaccgcccgaccacgcacaccgccaccacccccgccgccccccgacgcgaccccgccgacgcgcgacgcgccgcgcgcccccccgcgaaacgaacgcgacgacccnncgcgn

SEQ ID NO: 27463 - DNA, 626 bp, Artificial Sequence
  chemically treated genomic DNA (Homo sapiens) CpG-island No: 27463
  misc_feature (8)..(8): n is either a, c, g or t
  misc_feature (58)..(58): n is either a, c, g or t
  misc_feature (251)..(251): n is either a, c, g or t
  misc_feature (278)..(278): n is either a, c, g or t
  misc_feature (357)..(357): n is either a, c, g or t
  misc_feature (499)..(499): n is either a, c, g or t
  misc_feature (620)..(621): n is either a, c, g or t
  misc_feature (626)..(626): n is either a, c, g or t
cgattttncgttgttcgattttcgcgcgcggcgatcgggcgtttcgtcgtcgcgtttnttcgtcgttcgcgtcggtttttcgtcgtttcggtcgcggcgtcgcgtcgcgtttttcgtttcgcggcggcgatcggcgcgtttttttcgacgcgggttcgcgtcggcgttcgcgttttcgtttcgtcgtcgtttcgagcggttttcggtcgcgttttcgcgcgtcgcgcgttcgtttttcgttttcgcggttntttcgtttcgcgcggtcggcgtttcgngtcggcgttttcggcgtcgcggcgtcgcgggttcgcgggcgtcggcgcggcggcgcggcgtcggcggtcggttttcgtncgcggcggggttcggtatcgttcgcggtttcggcgcgcggcggcgagtcgtcgttcggcgcggcgcgtcgttcgttcgcgcgcgcgcgcgggcgtcggcgttcggtcggttcgtcggtcgtcgggtcgcggtttcgttcgtncgcgggcgggcgcggggtcgttcggttacgtatatcgttattattttcgtcgtttttcggcgcggtttcgtcggcgcgcggcgcgtcgcgcgttttttcgcggggcgggcgcggcggtttnncgcgn

SEQ ID NO: 27464 - DNA, 626 bp, Artificial Sequence
  chemically treated genomic DNA (Homo sapiens) CpG-island No: 27464
  misc_feature (1)..(1): n is either a, c, g or t
  misc_feature (6)..(7): n is either a, c, g or t
  misc_feature (128)..(128): n is either a, c, g or t
  misc_feature (270)..(270): n is either a, c, g or t
  misc_feature (349)..(349): n is either a, c, g or t
  misc_feature (376)..(376): n is either a, c, g or t
  misc_feature (569)..(569): n is either a, c, g or t
  misc_feature (619)..(619): n is either a, c, g or t
ncgcgnnaaaccgccgcgcccgccccgcgaaaaaacgcgcgacgcgccgcgcgccgacgaaaccgcgccgaaaaacgacgaaaataataacgatatacgtaaccgaacgaccccgcgcccgcccgcgnacgaacgaaaccgcgacccgacgaccgacgaaccgaccgaacgccgacgcccgcgcgcgcgcgcgaacgaacgacgcgccgcgccgaacgacgactcgccgccgcgcgccgaaaccgcgaacgataccgaaccccgccgcgnacgaaaaccgaccgccgacgccgcgccgccgcgccgacgcccgcgaacccgcgacgccgcgacgccgaaaacgccgacncgaaacgccgaccgcgcgaaacgaaanaaccgcgaaaacgaaaaacgaacgcgcgacgcgcgaaaacgcgaccgaaaaccgctcgaaacgacgacgaaacgaaaacgcgaacgccgacgcgaacccgcgtcgaaaaaaacgcgccgatcgccgccgcgaaacgaaaaacgcgacgcgacgccgcgaccgaaacgacgaaaaaccgacgcgaacgacgaanaaacgcgacgacgaaacgcccgatcgccgcgcgcgaaaatcgaacaacgnaaaatcg

SEQ ID NO: 27465 - DNA, 527 bp, Artificial Sequence
  chemically treated genomic DNA (Homo sapiens) CpG-island No: 27465
gagttcgggtttttatatgaatcgtttagggtgtttttttcggagtagttgagggttttgtggtcgtcgtcgttggtttggcgtcgtttggtcggaggggcgattttcggggtttcgttggggggtaatacgcgtttttatgtatcgtaggagtcggtcgtcggtgtattggtcggggttgcgggtacgggcgttggttttcgtttgtttacgggaaaggggaatattacggcgggatttacgtattcggcggtcgggtgtgcgagttttgcgggtatggcggtttggcgcggtcgtatttcgtaggcgcgtcgtggcggggattcgtagtttggcgcggcggttttcgtgtattgggcggtggaatcgcggttggcggtttcggtcgtgttgtagtttttcgtttacggcgcgttttagtttttcgcgggcggagaagtcgttttatatgtagttttggaggatgatcgggttggggtgaggttatttagtttttttaggtcgaacgcgtttttttcggtcgggtt

SEQ ID NO: 27466 - DNA, 527 bp, Artificial Sequence
  chemically treated genomic DNA (Homo sapiens) CpG-island No: 27466
aacccgaccgaaaaaaacgcgttcgacctaaaaaaactaaataacctcaccccaacccgatcatcctccaaaactacatataaaacgacttctccgcccgcgaaaaactaaaacgcgccgtaaacgaaaaactacaacacgaccgaaaccgccaaccgcgattccaccgcccaatacacgaaaaccgccgcgccaaactacgaatccccgccacgacgcgcctacgaaatacgaccgcgccaaaccgccatacccgcaaaactcgcacacccgaccgccgaatacgtaaatcccgccgtaatattcccctttcccgtaaacaaacgaaaaccaacgcccgtacccgcaaccccgaccaatacaccgacgaccgactcctacgatacataaaaacgcgtattaccccccaacgaaaccccgaaaatcgcccctccgaccaaacgacgccaaaccaacgacgacgaccacaaaaccctcaactactccgaaaaaaacaccctaaacgattcatataaaaacccgaactc

SEQ ID NO: 27467 - DNA, 527 bp, Artificial Sequence
  chemically treated genomic DNA (Homo sapiens) CpG-island No: 27467
agttcggtcgaggaggacgcgttcggtttggggggattgggtggttttattttaattcggttattttttaggattgtatgtggagcggttttttcgttcgcgagaagttggagcgcgtcgtgagcgagaagttgtagtacggtcggggtcgttaatcgcggttttatcgtttagtatacgggagtcgtcgcgttagattgcgggttttcgttacggcgcgtttgcgggatgcggtcgcgttaggtcgttatgttcgtagagttcgtatattcggtcgtcgagtgcgtggatttcgtcgtggtatttttttttttcgtgaataagcgagagttagcgttcgtgttcgtagtttcggttagtgtatcggcggtcggtttttgcggtgtataggggcgcgtattgttttttagcggggtttcgggggtcgttttttcggttaggcggcgttagattagcggcggcgattataaggtttttagttatttcggagaggatattttgagcgatttatgtaaagattcgaattt

SEQ ID NO: 27468 - DNA, 527 bp, Artificial Sequence
  chemically treated genomic DNA (Homo sapiens) CpG-island No: 27468
aaattcgaatctttacataaatcgctcaaaatatcctctccgaaataactaaaaaccttataatcgccgccgctaatctaacgccgcctaaccgaaaaaacgacccccgaaaccccgctaaaaaacaatacgcgcccctatacaccgcaaaaaccgaccgccgatacactaaccgaaactacgaacacgaacgctaactctcgcttattcacgaaaaaaaaaaataccacgacgaaatccacgcactcgacgaccgaatatacgaactctacgaacataacgacctaacgcgaccgcatcccgcaaacgcgccgtaacgaaaacccgcaatctaacgcgacgactcccgtatactaaacgataaaaccgcgattaacgaccccgaccgtactacaacttctcgctcacgacgcgctccaacttctcgcgaacgaaaaaaccgctccacatacaatcctaaaaaataaccgaattaaaataaaaccacccaatccccccaaaccgaacgcgtcctcctcgaccgaact

SEQ ID NO: 27469 - DNA, 913 bp, Artificial Sequence
  chemically treated genomic DNA (Homo sapiens) CpG-island No: 27469
  misc_feature (202)..(202): n is either a, c, g or t
atgtcgggcggtaaggtttcgttattttggtcggtttcgggcggaggaagaagaggaggcgtttagattggatattcgtttggattcggagtcgcggtattatttttagttcgttttacgttcgttagttttagacggttcgggtttcggtttcgtttttttttttcgaaagttcggttttcggtgcggggattaaattttntttcgcgggttttaagtttcggtttttggtttcgtttttcgcgttttcgttttcgttttcgttttcgtttcgtttaggcgcgggattattttttcgtttcgaggcggggtttagcgcgttcggtattttcggcggttcgggtttttcgttattatcgtcgtcgtcgtcgtcgtgagtttcgcggagtcgcgcgcgttttcgttgggtcgagcgttggtcgacgagcggagttttaggagtttgcggagacgttatgcgagttaggtaggtaggcggcggcggggaggtttcgggcggtagagtttgggggtcggcgggggcgcggggtcgtgttcgggggttttgtaattttttgcgggcgtagatcgtgtcgcgggcgtcgatcgtgttatcgtcgtttgagttcgggttgcgcgggtgtttgggcgtggggcgtttcggggaagttttcgcgcgttttttcgtcggtttttttcgggcgttcgggtttttttggtgttggtgggtagggattcggttcggggtttcgggcgtcgagtcgtacgttcgcgtgcgttcgggtcgttttttaatttcggttttggttatttttcggcgggcggtttgcggggtggtttttttgggtaatcggacgcgttttcgggcgtaaatcggggggcgcgttcggtttacgggggcgtgggggttacgggagggcgtggaggggtcggg

SEQ ID NO: 27470 - DNA, 913 bp, Artificial Sequence
  chemically treated genomic DNA (Homo sapiens) CpG-island No: 27470
  misc_feature (712)..(712): n is either a, c, g or t
cccgacccctccacgccctcccgtaacccccacgcccccgtaaaccgaacgcgccccccgatttacgcccgaaaacgcgtccgattacccaaaaaaaccaccccgcaaaccgcccgccgaaaaataaccaaaaccgaaattaaaaaacgacccgaacgcacgcgaacgtacgactcgacgcccgaaaccccgaaccgaatccctacccaccaacaccaaaaaaacccgaacgcccgaaaaaaaccgacgaaaaaacgcgcgaaaacttccccgaaacgccccacgcccaaacacccgcgcaacccgaactcaaacgacgataacacgatcgacgcccgcgacacgatctacgcccgcaaaaaattacaaaacccccgaacacgaccccgcgcccccgccgacccccaaactctaccgcccgaaacctccccgccgccgcctacctacctaactcgcataacgtctccgcaaactcctaaaactccgctcgtcgaccaacgctcgacccaacgaaaacgcgcgcgactccgcgaaactcacgacgacgacgacgacgataataacgaaaaacccgaaccgccgaaaataccgaacgcgctaaaccccgcctcgaaacgaaaaaataatcccgcgcctaaacgaaacgaaaacgaaaacgaaaacgaaaacgcgaaaaacgaaaccaaaaaccgaaacttaaaacccgcgaaanaaaatttaatccccgcaccgaaaaccgaactttcgaaaaaaaaaaacgaaaccgaaacccgaaccgtctaaaactaacgaacgtaaaacgaactaaaaataataccgcgactccgaatccaaacgaatatccaatctaaacgcctcctcttcttcctccgcccgaaaccgaccaaaataacgaaaccttaccgcccgacat

SEQ ID NO: 27471 - DNA, 913 bp, Artificial Sequence
  chemically treated genomic DNA (Homo sapiens) CpG-island No: 27471
  misc_feature (712)..(712): n is either a, c, g or t
ttcgatttttttacgttttttcgtggtttttacgttttcgtgagtcgagcgcgtttttcgatttgcgttcgaggacgcgttcggttgtttagggaggttatttcgtaggtcgttcgtcgggaagtggttagagtcggggttggggggcggttcgagcgtacgcgagcgtgcggttcggcgttcggaatttcgggtcgggtttttgtttattagtattagggagattcgagcgttcgggaggagtcggcgagggggcgcgcgaaggttttttcgaagcgttttacgtttaggtattcgcgtagttcgaatttaggcggcggtggtacgatcggcgttcgcggtacgatttgcgttcgtaaggagttgtaaagttttcgagtacgatttcgcgttttcgtcggtttttaggttttgtcgttcgaggttttttcgtcgtcgtttgtttatttggttcgtatggcgttttcgtaggtttttgaggtttcgttcgtcggttagcgttcggtttagcgggggcgcgcgcggtttcgcgggatttacggcggcggcggcggcggtagtggcgaggggttcggatcgtcgagagtgtcgggcgcgttgggtttcgtttcgggacggaagggtggtttcgcgtttgggcggggcgggggcgggggcgggggcgggggcgcggggggcggggttaggaatcggaatttaaggttcgcggaanggggtttggttttcgtatcgggggtcgggttttcggggagaaggggcgggatcggggttcgggtcgtttgaggttggcgagcgtggggcgggttgggggtggtgtcgcggtttcgggtttaggcgggtatttagtttgggcgttttttttttttttttcgttcggagtcggttagggtagcggggttttgtcgttcggtat

SEQ ID NO: 27472 - DNA, 913 bp, Artificial Sequence
  chemically treated genomic DNA (Homo sapiens) CpG-island No: 27472
  misc_feature (202)..(202): n is either a, c, g or t
ataccgaacgacaaaaccccgctaccctaaccgactccgaacgaaaaaaaaaaaaaaaacgcccaaactaaatacccgcctaaacccgaaaccgcgacaccacccccaacccgccccacgctcgccaacctcaaacgacccgaaccccgatcccgccccttctccccgaaaacccgacccccgatacgaaaaccaaaccccnttccgcgaaccttaaattccgattcctaaccccgccccccgcgcccccgcccccgcccccgcccccgccccgcccaaacgcgaaaccacccttccgtcccgaaacgaaacccaacgcgcccgacactctcgacgatccgaacccctcgccactaccgccgccgccgccgccgtaaatcccgcgaaaccgcgcgcgcccccgctaaaccgaacgctaaccgacgaacgaaacctcaaaaacctacgaaaacgccatacgaaccaaataaacaaacgacgacgaaaaaacctcgaacgacaaaacctaaaaaccgacgaaaacgcgaaatcgtactcgaaaactttacaactccttacgaacgcaaatcgtaccgcgaacgccgatcgtaccaccgccgcctaaattcgaactacgcgaatacctaaacgtaaaacgcttcgaaaaaaccttcgcgcgccccctcgccgactcctcccgaacgctcgaatctccctaatactaataaacaaaaacccgacccgaaattccgaacgccgaaccgcacgctcgcgtacgctcgaaccgccccccaaccccgactctaaccacttcccgacgaacgacctacgaaataacctccctaaacaaccgaacgcgtcctcgaacgcaaatcgaaaaacgcgctcgactcacgaaaacgtaaaaaccacgaaaaaacgtaaaaaaatcgaa

SEQ ID NO: 27473 - DNA, 924 bp, Artificial Sequence
  chemically treated genomic DNA (Homo sapiens) CpG-island No: 27473
cgagcggttacggagagttttgtaggtatcgatttttattttttttatagtcgtttcgggtacgtagaagtcgtttttgtaaggtttcgggggaggttgatttgcggaaaacgtatcgatcgcggttttcgggagtttcgtttcgtttcggggatgttaagtcgtttttttatttcgtagcggcgtcggtcgtttagatttgtttattttcgtcgggttagtcgttttttttcgtcgcgtcgatcgaggtcgtcgtagttcgattttatttttttaggtagtcgaggtcgtcgttgtcgtagttcgggttcgttttttaaagtttgggggaggtaggagcgttgcggaggtggatcggcgttatttcgtattcgcgttttttttttttgtttttttttttttttttttcggttttcgttcgcggtttttgcggcgttagagatttagtcgatttagtcgttcgcgtttaggttcgtttatcgcgtcgcgcgtggtttttgtaggtcgcgtttcgtttcggttcgtttcgttttcggtcgtttcgttatcgttttttttcggtgttttttttcggttgtagttggtcgttagcgtttgtcgggtgttagtttcgggtttagtttgggttggtggtaggtcgggagagggcgcggttttttagtttttgcgtagattgcggggtattaggtggggtcgaggcgacgtcgaacgtcggtaggtcggaaatcgcgtagtttcgttggatttcgttgattgtcggcggtatcggtggtttcgcgattttgaataggtgattttaatagttttaggagggtagcgagtttttcgcggaattattagataagttatgtttgaggttgtcgtagtttagtgggtagtcgtgaaatgtagatgcgtttttgttttttagatagtattttttat

SEQ ID NO: 27474 - DNA, 924 bp, Artificial Sequence
  chemically treated genomic DNA (Homo sapiens) CpG-island No: 27474
ataaaaaatactatctaaaaaacaaaaacgcatctacatttcacgactacccactaaactacgacaacctcaaacataacttatctaataattccgcgaaaaactcgctaccctcctaaaactattaaaatcacctattcaaaatcgcgaaaccaccgataccgccgacaatcaacgaaatccaacgaaactacgcgatttccgacctaccgacgttcgacgtcgcctcgaccccacctaataccccgcaatctacgcaaaaactaaaaaaccgcgccctctcccgacctaccaccaacccaaactaaacccgaaactaacacccgacaaacgctaacgaccaactacaaccgaaaaaaaacaccgaaaaaaaacgataacgaaacgaccgaaaacgaaacgaaccgaaacgaaacgcgacctacaaaaaccacgcgcgacgcgataaacgaacctaaacgcgaacgactaaatcgactaaatctctaacgccgcaaaaaccgcgaacgaaaaccgaaaaaaaaaaaaaaaaaaacaaaaaaaaaaaacgcgaatacgaaataacgccgatccacctccgcaacgctcctacctcccccaaactttaaaaaacgaacccgaactacgacaacgacgacctcgactacctaaaaaaataaaatcgaactacgacgacctcgatcgacgcgacgaaaaaaaacgactaacccgacgaaaataaacaaatctaaacgaccgacgccgctacgaaataaaaaaacgacttaacatccccgaaacgaaacgaaactcccgaaaaccgcgatcgatacgttttccgcaaatcaacctcccccgaaaccttacaaaaacgacttctacgtacccgaaacgactataaaaaaaataaaaatcgatacctacaaaactctccgtaaccgctcg

SEQ ID NO: 27475 - DNA, 924 bp, Artificial Sequence
  chemically treated genomic DNA (Homo sapiens) CpG-island No: 27475
atgaaagatgttatttgaggggtaaaggcgtatttgtattttacgattatttattaggttacgatagttttaagtatggtttatttggtagtttcgcgaagggttcgttgtttttttggagttattggagttatttgtttaaggtcgcgaaattatcggtgtcgtcggtaattagcgaggtttagcggggttgcgcggttttcggtttgtcggcgttcggcgtcgtttcggttttatttggtgtttcgtaatttgcgtaaaggttgggagatcgcgttttttttcgatttattattagtttaagttgggttcggaattaatattcgataagcgttggcggttagttgtagtcgggaaggagtatcggaaggaggcggtggcggggcggtcgagggcggagcgggtcggggcggggcgcggtttataaaagttacgcgcggcgcggtgggcgggtttgggcgcgagcggttgagtcggttgggtttttggcgtcgtagaggtcgcgggcgaggatcgggaggggagagggaggagataggaggaggagacgcgagtgcggggtggcgtcggtttattttcgtagcgtttttgttttttttaggttttggaaggcgggttcgggttgcggtagcggcggtttcggttgtttggggaggtgaagtcgggttgcggcggtttcggtcggcgcggcggagggaggcggttgattcggcgagggtgggtaggtttgggcggtcggcgtcgttgcgaggtggaggggcggtttggtattttcggggcggggcggggttttcgagggtcgcggtcggtgcgtttttcgtaggttagtttttttcggggttttgtagaagcggtttttgcgtattcggggcggttgtgggaagggtgggggtcggtgtttgtagggtttttcgtggtcgttcg

SEQ ID NO: 27476 - DNA, 924 bp, Artificial Sequence
  chemically treated genomic DNA (Homo sapiens) CpG-island No: 27476
cgaacgaccacgaaaaaccctacaaacaccgacccccacccttcccacaaccgccccgaatacgcaaaaaccgcttctacaaaaccccgaaaaaaactaacctacgaaaaacgcaccgaccgcgaccctcgaaaaccccgccccgccccgaaaataccaaaccgcccctccacctcgcaacgacgccgaccgcccaaacctacccaccctcgccgaatcaaccgcctccctccgccgcgccgaccgaaaccgccgcaacccgacttcacctccccaaacaaccgaaaccgccgctaccgcaacccgaacccgccttccaaaacctaaaaaaaacaaaaacgctacgaaaataaaccgacgccaccccgcactcgcgtctcctcctcctatctcctccctctcccctcccgatcctcgcccgcgacctctacgacgccaaaaacccaaccgactcaaccgctcgcgcccaaacccgcccaccgcgccgcgcgtaacttttataaaccgcgccccgccccgacccgctccgccctcgaccgccccgccaccgcctccttccgatactccttcccgactacaactaaccgccaacgcttatcgaatattaattccgaacccaacttaaactaataataaatcgaaaaaaaacgcgatctcccaacctttacgcaaattacgaaacaccaaataaaaccgaaacgacgccgaacgccgacaaaccgaaaaccgcgcaaccccgctaaacctcgctaattaccgacgacaccgataatttcgcgaccttaaacaaataactccaataactccaaaaaaacaacgaacccttcgcgaaactaccaaataaaccatacttaaaactatcgtaacctaataaataatcgtaaaatacaaatacgcctttacccctcaaataacatctttcat

SEQ ID NO: 27477 - DNA, 1291 bp, Artificial Sequence
  chemically treated genomic DNA (Homo sapiens) CpG-island No: 27477
  misc_feature (312)..(312): n is either a, c, g or t
  misc_feature (333)..(333): n is either a, c, g or t
  misc_feature (730)..(730): n is either a, c, g or t
  misc_feature (840)..(840): n is either a, c, g or t
  misc_feature (1131)..(1131): n is either a, c, g or t
  misc_feature (1168)..(1168): n is either a, c, g or t
  misc_feature (1206)..(1206): n is either a, c, g or t
  misc_feature (1285)..(1285): n is either a, c, g or t
cgagagcgagagagaaatagggagggagagagggagggaggaaggaacggacggtatttttttttttaaaaaaaacgattcgttcgtcgtattttttaaaaataatagattacggcgtttcgtttttattatattaataatatatcgcgggcgtttttttgtcggattttattaaaaagaaatagtatgcggcggcgtcgttacgtttcgtattataatatatttacgtatacggcgcgcgtttcgttcgttttatttgtattaattataataaattatcgtattgtcgttcgttttttttgcgtttttttnatattaaatatcgttatttanattcgtacgtttatacgtaatttattttttttttgttgattatattaattaatcgcgattacgaatattacgttaatcgtttcgtttattattatacgttttatttttacgacggcgacgcgttacgcgtttattagttacgtttttacgttatttatttttatattacgacgtacgcgttttacggcgtcgtatattttttttttcgcgtttttatttttttaatattatattattgtattatatcgtttacgtcgtcggtatattttcgtttttttatttttatataagaattacgatatatattaacgttaattattcgatcgtttttttattattatacgttcgttattttttatattatcgtacgataagaatatttgcgtcgcgtcgtcgngttttttattttatggtatcgtttttattatattatatattaaaaatatatattattacgttgcgtacgtatatcgcgcgcggggttcgtattttgtatatatatatganagatatatttatcgataggtgttacggattcgcgtatcgattttatacgttttatttatatataaattataatatacgagaattcgacgcgtatcgcgatttcgcggcgtcgtcgattatatttattttatttttatttatatcgtttatttatttttatagttcgttttcgtatattgcgtatcgcgtttttattatattttttatttatgtatatgatttacgttttataatcgacgtttacgcgcgggagatttacgttcgcgtatcggttacgttatttttttatantggattattatttataaaatattattttcgcggtgangcgtttcgtttttgttttatgtattacgatttttttantttatttttaatatttttaatattgttttttcgcgtatattacgtattacgtttcgtattacgatcgtcgttttatatntatttt

SEQ ID NO: 27478 - DNA, 1291 bp, Artificial Sequence
  chemically treated genomic DNA (Homo sapiens) CpG-island No: 27478
  misc_feature (7)..(7): n is either a, c, g or t
  misc_feature (86)..(86): n is either a, c, g or t
  misc_feature (124)..(124): n is either a, c, g or t
  misc_feature (161)..(161): n is either a, c, g or t
  misc_feature (452)..(452): n is either a, c, g or t
  misc_feature (562)..(562): n is either a, c, g or t
  misc_feature (959)..(959): n is either a, c, g or t
  misc_feature (980)..(980): n is either a, c, g or t
aaaatanatataaaacgacgatcgtaatacgaaacgtaatacgtaatatacgcgaaaaaacaatattaaaaatattaaaaataaantaaaaaaatcgtaatacataaaacaaaaacgaaacgcntcaccgcgaaaataatattttataaataataatccantataaaaaaataacgtaaccgatacgcgaacgtaaatctcccgcgcgtaaacgtcgattataaaacgtaaatcatatacataaataaaaaatataataaaaacgcgatacgcaatatacgaaaacgaactataaaaataaataaacgatataaataaaaataaaataaatataatcgacgacgccgcgaaatcgcgatacgcgtcgaattctcgtatattataatttatatataaataaaacgtataaaatcgatacgcgaatccgtaacacctatcgataaatatatctntcatatatatatacaaaatacgaaccccgcgcgcgatatacgtacgcaacgtaataatatatatttttaatatataatataataaaaacgataccataaaataaaaaacncgacgacgcgacgcaaatattcttatcgtacgataatataaaaaataacgaacgtataataataaaaaaacgatcgaataattaacgttaatatatatcgtaattcttatataaaaataaaaaaacgaaaatataccgacgacgtaaacgatataatacaataatataatattaaaaaaataaaaacgcgaaaaaaaaaatatacgacgccgtaaaacgcgtacgtcgtaatataaaaataaataacgtaaaaacgtaactaataaacgcgtaacgcgtcgccgtcgtaaaaataaaacgtataataataaacgaaacgattaacgtaatattcgtaatcgcgattaattaatataatcaacaaaaaaaaaataaattacgtataaacgtacgaatntaaataacgatatttaatatnaaaaaaacgcaaaaaaaacgaacgacaatacgataatttattataattaatacaaataaaacgaacgaaacgcgcgccgtatacgtaaatatattataatacgaaacgtaacgacgccgccgcatactatttctttttaataaaatccgacaaaaaaacgcccgcgatatattattaatataataaaaacgaaacgccgtaatctattatttttaaaaaatacgacgaacgaatcgttttttttaaaaaaaaaaataccgtccgttccttcctccctccctctctccctccctatttctctctcgctctcg

SEQ ID NO: 27479 - DNA, 1291 bp, Artificial Sequence
  chemically treated genomic DNA (Homo sapiens) CpG-island No: 27479
  misc_feature (7)..(7): n is either a, c, g or t
  misc_feature (86)..(86): n is either a, c, g or t
  misc_feature (124)..(124): n is either a, c, g or t
  misc_feature (161)..(161): n is either a, c, g or t
  misc_feature (452)..(452): n is either a, c, g or t
  misc_feature (562)..(562): n is either a, c, g or t
  misc_feature (959)..(959): n is either a, c, g or t
  misc_feature (980)..(980): n is either a, c, g or t
aaagtanatgtgaaacgacggtcgtggtgcggggcgtagtgcgtagtatacgcggaggagtagtgttagaggtgttgaggatgagntagaggaatcgtagtgtatgagataggggcggggcgtnttatcgcgaggatagtgttttatggatggtagtttantgtagagagatgacgtggtcgatgcgcgggcgtggatttttcgcgcgtgagcgtcgattatagggcgtaagttatatgtatgggtagggagtgtggtgagaacgcggtacgtaatgtgcgagggcgagttgtggggatgagtgagcggtgtggatagggatggagtgggtgtggtcggcgacgtcgcggagtcgcgatgcgcgtcgggttttcgtgtgttgtagtttgtatgtgggtggagcgtgtggagtcggtgcgcgagttcgtggtatttgtcggtgagtgtatttnttatgtgtatgtgtagagtgcggatttcgcgcgcggtgtgcgtgcgtagcgtggtagtgtgtgtttttagtatgtgatgtgatgaggacgatgttataggatggagagtncggcggcgcggcgtaggtgtttttgtcgtgcgatagtataagaggtagcgagcgtatagtggtggaggagcggtcgagtagttagcgttggtgtgtgtcgtggtttttgtgtggggataagaggacgggagtgtgtcggcgacgtgagcgatgtggtgtagtagtgtaatattgggaggatagggacgcgaggaagagagtgtgcgacgtcgtagagcgcgtgcgtcgtggtgtggagataggtgacgtgagagcgtggttagtgggcgcgtggcgcgtcgtcgtcgtggaagtgagacgtatgatagtgagcgaggcggttggcgtggtgttcgtggtcgcgattggttgatatggttagtagggggagagtgagttgcgtgtgggcgtgcggatntagatgacggtatttagtatnggggggacgtaggaggagcgagcggtagtacggtgatttgttgtggttggtataggtggagcggacggagcgcgcgtcgtgtgcgtaggtgtgttatagtgcgggacgtggcggcgtcgtcgtatgttgtttttttttagtagaattcggtaggggggcgttcgcggtgtgttgttgatgtggtgggggcggggcgtcgtggtttgttgtttttggggggtgcggcgggcggatcgttttttttgggggggggggtgtcgttcgtttttttttttttttttttttttttttttgtttttttttcgttttcg

SEQ ID NO: 27480 - DNA, 1291 bp, Artificial Sequence
  chemically treated genomic DNA (Homo sapiens) CpG-island No: 27480
  misc_feature (312)..(312): n is either a, c, g or t
  misc_feature (333)..(333): n is either a, c, g or t
  misc_feature (730)..(730): n is either a, c, g or t
  misc_feature (840)..(840): n is either a, c, g or t
  misc_feature (1131)..(1131): n is either a, c, g or t
  misc_feature (1168)..(1168): n is either a, c, g or t
  misc_feature (1206)..(1206): n is either a, c, g or t
  misc_feature (1285)..(1285): n is either a, c, g or t
cgaaaacgaaaaaaaaacaaaaaaaaaaaaaaaaaaaaaaaaaaaaacgaacgacacccccccccccaaaaaaaacgatccgcccgccgcaccccccaaaaacaacaaaccacgacgccccgcccccaccacatcaacaacacaccgcgaacgcccccctaccgaattctactaaaaaaaaacaacatacgacgacgccgccacgtcccgcactataacacacctacgcacacgacgcgcgctccgtccgctccacctataccaaccacaacaaatcaccgtactaccgctcgctcctcctacgtccccccnatactaaataccgtcatctanatccgcacgcccacacgcaactcactctccccctactaaccatatcaaccaatcgcgaccacgaacaccacgccaaccgcctcgctcactatcatacgtctcacttccacgacgacgacgcgccacgcgcccactaaccacgctctcacgtcacctatctccacaccacgacgcacgcgctctacgacgtcgcacactctcttcctcgcgtccctatcctcccaatattacactactacaccacatcgctcacgtcgccgacacactcccgtcctcttatccccacacaaaaaccacgacacacaccaacgctaactactcgaccgctcctccaccactatacgctcgctacctcttatactatcgcacgacaaaaacacctacgccgcgccgccgnactctccatcctataacatcgtcctcatcacatcacatactaaaaacacacactaccacgctacgcacgcacaccgcgcgcgaaatccgcactctacacatacacataanaaatacactcaccgacaaataccacgaactcgcgcaccgactccacacgctccacccacatacaaactacaacacacgaaaacccgacgcgcatcgcgactccgcgacgtcgccgaccacacccactccatccctatccacaccgctcactcatccccacaactcgccctcgcacattacgtaccgcgttctcaccacactccctacccatacatataacttacgccctataatcgacgctcacgcgcgaaaaatccacgcccgcgcatcgaccacgtcatctctctacantaaactaccatccataaaacactatcctcgcgataanacgccccgcccctatctcatacactacgattcctctanctcatcctcaacacctctaacactactcctccgcgtatactacgcactacgccccgcaccacgaccgtcgtttcacatntacttt

SEQ ID NO: 27481 - DNA, 933 bp, Artificial Sequence
  chemically treated genomic DNA (Homo sapiens) CpG-island No: 27481
gaacgattatggggtcgtattgtttttttttttataggcgagaaaacgaagttatttttttaaggttacggaggttgttaggttttaggcgtcgcgtttttacgtatttttggtcgattgacgttgggcgggcgcggtcgaaagaggtttcgtttcgtacgcgtggtgcggtttaggtagttttattcgcgcggggtcggggcgggggttttggaagttgcgtagtcggtgtgggtttcgcgcgttcgggtggtgaggttcgcggacggtttttttgtatcgggtcggagaggggtcgcggtaggcggcgcgcgggtcgtagtcgtatcgcgagtttgggttgtagcgggagcgacgcgtcggtcgtcgggtgggggtggagtttcgtcgcggttttaggtaacgtcgggttcggattttgcgtcgagcgtttcgggcgtagggtcggcgagtacgcggcggtagggggcggtcgcgggtcggcggaggaacgtacgcggggttttttcgttaggtttttgtcggcgttcgtacggcgggagttcgtagtttcgggttcggtagcgggagttgcgtcgttttttttttcgttcgttaggtttaaacgttttaattcggggagtttcggggaatttcgagttttcgcgtgttttgcgtttcgcgtacgtttcgatcgttattttcggcgagttttagttgcggttgggatttaggcgttcggtatcgcgagtcggagacgcgttgtagttttttggtttcgttatgttcgttttaaatattttttcgacgttttttgtgtcggtcgtcggggagttagagcggtttaagttttgttttggagcggttgtaggttcggggaatagatcgttgtattttagcgtcgtttttattgtattttggatgtcggaacgttgcggggttcggagagagttt

SEQ ID NO: 27482 - DNA, 933 bp, Artificial Sequence
  chemically treated genomic DNA (Homo sapiens) CpG-island No: 27482
aaactctctccgaaccccgcaacgttccgacatccaaaatacaataaaaacgacgctaaaatacaacgatctattccccgaacctacaaccgctccaaaacaaaacttaaaccgctctaactccccgacgaccgacacaaaaaacgtcgaaaaaatatttaaaacgaacataacgaaaccaaaaaactacaacgcgtctccgactcgcgataccgaacgcctaaatcccaaccgcaactaaaactcgccgaaaataacgatcgaaacgtacgcgaaacgcaaaacacgcgaaaactcgaaattccccgaaactccccgaattaaaacgtttaaacctaacgaacgaaaaaaaaaacgacgcaactcccgctaccgaacccgaaactacgaactcccgccgtacgaacgccgacaaaaacctaacgaaaaaaccccgcgtacgttcctccgccgacccgcgaccgccccctaccgccgcgtactcgccgaccctacgcccgaaacgctcgacgcaaaatccgaacccgacgttacctaaaaccgcgacgaaactccacccccacccgacgaccgacgcgtcgctcccgctacaacccaaactcgcgatacgactacgacccgcgcgccgcctaccgcgacccctctccgacccgatacaaaaaaaccgtccgcgaacctcaccacccgaacgcgcgaaacccacaccgactacgcaacttccaaaacccccgccccgaccccgcgcgaataaaactacctaaaccgcaccacgcgtacgaaacgaaacctctttcgaccgcgcccgcccaacgtcaatcgaccaaaaatacgtaaaaacgcgacgcctaaaacctaacaacctccgtaaccttaaaaaaataacttcgttttctcgcctataaaaaaaaaaacaatacgaccccataatcgttc

SEQ ID NO: 27483 - DNA, 933 bp, Artificial Sequence
  chemically treated genomic DNA (Homo sapiens) CpG-island No: 27483
ggatttttttcggatttcgtagcgtttcgatatttagaatgtagtaaggacggcgttgaagtgtagcggtttgtttttcggatttgtagtcgttttagggtagggtttaggtcgttttggtttttcggcggtcggtatagggggcgtcggggaaatgtttaggacggatatggcgaggttaaagaattgtagcgcgttttcggttcgcggtgtcggacgtttgggttttagtcgtagttgggattcgtcgggggtggcggtcgggacgtgcgcggggcgtagggtacgcgggggttcggagtttttcggggtttttcgagttggggcgtttggatttagcggacggggagaagagcggcgtagttttcgttgtcgggttcgggattgcgagttttcgtcgtgcgggcgtcggtagaggtttggcgggaagatttcgcgtgcgttttttcgtcggttcgcggtcgttttttatcgtcgcgtgttcgtcggttttgcgttcggggcgttcggcgtagggttcgggttcggcgttatttggggtcgcggcggggttttatttttattcggcggtcggcgcgtcgttttcgttgtagtttaggttcgcggtgcggttgcggttcgcgcgtcgtttgtcgcggttttttttcggttcggtgtaggggaatcgttcgcggattttattattcgggcgcgcggggtttatatcggttgcgtagtttttaggattttcgtttcggtttcgcgcgaatggagttgtttggatcgtattacgcgtgcggggcggagtttttttcggtcgcgttcgtttagcgttagtcggttaggggtgcgtaagggcgcggcgtttggggtttggtagttttcgtgattttggaggagtgatttcgttttttcgtttgtgaaaagggaaataatacgattttatggtcgttt

SEQ ID NO: 27484 - DNA, 933 bp, Artificial Sequence
  chemically treated genomic DNA (Homo sapiens) CpG-island No: 27484
aaacgaccataaaatcgtattatttcccttttcacaaacgaaaaaacgaaatcactcctccaaaatcacgaaaactaccaaaccccaaacgccgcgcccttacgcacccctaaccgactaacgctaaacgaacgcgaccgaaaaaaactccgccccgcacgcgtaatacgatccaaacaactccattcgcgcgaaaccgaaacgaaaatcctaaaaactacgcaaccgatataaaccccgcgcgcccgaataataaaatccgcgaacgattcccctacaccgaaccgaaaaaaaaccgcgacaaacgacgcgcgaaccgcaaccgcaccgcgaacctaaactacaacgaaaacgacgcgccgaccgccgaataaaaataaaaccccgccgcgaccccaaataacgccgaacccgaaccctacgccgaacgccccgaacgcaaaaccgacgaacacgcgacgataaaaaacgaccgcgaaccgacgaaaaaacgcacgcgaaatcttcccgccaaacctctaccgacgcccgcacgacgaaaactcgcaatcccgaacccgacaacgaaaactacgccgctcttctccccgtccgctaaatccaaacgccccaactcgaaaaaccccgaaaaactccgaacccccgcgtaccctacgccccgcgcacgtcccgaccgccacccccgacgaatcccaactacgactaaaacccaaacgtccgacaccgcgaaccgaaaacgcgctacaattctttaacctcgccatatccgtcctaaacatttccccgacgccccctataccgaccgccgaaaaaccaaaacgacctaaaccctaccctaaaacgactacaaatccgaaaaacaaaccgctacacttcaacgccgtccttactacattctaaatatcgaaacgctacgaaatccgaaaaaaatcc

SEQ ID NO: 27485 - DNA, 502 bp, Artificial Sequence
  chemically treated genomic DNA (Homo sapiens) CpG-island No: 27485
aattcgcgttttgttgtttggatatacgttaacgttattagaagcgttggtgtaaaattttcgtttgttacgaagtttggtcgtcgttttgatcggcgtaagtttggcgttcgcgggtacgttgttgtaaattttgatttataatttaatggttttttttttattgttcggtattaatagcggcgcggcgttggttatggcgtttattagcgcgttgagttcgacgtcgattgtaggttattttttgttatttatcgcggtatgcgggggcggcgtgagttggttgttggttatgatcgtaggaggcggatttcgttatatttatgatagaaataaattgattttcgcgggtatcgcgttgtcggttttttgtatgggttttattcgtattattttgttgttggtcgaagattatgtttacggtattttttattggttggtaggcggagtgttttacgttcgttggtaggatgtttgatagtttttgtcggtggtggttatt

SEQ ID NO: 27486 - DNA, 502 bp, Artificial Sequence
  chemically treated genomic DNA (Homo sapiens) CpG-island No: 27486
aataaccaccaccgacaaaaactatcaaacatcctaccaacgaacgtaaaacactccgcctaccaaccaataaaaaataccgtaaacataatcttcgaccaacaacaaaataatacgaataaaacccatacaaaaaaccgacaacgcgatacccgcgaaaatcaatttatttctatcataaatataacgaaatccgcctcctacgatcataaccaacaaccaactcacgccgcccccgcataccgcgataaataacaaaaaataacctacaatcgacgtcgaactcaacgcgctaataaacgccataaccaacgccgcgccgctattaataccgaacaataaaaaaaaaaccattaaattataaatcaaaatttacaacaacgtacccgcgaacgccaaacttacgccgatcaaaacgacgaccaaacttcgtaacaaacgaaaattttacaccaacgcttctaataacgttaacgtatatccaaacaacaaaacgcgaatt

SEQ ID NO: 27487 - DNA, 502 bp, Artificial Sequence
  chemically treated genomic DNA (Homo sapiens) CpG-island No: 27487
agtgattattatcggtaagagttgttagatattttgttagcgggcgtgggatatttcgtttgttagttagtaaaagatgtcgtaagtatgattttcggttagtagtagggtgatgcgggtaaggtttatataaaaggtcgatagcgcgatattcgcgaggattagtttgtttttgttatgggtatgacgaaattcgttttttgcggttatgattagtagttagtttacgtcgttttcgtatgtcgcgatgaatgatagagaatagtttgtaatcggcgtcggatttagcgcgttggtaagcgttatagttagcgtcgcgtcgttgttaatgtcgagtagtgaaggagaggttattgggttgtgggttagggtttgtagtagcgtgttcgcgagcgttaggtttgcgtcgattagaacggcgattaggtttcgtggtaaacgaaggttttgtattagcgtttttggtagcgttggcgtgtgtttaggtagtagggcgcgggtt

SEQ ID NO: 27488 - DNA, 502 bp, Artificial Sequence
  chemically treated genomic DNA (Homo sapiens) CpG-island No: 27488
aacccgcgccctactacctaaacacacgccaacgctaccaaaaacgctaatacaaaaccttcgtttaccacgaaacctaatcgccgttctaatcgacgcaaacctaacgctcgcgaacacgctactacaaaccctaacccacaacccaataacctctccttcactactcgacattaacaacgacgcgacgctaactataacgcttaccaacgcgctaaatccgacgccgattacaaactattctctatcattcatcgcgacatacgaaaacgacgtaaactaactactaatcataaccgcaaaaaacgaatttcgtcatacccataacaaaaacaaactaatcctcgcgaatatcgcgctatcgaccttttatataaaccttacccgcatcaccctactactaaccgaaaatcatacttacgacatcttttactaactaacaaacgaaatatcccacgcccgctaacaaaatatctaacaactcttaccgataataatcact

SEQ ID NO: 27489 - DNA, 539 bp, Artificial Sequence
  chemically treated genomic DNA (Homo sapiens) CpG-island No: 27489
attcgtcgtaggtttttattcgtgattatatttttgatatttatgatgaaaatggtaaagtatcgttgttgtcggtattcggcggtaacgttgattatttatcgaaaattggcggaatatgcgttggaaaaattaacgtcgtattattacgggtattggttcggatatggacgaaagagagtgtgttatcgggtggcgttattgaaggcgatcgcgacgattatgtcgttcgtttgcgtcgacgttattcgtttttgattgaatcgttggcgcgttattacgttcgtatttacggtagtaatagcgagttgttgttcggtaatgcgggaacggtaagcgatttcggggaagatttcggttatgagttttacgaagcggagttgaaatatttggtgggatttacgatatgggttcgtacgcgtcgatagacgttttgtggcgtcgtataaaataaggtatgtggttaaatgcggattaataatttcgtgtgagttagtggttggtggagtatacgtagtagaggttatcgttggcgtcgt

SEQ ID NO: 27490 - DNA, 539 bp, Artificial Sequence
  chemically treated genomic DNA (Homo sapiens) CpG-island No: 27490
acgacgccaacgataacctctactacgtatactccaccaaccactaactcacacgaaattattaatccgcatttaaccacataccttattttatacgacgccacaaaacgtctatcgacgcgtacgaacccatatcgtaaatcccaccaaatatttcaactccgcttcgtaaaactcataaccgaaatcttccccgaaatcgcttaccgttcccgcattaccgaacaacaactcgctattactaccgtaaatacgaacgtaataacgcgccaacgattcaatcaaaaacgaataacgtcgacgcaaacgaacgacataatcgtcgcgatcgccttcaataacgccacccgataacacactctctttcgtccatatccgaaccaatacccgtaataatacgacgttaatttttccaacgcatattccgccaattttcgataaataatcaacgttaccgccgaataccgacaacaacgatactttaccattttcatcataaatatcaaaaatataatcacgaataaaaacctacgacgaat

SEQ ID NO: 27491 - DNA, 539 bp, Artificial Sequence
  chemically treated genomic DNA (Homo sapiens) CpG-island No: 27491
acgacgttagcgataatttttgttgcgtatattttattagttattgatttatacgagattgttgattcgtatttagttatatgttttgttttgtgcgacgttatagggcgtttgtcggcgcgtgcggatttatgtcgtggattttattaggtattttagtttcgtttcgtagaatttatgatcgaaatttttttcgagatcgtttatcgttttcgtattgtcgagtagtagttcgttgttgttgtcgtaagtgcgagcgtaatgacgcgttagcgatttagttaggaacggatagcgtcggcgtaggcgagcggtataatcgtcgcggtcgtttttaatggcgttattcggtagtatattttttttcgtttatgttcgggttaatattcgtgataatacggcgttagtttttttagcgtatgtttcgttagttttcggtaggtggttagcgttatcgtcgaatatcgatagtagcggtgttttgttatttttattatgaatattaagggtgtaattacgggtaagagtttgcggcgagt

SEQ ID NO: 27492 - DNA, 539 bp, Artificial Sequence
  chemically treated genomic DNA (Homo sapiens) CpG-island No: 27492
actcgccgcaaactcttacccgtaattacacccttaatattcataataaaaataacaaaacaccgctactatcgatattcgacgataacgctaaccacctaccgaaaactaacgaaacatacgctaaaaaaactaacgccgtattatcacgaatattaacccgaacataaacgaaaaaaaatatactaccgaataacgccattaaaaacgaccgcgacgattataccgctcgcctacgccgacgctatccgttcctaactaaatcgctaacgcgtcattacgctcgcacttacgacaacaacaacgaactactactcgacaatacgaaaacgataaacgatctcgaaaaaaatttcgatcataaattctacgaaacgaaactaaaatacctaataaaatccacgacataaatccgcacgcgccgacaaacgccctataacgtcgcacaaaacaaaacatataactaaatacgaatcaacaatctcgtataaatcaataactaataaaatatacgcaacaaaaattatcgctaacgtcgt

SEQ ID NO: 27493 - DNA, 566 bp, Artificial Sequence
  chemically treated genomic DNA (Homo sapiens) CpG-island No: 27493
tcgtatgttagttattgcgcgtgcgggtaattaacgttcgtaaattgacgtcggatttaggtagtttttgttttagtttgagtggattaacgtcgcgattcgttaataaacgtagttatttacgtattagcgttgcgcgttttttcggtgaatgaattcggttttgggtgatttttatcgacggatatatcggattacgggtattaaagttgaagtataaatcgttgtcgttatattttatcgtatcgcgttattgttggcgtatcgtaatggggatttgtcgatcgaatgtatcgcgtatttaacgcgattatttttattatcggcgtatcgagattttttggtagggtaaattttttttgggttgagtcggttatgcgggttaaatgtcgtttttattttgcgtagttttgtaaaaagttttttatcgaaaaacgtcgggttgtatttagcgcgaaaatttttgtcgtgttcgttttataataaattatcgtatttcgtagttagcgttattacgttattagagatttgttttattaaaattttttgttgaggatcgtatatat

SEQ ID NO: 27494 - DNA, 566 bp, Artificial Sequence
  chemically treated genomic DNA (Homo sapiens) CpG-island No: 27494
atatatacgatcctcaacaaaaaattttaataaaacaaatctctaataacgtaataacgctaactacgaaatacgataatttattataaaacgaacacgacaaaaattttcgcgctaaatacaacccgacgtttttcgataaaaaactttttacaaaactacgcaaaataaaaacgacatttaacccgcataaccgactcaacccaaaaaaaatttaccctaccaaaaaatctcgatacgccgataataaaaataatcgcgttaaatacgcgatacattcgatcgacaaatccccattacgatacgccaacaataacgcgatacgataaaatataacgacaacgatttatacttcaactttaatacccgtaatccgatatatccgtcgataaaaatcacccaaaaccgaattcattcaccgaaaaaacgcgcaacgctaatacgtaaataactacgtttattaacgaatcgcgacgttaatccactcaaactaaaacaaaaactacctaaatccgacgtcaatttacgaacgttaattacccgcacgcgcaataactaacatacga

SEQ ID NO: 27495 - DNA, 566 bp, Artificial Sequence
  chemically treated genomic DNA (Homo sapiens) CpG-island No: 27495
atatgtgcgatttttaataagagattttgatgaagtaaatttttgatgacgtggtggcgttgattgcgaaatacggtggtttgttgtggggcgagtacggtaaaggttttcgcgttgaatatagttcggcgtttttcggtgaggaattttttgtagaattgcgtaaagtgaaagcggtatttgattcgtataatcgatttaatttagggaagatttgttttgttagaaggtttcgatgcgtcgatgatgaaagtgatcgcgttgaatgcgcggtatattcgatcggtagatttttattgcggtacgttagtagtggcgcggtgcgatggagtgtaacggtaacggtttatgttttaattttgatgttcgtagttcgatgtgttcgtcgatgaagattatttagaatcggatttatttatcgaaagggcgcgtaacgttggtgcgtgaatggttgcgtttgttggcggatcgcggcgttgatttatttaaattggaataagaattgtttgaattcggcgttagtttgcggacgttaattgttcgtacgcgtaatagttggtatgcga

SEQ ID NO: 27496 - DNA, 566 bp, Artificial Sequence
  chemically treated genomic DNA (Homo sapiens) CpG-island No: 27496
tcgcataccaactattacgcgtacgaacaattaacgtccgcaaactaacgccgaattcaaacaattcttattccaatttaaataaatcaacgccgcgatccgccaacaaacgcaaccattcacgcaccaacgttacgcgccctttcgataaataaatccgattctaaataatcttcatcgacgaacacatcgaactacgaacatcaaaattaaaacataaaccgttaccgttacactccatcgcaccgcgccactactaacgtaccgcaataaaaatctaccgatcgaatataccgcgcattcaacgcgatcactttcatcatcgacgcatcgaaaccttctaacaaaacaaatcttccctaaattaaatcgattatacgaatcaaataccgctttcactttacgcaattctacaaaaaattcctcaccgaaaaacgccgaactatattcaacgcgaaaacctttaccgtactcgccccacaacaaaccaccgtatttcgcaatcaacgccaccacgtcatcaaaaatttacttcatcaaaatctcttattaaaaatcgcacatat

SEQ ID NO: 27497 - DNA, 551 bp, Artificial Sequence
  chemically treated genomic DNA (Homo sapiens) CpG-island No: 27497
atttttcggtgttatttgtaagatatatttttgttcgcgtatattacgcgattttatatttagcgaatgtaggttggtaggggcgttttttatcgttttaggcggtattatttttgcgcgaatagttgagtgtgggtaagcggtaacgtagtggttatattgggtatagagtttttttttttagatggggattttttcggcgatattgcgttttttttagcgcgtagtgtttatcggttaggtgtcgtttggcggtagcgtcgaaacggggagggcgttattaagttcggcgagtatcgtagcggttacggtttttacgaaattaggggcggtatcggaaattattggcggtcgattggcgttgtgcggatttatcggttgtaacggaattttttttacggatttacgcgttagcgttagagtttgttagttgcgttttattagattttggtttttgttattgtaatttttggtaatcgtattttgtaattttgcgagggcgttatcgttaggtagaatttgcgttagatggaaaaaagttatttgtatga

SEQ ID NO: 27498 - DNA, 551 bp, Artificial Sequence
  chemically treated genomic DNA (Homo sapiens) CpG-island No: 27498
tcatacaaataacttttttccatctaacgcaaattctacctaacgataacgccctcgcaaaattacaaaatacgattaccaaaaattacaataacaaaaaccaaaatctaataaaacgcaactaacaaactctaacgctaacgcgtaaatccgtaaaaaaaattccgttacaaccgataaatccgcacaacgccaatcgaccgccaataatttccgataccgcccctaatttcgtaaaaaccgtaaccgctacgatactcgccgaacttaataacgccctccccgtttcgacgctaccgccaaacgacacctaaccgataaacactacgcgctaaaaaaaacgcaatatcgccgaaaaaatccccatctaaaaaaaaaaactctatacccaatataaccactacgttaccgcttacccacactcaactattcgcgcaaaaataataccgcctaaaacgataaaaaacgcccctaccaacctacattcgctaaatataaaatcgcgtaatatacgcgaacaaaaatatatcttacaaataacaccgaaaaat

SEQ ID NO: 27499 - DNA, 551 bp, Artificial Sequence
  chemically treated genomic DNA (Homo sapiens) CpG-island No: 27499
ttatgtagatggtttttttttatttgacgtaaattttgtttggcgatagcgttttcgtagaattgtagggtgcgattgttaaaagttatagtagtaaaggttaggatttggtggaacgtaattggtaggttttggcgttggcgcgtgaattcgtagaagaagtttcgttgtaatcggtaaattcgtatagcgttaatcgatcgttagtggttttcgatgtcgtttttgatttcgtgaaaatcgtaatcgttgcgatgttcgtcgggtttggtgacgtttttttcgtttcggcgttgtcgttagacggtatttggtcgatgggtattacgcgttgggaaaaacgtaatatcgtcgaagagatttttatttggaaagaggaattttgtatttaatgtaattattgcgttgtcgtttgtttatatttagttattcgcgtaaaagtggtgtcgtttgaagcgatggaaaacgtttttgttagtttgtattcgttggatgtgaaatcgcgtgatatgcgcgggtagaaatatgttttgtaggtggtatcggaagat

SEQ ID NO: 27500 - DNA, 551 bp, Artificial Sequence
  chemically treated genomic DNA (Homo sapiens) CpG-island No: 27500
atcttccgataccacctacaaaacatatttctacccgcgcatatcacgcgatttcacatccaacgaatacaaactaacaaaaacgttttccatcgcttcaaacgacaccacttttacgcgaataactaaatataaacaaacgacaacgcaataattacattaaatacaaaattcctctttccaaataaaaatctcttcgacgatattacgtttttcccaacgcgtaatacccatcgaccaaataccgtctaacgacaacgccgaaacgaaaaaaacgtcaccaaacccgacgaacatcgcaacgattacgattttcacgaaatcaaaaacgacatcgaaaaccactaacgatcgattaacgctatacgaatttaccgattacaacgaaacttcttctacgaattcacgcgccaacgccaaaacctaccaattacgttccaccaaatcctaacctttactactataacttttaacaatcgcaccctacaattctacgaaaacgctatcgccaaacaaaatttacgtcaaataaaaaaaaaccatctacataa

SEQ ID NO: 27501 - DNA, 935 bp, Artificial Sequence
  chemically treated genomic DNA (Homo sapiens) CpG-island No: 27501
  misc_feature (760)..(760): n is either a, c, g or t
  misc_feature (813)..(813): n is either a, c, g or t
  misc_feature (833)..(833): n is either a, c, g or t
ttcgttattagcgtataggtattatttgtttgttttagcgagaagcgatgggtaatggcgttacgcggttatagtttttagttcgttagattatgggcgtatttttttatatggaatagattggttatttaggagtcgataattcgtcgttgatggtgtattagatcggcgttgatttcgaattttattttttcggttttattaatgtaaattattcgtttttagttagcggtggattgtagtgttagtaagcgatttgcggtattatcggaataatcgagcgtaatattcgcgttatcgtgggtgagttcggcgataatttgcggtagattttcggtggttgttaaatagtcgtgatttattatttttaattgttttgttatcgttagacgtttcggtagtatattaacgtcgatgattcgttttgtatcgcgatttttcgttagtattatcgttattatgtcgattggttttagatcgattattagtacgttattattgtcggaaatttcgtcgcgtaaaatttttttatacgttgtattaacgtcgtaattgataaacgtattattttcgtagtttagcgtattcggtaggaggattagatttttttttttcgttagtaagtattcggtatgatcgtcgttacgttgttagtcgtaagtcgtttttttttcgttagtataagaaataggaaaatcgcgacggtagttcgggtaaaaattatagttagaaatgtgatatattagtatagcggtcgttnttttttaataatggcggtagttttgttttatcgttataattttgttcgtacgngtttagtgatcggttgatanagagttttggtataacggtttatcgggtgtcgtcgttgtggtacggtgttgatgatagatatagtggatatcgttttcgtaaatttcggaggattttatttt

SEQ ID NO: 27502 - DNA, 935 bp, Artificial Sequence
  chemically treated genomic DNA (Homo sapiens) CpG-island No: 27502
  misc_feature (103)..(103): n is either a, c, g or t
  misc_feature (123)..(123): n is either a, c, g or t
  misc_feature (176)..(176): n is either a, c, g or t
aaaataaaatcctccgaaatttacgaaaacgatatccactatatctatcatcaacaccgtaccacaacgacgacacccgataaaccgttataccaaaactctntatcaaccgatcactaaacncgtacgaacaaaattataacgataaaacaaaactaccgccattattaaaaaanaacgaccgctatactaatatatcacatttctaactataatttttacccgaactaccgtcgcgattttcctatttcttatactaacgaaaaaaaaacgacttacgactaacaacgtaacgacgatcataccgaatacttactaacgaaaaaaaaaaatctaatcctcctaccgaatacgctaaactacgaaaataatacgtttatcaattacgacgttaatacaacgtataaaaaaattttacgcgacgaaatttccgacaataataacgtactaataatcgatctaaaaccaatcgacataataacgataatactaacgaaaaatcgcgatacaaaacgaatcatcgacgttaatatactaccgaaacgtctaacgataacaaaacaattaaaaataataaatcacgactatttaacaaccaccgaaaatctaccgcaaattatcgccgaactcacccacgataacgcgaatattacgctcgattattccgataataccgcaaatcgcttactaacactacaatccaccgctaactaaaaacgaataatttacattaataaaaccgaaaaaataaaattcgaaatcaacgccgatctaatacaccatcaacgacgaattatcgactcctaaataaccaatctattccatataaaaaaatacgcccataatctaacgaactaaaaactataaccgcgtaacgccattacccatcgcttctcgctaaaacaaacaaataatacctatacgctaataacgaa

SEQ ID NO: 27503 - DNA, 935 bp, Artificial Sequence
  chemically treated genomic DNA (Homo sapiens) CpG-island No: 27503
  misc_feature (103)..(103): n is either a, c, g or t
  misc_feature (123)..(123): n is either a, c, g or t
  misc_feature (176)..(176): n is either a, c, g or t
aaaatgaaatttttcgggatttgcggaagcgatgtttattatatttattattaatatcgtgttatagcggcggtattcgataaatcgttatattagggttttntattaatcggttattgaatncgtgcgggtagaattgtggcgatggggtaaggttgtcgttattgttaaagagnggcgatcgttgtgttggtgtattatatttttggttgtggtttttgttcgaattgtcgtcgcggtttttttattttttgtattggcgaaggaaaagcggtttacggttggtagcgtgacggcggttatgtcgaatatttgttggcggaagaaaaagatttgatttttttgtcggatgcgttgagttacgaagatggtgcgtttattagttgcggcgttggtatagcgtatgaaggaattttgcgcggcgaagttttcggtagtgataacgtgttggtggtcggtttggggttagtcggtatgatggcgatgatgttggcgaaaggtcgcggtgtaaaacggattatcggcgttgatatgttgtcggaacgtttggcgatggtaaaatagttaggggtgatggattacggttatttagtaattatcgaaggtttgtcgtagattatcgtcgaatttatttacggtggcgcggatgttgcgttcgattgtttcggtaatgtcgtaggtcgtttgttggtattgtaatttatcgttgattggggacgggtggtttatattggtgaaatcggaaaagtggaattcgaggttagcgtcgatttgatgtattattaacggcggattatcggtttttgggtgattagtttgttttatatggaaaaatgcgtttatgatttgacggattggaagttgtggtcgcgtaacgttattatttatcgtttttcgttggaataggtaggtgatgtttatgcgttgatggcgag

SEQ ID NO: 27504 - DNA, 935 bp, Artificial Sequence
  chemically treated genomic DNA (Homo sapiens) CpG-island No: 27504
  misc_feature (760)..(760): n is either a, c, g or t
  misc_feature (813)..(813): n is either a, c, g or t
  misc_feature (833)..(833): n is either a, c, g or t
ctcgccatcaacgcataaacatcacctacctattccaacgaaaaacgataaataataacgttacgcgaccacaacttccaatccgtcaaatcataaacgcatttttccatataaaacaaactaatcacccaaaaaccgataatccgccgttaataatacatcaaatcgacgctaacctcgaattccacttttccgatttcaccaatataaaccacccgtccccaatcaacgataaattacaataccaacaaacgacctacgacattaccgaaacaatcgaacgcaacatccgcgccaccgtaaataaattcgacgataatctacgacaaaccttcgataattactaaataaccgtaatccatcacccctaactattttaccatcgccaaacgttccgacaacatatcaacgccgataatccgttttacaccgcgacctttcgccaacatcatcgccatcataccgactaaccccaaaccgaccaccaacacgttatcactaccgaaaacttcgccgcgcaaaattccttcatacgctataccaacgccgcaactaataaacgcaccatcttcgtaactcaacgcatccgacaaaaaaatcaaatctttttcttccgccaacaaatattcgacataaccgccgtcacgctaccaaccgtaaaccgcttttccttcgccaatacaaaaaataaaaaaaccgcgacgacaattcgaacaaaaaccacaaccaaaaatataatacaccaacacaacgatcgccnctctttaacaataacgacaaccttaccccatcgccacaattctacccgcacgnattcaataaccgattaatanaaaaccctaatataacgatttatcgaataccgccgctataacacgatattaataataaatataataaacatcgcttccgcaaatcccgaaaaatttcatttt

SEQ ID NO: 27505 - DNA, 858 bp, Artificial Sequence
  chemically treated genomic DNA (Homo sapiens) CpG-island No: 27505
tgacgcgttgggcgtttggtattagaacgattcggtattggtgaaagaatttgtcgaattgttgtggttgaaaggcgatgaatttgttatcgatcgtagggtaaaacgttgtttttgaacgaagcgttatatgtggtattatcgtatattcgattttggtatagatatttgttaatattgttgagaattacgttattgtttatcgcggtagttgaatatacgtgttgtcgttggtgggcgataaatgcgatacgttacgatgatagtttattgatttgttgattgacgtcgattgttgatatggtgcgttattattttacgtggtacgagttatggagtgtattagagaagttgtttaagtttatattttaggtatagacgattattgtttgattgtcgcgtttgtattttatcgttttttcgtaggcgagaagtcgtagaattgaagttaatagcgggttcgaatacggatttgcgttaggtggcgtggcgtttatcgaacgtggaaggtcgcgttcgtgtcggtggtgtttttagttttttcgttgatcgcgtggaagaagagggcgaagttcgcgtatttatcgaatataacgataattttcgtttgttagttaatttagaaatttcggtgattatgattggtttaggtatcggtattgcgtcgtttcgcgtttttatgtagtaacgcgtcgtcgacgaagcgttaggtaaaaattggttgttttttggtaattcgtattttacggaagattttttgtattaggtggagtggtagcgttacgttaaagatggcgtgttgatacgtatcgattttgtttggtcgcgcgattaaaaagaaaaagtttacgtataaga

SEQ ID NO: 27506 - DNA, 858 bp, Artificial Sequence
  chemically treated genomic DNA (Homo sapiens) CpG-island No: 27506
tcttatacgtaaactttttctttttaatcgcgcgaccaaacaaaatcgatacgtatcaacacgccatctttaacgtaacgctaccactccacctaatacaaaaaatcttccgtaaaatacgaattaccaaaaaacaaccaatttttacctaacgcttcgtcgacgacgcgttactacataaaaacgcgaaacgacgcaataccgatacctaaaccaatcataatcaccgaaatttctaaattaactaacaaacgaaaattatcgttatattcgataaatacgcgaacttcgccctcttcttccacgcgatcaacgaaaaaactaaaaacaccaccgacacgaacgcgaccttccacgttcgataaacgccacgccacctaacgcaaatccgtattcgaacccgctattaacttcaattctacgacttctcgcctacgaaaaaacgataaaatacaaacgcgacaatcaaacaataatcgtctatacctaaaatataaacttaaacaacttctctaatacactccataactcgtaccacgtaaaataataacgcaccatatcaacaatcgacgtcaatcaacaaatcaataaactatcatcgtaacgtatcgcatttatcgcccaccaacgacaacacgtatattcaactaccgcgataaacaataacgtaattctcaacaatattaacaaatatctataccaaaatcgaatatacgataataccacatataacgcttcgttcaaaaacaacgttttaccctacgatcgataacaaattcatcgcctttcaaccacaacaattcgacaaattctttcaccaataccgaatcgttctaataccaaacgcccaacgcgtca

SEQ ID NO: 27507 - DNA, 858 bp, Artificial Sequence
  chemically treated genomic DNA (Homo sapiens) CpG-island No: 27507
ttttgtacgtaaattttttttttttgatcgcgcgattaggtaagatcgatacgtgttagtacgttatttttgacgtagcgttgttattttatttggtataggaagtttttcgtaaagtgcggattattaaagaatagttagtttttatttggcgtttcgtcggcggcgcgttgttgtataaaggcgcggaacggcgtaatatcggtgtttgggttaattataattatcggggtttttggattggttggtaggcggaagttatcgttatgttcgataaatacgcggatttcgttttttttttttacgcggttagcgaggaagttggaggtattatcggtacgggcgcggttttttacgttcggtaagcgttacgttatttagcgtagattcgtgttcggattcgttgttagttttagttttgcgatttttcgtttgcgaggaggcgatggaatatagacgcggtagttaagtagtggtcgtttatgtttagaatgtgaatttgagtagtttttttggtgtattttatagttcgtgttacgtgggatgataacgtattatgttaataatcggcgttagttagtaggttagtaaattgttatcgtaacgtgtcgtatttatcgtttattagcggtagtacgtgtgtttagttgtcgcggtaagtagtggcgtaatttttaataatgttggtaggtgtttgtattagggtcgagtgtgcgatagtgttatatgtagcgtttcgtttagaggtaacgttttgttttgcgatcggtgataggtttatcgttttttagttatagtagttcgataagtttttttattagtgtcggatcgttttgatattagacgtttagcgcgtta

SEQ ID NO: 27508 - DNA, 858 bp, Artificial Sequence
  chemically treated genomic DNA (Homo sapiens) CpG-island No: 27508
taacgcgctaaacgtctaatatcaaaacgatccgacactaataaaaaaacttatcgaactactataactaaaaaacgataaacctatcaccgatcgcaaaacaaaacgttacctctaaacgaaacgctacatataacactatcgcacactcgaccctaatacaaacacctaccaacattattaaaaattacgccactacttaccgcgacaactaaacacacgtactaccgctaataaacgataaatacgacacgttacgataacaatttactaacctactaactaacgccgattattaacataatacgttatcatcccacgtaacacgaactataaaatacaccaaaaaaactactcaaattcacattctaaacataaacgaccactacttaactaccgcgtctatattccatcgcctcctcgcaaacgaaaaatcgcaaaactaaaactaacaacgaatccgaacacgaatctacgctaaataacgtaacgcttaccgaacgtaaaaaaccgcgcccgtaccgataatacctccaacttcctcgctaaccgcgtaaaaaaaaaaaacgaaatccgcgtatttatcgaacataacgataacttccgcctaccaaccaatccaaaaaccccgataattataattaacccaaacaccgatattacgccgttccgcgcctttatacaacaacgcgccgccgacgaaacgccaaataaaaactaactattctttaataatccgcactttacgaaaaacttcctataccaaataaaataacaacgctacgtcaaaaataacgtactaacacgtatcgatcttacctaatcgcgcgatcaaaaaaaaaaaatttacgtacaaaa

SEQ ID NO: 27509 - DNA, 1134 bp, Artificial Sequence
  chemically treated genomic DNA (Homo sapiens) CpG-island No: 27509
agcggaaattaggttgcgcgttattgtatgtttgggggcgttaaatagcgtttttatatcgttttgttcgataattttatcgttagatattatcgttacgttattcgttagacgcgttataacgtttatattatgggttattagtagtattttcggcgtttgtttttgtataatgttttttagtagatcgaggatgcgcgtttgtgttattacgttaaggtcggtggtcggtttatcggcgatgataaacggtgatttatatagtatcgttatcgtaattattatgcgttgtaatatgtcgtcgtttatttcgaacgggtatagttttagtacgcgcgcggcgttttttagttttatcgtttttatggtagcggtaagcgtagcgttatcggcgggtttttttaacgttaggtaggtttttcgcgcgtgggtgtgtatggtgtgtagtggattataggggttgcgcgggttttgtatgatgttgttaattttgatgtcgcgtagggcgtaaggcgaaatcggtttgttatcggttaaaatttttttcgtcgtttggcgaacgttagcgggtaaaatgtttagcgttgcggcgtaggttaatgatttttcgttgtcgttatcgtcgattaacgttagtacgcgttcgcgttgtagggttaacgatatatcgtgtattagcggttgcgcggtttgtagcgcgatattacgtagtttaatttgttgcggtattagtgtgcgtgtttcgttattagatgagggtttagatgatcgcgtagtgcgttatttattaggttaaaggttattacgttgataaatagcgttagtttcggttagaatatttgtagcggttgggtttagatatattggcgcgcgtcgttaattattacgttttattcggcggtcggcgcggttatatcgaggttaaggaaagatattttcgcgacgtgtagtattatatggtcgatatttagcgttgttagtattagtagcgaagggattatcgcgtttgttagatgatcgataaatattcgtatatggttcgtatcggatatagtcgtgacgtttagttataaattcgcgttggcgtagtgaaattattaggttgcgtattatgcgtgtatatttacgttttag

SEQ ID NO: 27510 - DNA, 1134 bp, Artificial Sequence
  chemically treated genomic DNA (Homo sapiens) CpG-island No: 27510
ctaaaacgtaaatatacacgcataatacgcaacctaataatttcactacgccaacgcgaatttataactaaacgtcacgactatatccgatacgaaccatatacgaatatttatcgatcatctaacaaacgcgataatcccttcgctactaatactaacaacgctaaatatcgaccatataatactacacgtcgcgaaaatatctttccttaacctcgatataaccgcgccgaccgccgaataaaacgtaataattaacgacgcgcgccaatatatctaaacccaaccgctacaaatattctaaccgaaactaacgctatttatcaacgtaataacctttaacctaataaataacgcactacgcgatcatctaaaccctcatctaataacgaaacacgcacactaataccgcaacaaattaaactacgtaatatcgcgctacaaaccgcgcaaccgctaatacacgatatatcgttaaccctacaacgcgaacgcgtactaacgttaatcgacgataacgacaacgaaaaatcattaacctacgccgcaacgctaaacattttacccgctaacgttcgccaaacgacgaaaaaaattttaaccgataacaaaccgatttcgccttacgccctacgcgacatcaaaattaacaacatcatacaaaacccgcgcaacccctataatccactacacaccatacacacccacgcgcgaaaaacctacctaacgttaaaaaaacccgccgataacgctacgcttaccgctaccataaaaacgataaaactaaaaaacgccgcgcgcgtactaaaactatacccgttcgaaataaacgacgacatattacaacgcataataattacgataacgatactatataaatcaccgtttatcatcgccgataaaccgaccaccgaccttaacgtaataacacaaacgcgcatcctcgatctactaaaaaacattatacaaaaacaaacgccgaaaatactactaataacccataatataaacgttataacgcgtctaacgaataacgtaacgataatatctaacgataaaattatcgaacaaaacgatataaaaacgctatttaacgcccccaaacatacaataacgcgcaacctaatttccgct

SEQ ID NO: 27511 - DNA, 1134 bp, Artificial Sequence
  chemically treated genomic DNA (Homo sapiens) CpG-island No: 27511
ttagggcgtaggtatgtacgtatggtgcgtagtttggtgattttattacgttaacgcgagtttgtagttaggcgttacggttatattcggtgcgggttatgtgcgggtgtttgtcgattatttggtaggcgcggtgattttttcgttgttggtgttggtaacgttggatatcggttatatgatgttgtacgtcgcggggatgtttttttttggtttcggtgtgatcgcgtcgatcgtcgaatggggcgtgatgattaacgacgcgcgttagtatatttggatttagtcgttgtaaatgttttggtcggggttggcgttgtttattagcgtgatggtttttaatttggtgggtgacgtattgcgcgattatttggatttttatttggtgacggagtacgtatattaatgtcgtaatagattgaattacgtaatatcgcgttataggtcgcgtagtcgttggtatacggtgtatcgttaattttgtaacgcgggcgcgtgttggcgttagtcggcggtagcggtagcgggaaattattaatttgcgtcgtaacgttgggtattttgttcgttggcgttcgttagacggcgggggaaattttagtcgatggtaaatcggtttcgttttgcgttttgcgcggtattaaaattggtagtattatgtagaattcgcgtagtttttgtaatttattgtatattatgtatatttacgcgcgggaaatttgtttggcgttagggaaattcgtcgatgacgttacgtttatcgttgttatagaagcggtggggttggaaaacgtcgcgcgcgtgttgaagttgtattcgttcgagatgagcggcggtatgttgtagcgtatgatgattgcgatggcggtgttgtgtgaattatcgtttattatcgtcgatgaatcgattatcgattttgacgtggtagtataggcgcgtattttcgatttgttggaaagtattatgtaaaaataagcgtcgggaatgttgttggtgatttatgatatgggcgttgtggcgcgtttggcggatgacgtggcggtgatgtttgacggtaagattgtcgaatagggcgatgtagaaacgttgtttaacgtttttaaatatatagtgacgcgtagtttggttttcgtt

SEQ ID NO: 27512 - DNA, 1134 bp, Artificial Sequence
  chemically treated genomic DNA (Homo sapiens) CpG-island No: 27512
aacgaaaaccaaactacgcgtcactatatatttaaaaacgttaaacaacgtttctacatcgccctattcgacaatcttaccgtcaaacatcaccgccacgtcatccgccaaacgcgccacaacgcccatatcataaatcaccaacaacattcccgacgcttatttttacataatactttccaacaaatcgaaaatacgcgcctatactaccacgtcaaaatcgataatcgattcatcgacgataataaacgataattcacacaacaccgccatcgcaatcatcatacgctacaacataccgccgctcatctcgaacgaatacaacttcaacacgcgcgcgacgttttccaaccccaccgcttctataacaacgataaacgtaacgtcatcgacgaatttccctaacgccaaacaaatttcccgcgcgtaaatatacataatatacaataaattacaaaaactacgcgaattctacataatactaccaattttaataccgcgcaaaacgcaaaacgaaaccgatttaccatcgactaaaatttcccccgccgtctaacgaacgccaacgaacaaaatacccaacgttacgacgcaaattaataatttcccgctaccgctaccgccgactaacgccaacacgcgcccgcgttacaaaattaacgatacaccgtataccaacgactacgcgacctataacgcgatattacgtaattcaatctattacgacattaatatacgtactccgtcaccaaataaaaatccaaataatcgcgcaatacgtcacccaccaaattaaaaaccatcacgctaataaacaacgccaaccccgaccaaaacatttacaacgactaaatccaaatatactaacgcgcgtcgttaatcatcacgccccattcgacgatcgacgcgatcacaccgaaaccaaaaaaaaacatccccgcgacgtacaacatcatataaccgatatccaacgttaccaacaccaacaacgaaaaaatcaccgcgcctaccaaataatcgacaaacacccgcacataacccgcaccgaatataaccgtaacgcctaactacaaactcgcgttaacgtaataaaatcaccaaactacgcaccatacgtacatacctacgccctaa

SEQ ID NO: 27513 - DNA, 981 bp, Artificial Sequence
  chemically treated genomic DNA (Homo sapiens) CpG-island No: 27513
tcgcggtcgtcgttaggtaagtcgttaatagtagtagcgtaattcgcgtcggcgttagcgttatttttacggttcgggcggtattattatttagcggtaaaatggttagttagcggcggtatagcggggtaatcgttagtaaaattattattataatttcggtgcgttagatttgcgtatcggtcgcgttgtaggtcgaatcggaaatttaggttagtatttgcgttattcgcgggttattatttgtttgtaatattattaaaagtatggtgaacgcggtgtttaacgttattttcgttagtaatatacggtgtggggaaaatttatcgcggtcggcggcgattataatgattaatagcgttatcgtcgcgtcgagattgtttgtaggtaatagttagttaaaggtattattcggtattagaaatagtattaatattacgttaaacgtcgcgtcggagttaatttttagtattttcgggtttgttatcgggttttcggttagtcgttgaataatatagttcgttatcgttagtatgacgttcgtaaatagcgtcgttataattcgcggttagcgttagggtattaaattttcgagtaacgtttcgttcgtttacgtttagtcgtgcgtattacgattaaacgatagcgttattattatagttattaatagtagtacgtcgttcgcgagggtaaacgttagtatatgttggcgtttagtcgcgatacgatcgttgatttttatattcggcgcgttaatgttgcgtaaacgcggtaatagttatagtagtagcggcgtatcgattaacgtagtgatcgaatcggtggatatttttatttatacgcgagttagttagaggatgatttgatcggaaagttagaggattagcgtattaattaacgacgttagtattagtcgtggtagtagacgtcgcgtttttagtatttttgttagtagcggcgcgaataattcgataaagtcga

SEQ ID NO: 27514 - DNA, 981 bp, Artificial Sequence
  chemically treated genomic DNA (Homo sapiens) CpG-island No: 27514
tcgactttatcgaattattcgcgccgctactaacaaaaatactaaaaacgcgacgtctactaccacgactaatactaacgtcgttaattaatacgctaatcctctaactttccgatcaaatcatcctctaactaactcgcgtataaataaaaatatccaccgattcgatcactacgttaatcgatacgccgctactactataactattaccgcgtttacgcaacattaacgcgccgaatataaaaatcaacgatcgtatcgcgactaaacgccaacatatactaacgtttaccctcgcgaacgacgtactactattaataactataataataacgctatcgtttaatcgtaatacgcacgactaaacgtaaacgaacgaaacgttactcgaaaatttaataccctaacgctaaccgcgaattataacgacgctatttacgaacgtcatactaacgataacgaactatattattcaacgactaaccgaaaacccgataacaaacccgaaaatactaaaaattaactccgacgcgacgtttaacgtaatattaatactatttctaataccgaataatacctttaactaactattacctacaaacaatctcgacgcgacgataacgctattaatcattataatcgccgccgaccgcgataaattttccccacaccgtatattactaacgaaaataacgttaaacaccgcgttcaccatacttttaataatattacaaacaaataataacccgcgaataacgcaaatactaacctaaatttccgattcgacctacaacgcgaccgatacgcaaatctaacgcaccgaaattataataataattttactaacgattaccccgctataccgccgctaactaaccattttaccgctaaataataataccgcccgaaccgtaaaaataacgctaacgccgacgcgaattacgctactactattaacgacttacctaacgacgaccgcga

SEQ ID NO: 27515 - DNA, 981 bp, Artificial Sequence
  chemically treated genomic DNA (Homo sapiens) CpG-island No: 27515
tcggttttatcgggttgttcgcgtcgttgttggtaaaaatgttgggggcgcggcgtttgttgttacgattgatgttggcgtcgttgattggtgcgttgattttttggtttttcgattaaattattttttggttgattcgcgtgtggatggaagtgtttatcggttcggttattgcgttgatcggtgcgtcgttgttattgtggttgttgtcgcgtttacgtagtattagcgcgtcggatatgaaggttaacgatcgtgtcgcggttgaacgttaatatgtgttggcgtttgttttcgcgggcggcgtgttgttgttgatggttgtggtggtggcgttgtcgtttggtcgtgatgcgtacggttggacgtgggcgagcggggcgttgttcgaggatttaatgttttggcgttggtcgcgaattatggcggcgttgtttgcgggcgttatgttggcggtggcgggttgtattatttagcgattgatcggaaattcgatggtaagttcggaagtgttggggattagtttcggcgcggcgtttggcgtggtgttgatgttgtttttggtgtcgggtaatgtttttggttggttgttatttgtaggtagtttcggcgcggcggtgacgttgttgattattatgatcgtcgtcggtcgcggtggattttttttatatcgtatgttattggcggggatggcgttaagtatcgcgtttattatgtttttgatgatgttgtaggtaagtggtgattcgcgaatggcgtaagtgttgatttggattttcggttcgatttataacgcgatcgatgcgtaggtttggcgtatcggaattgtgatggtgattttgttggcgattatttcgttgtgtcgtcgttggttgattattttatcgttgggtggtgatatcgttcgagtcgtaggaatggcgttgacgtcgacgcgaattgcgttgttgttgttagcggtttgtttgacggcgatcgcga

SEQ ID NO: 27516 - DNA, 981 bp, Artificial Sequence
  chemically treated genomic DNA (Homo sapiens) CpG-island No: 27516
tcgcgatcgccgtcaaacaaaccgctaacaacaacaacgcaattcgcgtcgacgtcaacgccattcctacgactcgaacgatatcaccacccaacgataaaataatcaaccaacgacgacacaacgaaataatcgccaacaaaatcaccatcacaattccgatacgccaaacctacgcatcgatcgcgttataaatcgaaccgaaaatccaaatcaacacttacgccattcgcgaatcaccacttacctacaacatcatcaaaaacataataaacgcgatacttaacgccatccccgccaataacatacgatataaaaaaaatccaccgcgaccgacgacgatcataataatcaacaacgtcaccgccgcgccgaaactacctacaaataacaaccaaccaaaaacattacccgacaccaaaaacaacatcaacaccacgccaaacgccgcgccgaaactaatccccaacacttccgaacttaccatcgaatttccgatcaatcgctaaataatacaacccgccaccgccaacataacgcccgcaaacaacgccgccataattcgcgaccaacgccaaaacattaaatcctcgaacaacgccccgctcgcccacgtccaaccgtacgcatcacgaccaaacgacaacgccaccaccacaaccatcaacaacaacacgccgcccgcgaaaacaaacgccaacacatattaacgttcaaccgcgacacgatcgttaaccttcatatccgacgcgctaatactacgtaaacgcgacaacaaccacaataacaacgacgcaccgatcaacgcaataaccgaaccgataaacacttccatccacacgcgaatcaaccaaaaaataatttaatcgaaaaaccaaaaaatcaacgcaccaatcaacgacgccaacatcaatcgtaacaacaaacgccgcgcccccaacatttttaccaacaacgacgcgaacaacccgataaaaccga

SEQ ID NO: 27517 - DNA, 620 bp, Artificial Sequence
  chemically treated genomic DNA (Homo sapiens) CpG-island No: 27517
acgttttcggttatggtttgacgtttggcgtttatacgcgtattgatgaattatcgcgtagttattggttcggtttatgttgtaatttgtatgtatcgtatatggtggcgtagtgttgtggtatcgttcgcggcgaaggtgttcgtatcgcggagtcgcgttcgttttatttttatttttgttggcgaatcgttcggaaagtgcgttggtagtgacgttcgcgcgttaggatgtaaagtattcggtcgatgcgtagttgaaagtcgtattgatttagtcgttaaatgtattgcgggaatgggtagtaaatcgtttagaattgtaggcgttatgtacgtaatatggcgagttggcgtaggtaggaatataacgattgttgtcggggtcgacgggtgaacgtaatatttggacgttgttgtcgcgtgagcgcgtgttgtgtattgtcgatgatgagtaggatgcgttgatttagttcgtcgtcgtgttggcggtgggtagttaggtattgtggtcggatgacgcgttgtatcgttagttagtgaaggtattgttatcggtagttagcgaacgtatttaattggcgaaagcggaaaatataatcgtttaatcgtttgatgcgg

SEQ ID NO: 27518 - DNA, 620 bp, Artificial Sequence
  chemically treated genomic DNA (Homo sapiens) CpG-island No: 27518
ccgcatcaaacgattaaacgattatattttccgctttcgccaattaaatacgttcgctaactaccgataacaataccttcactaactaacgatacaacgcgtcatccgaccacaatacctaactacccaccgccaacacgacgacgaactaaatcaacgcatcctactcatcatcgacaatacacaacacgcgctcacgcgacaacaacgtccaaatattacgttcacccgtcgaccccgacaacaatcgttatattcctacctacgccaactcgccatattacgtacataacgcctacaattctaaacgatttactacccattcccgcaatacatttaacgactaaatcaatacgactttcaactacgcatcgaccgaatactttacatcctaacgcgcgaacgtcactaccaacgcactttccgaacgattcgccaacaaaaataaaaataaaacgaacgcgactccgcgatacgaacaccttcgccgcgaacgataccacaacactacgccaccatatacgatacatacaaattacaacataaaccgaaccaataactacgcgataattcatcaatacgcgtataaacgccaaacgtcaaaccataaccgaaaacgt

SEQ ID NO: 27519 - DNA, 620 bp, Artificial Sequence
  chemically treated genomic DNA (Homo sapiens) CpG-island No: 27519
tcgtattaaacggttgagcggttatatttttcgttttcgttagttgaatacgttcgttgattgtcgatggtaatgtttttattaattgacgatgtagcgcgttattcggttatagtatttggttgtttatcgttagtacggcggcgagttgagttagcgtattttgtttattatcggtaatatataatacgcgtttacgcggtagtagcgtttaggtgttgcgtttattcgtcggtttcggtagtaatcgttgtgtttttgtttgcgttagttcgttatattgcgtatataacgtttgtaattttggacgatttgttgtttattttcgtagtgtatttagcggttgagttaatgcggtttttaattgcgtatcgatcggatattttgtattttgacgcgcgagcgttattgttagcgtatttttcgggcgattcgttagtagaggtagagatagagcggacgcggtttcgcggtacggatattttcgtcgcgaacggtgttataatattgcgttattatatacggtatatataggttataatatgggtcgagttagtgattgcgcgatggtttattaatgcgcgtatggacgttaagcgttagattataatcggaagcgt

SEQ ID NO: 27520 - DNA, 620 bp, Artificial Sequence
  chemically treated genomic DNA (Homo sapiens) CpG-island No: 27520
acgcttccgattataatctaacgcttaacgtccatacgcgcattaataaaccatcgcgcaatcactaactcgacccatattataacctatatataccgtatataataacgcaatattataacaccgttcgcgacgaaaatatccgtaccgcgaaaccgcgtccgctctatctctacctctactaacgaatcgcccgaaaaatacgctaacaataacgctcgcgcgtcaaaatacaaaatatccgatcgatacgcaattaaaaaccgcattaactcaaccgctaaatacactacgaaaataaacaacaaatcgtccaaaattacaaacgttatatacgcaatataacgaactaacgcaaacaaaaacacaacgattactaccgaaaccgacgaataaacgcaacacctaaacgctactaccgcgtaaacgcgtattatatattaccgataataaacaaaatacgctaactcaactcgccgccgtactaacgataaacaaccaaatactataaccgaataacgcgctacatcgtcaattaataaaaacattaccatcgacaatcaacgaacgtattcaactaacgaaaacgaaaaatataaccgctcaaccgtttaatacga

SEQ ID NO: 27521 - DNA, 678 bp, Artificial Sequence
  chemically treated genomic DNA (Homo sapiens) CpG-island No: 27521
tttagcgttttttttcggtgcggcgtcgtgttacggttttgtgtagttgttattttttttgttttttttcgttgggtttcgtttttatttgtttgcgtttgttttaggtgttttgttcgatcgttcgcggtttgtttttgcgttttttagtgtttttcgtttatttttttcgtttttgttttttgacgttatattttgtttgtcgatcgatacgttgtttttcggtcgttttagtcgttattttttgttttttataatgttatgaattatttcgttatttttattcgttttttgttcgttcgtagtttttcgtttttgtttgttcgcgtgtttttcgttcgttttgttttcggttcgttcgtttcgttcgggttttcgtgtcgttcgtttggtttcggttgtggcgtgttgtgcgttagtttggttgcgtcgtcgtttgtttgtggttcgtcgtttgtgtttttttgtttgtttttttttcgtttttgtttcgcgtttgcgtatttttatttttcgttatattcgcgtcgtttcgtcggcgtagcgtcgcggttgtacgttcgtcgtttattagttttttcgttttttttagtcgtttgtacgttacgtttagcgttttttgtacgtcgtatcgattatagcgcgttcgttgtatttttagtcgtcgcgttttattcg

SEQ ID NO: 27522 - DNA, 678 bp, Artificial Sequence
  chemically treated genomic DNA (Homo sapiens) CpG-island No: 27522
cgaataaaacgcgacgactaaaaatacaacgaacgcgctataatcgatacgacgtacaaaaaacgctaaacgtaacgtacaaacgactaaaaaaaacgaaaaaactaataaacgacgaacgtacaaccgcgacgctacgccgacgaaacgacgcgaatataacgaaaaataaaaatacgcaaacgcgaaacaaaaacgaaaaaaaaacaaacaaaaaaacacaaacgacgaaccacaaacaaacgacgacgcaaccaaactaacgcacaacacgccacaaccgaaaccaaacgaacgacacgaaaacccgaacgaaacgaacgaaccgaaaacaaaacgaacgaaaaacacgcgaacaaacaaaaacgaaaaactacgaacgaacaaaaaacgaataaaaataacgaaataattcataacattataaaaaacaaaaaataacgactaaaacgaccgaaaaacaacgtatcgatcgacaaacaaaatataacgtcaaaaaacaaaaacgaaaaaaataaacgaaaaacactaaaaaacgcaaaaacaaaccgcgaacgatcgaacaaaacacctaaaacaaacgcaaacaaataaaaacgaaacccaacgaaaaaaaacaaaaaaaataacaactacacaaaaccgtaacacgacgccgcaccgaaaaaaaacgctaaa

SEQ ID NO: 27523 - DNA, 678 bp, Artificial Sequence
  chemically treated genomic DNA (Homo sapiens) CpG-island No: 27523
cgagtgagacgcgacggttaggagtgtaacgaacgcgttgtaatcgatacggcgtataagaagcgttggacgtgacgtataagcgattagagggagcgagaaggttagtagacgacgagcgtatagtcgcgacgttacgtcgacgaagcggcgcgagtgtggcgaggagtagagatgcgtaagcgcgaagtagagacgaggagaagataggtagagaggtataggcggcggattataaataggcgacgacgtagttagattagcgtatagtacgttatagtcggaattagacgaacggtacgagagttcggacggaacgaacggatcgaagataggacgaacgagagatacgcgaatagataagaacggagagttacgagcgagtagagagcgagtgagagtgacgaggtaatttatgatattataagagatagagggtagcgattaggacggtcgagaagtaacgtgtcgatcggtaagtaggatgtggcgttaagagatagagacgggagggataggcggaggatattgagaggcgtaagggtaggtcgcgaacgatcggataaaatatttaggataaacgtagatagataaggacgagatttagcgaaagagagtaggaagaatagtaattatatagggtcgtgatacgacgtcgtatcggagagaaacgttgag

SEQ ID NO: 27524 - DNA, 678 bp, Artificial Sequence
  chemically treated genomic DNA (Homo sapiens) CpG-island No: 27524
ctcaacgtttctctccgatacgacgtcgtatcacgaccctatataattactattcttcctactctctttcgctaaatctcgtccttatctatctacgtttatcctaaatattttatccgatcgttcgcgacctacccttacgcctctcaatatcctccgcctatccctcccgtctctatctcttaacgccacatcctacttaccgatcgacacgttacttctcgaccgtcctaatcgctaccctctatctcttataatatcataaattacctcgtcactctcactcgctctctactcgctcgtaactctccgttcttatctattcgcgtatctctcgttcgtcctatcttcgatccgttcgttccgtccgaactctcgtaccgttcgtctaattccgactataacgtactatacgctaatctaactacgtcgtcgcctatttataatccgccgcctatacctctctacctatcttctcctcgtctctacttcgcgcttacgcatctctactcctcgccacactcgcgccgcttcgtcgacgtaacgtcgcgactatacgctcgtcgtctactaaccttctcgctccctctaatcgcttatacgtcacgtccaacgcttcttatacgccgtatcgattacaacgcgttcgttacactcctaaccgtcgcgtctcactcg

SEQ ID NO: 27525 - DNA, 525 bp, Artificial Sequence
  chemically treated genomic DNA (Homo sapiens) CpG-island No: 27525
ttagtcgggcgtaggtcggattatgatgtcggatgtcgataattaacggttcgtttatgtatttttttttacggtaggcggtggcgggtttgataataagtttgttagtgagtttttttatgtgtggcgatacgttgttcgaagtaacggcgtagacgcgcgcgatttttttcgttatttttgacgatggtttcggtaatatattttattaggtcggtaggttttttcgcgcgattcgttaaaaattaggcgcggacgtttatagtatgggttacgtttacggttttagcggtggatataatcgttgttagtgtatttattgacgtttttttttcgtcgttggtacgtagatcgcggaaggtgcggattagtaattttagtatcgcgttaggtattttatgcggaatatcgttatgggttagtaaacgcgtcgaagtattggcgattagttttaatttttgggcgaaatttataatcggaaaaatcgttttaaaatcgaagcgacgttttagcgtagtatttatt

SEQ ID NO: 27526 - DNA, 525 bp, Artificial Sequence
  chemically treated genomic DNA (Homo sapiens) CpG-island No: 27526
aataaatactacgctaaaacgtcgcttcgattttaaaacgatttttccgattataaatttcgcccaaaaattaaaactaatcgccaatacttcgacgcgtttactaacccataacgatattccgcataaaatacctaacgcgatactaaaattactaatccgcaccttccgcgatctacgtaccaacgacgaaaaaaaaacgtcaataaatacactaacaacgattatatccaccgctaaaaccgtaaacgtaacccatactataaacgtccgcgcctaatttttaacgaatcgcgcgaaaaaacctaccgacctaataaaatatattaccgaaaccatcgtcaaaaataacgaaaaaaatcgcgcgcgtctacgccgttacttcgaacaacgtatcgccacacataaaaaaactcactaacaaacttattatcaaacccgccaccgcctaccgtaaaaaaaaatacataaacgaaccgttaattatcgacatccgacatcataatccgacctacgcccgactaa

SEQ ID NO: 27527 - DNA, 525 bp, Artificial Sequence
  chemically treated genomic DNA (Homo sapiens) CpG-island No: 27527
aatgagtgttgcgttaaagcgtcgtttcgattttgaaacggttttttcgattatggatttcgtttaggagttggaattggtcgttagtgtttcggcgcgtttgttggtttatagcggtatttcgtataaagtgtttgacgcggtattggaattattggttcgtatttttcgcgatttgcgtgttaacggcgaaaagaaaacgttaatggatatattgatagcgattatgtttatcgttgaagtcgtgaacgtggtttatgttgtgggcgttcgcgtttggtttttagcgaatcgcgcgggggagtttgtcgatttggtggaatgtattgtcggaattatcgttaaagataacgaagaagatcgcgcgcgtttgcgtcgttatttcgaatagcgtgtcgttatatataaagaagtttattggtaggtttattattaagttcgttatcgtttgtcgtgaggaaagatgtatgagcgagtcgttaattgtcggtattcggtattatagttcggtttgcgttcggttgg

SEQ ID NO: 27528 - DNA, 525 bp, Artificial Sequence
  chemically treated genomic DNA (Homo sapiens) CpG-island No: 27528
ccaaccgaacgcaaaccgaactataataccgaataccgacaattaacgactcgctcatacatctttcctcacgacaaacgataacgaacttaataataaacctaccaataaacttctttatatataacgacacgctattcgaaataacgacgcaaacgcgcgcgatcttcttcgttatctttaacgataattccgacaatacattccaccaaatcgacaaactcccccgcgcgattcgctaaaaaccaaacgcgaacgcccacaacataaaccacgttcacgacttcaacgataaacataatcgctatcaatatatccattaacgttttcttttcgccgttaacacgcaaatcgcgaaaaatacgaaccaataattccaataccgcgtcaaacactttatacgaaataccgctataaaccaacaaacgcgccgaaacactaacgaccaattccaactcctaaacgaaatccataatcgaaaaaaccgtttcaaaatcgaaacgacgctttaacgcaacactcatt

SEQ ID NO: 27529 - DNA, 905 bp, Artificial Sequence
  chemically treated genomic DNA (Homo sapiens) CpG-island No: 27529
ggggcgaatattcgttttttttgtcgtcgtttcggtattttatttgttatcggttataagtggttttagcgttgggtttaggaaggtgtcgtcggtttttaggatcgttcgcgtatttcgtattatttttcgaatcgtttatttgacgatattacggttttgttgcgtatggtttatgatcgttatgaacgttggggagttcgtaagattaagcgttggttcgaggattaggggtatattatgttcgtttttagtatcgtttataatttgatggttcgttatggtttgttgtcgggcgttttatcgggtattttcgttacgggtcggttcgaatacgacgcgtcgaatcgtttttggtagatggattttaagggttattttttttttggcggtggacgttgttattcgtttattttgttggacgattattttcgtttttttttgtgtttggcgtattgtatcgatgaacggcgcgagatcgtgtagtagtagttggttagcgtgtttgagcgttacggtttgtcggatcggatgattatggataacggtttatcgtggggcgatattatcggtatttggacggcgttggagttgtggttgatgcgtttgggtattcgggtggggtattttcgggtttattattcgtagacgtaggggaagttggagcgtattatcgtagtttgtatgggggaatgttgtaggtaattggttcgaaatcgcggtgaatgtaggggttttgaatattggggaggttatatttgaggtcgaaaagcgtgaatgggagcggttagaaacgtagcgagtataggttaaagtcgaaataaaggcggtttaaggtatatattagtacggagttagcgataggttagaagtcgcgaaaaaaatattaatttgttaacgtgtta

SEQ ID NO: 27530 - DNA, 905 bp, Artificial Sequence
  chemically treated genomic DNA (Homo sapiens) CpG-island No: 27530
taacacgttaacaaattaatatttttttcgcgacttctaacctatcgctaactccgtactaatatataccttaaaccgcctttatttcgactttaacctatactcgctacgtttctaaccgctcccattcacgcttttcgacctcaaatataacctccccaatattcaaaacccctacattcaccgcgatttcgaaccaattacctacaacattcccccatacaaactacgataatacgctccaacttcccctacgtctacgaataataaacccgaaaataccccacccgaatacccaaacgcatcaaccacaactccaacgccgtccaaataccgataatatcgccccacgataaaccgttatccataatcatccgatccgacaaaccgtaacgctcaaacacgctaaccaactactactacacgatctcgcgccgttcatcgatacaatacgccaaacacaaaaaaaaacgaaaataatcgtccaacaaaataaacgaataacaacgtccaccgccaaaaaaaaaataacccttaaaatccatctaccaaaaacgattcgacgcgtcgtattcgaaccgacccgtaacgaaaatacccgataaaacgcccgacaacaaaccataacgaaccatcaaattataaacgatactaaaaacgaacataatatacccctaatcctcgaaccaacgcttaatcttacgaactccccaacgttcataacgatcataaaccatacgcaacaaaaccgtaatatcgtcaaataaacgattcgaaaaataatacgaaatacgcgaacgatcctaaaaaccgacgacaccttcctaaacccaacgctaaaaccacttataaccgataacaaataaaataccgaaacgacgacaaaaaaaacgaatattcgcccc

SEQ ID NO: 27531 - DNA, 905 bp, Artificial Sequence
  chemically treated genomic DNA (Homo sapiens) CpG-island No: 27531
taatacgttgataaattagtgtttttttcgcggtttttagtttgtcgttaatttcgtgttggtgtgtattttgggtcgtttttgtttcggttttggtttgtgttcgttgcgtttttggtcgtttttatttacgtttttcggttttaagtataatttttttagtgtttaaggtttttgtatttatcgcggtttcgaattagttgtttgtagtatttttttatgtagattgcggtgatacgttttagttttttttgcgtttgcggatgataagttcgggagtgttttattcggatatttaggcgtattagttatagttttagcgtcgtttaggtgtcggtggtgtcgttttacggtgagtcgttatttatggttattcggttcggtaggtcgtaacgtttaaatacgttgattagttgttgttgtacggtttcgcgtcgtttatcggtatagtgcgttaggtatagggaaaaacgggagtggtcgtttagtagggtgagcggatggtagcgtttatcgttaaaaggaaagtggtttttaaaatttatttgttagaggcggttcggcgcgtcgtgttcgaatcggttcgtggcgggaatgttcggtgaagcgttcggtagtaggttatggcgggttattaggttatggacggtgttgaaggcgggtatggtgtgtttttggttttcgagttagcgtttaattttgcgggttttttagcgtttatgacggttatgggttatacgtagtagggtcgtgatgtcgttagatgagcggttcggggaatggtgcggaatgcgcgggcggttttgaagatcggcggtatttttttgagtttagcgttggagttatttgtagtcggtggtaggtgaaatgtcgaagcgacggtagagggaacggatgttcgtttt

SEQ ID NO: 27532 - DNA, 905 bp, Artificial Sequence
  chemically treated genomic DNA (Homo sapiens) CpG-island No: 27532
aaaacgaacatccgttccctctaccgtcgcttcgacatttcacctaccaccgactacaaataactccaacgctaaactcaaaaaaataccgccgatcttcaaaaccgcccgcgcattccgcaccattccccgaaccgctcatctaacgacatcacgaccctactacgtataacccataaccgtcataaacgctaaaaaacccgcaaaattaaacgctaactcgaaaaccaaaaacacaccatacccgccttcaacaccgtccataacctaataacccgccataacctactaccgaacgcttcaccgaacattcccgccacgaaccgattcgaacacgacgcgccgaaccgcctctaacaaataaattttaaaaaccactttccttttaacgataaacgctaccatccgctcaccctactaaacgaccactcccgtttttccctatacctaacgcactataccgataaacgacgcgaaaccgtacaacaacaactaatcaacgtatttaaacgttacgacctaccgaaccgaataaccataaataacgactcaccgtaaaacgacaccaccgacacctaaacgacgctaaaactataactaatacgcctaaatatccgaataaaacactcccgaacttatcatccgcaaacgcaaaaaaaactaaaacgtatcaccgcaatctacataaaaaaatactacaaacaactaattcgaaaccgcgataaatacaaaaaccttaaacactaaaaaaattatacttaaaaccgaaaaacgtaaataaaaacgaccaaaaacgcaacgaacacaaaccaaaaccgaaacaaaaacgacccaaaatacacaccaacacgaaattaacgacaaactaaaaaccgcgaaaaaaacactaatttatcaacgtatta

SEQ ID NO: 27533 - DNA, 506 bp, Artificial Sequence
  chemically treated genomic DNA (Homo sapiens) CpG-island No: 27533
gttttttattttcggttcgcggttggcgttggagggtagtatcgtttatatcgttaattacgcgttcgttaaaagtttgtttttttttgtagtaggtgcgttgagttatagttgcggtacgcgtttgttgtcgcgtttgcgtggcgtattgtatattttgtcgttgttaggcgtgggtttttgcgtggtagcgttggcgattatcggcgtgtcgtcgtttaacggtttttttagtaaattttcgttgtttgttgtcggttttgcgttgttagtggagtattggattttgttgttcgttatgatttttttgatgattgaatcggtcgttagtttcgtttggtttattcgttggtttggtcgcgttgtgtttggtaaatcgagcgaggtcgtcgtcgatgtcgtatcgttgttaggattaatgcgtttggtgttgattgtattgattgtgatgtcgttgatttttagcgtaatcgtcgcgatttggttgtagtaaggagatgatgaat

SEQ ID NO: 27534 - DNA, 506 bp, Artificial Sequence
  chemically treated genomic DNA (Homo sapiens) CpG-island No: 27534
attcatcatctccttactacaaccaaatcgcgacgattacgctaaaaatcaacgacatcacaatcaatacaatcaacaccaaacgcattaatcctaacaacgatacgacatcgacgacgacctcgctcgatttaccaaacacaacgcgaccaaaccaacgaataaaccaaacgaaactaacgaccgattcaatcatcaaaaaaatcataacgaacaacaaaatccaatactccactaacaacgcaaaaccgacaacaaacaacgaaaatttactaaaaaaaccgttaaacgacgacacgccgataatcgccaacgctaccacgcaaaaacccacgcctaacaacgacaaaatatacaatacgccacgcaaacgcgacaacaaacgcgtaccgcaactataactcaacgcacctactacaaaaaaaaacaaacttttaacgaacgcgtaattaacgatataaacgatactaccctccaacgccaaccgcgaaccgaaaataaaaaac

SEQ ID NO: 27535 - DNA, 506 bp, Artificial Sequence
  chemically treated genomic DNA (Homo sapiens) CpG-island No: 27535
atttattatttttttattgtaattaggtcgcggcgattacgttggaaattagcgatattataattagtataattaatattaggcgtattgattttggtagcggtgcggtatcggcgacggtttcgttcggtttgttaggtataacgcgattaaattagcgaataaattaggcgaaattggcgatcgatttaattattagaagaattatggcgggtagtaggatttagtattttattgataacgtaaaatcggtagtaaatagcgggaatttattgaagaagtcgttgaacggcggtacgtcggtaatcgttagcgttgttacgtagaaatttacgtttggtaacggtagggtgtgtaatacgttacgtagacgcggtaataagcgcgtgtcgtagttgtaatttagcgtatttgttataaggaaaaataggtttttagcgaacgcgtggttgacgatgtaggcgatgttgttttttagcgttagtcgcgagtcgaagatggagagt

SEQ ID NO: 27536 - DNA, 506 bp, Artificial Sequence
  chemically treated genomic DNA (Homo sapiens) CpG-island No: 27536
actctccatcttcgactcgcgactaacgctaaaaaacaacatcgcctacatcgtcaaccacgcgttcgctaaaaacctatttttccttataacaaatacgctaaattacaactacgacacgcgcttattaccgcgtctacgtaacgtattacacaccctaccgttaccaaacgtaaatttctacgtaacaacgctaacgattaccgacgtaccgccgttcaacgacttcttcaataaattcccgctatttactaccgattttacgttatcaataaaatactaaatcctactacccgccataattcttctaataattaaatcgatcgccaatttcgcctaatttattcgctaatttaatcgcgttatacctaacaaaccgaacgaaaccgtcgccgataccgcaccgctaccaaaatcaatacgcctaatattaattatactaattataatatcgctaatttccaacgtaatcgccgcgacctaattacaataaaaaaataataaat

SEQ ID NO: 27537 - DNA, 856 bp, Artificial Sequence
  chemically treated genomic DNA (Homo sapiens) CpG-island No: 27537
tatttttgtcgttcgcgttgcggttacggcggtttgaatgttggtaatgatcgggcgagtggttgagatattaaattcggcgagatttaagtagtcgtttggcgtggtataagcgttttgtatatttattacgattagcgtattttgttgcggatcgaaggtaatggttttcggtcgagcggttaaggtcgttattatgttattttttgagttagcgtaggtagatgggcgcggtattgtattagtggttgaatgcgttcgtcgaaggtttcgattttcgatagaaaatcgtcgaaggttaatagtacgttttcggtattaggtacgtttgcgattttatttaatatgcgcgcgatattggcgtaagaatcgattaacgtttttatattgatgtttatcgtcgaagtgggatcggttatttgacgaacgttggtgttagtatcggagcgggtatttttttgattttgttcggttagttagtttaacgtttttttattcgcgttcgttttgtagtgtttttatttggcgcgagcggtatcgtcggttttatcggtaattattataaataatatataagagttaacgtcgcgttcggtttgttttgcggtttgttttattcgcgtagcggtcggggcgaaagtcgtgggtgtatttacgtttttgtcgaaatagaagttgaaatcggtatatcgggcggagaacgttatgttagcgtcgttttgttcggcgtagattatttttatggggatattcggttgcggatttacgcgataattatttatggtgaaaaaatcgtttttaaaatcgttttttttcgtgttttataggtcgcgtagtatttgaatatattcggtga

SEQ ID NO: 27538 - DNA, 856 bp, Artificial Sequence
  chemically treated genomic DNA (Homo sapiens) CpG-island No: 27538
tcaccgaatatattcaaatactacgcgacctataaaacacgaaaaaaaacgattttaaaaacgattttttcaccataaataattatcgcgtaaatccgcaaccgaatatccccataaaaataatctacgccgaacaaaacgacgctaacataacgttctccgcccgatataccgatttcaacttctatttcgacaaaaacgtaaatacacccacgactttcgccccgaccgctacgcgaataaaacaaaccgcaaaacaaaccgaacgcgacgttaactcttatatattatttataataattaccgataaaaccgacgataccgctcgcgccaaataaaaacactacaaaacgaacgcgaataaaaaaacgttaaactaactaaccgaacaaaatcaaaaaaatacccgctccgatactaacaccaacgttcgtcaaataaccgatcccacttcgacgataaacatcaatataaaaacgttaatcgattcttacgccaatatcgcgcgcatattaaataaaatcgcaaacgtacctaataccgaaaacgtactattaaccttcgacgattttctatcgaaaatcgaaaccttcgacgaacgcattcaaccactaatacaataccgcgcccatctacctacgctaactcaaaaaataacataataacgaccttaaccgctcgaccgaaaaccattaccttcgatccgcaacaaaatacgctaatcgtaataaatatacaaaacgcttataccacgccaaacgactacttaaatctcgccgaatttaatatctcaaccactcgcccgatcattaccaacattcaaaccgccgtaaccgcaacgcgaacgacaaaaata

SEQ ID NO: 27539 - DNA, 856 bp, Artificial Sequence
  chemically treated genomic DNA (Homo sapiens) CpG-island No: 27539
ttatcgaatatgtttaggtgttgcgcgatttgtggggtacggggaaaagcgattttaaaggcgatttttttattatgaatgattgtcgcgtgagttcgtaatcgagtgtttttatgaaagtgatttgcgtcgggtaaagcgacgttggtatggcgtttttcgttcggtatgtcgattttaatttttgtttcggtaaaggcgtaaatatatttacggttttcgtttcgatcgttgcgcggatgaaataggtcgtagagtaaatcggacgcgacgttggtttttatgtgttgtttatggtgattgtcgatgaaatcgacgatgtcgttcgcgttaaatgggaatattataaagcgggcgcggatgaagaggcgttaagttggttaatcgaataaagttagaaagatattcgtttcggtattgatattaacgttcgttagatggtcgattttatttcggcggtaaatattaatatggggacgttagtcggtttttacgttagtgtcgcgcgtatgttagatgaagtcgtaagcgtgtttggtgtcgaaggcgtgttgttaattttcgacgattttttgtcgggaatcgaaattttcggcgagcgtatttaattattgatgtaatgtcgcgtttatttatttgcgttgatttaggaggtggtatgatgacgattttaatcgttcgatcggaagttattattttcgattcgtagtaaagtgcgttgatcgtggtggatatgtaaaacgtttatgttacgttaggcggttatttagatttcgtcgggtttgatgttttaattattcgttcggttattgttaatatttaaatcgtcgtgatcgtagcgcgagcggtagggatg

SEQ ID NO: 27540 - DNA, 856 bp, Artificial Sequence
  chemically treated genomic DNA (Homo sapiens) CpG-island No: 27540
catccctaccgctcgcgctacgatcacgacgatttaaatattaacaataaccgaacgaataattaaaacatcaaacccgacgaaatctaaataaccgcctaacgtaacataaacgttttacatatccaccacgatcaacgcactttactacgaatcgaaaataataacttccgatcgaacgattaaaatcgtcatcataccacctcctaaatcaacgcaaataaataaacgcgacattacatcaataattaaatacgctcgccgaaaatttcgattcccgacaaaaaatcgtcgaaaattaacaacacgccttcgacaccaaacacgcttacgacttcatctaacatacgcgcgacactaacgtaaaaaccgactaacgtccccatattaatatttaccgccgaaataaaatcgaccatctaacgaacgttaatatcaataccgaaacgaatatctttctaactttattcgattaaccaacttaacgcctcttcatccgcgcccgctttataatattcccatttaacgcgaacgacatcgtcgatttcatcgacaatcaccataaacaacacataaaaaccaacgtcgcgtccgatttactctacgacctatttcatccgcgcaacgatcgaaacgaaaaccgtaaatatatttacgcctttaccgaaacaaaaattaaaatcgacataccgaacgaaaaacgccataccaacgtcgctttacccgacgcaaatcactttcataaaaacactcgattacgaactcacgcgacaatcattcataataaaaaaatcgcctttaaaatcgcttttccccgtaccccacaaatcgcgcaacacctaaacatattcgataa

SEQ ID NO: 27541 - DNA, 940 bp, Artificial Sequence
  chemically treated genomic DNA (Homo sapiens) CpG-island No: 27541
  misc_feature (367)..(368): n is either a, c, g or t
  misc_feature (376)..(376): n is either a, c, g or t
  misc_feature (379)..(379): n is either a, c, g or t
  misc_feature (384)..(384): n is either a, c, g or t
  misc_feature (390)..(390): n is either a, c, g or t
  misc_feature (397)..(397): n is either a, c, g or t
  misc_feature (402)..(402): n is either a, c, g or t
  misc_feature (411)..(411): n is either a, c, g or t
  misc_feature (414)..(414): n is either a, c, g or t
tgaatggttttcgtcgcgtacgtcgttttttgcgttatcgtttgcggtaatgttattttcgtagattagtcgtaaaggaattcggtaatgaacgaattttcggtatttatggtgtcgataatcgttatcggtttaggagtttgacgttagaattgcgcgttattttaggtaatgttggcgtttttatttagcgtgataattattgtttttgcgttacgggtaataatcgtttttatttttagacgtagcgtttcgttttttgcggcggaggtaaggtaaaatcgagatgcggtattagtgtttgttagagcgggttgttttattgtcggagaagtcgaaagcggtaagtttttgtttcggtaagcgnntgttagtntgntgagngaatanttgtcgnttatnttttcgtantgnttatattagattgtcgcgtgtataatgttatattgcgttagttaggcgtaattttttttatttagggtaaagtcggttattacgttttcggtgtagtcgtttaaaacgcgagtaggggcgggtagggttatcggaggttgtgcgggaacgtcgtgtttcgtagggatagggttgagagcgacgtttaggcgggcgagagttcggcggtagcgtgtgggtcggaggtagcggtatttatttaggtaatgtagtttcggcgggaggtcgtagcgagggtaggatatcgttatagggatcgtaggatcgttagaaaacgcgggaggttaggggcggggtagagagtcgacgtagggagtcgtcgagtggtcgttagggggggttagtcgtcgttagttcgttcggtagtagcgcgcgaaagcgggtttagcgtcgggcgggtatagagtttgggttcgtttatatatatcgttattagtttttattcgtatagtaatttttatagtttcgtttaatatagtcgcgtatt

SEQ ID NO: 27542 - DNA, 940 bp, Artificial Sequence
  chemically treated genomic DNA (Homo sapiens) CpG-island No: 27542
  misc_feature (527)..(527): n is either a, c, g or t
  misc_feature (530)..(530): n is either a, c, g or t
  misc_feature (539)..(539): n is either a, c, g or t
  misc_feature (544)..(544): n is either a, c, g or t
  misc_feature (551)..(551): n is either a, c, g or t
  misc_feature (557)..(557): n is either a, c, g or t
  misc_feature (562)..(562): n is either a, c, g or t
  misc_feature (565)..(565): n is either a, c, g or t
  misc_feature (573)..(574): n is either a, c, g or t
aatacgcgactatattaaacgaaactataaaaattactatacgaataaaaactaataacgatatatataaacgaacccaaactctatacccgcccgacgctaaacccgctttcgcgcgctactaccgaacgaactaacgacgactaaccccccctaacgaccactcgacgactccctacgtcgactctctaccccgcccctaacctcccgcgttttctaacgatcctacgatccctataacgatatcctaccctcgctacgacctcccgccgaaactacattacctaaataaataccgctacctccgacccacacgctaccgccgaactctcgcccgcctaaacgtcgctctcaaccctatccctacgaaacacgacgttcccgcacaacctccgataaccctacccgcccctactcgcgttttaaacgactacaccgaaaacgtaataaccgactttaccctaaataaaaaaaattacgcctaactaacgcaatataacattatacacgcgacaatctaatataancantacgaaaanataancgacaantattcnctcancanactaacanncgcttaccgaaacaaaaacttaccgctttcgacttctccgacaataaaacaacccgctctaacaaacactaataccgcatctcgattttaccttacctccgccgcaaaaaacgaaacgctacgtctaaaaataaaaacgattattacccgtaacgcaaaaacaataattatcacgctaaataaaaacgccaacattacctaaaataacgcgcaattctaacgtcaaactcctaaaccgataacgattatcgacaccataaataccgaaaattcgttcattaccgaattcctttacgactaatctacgaaaataacattaccgcaaacgataacgcaaaaaacgacgtacgcgacgaaaaccattca

SEQ ID NO: 27543 - DNA, 940 bp, Artificial Sequence
  chemically treated genomic DNA (Homo sapiens) CpG-island No: 27543
  misc_feature (527)..(527): n is either a, c, g or t
  misc_feature (530)..(530): n is either a, c, g or t
  misc_feature (539)..(539): n is either a, c, g or t
  misc_feature (544)..(544): n is either a, c, g or t
  misc_feature (551)..(551): n is either a, c, g or t
  misc_feature (557)..(557): n is either a, c, g or t
  misc_feature (562)..(562): n is either a, c, g or t
  misc_feature (565)..(565): n is either a, c, g or t
  misc_feature (573)..(574): n is either a, c, g or t
gatgcgcgattatattgagcggggttatgagggttattgtacgagtggaggttggtgacgatgtatatgaacgagtttagattttatgttcgttcggcgttggattcgttttcgcgcgttgttgtcggacggattgacgacgattgattttttttggcgattattcggcgattttttgcgtcgattttttatttcgtttttgatttttcgcgttttttggcggttttgcggtttttgtggcggtgttttgttttcgttacggtttttcgtcgggattgtattatttgggtgggtgtcgttgttttcggtttatacgttgtcgtcggattttcgttcgtttgggcgtcgtttttagttttgtttttacgaaatacggcgttttcgtataattttcggtggttttgttcgtttttgttcgcgttttgggcgattatatcgaaggcgtgatggtcgattttgttttgagtgaagaggattacgtttggttggcgtagtatgatattgtgtacgcggtaatttggtgtgantantgcgggganatgancggtaantgtttntttantangttggtanncgtttgtcggggtaagagtttatcgttttcgattttttcgatagtgggatagttcgttttggtagatattggtgtcgtatttcgattttgttttgttttcgtcgtagaagacgaaacgttgcgtttgaagatgaaagcgattgttgttcgtggcgtaggaatagtgattgttacgttgggtgaaaacgttagtattgtttgggatggcgcgtagttttggcgttaggtttttgaatcggtgacggttatcgatattatgggtgtcggagattcgtttattgtcggatttttttgcggttggtttgcggggatgatattatcgtaggcgatagcgtagggaacggcgtgcgcggcgaaaattattta

SEQ ID NO: 27544 - DNA, 940 bp, Artificial Sequence
  chemically treated genomic DNA (Homo sapiens) CpG-island No: 27544
  misc_feature (367)..(368): n is either a, c, g or t
  misc_feature (376)..(376): n is either a, c, g or t
  misc_feature (379)..(379): n is either a, c, g or t
  misc_feature (384)..(384): n is either a, c, g or t
  misc_feature (390)..(390): n is either a, c, g or t
  misc_feature (397)..(397): n is either a, c, g or t
  misc_feature (402)..(402): n is either a, c, g or t
  misc_feature (411)..(411): n is either a, c, g or t
  misc_feature (414)..(414): n is either a, c, g or t
taaataattttcgccgcgcacgccgttccctacgctatcgcctacgataatatcatccccgcaaaccaaccgcaaaaaaatccgacaataaacgaatctccgacacccataatatcgataaccgtcaccgattcaaaaacctaacgccaaaactacgcgccatcccaaacaatactaacgttttcacccaacgtaacaatcactattcctacgccacgaacaacaatcgctttcatcttcaaacgcaacgtttcgtcttctacgacgaaaacaaaacaaaatcgaaatacgacaccaatatctaccaaaacgaactatcccactatcgaaaaaatcgaaaacgataaactcttaccccgacaaacgnntaccaacntantaaanaaacanttaccgntcatntccccgcantantcacaccaaattaccgcgtacacaatatcatactacgccaaccaaacgtaatcctcttcactcaaaacaaaatcgaccatcacgccttcgatataatcgcccaaaacgcgaacaaaaacgaacaaaaccaccgaaaattatacgaaaacgccgtatttcgtaaaaacaaaactaaaaacgacgcccaaacgaacgaaaatccgacgacaacgtataaaccgaaaacaacgacacccacccaaataatacaatcccgacgaaaaaccgtaacgaaaacaaaacaccgccacaaaaaccgcaaaaccgccaaaaaacgcgaaaaatcaaaaacgaaataaaaaatcgacgcaaaaaatcgccgaataatcgccaaaaaaaatcaatcgtcgtcaatccgtccgacaacaacgcgcgaaaacgaatccaacgccgaacgaacataaaatctaaactcgttcatatacatcgtcaccaacctccactcgtacaataaccctcataaccccgctcaatataatcgcgcatc

SEQ ID NO: 27545 - DNA, 560 bp, Artificial Sequence
  chemically treated genomic DNA (Homo sapiens) CpG-island No: 27545
tagcgtgtcgtttttcgggcgatcgaagtagacgttgtcgtgcgtatcgtaaacgtttagatttgtatcgttagcgtaatttttgtagtaacgtatatagcggtagtaggcgatgtagcggtttatttcgtgagagatgaatggttttaaattttgattacggtgggtacgtttggtgaaacggtagcgacggaagttgtgttcggttattatagttatattttgaagatggtagttatcgttttttttatatatcggatagtcgtgcgggtggttggttattaattattcgattacgtttttacggaattgtttcgttttttcgtcgttaatggaaataaaggtgttatcggaagtcggtgttatataggatattattaggcgattacgcgtgtttttcgcgttttggtattgttttatcgtatattggcggtaagtatcgatattttttagcgtcggatgttagtaaaagtcgggaatattaaggtttagagatagataagtttttagtaggttgttcgtttcgttgatttcgtattttttgtcgtttatatgaattg

SEQ ID NO: 27546 - DNA, 560 bp, Artificial Sequence
  chemically treated genomic DNA (Homo sapiens) CpG-island No: 27546
caattcatataaacgacaaaaaatacgaaatcaacgaaacgaacaacctactaaaaacttatctatctctaaaccttaatattcccgacttttactaacatccgacgctaaaaaatatcgatacttaccgccaatatacgataaaacaataccaaaacgcgaaaaacacgcgtaatcgcctaataatatcctatataacaccgacttccgataacacctttatttccattaacgacgaaaaaacgaaacaattccgtaaaaacgtaatcgaataattaataaccaaccacccgcacgactatccgatatataaaaaaaacgataactaccatcttcaaaatataactataataaccgaacacaacttccgtcgctaccgtttcaccaaacgtacccaccgtaatcaaaatttaaaaccattcatctctcacgaaataaaccgctacatcgcctactaccgctatatacgttactacaaaaattacgctaacgatacaaatctaaacgtttacgatacgcacgacaacgtctacttcgatcgcccgaaaaacgacacgcta

SEQ ID NO: 27547 - DNA, 560 bp, Artificial Sequence
  chemically treated genomic DNA (Homo sapiens) CpG-island No: 27547
taatttatgtagacggtaaagaatacgaggttaacggagcggataatttgttggaagtttgtttgtttttgggttttgatattttcgatttttgttggtattcggcgttgggaagtgtcggtgtttgtcgttagtgtgcggtgaagtaatattaaaacgcggaagatacgcgtggtcgtttggtgatgttttgtatgatatcggttttcgatggtatttttatttttattgacgacgaagaagcgaaatagtttcgtgaaagcgtggtcgagtggttgatgattaattattcgtacgattgttcggtatgtgaagagggcggtaattgttatttttaggatatgattgtgatgatcggatatagttttcgtcgttatcgttttattaaacgtatttatcgtaattaggatttggggttatttattttttacgaaatgaatcgttgtatcgtttgttatcgttgtgtgcgttattataaagattacgttgacggtatagatttgggcgtttacggtgcgtacgataacgtttatttcggtcgttcggaagacggtacgttg

SEQ ID NO: 27548 - DNA, 560 bp, Artificial Sequence
  chemically treated genomic DNA (Homo sapiens) CpG-island No: 27548
caacgtaccgtcttccgaacgaccgaaataaacgttatcgtacgcaccgtaaacgcccaaatctataccgtcaacgtaatctttataataacgcacacaacgataacaaacgatacaacgattcatttcgtaaaaaataaataaccccaaatcctaattacgataaatacgtttaataaaacgataacgacgaaaactatatccgatcatcacaatcatatcctaaaaataacaattaccgccctcttcacataccgaacaatcgtacgaataattaatcatcaaccactcgaccacgctttcacgaaactatttcgcttcttcgtcgtcaataaaaataaaaataccatcgaaaaccgatatcatacaaaacatcaccaaacgaccacgcgtatcttccgcgttttaatattacttcaccgcacactaacgacaaacaccgacacttcccaacgccgaataccaacaaaaatcgaaaatatcaaaacccaaaaacaaacaaacttccaacaaattatccgctccgttaacctcgtattctttaccgtctacataaatta

SEQ ID NO: 27549 - DNA, 588 bp, Artificial Sequence
  chemically treated genomic DNA (Homo sapiens) CpG-island No: 27549
  misc_feature (35)..(35): n is either a, c, g or t
  misc_feature (48)..(48): n is either a, c, g or t
  misc_feature (51)..(51): n is either a, c, g or t
gtagttatggtcggtaagttatttggttttagggnttttaagttcggnggntggcgtattttggtgtttttatcggcgtggtttgttcggtgtgtttcggcggagtgacgttcggttattcggttaattttttgttcggtgtaaaggtttttttcggtgaaatcgatatcgttttgttcggttcgttgtcgtttattttttttcgtatttatagtagttatcggataaaaacgttcgcgtcggtggggagtttcggtttcggttggaaaatgtttgcggatattcgtttatagttgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttattttttaagcgtaaagtatgggcgtggtggaaatcgagagtcggtagcgagatagagtaagatttatcgtttttggatttgtatcgggtagt

SEQ ID NO: 27550 - DNA, 588 bp, Artificial Sequence
  chemically treated genomic DNA (Homo sapiens) CpG-island No: 27550
  misc_feature (538)..(538): n is either a, c, g or t
  misc_feature (541)..(541): n is either a, c, g or t
  misc_feature (554)..(554): n is either a, c, g or t
actacccgatacaaatccaaaaacgataaatcttactctatctcgctaccgactctcgatttccaccacgcccatactttacgcttaaaaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcaactataaacgaatatccgcaaacattttccaaccgaaaccgaaactccccaccgacgcgaacgtttttatccgataactactataaatacgaaaaaaaataaacgacaacgaaccgaacaaaacgatatcgatttcaccgaaaaaaacctttacaccgaacaaaaaattaaccgaataaccgaacgtcactccgccgaaacacaccgaacaaaccacgccgataaaaacaccaaaatacgccanccnccgaacttaaaanccctaaaaccaaataacttaccgaccataactac

SEQ ID NO: 27551 - DNA, 588 bp, Artificial Sequence
  chemically treated genomic DNA (Homo sapiens) CpG-island No: 27551
  misc_feature (538)..(538): n is either a, c, g or t
  misc_feature (541)..(541): n is either a, c, g or t
  misc_feature (554)..(554): n is either a, c, g or t
gttattcgatataaatttaggaacggtgaattttgttttgtttcgttatcgattttcgatttttattacgtttatgttttgcgtttgaagaataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtagttgtaagcggatattcgtaggtattttttagtcggggtcgaggttttttatcggcgcgggcgtttttgttcggtaattgttgtaggtgcgggagaggatgaacggtagcgggtcgggtagggcgatgtcggttttatcgggaaggatttttgtatcgagtaggggattgatcggatggtcggacgttatttcgtcggggtatatcgaataggttacgtcggtgggggtattaaaatgcgttanttntcgggtttgaaanttttggaattaaatggtttatcggttataattgt

SEQ ID NO: 27552 - DNA, 588 bp, Artificial Sequence
  chemically treated genomic DNA (Homo sapiens) CpG-island No: 27552
  misc_feature (35)..(35): n is either a, c, g or t
  misc_feature (48)..(48): n is either a, c, g or t
  misc_feature (51)..(51): n is either a, c, g or t
acaattataaccgataaaccatttaattccaaaantttcaaacccganaantaacgcattttaatacccccaccgacgtaacctattcgatataccccgacgaaataacgtccgaccatccgatcaatcccctactcgatacaaaaatccttcccgataaaaccgacatcgccctacccgacccgctaccgttcatcctctcccgcacctacaacaattaccgaacaaaaacgcccgcgccgataaaaaacctcgaccccgactaaaaaatacctacgaatatccgcttacaactacgcgataacacactaatactcaataataacgacgacaaaaacctatattttaaacacctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttattcttcaaacgcaaaacataaacgtaataaaaatcgaaaatcgataacgaaacaaaacaaaattcaccgttcctaaatttatatcgaataac

SEQ ID NO: 27553 - DNA, 1238 bp, Artificial Sequence
  chemically treated genomic DNA (Homo sapiens) CpG-island No: 27553
gttttttagttgcgcgatatcgcgtatatttgtcggtttgtcgttaagttgacgataaatttgcgttagcgtcgttgcgtttagcgcgttattgtttttgtttaaattaattagtagtagtgcgttattttcggtagaaagttgcggcgtgatggtgtgacgtatattttttacgcgggtaaatgtagaaattattagcgatagcggcgacgttatttcgcgtttttcgttatttttttgttagcgggtttttatcgatatggagtttttatttatcgggatcgttaggtttagcgtcggataaagtttttcgtttacggttttaacggttttatataggttcgtatttttattagcgtggtttgtcgtcgttatttagttggcggaaagtttgatgcgtatgatatcgttaatttgtgttgcggcgatgttggttaacgttttatcgatcggtagacgggtagaggcggcgaaatttagtagcgtaatcggcgtacgttcgttaatcgttatcgttttatcgtagtagttgtcgaggttggcggtagtgatcgcgtagttagcgatcggtatttgttacggttttattatttgatcgcgcgttattatgtcggttacgttgcggtcgttaatggttattaggaaggtttttttcgttattagtcggtagtatgtagtatacgtttgtatcgcgtttgtaattggtgatttttttacgggttagcgcgtcgtttttcgtttttagcgtttgtatatcgcgggttattttcggcgttttattaagtaggacgtttagcggtagatcgatcggttgattattaaaatgacgatcgtgtagagaaagatgtagtttttcggtcgttttattaattatcgcgtagggtgcgcgtttacgtttatatagttcgttaaatagcggtaattgatcggtagtaatcgttagtacgtagcgtttttgggattcgttatattagatttttagcgggtttatgttcggttcgtcgtttagaatttcgcgtagtttaaatttatcgtcgcgttcgtcgtcgtttattagtttcggtatggcgttagaaagatcgttagcgttaacgtcgtggataaataggattgggttggtattattaagttgttagtaacggtcgattattttttggtagcgacgttttattttcgggttgtcgcgttgtacggaagtaaagtcgaggtcggtattagattgattagacgttatagaa

SEQ ID NO: 27554 - DNA, 1238 bp, Artificial Sequence
  chemically treated genomic DNA (Homo sapiens) CpG-island No: 27554
ttctataacgtctaatcaatctaataccgacctcgactttacttccgtacaacgcgacaacccgaaaataaaacgtcgctaccaaaaaataatcgaccgttactaacaacttaataataccaacccaatcctatttatccacgacgttaacgctaacgatctttctaacgccataccgaaactaataaacgacgacgaacgcgacgataaatttaaactacgcgaaattctaaacgacgaaccgaacataaacccgctaaaaatctaatataacgaatcccaaaaacgctacgtactaacgattactaccgatcaattaccgctatttaacgaactatataaacgtaaacgcgcaccctacgcgataattaataaaacgaccgaaaaactacatctttctctacacgatcgtcattttaataatcaaccgatcgatctaccgctaaacgtcctacttaataaaacgccgaaaataacccgcgatatacaaacgctaaaaacgaaaaacgacgcgctaacccgtaaaaaaatcaccaattacaaacgcgatacaaacgtatactacatactaccgactaataacgaaaaaaaccttcctaataaccattaacgaccgcaacgtaaccgacataataacgcgcgatcaaataataaaaccgtaacaaataccgatcgctaactacgcgatcactaccgccaacctcgacaactactacgataaaacgataacgattaacgaacgtacgccgattacgctactaaatttcgccgcctctacccgtctaccgatcgataaaacgttaaccaacatcgccgcaacacaaattaacgatatcatacgcatcaaactttccgccaactaaataacgacgacaaaccacgctaataaaaatacgaacctatataaaaccgttaaaaccgtaaacgaaaaactttatccgacgctaaacctaacgatcccgataaataaaaactccatatcgataaaaacccgctaacaaaaaaataacgaaaaacgcgaaataacgtcgccgctatcgctaataatttctacatttacccgcgtaaaaaatatacgtcacaccatcacgccgcaactttctaccgaaaataacgcactactactaattaatttaaacaaaaacaataacgcgctaaacgcaacgacgctaacgcaaatttatcgtcaacttaacgacaaaccgacaaatatacgcgatatcgcgcaactaaaaaac

SEQ ID NO: 27555 - DNA, 1238 bp, Artificial Sequence
  chemically treated genomic DNA (Homo sapiens) CpG-island No: 27555
ttttatggcgtttggttagtttgatgtcgatttcgattttgttttcgtatagcgcgataattcggagatggagcgtcgttgttaggaagtgatcgatcgttgttggtagtttggtgatgttaatttaattttgtttatttacgacgttggcgttggcggtttttttaacgttatgtcggaattggtgagcgacggcgggcgcggcggtaaatttgaattgcgcgagattttaagcgacgaatcgggtatgagttcgttggaaatttggtgtaacgaattttaggaacgttacgtgttggcggttgttgtcgattaattatcgttgtttgacgaattgtgtaagcgtgagcgcgtattttacgcggtgattggtgaagcgatcgaagaattgtatttttttttgtacgatcgttattttgataattagtcgatcgatttgtcgttggacgttttgtttggtaaaacgtcgaagatgattcgcgatgtataaacgttgaaagcgaaaggcgacgcgttggttcgtgaagggattattagttgtagacgcggtgtaaacgtgtgttgtatattgtcgattagtggcggaaaaaatttttttggtgattattggcgatcgtagcgtaatcggtatggtagcgcgcgattagatggtggggtcgtggtaggtgtcggtcgttaattgcgcggttattatcgttagtttcgatagttattacggtgaagcgatggcgattggcgagcgtgcgtcggttgcgttgttggatttcgtcgtttttgttcgtttgtcggtcggtgaagcgttaattaatatcgtcgtaatataaattggcgatattatacgtattaaatttttcgttaattggatggcggcggtaggttacgttggtgaagatgcgggtttgtatgaagtcgttaaagtcgtgggcgaagagttttgttcggcgttgggtttgacgatttcggtgggtaaagattttatgtcgatgaaaattcgttggtaggaaggtaacgaagagcgcgaaatgacgtcgtcgttgtcgttggtgatttttgtatttgttcgcgtggaagatgtacgttatattattacgtcgtagttttttatcgaagataacgtattgttgttgattgatttgggtaaaggtaataacgcgttgggcgtaacggcgttggcgtaggtttatcgttagtttggcgataaatcggtagatgtacgcgatgtcgcgtaattgaaaggt

SEQ ID NO: 27556 - DNA, 1238 bp, Artificial Sequence
  chemically treated genomic DNA (Homo sapiens) CpG-island No: 27556
acctttcaattacgcgacatcgcgtacatctaccgatttatcgccaaactaacgataaacctacgccaacgccgttacgcccaacgcgttattacctttacccaaatcaatcaacaacaatacgttatcttcgataaaaaactacgacgtaataatataacgtacatcttccacgcgaacaaatacaaaaatcaccaacgacaacgacgacgtcatttcgcgctcttcgttaccttcctaccaacgaattttcatcgacataaaatctttacccaccgaaatcgtcaaacccaacgccgaacaaaactcttcgcccacgactttaacgacttcatacaaacccgcatcttcaccaacgtaacctaccgccgccatccaattaacgaaaaatttaatacgtataatatcgccaatttatattacgacgatattaattaacgcttcaccgaccgacaaacgaacaaaaacgacgaaatccaacaacgcaaccgacgcacgctcgccaatcgccatcgcttcaccgtaataactatcgaaactaacgataataaccgcgcaattaacgaccgacacctaccacgaccccaccatctaatcgcgcgctaccataccgattacgctacgatcgccaataatcaccaaaaaaattttttccgccactaatcgacaatatacaacacacgtttacaccgcgtctacaactaataatcccttcacgaaccaacgcgtcgcctttcgctttcaacgtttatacatcgcgaatcatcttcgacgttttaccaaacaaaacgtccaacgacaaatcgatcgactaattatcaaaataacgatcgtacaaaaaaaaatacaattcttcgatcgcttcaccaatcaccgcgtaaaatacgcgctcacgcttacacaattcgtcaaacaacgataattaatcgacaacaaccgccaacacgtaacgttcctaaaattcgttacaccaaatttccaacgaactcatacccgattcgtcgcttaaaatctcgcgcaattcaaatttaccgccgcgcccgccgtcgctcaccaattccgacataacgttaaaaaaaccgccaacgccaacgtcgtaaataaacaaaattaaattaacatcaccaaactaccaacaacgatcgatcacttcctaacaacgacgctccatctccgaattatcgcgctatacgaaaacaaaatcgaaatcgacatcaaactaaccaaacgccataaaa

SEQ ID NO: 27557 - DNA, 1158 bp, Artificial Sequence
  chemically treated genomic DNA (Homo sapiens) CpG-island No: 27557
tggttggtacgttgggtatgttaagtaaagtaatgcggattttacgttagtaggaagttacggttttgcgtatttatttgtaaattcgtatcggtttgtatgcggcgtttaatgtttgtgaagagatgtgttaacgcgtggcgttggagcgttaattggatagcgaagaacgcgtattattgattgaacgttcgtaaacggttattcgttagggtcgcgattttttttacgtttgggatgttatttggaattcggcgtaggcgttggataacgtattatagtcggatagagtaggttagtttgtcgacgttttggagaaatacgttgtcggtttggtaatcgtatttagtcgttttttttaaataacgtttgaagagatattcgttttttaggttattttgtttattttattaaaataggagtaatacgtttgttagtttttcgttcgtttgttagattggatagtttcggtattaacgttcgttacggaataggtataaggagttacgtaatgattaatcgttaatttttacgtttgttgttgtgtagtattttcggtagtacgacgttgattttcggttgtgttttggtacgtaaggattttgtattttattaatagtttaaatcggaataaattaaattggtcgacgatatttattttgttagtttcggttggtcgtaggcgtagtggtggaaataatttaatgattcgtagttggatgcgttgatttaacggacgttaagtggtttatatattttcgtcgaagcgaaattgcgggaagaaaaagcgtagttttaggtcgatttgttagatgtcggtttataattataggtcgtagcgttagggatgtttaatcgttaacgtgtttcggcgaacggttttttaagtttttatttaatggatgcgttagtattgggtggacgggtcgtattacggaagttatagtaggttgttcggattgttttgatttgtggggtgtatcgtttagcggttgtcgtcgttagcgcgtataatgtcgttggtagaaatcgtagtagtagagttatcgtggttacgggcgtagtagttttattagtataggttagattagatgttcgatttgtgataatttaatgtgatgatacgcggaaagcgtattagagtaaagtggcgtacgg

SEQ ID NO: 27558 - DNA, 1158 bp, Artificial Sequence
  chemically treated genomic DNA (Homo sapiens) CpG-island No: 27558
ccgtacgccactttactctaatacgctttccgcgtatcatcacattaaattatcacaaatcgaacatctaatctaacctatactaataaaactactacgcccgtaaccacgataactctactactacgatttctaccaacgacattatacgcgctaacgacgacaaccgctaaacgatacaccccacaaatcaaaacaatccgaacaacctactataacttccgtaatacgacccgtccacccaatactaacgcatccattaaataaaaacttaaaaaaccgttcgccgaaacacgttaacgattaaacatccctaacgctacgacctataattataaaccgacatctaacaaatcgacctaaaactacgctttttcttcccgcaatttcgcttcgacgaaaatatataaaccacttaacgtccgttaaatcaacgcatccaactacgaatcattaaattatttccaccactacgcctacgaccaaccgaaactaacaaaataaatatcgtcgaccaatttaatttattccgatttaaactattaataaaatacaaaatccttacgtaccaaaacacaaccgaaaatcaacgtcgtactaccgaaaatactacacaacaacaaacgtaaaaattaacgattaatcattacgtaactccttatacctattccgtaacgaacgttaataccgaaactatccaatctaacaaacgaacgaaaaactaacaaacgtattactcctattttaataaaataaacaaaataacctaaaaaacgaatatctcttcaaacgttatttaaaaaaaacgactaaatacgattaccaaaccgacaacgtatttctccaaaacgtcgacaaactaacctactctatccgactataatacgttatccaacgcctacgccgaattccaaataacatcccaaacgtaaaaaaaatcgcgaccctaacgaataaccgtttacgaacgttcaatcaataatacgcgttcttcgctatccaattaacgctccaacgccacgcgttaacacatctcttcacaaacattaaacgccgcatacaaaccgatacgaatttacaaataaatacgcaaaaccgtaacttcctactaacgtaaaatccgcattactttacttaacatacccaacgtaccaacca

SEQ ID NO: 27559 - DNA, 1158 bp, Artificial Sequence
  chemically treated genomic DNA (Homo sapiens) CpG-island No: 27559
tcgtgcgttattttattttggtgcgtttttcgcgtattattatattgagttgttatagatcgagtatttgatttggtttatattgataaagttgttacgttcgtggttacgatagttttattgttgcggtttttgttagcggtattatgcgcgttggcggcggtaatcgttgagcgatgtattttataaattaagatagttcggataatttattgtggttttcgtagtacggttcgtttatttagtgttggcgtatttattgaataagggtttaaaaagtcgttcgtcgagatacgttggcggttgagtatttttaacgttgcgatttgtaattgtgaatcggtatttaataaatcggtttgggattgcgtttttttttttcgtagtttcgtttcggcgagggtgtgtgaattatttagcgttcgttggattagcgtatttagttgcgggttattgagttgtttttattattgcgtttgcggttagtcggagttggtaagatgaatatcgtcggttagtttgatttgtttcggtttgagttgttgatgaggtgtagaatttttacgtattagggtatagtcggaaattagcgtcgtgttgtcgagaatgttgtataatagtagacgtgaaagttgacgattgattattgcgtggttttttgtgtttgtttcgtggcgggcgttaatgtcggggttgtttagtttggtaagcgggcgaaaagttggtagacgtgttgtttttgttttaataaggtgggtaggatggtttgagaggcgggtgtttttttaagcgttatttgaggagaacggttgagtgcggttgttagatcggtagcgtatttttttagggcgtcggtaaattgatttgttttgttcggttgtagtgcgttatttagcgtttgcgtcgagttttaggtggtattttaggcgtgaagaagatcgcggttttgacgaataatcgtttgcgaacgtttaattagtaatgcgcgtttttcgttgtttagttgacgttttagcgttacgcgttggtatatttttttataggtattaaacgtcgtatgtagatcgatacgaatttgtagataagtgcgtagagtcgtgattttttgttggcgtgggattcgtattattttatttaatatatttagcgtgttagtta

SEQ ID NO: 27560 - DNA, 1158 bp, Artificial Sequence
  chemically treated genomic DNA (Homo sapiens) CpG-island No: 27560
taactaacacgctaaatatattaaataaaataatacgaatcccacgccaacaaaaaatcacgactctacgcacttatctacaaattcgtatcgatctacatacgacgtttaatacctataaaaaaatataccaacgcgtaacgctaaaacgtcaactaaacaacgaaaaacgcgcattactaattaaacgttcgcaaacgattattcgtcaaaaccgcgatcttcttcacgcctaaaataccacctaaaactcgacgcaaacgctaaataacgcactacaaccgaacaaaacaaatcaatttaccgacgccctaaaaaaatacgctaccgatctaacaaccgcactcaaccgttctcctcaaataacgcttaaaaaaacacccgcctctcaaaccatcctacccaccttattaaaacaaaaacaacacgtctaccaacttttcgcccgcttaccaaactaaacaaccccgacattaacgcccgccacgaaacaaacacaaaaaaccacgcaataatcaatcgtcaactttcacgtctactattatacaacattctcgacaacacgacgctaatttccgactataccctaatacgtaaaaattctacacctcatcaacaactcaaaccgaaacaaatcaaactaaccgacgatattcatcttaccaactccgactaaccgcaaacgcaataataaaaacaactcaataacccgcaactaaatacgctaatccaacgaacgctaaataattcacacaccctcgccgaaacgaaactacgaaaaaaaaaaacgcaatcccaaaccgatttattaaataccgattcacaattacaaatcgcaacgttaaaaatactcaaccgccaacgtatctcgacgaacgactttttaaacccttattcaataaatacgccaacactaaataaacgaaccgtactacgaaaaccacaataaattatccgaactatcttaatttataaaatacatcgctcaacgattaccgccgccaacgcgcataataccgctaacaaaaaccgcaacaataaaactatcgtaaccacgaacgtaacaactttatcaatataaaccaaatcaaatactcgatctataacaactcaatataataatacgcgaaaaacgcaccaaaataaaataacgcacga

SEQ ID NO: 27561 - DNA, 720 bp, Artificial Sequence
  chemically treated genomic DNA (Homo sapiens) CpG-island No: 27561
aacgttggcgtatagatgatgtaggtatgaagtagtaggaacgttagcggcgtagttaggaagattagtcgtggaatgttcgataagaagtggaatatggcgttgacgtaatatagtcgttgagtaaattttagttttttatcggtgagcgggttatcgagacggaagatttgtattatttcgcgcgtttagcgaatacgttgatcgatatgcgtcgatagattttcggtcgttagtttcgtttgtttgtcggaatacgtattatagcgttggtaggtattaggttacggattgggtgtaaatcgtggtagagtaacgttattcgcggttattcgttttagggtttaacgggttatcgatagtaatgtcgttaattttatttagcggtttacgacgaattatcgtataggaatcgtagaagaaagtggcgttttatatatcgttgttattttgtattagattatagaatagcgtgttttcgttcggcgttttacggaaacgttttaggttgcgtttaaacgggttcggtgagaagaagtggtgcggcgtttgtattatcgttagttgttttttttttaggaattagtttatggttatttgtaagaacgatcgcgttggtacgtggtcgtagtcgaaaatcgatacgaattcgttttgggtatattttagcgtattgttgatgttgtttgttttcgtatgtttatgagtggtgcgggcgat

SEQ ID NO: 27562 - DNA, 720 bp, Artificial Sequence
  chemically treated genomic DNA (Homo sapiens) CpG-island No: 27562
atcgcccgcaccactcataaacatacgaaaacaaacaacatcaacaatacgctaaaatatacccaaaacgaattcgtatcgattttcgactacgaccacgtaccaacgcgatcgttcttacaaataaccataaactaattcctaaaaaaaaaacaactaacgataatacaaacgccgcaccacttcttctcaccgaacccgtttaaacgcaacctaaaacgtttccgtaaaacgccgaacgaaaacacgctattctataatctaatacaaaataacaacgatatataaaacgccactttcttctacgattcctatacgataattcgtcgtaaaccgctaaataaaattaacgacattactatcgataacccgttaaaccctaaaacgaataaccgcgaataacgttactctaccacgatttacacccaatccgtaacctaatacctaccaacgctataatacgtattccgacaaacaaacgaaactaacgaccgaaaatctatcgacgcatatcgatcaacgtattcgctaaacgcgcgaaataatacaaatcttccgtctcgataacccgctcaccgataaaaaactaaaatttactcaacgactatattacgtcaacgccatattccacttcttatcgaacattccacgactaatcttcctaactacgccgctaacgttcctactacttcatacctacatcatctatacgccaacgtt

SEQ ID NO: 27563 - DNA, 720 bp, Artificial Sequence
  chemically treated genomic DNA (Homo sapiens) CpG-island No: 27563
atcgttcgtattatttatgaatatgcgaaagtaggtaatattaataatgcgttgaaatatgtttaaggcgagttcgtgtcgattttcgattgcgattacgtattaacgcgatcgtttttgtaaatgattatgggttggtttttgaaagaaaaatagttggcgatgatgtagacgtcgtattatttttttttatcggattcgtttgaacgtaatttggggcgttttcgtaaaacgtcgaacgaaggtacgttgttttatggtttggtgtaggatggtaacgatatgtgggacgttatttttttttgcggtttttgtgcggtgattcgtcgtaagtcgttggatgaaattggcggtattgttgtcgataattcgttggattttgaaacgaatggtcgcgaataacgttgttttgttacggtttgtatttagttcgtggtttaatatttgttagcgttataatgcgtatttcggtaggtaggcggggttggcgatcgaaagtttgtcggcgtatatcggttagcgtattcgttgggcgcgcgggatggtataaatttttcgtttcgataattcgtttatcggtaaagggttgaagtttgtttagcggttatgttacgttaacgttatgttttattttttgtcgggtattttacggttgatttttttgattgcgtcgttggcgtttttgttgttttatgtttatattatttatgcgttagcgtt

SEQ ID NO: 27564 - DNA, 720 bp, Artificial Sequence
  chemically treated genomic DNA (Homo sapiens) CpG-island No: 27564
aacgctaacgcataaataatataaacataaaacaacaaaaacgccaacgacgcaatcaaaaaaatcaaccgtaaaatacccgacaaaaaataaaacataacgttaacgtaacataaccgctaaacaaacttcaaccctttaccgataaacgaattatcgaaacgaaaaatttataccatcccgcgcgcccaacgaatacgctaaccgatatacgccgacaaactttcgatcgccaaccccgcctacctaccgaaatacgcattataacgctaacaaatattaaaccacgaactaaatacaaaccgtaacaaaacaacgttattcgcgaccattcgtttcaaaatccaacgaattatcgacaacaataccgccaatttcatccaacgacttacgacgaatcaccgcacaaaaaccgcaaaaaaaaataacgtcccacatatcgttaccatcctacaccaaaccataaaacaacgtaccttcgttcgacgttttacgaaaacgccccaaattacgttcaaacgaatccgataaaaaaaaataatacgacgtctacatcatcgccaactatttttctttcaaaaaccaacccataatcatttacaaaaacgatcgcgttaatacgtaatcgcaatcgaaaatcgacacgaactcgccttaaacatatttcaacgcattattaatattacctactttcgcatattcataaataatacgaacgat

SEQ ID NO: 27565 - DNA, 630 bp, Artificial Sequence
  chemically treated genomic DNA (Homo sapiens) CpG-island No: 27565
  misc_feature (224)..(224): n is either a, c, g or t
  misc_feature (278)..(278): n is either a, c, g or t
  misc_feature (288)..(288): n is either a, c, g or t
  misc_feature (402)..(402): n is either a, c, g or t
  misc_feature (443)..(443): n is either a, c, g or t
atttagtagcggacgtagtagaaaatcgtcgaggcgtagggtttgtattttcgttatatagtgtgaacgattggttttttttatacgttcgttaaatcgcgtttgttgacgaaattgttggataacggttttatgttattgatgatttcgttaaagtcgtcgttgatattcgttaaataggcgcgtatacgacggataatcggcgtgttgtaacgttggtatanttatttattatttattaagtattaattcgggataaatttattatcgcgtattangtgttatttngttagtcgaggttgaatatcgttattagtatcgcgtttattagcgcggtattgcgtaggatagttgttatttacgggtaaacggtaaggaggatttcgcggaatttattttagntggttattaagtgacgcgggaaattatttgttcgacgggtngggtattaaattcgtttaatggttggcgtaacgtagtatttattacgtcggtacgtaattgttgcgattaacgtttatatgcgcggttcggagtttaaaattagggtaagcgaaaattgcgtcgtttaattggttagtttcggggcggtaatatagttgtagtttaatatacgtcgtagttagtttt

SEQ ID NO: 27566 - DNA, 630 bp, Artificial Sequence
  chemically treated genomic DNA (Homo sapiens) CpG-island No: 27566
  misc_feature (188)..(188): n is either a, c, g or t
  misc_feature (229)..(229): n is either a, c, g or t
  misc_feature (343)..(343): n is either a, c, g or t
  misc_feature (353)..(353): n is either a, c, g or t
  misc_feature (407)..(407): n is either a, c, g or t
aaaactaactacgacgtatattaaactacaactatattaccgccccgaaactaaccaattaaacgacgcaattttcgcttaccctaattttaaactccgaaccgcgcatataaacgttaatcgcaacaattacgtaccgacgtaataaatactacgttacgccaaccattaaacgaatttaatacccnacccgtcgaacaaataatttcccgcgtcacttaataaccanctaaaataaattccgcgaaatcctccttaccgtttacccgtaaataacaactatcctacgcaataccgcgctaataaacgcgatactaataacgatattcaacctcgactaacnaaataacacntaatacgcgataataaatttatcccgaattaatacttaataaataataaataantataccaacgttacaacacgccgattatccgtcgtatacgcgcctatttaacgaatatcaacgacgactttaacgaaatcatcaataacataaaaccgttatccaacaatttcgtcaacaaacgcgatttaacgaacgtataaaaaaaaccaatcgttcacactatataacgaaaatacaaaccctacgcctcgacgattttctactacgtccgctactaaat

SEQ ID NO: 27567 - DNA, 630 bp, Artificial Sequence
  chemically treated genomic DNA (Homo sapiens) CpG-island No: 27567
  misc_feature (188)..(188): n is either a, c, g or t
  misc_feature (229)..(229): n is either a, c, g or t
  misc_feature (343)..(343): n is either a, c, g or t
  misc_feature (353)..(353): n is either a, c, g or t
  misc_feature (407)..(407): n is either a, c, g or t
agggttggttgcggcgtatgttgggttgtaattgtattgtcgtttcggggttaattaattaagcggcgtagttttcgtttgttttggttttaaatttcgggtcgcgtatgtaggcgttagtcgtaatagttgcgtatcgacgtgatggatgttgcgttacgttagttattaagcgagtttgatatttnattcgtcgggtaggtgatttttcgcgttatttaatgattanttgaagtgaatttcgcggaattttttttatcgtttattcgtaagtggtaattgttttgcgtagtgtcgcgttggtgggcgcgatgttggtggcgatgtttagtttcgattggtngaatggtatntggtgcgcgataatggatttgtttcgggttggtgtttggtgggtaatgggtgantatattagcgttatagtacgtcgattgttcgtcgtgtgcgcgtttatttggcggatattaacgacggttttaacgaaattattaatggtatggagtcgttatttagtagtttcgttagtaggcgcgatttggcgaacgtatgggggaggttagtcgtttatattatatggcgaggatgtaaattttgcgtttcgacggttttttgttgcgttcgttgttgagt

SEQ ID NO: 27568 - DNA, 630 bp, Artificial Sequence
  chemically treated genomic DNA (Homo sapiens) CpG-island No: 27568
  misc_feature (224)..(224): n is either a, c, g or t
  misc_feature (278)..(278): n is either a, c, g or t
  misc_feature (288)..(288): n is either a, c, g or t
  misc_feature (402)..(402): n is either a, c, g or t
  misc_feature (443)..(443): n is either a, c, g or t
actcaacaacgaacgcaacaaaaaaccgtcgaaacgcaaaatttacatcctcgccatataatataaacgactaacctcccccatacgttcgccaaatcgcgcctactaacgaaactactaaataacgactccataccattaataatttcgttaaaaccgtcgttaatatccgccaaataaacgcgcacacgacgaacaatcgacgtactataacgctaatatantcacccattacccaccaaacaccaacccgaaacaaatccattatcgcgcaccanataccattcnaccaatcgaaactaaacatcgccaccaacatcgcgcccaccaacgcgacactacgcaaaacaattaccacttacgaataaacgataaaaaaaattccgcgaaattcacttcaantaatcattaaataacgcgaaaaatcacctacccgacgaatnaaatatcaaactcgcttaataactaacgtaacgcaacatccatcacgtcgatacgcaactattacgactaacgcctacatacgcgacccgaaatttaaaaccaaaacaaacgaaaactacgccgcttaattaattaaccccgaaacgacaatacaattacaacccaacatacgccgcaaccaaccct

SEQ ID NO: 27569 - DNA, 684 bp, Artificial Sequence
  chemically treated genomic DNA (Homo sapiens) CpG-island No: 27569
gcggtagcgttattcgttgatttcgaaagcgtcgcgatatgtggcgaaggcggatttgatttttgggaggtcgtttttgttcgttagtcgtcgttatcgtcgttaggtggagattttgttatcgcgttggggttggcgtttgggaaggcgtattgatgaattcgttaattaattttttgttttggcgatagtaacgtcggatcgtttttttgcgtttttggttgttgatgttcgttgcgtttttgttgttggtcgtcgggataacgttaatattgcgtttgataggtagcgtcgaagcgcgtatagacgtagttttgttttaggcggaataataattcgttcgtagtttatagataacgaagttacgtttgttggagtaatagtagttacgcgaatagcgttcgtaacggtagcgttagcgataatttattcgcgattggtaatttgcgttggaagtattggcggcgtttttattcgagtacgtttggttgataacgataagttggtagtagggaacgttggagattaaggggttgataataagtattatcgcgttaaacgtattagaaacgttatttcgttaggatgtatttttttattttaattagcggggagttacgtagtaggatgcgtagggacgttggtaatttgagtattagttaataaggaaggttagcgatgaat

SEQ ID NO: 27570 - DNA, 684 bp, Artificial Sequence
  chemically treated genomic DNA (Homo sapiens) CpG-island No: 27570
attcatcgctaaccttccttattaactaatactcaaattaccaacgtccctacgcatcctactacgtaactccccgctaattaaaataaaaaaatacatcctaacgaaataacgtttctaatacgtttaacgcgataatacttattatcaaccccttaatctccaacgttccctactaccaacttatcgttatcaaccaaacgtactcgaataaaaacgccgccaatacttccaacgcaaattaccaatcgcgaataaattatcgctaacgctaccgttacgaacgctattcgcgtaactactattactccaacaaacgtaacttcgttatctataaactacgaacgaattattattccgcctaaaacaaaactacgtctatacgcgcttcgacgctacctatcaaacgcaatattaacgttatcccgacgaccaacaacaaaaacgcaacgaacatcaacaaccaaaaacgcaaaaaaacgatccgacgttactatcgccaaaacaaaaaattaattaacgaattcatcaatacgccttcccaaacgccaaccccaacgcgataacaaaatctccacctaacgacgataacgacgactaacgaacaaaaacgacctcccaaaaatcaaatccgccttcgccacatatcgcgacgctttcgaaatcaacgaataacgctaccgc

SEQ ID NO: 27571 - DNA, 684 bp, Artificial Sequence
  chemically treated genomic DNA (Homo sapiens) CpG-island No: 27571
gtttatcgttaattttttttgttaattgatatttaaattgttagcgtttttgcgtattttgttgcgtggtttttcgttgattgagatgaaaagatgtattttggcggagtgacgtttttagtgcgtttaacgcggtaatgtttgttgttagttttttgatttttagcgttttttgttgttagtttatcgttgttagttaggcgtgttcgggtaaaagcgtcgttagtgtttttagcgtagattgttagtcgcgggtaaattgtcgttggcgttgtcgttgcgaacgttgttcgcgtaattgttgttgttttagtaaacgtggtttcgttatttgtaagttgcgggcgagttgttgtttcgtttgaagtaaaattgcgtttatgcgcgtttcggcgttgtttgttagacgtagtattagcgttatttcgacggttagtagtagaggcgtaacgaatattagtaattagaaacgtagaaaagcggttcggcgttgttgtcgttagggtaaaaaattaattggcgggtttattagtacgtttttttaagcgttagttttagcgcgatggtaaagtttttatttggcggcggtagcggcggttgacgaatagaaacggttttttagggattaaattcgttttcgttatatatcgcgacgttttcgggattaacggataacgttgtcgt

SEQ ID NO: 27572 - DNA, 684 bp, Artificial Sequence
  chemically treated genomic DNA (Homo sapiens) CpG-island No: 27572
acgacaacgttatccgttaatcccgaaaacgtcgcgatatataacgaaaacgaatttaatccctaaaaaaccgtttctattcgtcaaccgccgctaccgccgccaaataaaaactttaccatcgcgctaaaactaacgcttaaaaaaacgtactaataaacccgccaattaattttttaccctaacgacaacaacgccgaaccgcttttctacgtttctaattactaatattcgttacgcctctactactaaccgtcgaaataacgctaatactacgtctaacaaacaacgccgaaacgcgcataaacgcaattttacttcaaacgaaacaacaactcgcccgcaacttacaaataacgaaaccacgtttactaaaacaacaacaattacgcgaacaacgttcgcaacgacaacgccaacgacaatttacccgcgactaacaatctacgctaaaaacactaacgacgcttttacccgaacacgcctaactaacaacgataaactaacaacaaaaaacgctaaaaatcaaaaaactaacaacaaacattaccgcgttaaacgcactaaaaacgtcactccgccaaaatacatcttttcatctcaatcaacgaaaaaccacgcaacaaaatacgcaaaaacgctaacaatttaaatatcaattaacaaaaaaaattaacgataaac

SEQ ID NO: 27573 - DNA, 930 bp, Artificial Sequence
  chemically treated genomic DNA (Homo sapiens) CpG-island No: 27573
  misc_feature (741)..(742): n is either a, c, g or t
  misc_feature (744)..(744): n is either a, c, g or t
  misc_feature (754)..(755): n is either a, c, g or t
  misc_feature (763)..(764): n is either a, c, g or t
  misc_feature (766)..(766): n is either a, c, g or t
  misc_feature (772)..(773): n is either a, c, g or t
  misc_feature (775)..(775): n is either a, c, g or t
  misc_feature (783)..(784): n is either a, c, g or t
  misc_feature (788)..(789): n is either a, c, g or t
  misc_feature (803)..(804): n is either a, c, g or t
  misc_feature (898)..(898): n is either a, c, g or t
  misc_feature (902)..(902): n is either a, c, g or t
  misc_feature (924)..(924): n is either a, c, g or t
ggtattcgtcgtagtatgttgtttgtgtttggtgttaatgtcgcgatggttagtaatttttttatttattcggttgatgttttgatgtttgatttcgaagatttcgtagtattgcgtgaaaaagatatcgttcgtcgtatggtttattacgcgttgtaatattcgttgtatcgcgatattgaaattattgtgcgtgttaacgcgttggatttcgaatggggtgttaacgatttggaagtcgtcgttcgcggtggtgcggacgttgtgcgtttgtcgaaaatcgatatcgtttaggatgttttggatattgaaaaagagattttgcgtatcgaaaaagtttgtggtcgtgaattcggtagtatcggtttgttggcggcgattgaattttcgttggggattattcgcgtagtggaaatcgtttacgttttcgagcgtttgatcggtatcgttttcggtgtagaagattatgtgcgtaatttgcgtatagaacgtttttcggaaggaattgaattgttgttcgtacgttgttttattttgtaggtcgcgcgttttgcgggtatttaggcgttcgatatcgtttatttcgacgttaataacgaagtcggatttttgtaagaagtcggttatattaaatagttgggttttgacggtaaatcgttgattaattcgcgttagattgatttgttgtataatttttacgtatcgatttagaaagaagtggattacgttcgtcgcgtcgtnnangaagtcgttnngaagtcgnntncgtttnngncgaacggnntttnncggcgtggtttttnnttgaacggtaagatggtggacggttcggttatcgatcgcgttcgtttggtgttttttcgtgtagaatttttcggtattcgcgaagaataaggtnattnaaatgacgtagaaaattgaatnatttta

SEQ ID NO: 27574 - DNA, 930 bp, Artificial Sequence
  chemically treated genomic DNA (Homo sapiens) CpG-island No: 27574
  misc_feature (7)..(7): n is either a, c, g or t
  misc_feature (29)..(29): n is either a, c, g or t
  misc_feature (33)..(33): n is either a, c, g or t
  misc_feature (127)..(128): n is either a, c, g or t
  misc_feature (142)..(143): n is either a, c, g or t
  misc_feature (147)..(148): n is either a, c, g or t
  misc_feature (156)..(156): n is either a, c, g or t
  misc_feature (158)..(159): n is either a, c, g or t
  misc_feature (165)..(165): n is either a, c, g or t
  misc_feature (167)..(168): n is either a, c, g or t
  misc_feature (176)..(177): n is either a, c, g or t
  misc_feature (187)..(187): n is either a, c, g or t
  misc_feature (189)..(190): n is either a, c, g or t
taaaatnattcaattttctacgtcatttnaatnaccttattcttcgcgaataccgaaaaattctacacgaaaaaacaccaaacgaacgcgatcgataaccgaaccgtccaccatcttaccgttcaannaaaaaccacgccgnnaaannccgttcgncnnaaacgnanncgacttcnnaacgacttcntnnacgacgcgacgaacgtaatccacttctttctaaatcgatacgtaaaaattatacaacaaatcaatctaacgcgaattaatcaacgatttaccgtcaaaacccaactatttaatataaccgacttcttacaaaaatccgacttcgttattaacgtcgaaataaacgatatcgaacgcctaaatacccgcaaaacgcgcgacctacaaaataaaacaacgtacgaacaacaattcaattccttccgaaaaacgttctatacgcaaattacgcacataatcttctacaccgaaaacgataccgatcaaacgctcgaaaacgtaaacgatttccactacgcgaataatccccaacgaaaattcaatcgccgccaacaaaccgatactaccgaattcacgaccacaaactttttcgatacgcaaaatctctttttcaatatccaaaacatcctaaacgatatcgattttcgacaaacgcacaacgtccgcaccaccgcgaacgacgacttccaaatcgttaacaccccattcgaaatccaacgcgttaacacgcacaataatttcaatatcgcgatacaacgaatattacaacgcgtaataaaccatacgacgaacgatatctttttcacgcaatactacgaaatcttcgaaatcaaacatcaaaacatcaaccgaataaataaaaaaattactaaccatcgcgacattaacaccaaacacaaacaacatactacgacgaatacc

SEQ ID NO: 27575 - DNA, 930 bp, Artificial Sequence
  chemically treated genomic DNA (Homo sapiens) CpG-island No: 27575
  misc_feature (7)..(7): n is either a, c, g or t
  misc_feature (29)..(29): n is either a, c, g or t
  misc_feature (33)..(33): n is either a, c, g or t
  misc_feature (127)..(128): n is either a, c, g or t
  misc_feature (142)..(143): n is either a, c, g or t
  misc_feature (147)..(148): n is either a, c, g or t
  misc_feature (156)..(156): n is either a, c, g or t
  misc_feature (158)..(159): n is either a, c, g or t
  misc_feature (165)..(165): n is either a, c, g or t
  misc_feature (167)..(168): n is either a, c, g or t
  misc_feature (176)..(177): n is either a, c, g or t
  misc_feature (187)..(187): n is either a, c, g or t
  misc_feature (189)..(190): n is either a, c, g or t
tgagatngtttaattttttgcgttatttngatngttttatttttcgcggatgtcggaaagttttgtacgggagagtattagacgggcgcgatcgataatcggatcgtttattattttgtcgtttagnnggaaattacgtcgnnaggnntcgttcgntnngagcgngnncggttttnnagcggttttntnnacgacgcggcgggcgtgatttatttttttttgggtcggtgcgtagaggttgtgtagtagattaatttgacgcgggttgattagcgatttgtcgttaaagtttagttgtttgatgtggtcggttttttgtagaaattcggtttcgttgttagcgtcggaatagacggtatcgaacgtttgaatattcgtagagcgcgcggtttgtaaaatggaatagcgtgcgaatagtagtttagtttttttcggggagcgttttgtacgtaggttgcgtatatagttttttgtatcgagggcgatatcgattaaacgttcggaagcgtgagcgatttttattgcgcgggtaatttttagcggagatttaatcgtcgttagtaggtcggtgttgtcgggtttacgattataggttttttcgatacgtaggattttttttttaatatttagaatattttgagcggtatcggttttcggtagacgtataacgttcgtattatcgcgaacgacggtttttaggtcgttaatattttattcggaatttagcgcgttgatacgtataatggttttaatatcgcgatatagcggatgttgtagcgcgtggtaaattatgcggcgggcggtgttttttttacgtaatgttacggagttttcgaggttaaatattagggtattagtcgggtagatgaaggagttgttgattatcgcggtattggtattaggtataaataatatgttgcggcgggtgtt

SEQ ID NO: 27576 - DNA, 930 bp, Artificial Sequence
  chemically treated genomic DNA (Homo sapiens) CpG-island No: 27576
  misc_feature (741)..(742): n is either a, c, g or t
  misc_feature (744)..(744): n is either a, c, g or t
  misc_feature (754)..(755): n is either a, c, g or t
  misc_feature (763)..(764): n is either a, c, g or t
  misc_feature (766)..(766): n is either a, c, g or t
  misc_feature (772)..(773): n is either a, c, g or t
  misc_feature (775)..(775): n is either a, c, g or t
  misc_feature (783)..(784): n is either a, c, g or t
  misc_feature (788)..(789): n is either a, c, g or t
  misc_feature (803)..(804): n is either a, c, g or t
  misc_feature (898)..(898): n is either a, c, g or t
  misc_feature (902)..(902): n is either a, c, g or t
  misc_feature (924)..(924): n is either a, c, g or t
aacacccgccgcaacatattatttatacctaataccaataccgcgataatcaacaactccttcatctacccgactaataccctaatatttaacctcgaaaactccgtaacattacgtaaaaaaaacaccgcccgccgcataatttaccacgcgctacaacatccgctatatcgcgatattaaaaccattatacgtatcaacgcgctaaattccgaataaaatattaacgacctaaaaaccgtcgttcgcgataatacgaacgttatacgtctaccgaaaaccgataccgctcaaaatattctaaatattaaaaaaaaaatcctacgtatcgaaaaaacctataatcgtaaacccgacaacaccgacctactaacgacgattaaatctccgctaaaaattacccgcgcaataaaaatcgctcacgcttccgaacgtttaatcgatatcgccctcgatacaaaaaactatatacgcaacctacgtacaaaacgctccccgaaaaaaactaaactactattcgcacgctattccattttacaaaccgcgcgctctacgaatattcaaacgttcgataccgtctattccgacgctaacaacgaaaccgaatttctacaaaaaaccgaccacatcaaacaactaaactttaacgacaaatcgctaatcaacccgcgtcaaattaatctactacacaacctctacgcaccgacccaaaaaaaaataaatcacgcccgccgcgtcgtnnanaaaaccgctnnaaaaccgnncncgctcnnancgaacganncctnncgacgtaatttccnnctaaacgacaaaataataaacgatccgattatcgatcgcgcccgtctaatactctcccgtacaaaactttccgacatccgcgaaaaataaaacnatcnaaataacgcaaaaaattaaacnatctca

SEQ ID NO: 27577 - DNA, 1011 bp, Artificial Sequence
  chemically treated genomic DNA (Homo sapiens) CpG-island No: 27577
tcgatgttttagggtataggtgatttttcgttcggcgtttatatcggtttatttgttttgtatttgcgttatcgttagttcgtacgatgttagttagcggcggttttttttatttattcgtttagttaggattttattttttagtcggtcgagtatttgtattagtatcggcgggaatattatattgttatcgttttcgttatcggattgttgaagggtattcgttaggttgcggcgttgcgttttcgttagtttatcggtggcggttttaattttgatgagtggcgtgaagtttttcggttgataaatcgtttggatgcgggttttgtcgttttgtatcgtggttaggcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttgtatattgtgttcgcgtgtagtgtattagtcggtgttgattgtcgtaatggtatcggtgggtgcgtttattattcgtgcggataatttttttcgggatgaggtcggttttttttgttagtttgtcgtgacggttatatcggtaaagatagtgcgcgttacgggcgatacggttattcggttatatgttgagggtgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtaggttgtttaggtgttggttttgtaattgttcggtaggggtataagcggtggtgagtttataacggtcgaagttgcgtagcgtttttcggtgtaggcggtcgcgggtgtattttat

SEQ ID NO: 27578 - DNA, 1011 bp, Artificial Sequence
  chemically treated genomic DNA (Homo sapiens) CpG-island No: 27578
ataaaatacacccgcgaccgcctacaccgaaaaacgctacgcaacttcgaccgttataaactcaccaccgcttatacccctaccgaacaattacaaaaccaacacctaaacaacctactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacaccctcaacatataaccgaataaccgtatcgcccgtaacgcgcactatctttaccgatataaccgtcacgacaaactaacaaaaaaaaccgacctcatcccgaaaaaaattatccgcacgaataataaacgcacccaccgataccattacgacaatcaacaccgactaatacactacacgcgaacacaatatacaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgcctaaccacgatacaaaacgacaaaacccgcatccaaacgatttatcaaccgaaaaacttcacgccactcatcaaaattaaaaccgccaccgataaactaacgaaaacgcaacgccgcaacctaacgaatacccttcaacaatccgataacgaaaacgataacaatataatattcccgccgatactaatacaaatactcgaccgactaaaaaataaaatcctaactaaacgaataaataaaaaaaaccgccgctaactaacatcgtacgaactaacgataacgcaaatacaaaacaaataaaccgatataaacgccgaacgaaaaatcacctataccctaaaacatcga

SEQ ID NO: 27579 - DNA, 1011 bp, Artificial Sequence
  chemically treated genomic DNA (Homo sapiens) CpG-island No: 27579
gtggagtatattcgcgatcgtttgtatcgggaaacgttgcgtagtttcggtcgttatgaatttattatcgtttatatttttgtcgggtagttatagagttagtatttgaatagtttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatgttatagattcggtaggtaatcgtttgttcgattcggagttgtattcggatagtatttttagtatgtggtcggataatcgtatcgttcgtgacgcgtattatttttatcggtatgatcgttacggtaggttgatagagaaaatcgattttatttcggaaggggttattcgtacggatgatgagcgtatttatcggtattattacgatagttagtatcggttggtgtattatacgcggatataatatgtagagtcgttggtcgaaagtcgttatttttacgattcgttgggtcgtagggtggtaaaacgggtatggcggcgtgaacgggatttgacgggttggatgtcgttgttacggaaatcgtaagtgatttggtacggttgggacggcgatcgtttgattacgatatagaacgatagaattcgtatttagacgatttattagtcggggagttttacgttatttattagggttgaaatcgttatcggtgagttggcgaaaacgtagcgtcgtagtttggcggatattttttagtagttcggtggcgaagacggtggtagtgtggtgttttcgtcggtgttggtgtagatgttcgatcggttggaaagtgaaattttggttgagcgggtgagtgaggaaagtcgtcgttggttggtatcgtgcgggttgacggtggcgtagatgtaaggtagatgggtcggtataaacgtcgggcgaaaaattatttgtattttgggatatcgg

SEQ ID NO: 27580 - DNA, 1011 bp, Artificial Sequence
  chemically treated genomic DNA (Homo sapiens) CpG-island No: 27580
ccgatatcccaaaatacaaataatttttcgcccgacgtttataccgacccatctaccttacatctacgccaccgtcaacccgcacgataccaaccaacgacgactttcctcactcacccgctcaaccaaaatttcactttccaaccgatcgaacatctacaccaacaccgacgaaaacaccacactaccaccgtcttcgccaccgaactactaaaaaatatccgccaaactacgacgctacgttttcgccaactcaccgataacgatttcaaccctaataaataacgtaaaactccccgactaataaatcgtctaaatacgaattctatcgttctatatcgtaatcaaacgatcgccgtcccaaccgtaccaaatcacttacgatttccgtaacaacgacatccaacccgtcaaatcccgttcacgccgccatacccgttttaccaccctacgacccaacgaatcgtaaaaataacgactttcgaccaacgactctacatattatatccgcgtataatacaccaaccgatactaactatcgtaataataccgataaatacgctcatcatccgtacgaataaccccttccgaaataaaatcgattttctctatcaacctaccgtaacgatcataccgataaaaataatacgcgtcacgaacgatacgattatccgaccacatactaaaaatactatccgaatacaactccgaatcgaacaaacgattacctaccgaatctataacatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaactattcaaatactaactctataactacccgacaaaaatataaacgataataaattcataacgaccgaaactacgcaacgtttcccgatacaaacgatcgcgaatatactccac

SEQ ID NO: 27581 - DNA, 755 bp, Artificial Sequence
  chemically treated genomic DNA (Homo sapiens) CpG-island No: 27581
  misc_feature (407)..(407): n is either a, c, g or t
  misc_feature (410)..(410): n is either a, c, g or t
  misc_feature (462)..(463): n is either a, c, g or t
  misc_feature (527)..(527): n is either a, c, g or t
  misc_feature (540)..(541): n is either a, c, g or t
  misc_feature (688)..(688): n is either a, c, g or t
  misc_feature (707)..(707): n is either a, c, g or t
  misc_feature (716)..(716): n is either a, c, g or t
  misc_feature (728)..(728): n is either a, c, g or t
  misc_feature (730)..(730): n is either a, c, g or t
  misc_feature (734)..(734): n is either a, c, g or t
  misc_feature (736)..(737): n is either a, c, g or t
  misc_feature (748)..(749): n is either a, c, g or t
ttgtcgacgtcggagcgttgtaggatttgcggtgaggtaatcgcgtttgtatataatagtatttttttgttggtcgttgcgcgggttgggatggtgttgtcgttttttagttattcgacgtttatcgcgcgtttgtcgttaaaaatgatgtgatcggttatagcgtgagtacgaatggttaggttaggacgcgatttggtttgatcgagatagttacgcgcggtgttggcgcgacggttttgcggcgtgacggtgcgatttatcggattaaaatttttttgttgataatcgttgagatcgttcgtgcgcgggtagttcgtttgtacgttcgttttaattatcgttttaaatagcggattgacgtcgggtttggaggtagtgacgtttatcgggttatttatcgtcgntgnataggttcgtttttaatttaataattcggcgaggtttttcgggtttttggtnnggtagtagggtaggtagtcgaggtagttttagttttttagatcgggtttttgcgtttagttatncgagattttaagnncgtattgcgtacgggaatggttaggttattaattgttttcgggttttggaagttttaaggtcggaatcgggaattttttaagcgttttaaggaaatttcgttgttttaagcgttcggagcgggattttatcgggttaaatcgttttnttaaattggggtcgggggncgggggttntaatttttttantnaaananncgggttttagnngtttcg

SEQ ID NO: 27582 - DNA, 755 bp, Artificial Sequence
  chemically treated genomic DNA (Homo sapiens) CpG-island No: 27582
  misc_feature (7)..(8): n is either a, c, g or t
  misc_feature (19)..(20): n is either a, c, g or t
  misc_feature (22)..(22): n is either a, c, g or t
  misc_feature (26)..(26): n is either a, c, g or t
  misc_feature (28)..(28): n is either a, c, g or t
  misc_feature (40)..(40): n is either a, c, g or t
  misc_feature (49)..(49): n is either a, c, g or t
  misc_feature (68)..(68): n is either a, c, g or t
  misc_feature (215)..(216): n is either a, c, g or t
  misc_feature (229)..(229): n is either a, c, g or t
  misc_feature (293)..(294): n is either a, c, g or t
  misc_feature (346)..(346): n is either a, c, g or t
  misc_feature (349)..(349): n is either a, c, g or t
cgaaacnnctaaaacccgnntntttnantaaaaaaattanaacccccgncccccgaccccaatttaanaaaacgatttaacccgataaaatcccgctccgaacgcttaaaacaacgaaatttccttaaaacgcttaaaaaattcccgattccgaccttaaaacttccaaaacccgaaaacaattaataacctaaccattcccgtacgcaatacgnncttaaaatctcgnataactaaacgcaaaaacccgatctaaaaaactaaaactacctcgactacctaccctactaccnnaccaaaaacccgaaaaacctcgccgaattattaaattaaaaacgaacctatncancgacgataaataacccgataaacgtcactacctccaaacccgacgtcaatccgctatttaaaacgataattaaaacgaacgtacaaacgaactacccgcgcacgaacgatctcaacgattatcaacaaaaaaattttaatccgataaatcgcaccgtcacgccgcaaaaccgtcgcgccaacaccgcgcgtaactatctcgatcaaaccaaatcgcgtcctaacctaaccattcgtactcacgctataaccgatcacatcatttttaacgacaaacgcgcgataaacgtcgaataactaaaaaacgacaacaccatcccaacccgcgcaacgaccaacaaaaaaatactattatatacaaacgcgattacctcaccgcaaatcctacaacgctccgacgtcgacaa

SEQ ID NO: 27583 - DNA, 755 bp, Artificial Sequence
  chemically treated genomic DNA (Homo sapiens) CpG-island No: 27583
  misc_feature (7)..(8): n is either a, c, g or t
  misc_feature (19)..(20): n is either a, c, g or t
  misc_feature (22)..(22): n is either a, c, g or t
  misc_feature (26)..(26): n is either a, c, g or t
  misc_feature (28)..(28): n is either a, c, g or t
  misc_feature (40)..(40): n is either a, c, g or t
  misc_feature (49)..(49): n is either a, c, g or t
  misc_feature (68)..(68): n is either a, c, g or t
  misc_feature (215)..(216): n is either a, c, g or t
  misc_feature (229)..(229): n is either a, c, g or t
  misc_feature (293)..(294): n is either a, c, g or t
  misc_feature (346)..(346): n is either a, c, g or t
  misc_feature (349)..(349): n is either a, c, g or t
cggaatnnttggaattcgnntntttnantggaaaaattanaattttcgnttttcggttttaatttggnggaacggtttggttcggtgaaatttcgtttcgggcgtttaaaataacggggtttttttggggcgtttggggaattttcggtttcggttttggaatttttaaaattcgggggtaattggtggtttaattattttcgtgcgtaatgcgnntttggaatttcgnataattgggcgtaagaattcggtttggagaattggagttatttcgattgtttgttttattattnngttaagggttcgaagaatttcgtcgaattattgggttgaaaacgaatttatntancggcggtgaatggttcggtgagcgttattatttttaaattcggcgttaattcgttgtttgaagcgatgattgaagcgggcgtgtaggcgggttattcgcgtacggacgattttaacggttattagtaggaaggttttggttcgatggatcgtatcgttacgtcgtagggtcgtcgcgttagtatcgcgcgtggttatttcgattaggttaaatcgcgttttaatttgattattcgtatttacgttatgatcgattatattatttttgacggtaaacgcgcggtgggcgtcgaatggttggaaggcgatagtattattttaattcgcgtaacggttaataaagaagtgttgttatgtgtaggcgcgattgttttatcgtagattttgtaacgtttcggcgtcggtaa

SEQ ID NO: 27584 - DNA, 755 bp, Artificial Sequence
  chemically treated genomic DNA (Homo sapiens) CpG-island No: 27584
  misc_feature (407)..(407): n is either a, c, g or t
  misc_feature (410)..(410): n is either a, c, g or t
  misc_feature (462)..(463): n is either a, c, g or t
  misc_feature (527)..(527): n is either a, c, g or t
  misc_feature (540)..(541): n is either a, c, g or t
  misc_feature (688)..(688): n is either a, c, g or t
  misc_feature (707)..(707): n is either a, c, g or t
  misc_feature (716)..(716): n is either a, c, g or t
  misc_feature (728)..(728): n is either a, c, g or t
  misc_feature (730)..(730): n is either a, c, g or t
  misc_feature (734)..(734): n is either a, c, g or t
  misc_feature (736)..(737): n is either a, c, g or t
  misc_feature (748)..(749): n is either a, c, g or t
ttaccgacgccgaaacgttacaaaatctacgataaaacaatcgcgcctacacataacaacacttctttattaaccgttacgcgaattaaaataatactatcgccttccaaccattcgacgcccaccgcgcgtttaccgtcaaaaataatataatcgatcataacgtaaatacgaataatcaaattaaaacgcgatttaacctaatcgaaataaccacgcgcgatactaacgcgacgaccctacgacgtaacgatacgatccatcgaaccaaaaccttcctactaataaccgttaaaatcgtccgtacgcgaataacccgcctacacgcccgcttcaatcatcgcttcaaacaacgaattaacgccgaatttaaaaataataacgctcaccgaaccattcaccgccgntanataaattcgttttcaacccaataattcgacgaaattcttcgaacccttaacnnaataataaaacaaacaatcgaaataactccaattctccaaaccgaattcttacgcccaattatncgaaattccaaanncgcattacgcacgaaaataattaaaccaccaattacccccgaattttaaaaattccaaaaccgaaaccgaaaattccccaaacgccccaaaaaaaccccgttattttaaacgcccgaaacgaaatttcaccgaaccaaaccgttccnccaaattaaaaccgaaaancgaaaattntaatttttccantnaaananncgaattccaannattccg

SEQ ID NO: 27585 - DNA, 596 bp, Artificial Sequence
  chemically treated genomic DNA (Homo sapiens) CpG-island No: 27585
gtttatacggtttgtcgggaataggtttattacgttacgcggatttagcgttttttcggcgtttaatttatttagtatgtcgttggcgtttttaaatagtcgttgcgttttaacgtttattattttattttttagaatgcgcggatatttttcggttagcgattaggttataaagaacggtgtttagtcgatgtaattacgtagcgtttcgatgttggtttcgattttttgtacgtcgagacggtgcgttatcggcggcgtgtaagtttgttagttaaaagcgaaatcgttatcgcgcgtcgtttttagcgtgatcggtggtgtgcgcggttttttgcgttcgtgttgaatacgtacggtttcgtattttttgcgggtacgagcgataaaattattacgttgggtatcggaaagtagcgtcgttattatattaacggtacgcgaggtattttgtatatatatcgtcgggtcgttgtagttttgttcgatttttatcgtcgtgtgcgtttttgaggtcgtcgcgtcgttaattagtaacggaatagtgaagttttgacgttttatttttttcgttacgttaattatttcgtttagcg

SEQ ID NO: 27586 - DNA, 596 bp, Artificial Sequence
  chemically treated genomic DNA (Homo sapiens) CpG-island No: 27586
cgctaaacgaaataattaacgtaacgaaaaaaataaaacgtcaaaacttcactattccgttactaattaacgacgcgacgacctcaaaaacgcacacgacgataaaaatcgaacaaaactacaacgacccgacgatatatatacaaaatacctcgcgtaccgttaatataataacgacgctactttccgatacccaacgtaataattttatcgctcgtacccgcaaaaaatacgaaaccgtacgtattcaacacgaacgcaaaaaaccgcgcacaccaccgatcacgctaaaaacgacgcgcgataacgatttcgcttttaactaacaaacttacacgccgccgataacgcaccgtctcgacgtacaaaaaatcgaaaccaacatcgaaacgctacgtaattacatcgactaaacaccgttctttataacctaatcgctaaccgaaaaatatccgcgcattctaaaaaataaaataataaacgttaaaacgcaacgactatttaaaaacgccaacgacatactaaataaattaaacgccgaaaaaacgctaaatccgcgtaacgtaataaacctattcccgacaaaccgtataaac

SEQ ID NO: 27587 - DNA, 596 bp, Artificial Sequence
  chemically treated genomic DNA (Homo sapiens) CpG-island No: 27587
cgttggacgagatggttaacgtggcgaaagagatggagcgttagggttttattatttcgttattgattggcggcgcgacgattttaaaagcgtatacggcggtgaaaatcgagtagaattatagcggttcgacggtgtatgtgtagaatgtttcgcgtatcgttggtgtggtggcggcgttgtttttcgatatttagcgtgatgattttgtcgttcgtattcgtaaggagtacgaaatcgtacgtatttagtacgggcgtaagaaatcgcgtatattatcggttacgttggaagcggcgcgcgataacgatttcgtttttgattggtaggtttatacgtcgtcggtggcgtatcgtttcggcgtgtaggaagtcgaagttagtatcgaaacgttgcgtaattatatcgattggatatcgttttttatgatttggtcgttggtcgggaagtattcgcgtattttggaagatgaagtggtgggcgttgaggcgtagcggttgtttaaagacgttaacgatatgttggataaattaagcgtcgagaaaacgttgaattcgcgtggcgtggtgggtttgttttcggtaaatcgtgtgggt

SEQ ID NO: 27588 - DNA, 596 bp, Artificial Sequence
  chemically treated genomic DNA (Homo sapiens) CpG-island No: 27588
acccacacgatttaccgaaaacaaacccaccacgccacgcgaattcaacgttttctcgacgcttaatttatccaacatatcgttaacgtctttaaacaaccgctacgcctcaacgcccaccacttcatcttccaaaatacgcgaatacttcccgaccaacgaccaaatcataaaaaacgatatccaatcgatataattacgcaacgtttcgatactaacttcgacttcctacacgccgaaacgatacgccaccgacgacgtataaacctaccaatcaaaaacgaaatcgttatcgcgcgccgcttccaacgtaaccgataatatacgcgatttcttacgcccgtactaaatacgtacgatttcgtactccttacgaatacgaacgacaaaatcatcacgctaaatatcgaaaaacaacgccgccaccacaccaacgatacgcgaaacattctacacatacaccgtcgaaccgctataattctactcgattttcaccgccgtatacgcttttaaaatcgtcgcgccgccaatcaataacgaaataataaaaccctaacgctccatctctttcgccacgttaaccatctcgtccaacg

SEQ ID NO: 27589 - DNA, 537 bp, Artificial Sequence
  chemically treated genomic DNA (Homo sapiens) CpG-island No: 27589
gttttattcgatgtcgatcgtatatcggtattgatggtattgcgtgagtatgtttttggatttgagattttgtatatcgatgaggagattattttttacgagtgtgacgggttgagcgcgtatcgtacgcgtttattattggttgttttgtttaagtaaatggaataggtgatagcgattttggttgtttgttatcgtttgcgtgtatcggtggtgattcgtggtgtaggtatcgggttttttggtggcgcgttgtcgttggaaaaaggtgtgttgttggtgatggcgcgttttaaagagattttcgatattaatttcgttggtcgtcgcgcgcgcgtgtagttaggcgtgcgtaatttggcgattttttaggtcgttgtatcgtataatttttattacgtatcggatttttttttataaatcgtttgttttattggcggtaatgtggttgaaaatgtcggcggcgtttattgtttgaaatatggtttgatcgtatataatttgttgaaaattgaagtgtaaacgttggacggcgag

SEQ ID NO: 27590 - DNA, 537 bp, Artificial Sequence
  chemically treated genomic DNA (Homo sapiens) CpG-island No: 27590
ctcgccgtccaacgtttacacttcaattttcaacaaattatatacgatcaaaccatatttcaaacaataaacgccgccgacattttcaaccacattaccgccaataaaacaaacgatttataaaaaaaaatccgatacgtaataaaaattatacgatacaacgacctaaaaaatcgccaaattacgcacgcctaactacacgcgcgcgcgacgaccaacgaaattaatatcgaaaatctctttaaaacgcgccatcaccaacaacacacctttttccaacgacaacgcgccaccaaaaaacccgatacctacaccacgaatcaccaccgatacacgcaaacgataacaaacaaccaaaatcgctatcacctattccatttacttaaacaaaacaaccaataataaacgcgtacgatacgcgctcaacccgtcacactcgtaaaaaataatctcctcatcgatatacaaaatctcaaatccaaaaacatactcacgcaataccatcaataccgatatacgatcgacatcgaataaaac

SEQ ID NO: 27591 - DNA, 537 bp, Artificial Sequence
  chemically treated genomic DNA (Homo sapiens) CpG-island No: 27591
ttcgtcgtttagcgtttgtattttaatttttagtaggttatgtacggttagattatattttaggtagtggacgtcgtcggtatttttagttatattgtcgttaatggaataggcgatttgtgaggaagggttcggtgcgtagtagagattatgcggtgtaacggtttgggagatcgttaggttacgtacgtttggttgtacgcgcgcgcggcgattaacggggttaatgtcgaggatttttttaaagcgcgttattattaataatatatttttttttagcggtagcgcgttattagaaagttcggtgtttgtattacgggttattatcggtatacgtaggcgatggtagatagttagaatcgttgttatttgttttatttgtttaggtagaataattagtaatggacgcgtgcgatacgcgtttaattcgttatattcgtaaggaatgatttttttatcggtatgtaggattttaagtttagggatatgtttacgtagtgttattagtatcgatgtgcggtcgatatcgggtaaagt

SEQ ID NO: 27592 - DNA, 537 bp, Artificial Sequence
  chemically treated genomic DNA (Homo sapiens) CpG-island No: 27592
actttacccgatatcgaccgcacatcgatactaataacactacgtaaacatatccctaaacttaaaatcctacataccgataaaaaaatcattccttacgaatataacgaattaaacgcgtatcgcacgcgtccattactaattattctacctaaacaaataaaacaaataacaacgattctaactatctaccatcgcctacgtataccgataataacccgtaatacaaacaccgaactttctaataacgcgctaccgctaaaaaaaaatatattattaataataacgcgctttaaaaaaatcctcgacattaaccccgttaatcgccgcgcgcgcgtacaaccaaacgtacgtaacctaacgatctcccaaaccgttacaccgcataatctctactacgcaccgaacccttcctcacaaatcgcctattccattaacgacaatataactaaaaataccgacgacgtccactacctaaaatataatctaaccgtacataacctactaaaaattaaaatacaaacgctaaacgacgaa

SEQ ID NO: 27593 - DNA, 508 bp, Artificial Sequence
  chemically treated genomic DNA (Homo sapiens) CpG-island No: 27593
cggtttcggtggggcgatcggtgtaggtttcggtttaaattcggtgttattggttgtaatagtggtcggatcgagcgacggtgttgcggtattatttgttcgtatttttttcgttgcgtttttcggcggttgcgtcggtaacgtttgggtggcggttggtattatattaggtttattacgatcgttcgttttcggtattagcgggatagtcgcgaatttattttgataatgttttttttgttcgtttagtagttttggaagtataattatttttagcgttattagtacgatcgtgtttattaatcgattttgaaatttatttgttatcgttttttttcgcgttaattatttttatgatatgtgcgatcgtgtggaaagaattatatattagtacggtgtttttcgttttagcgttcgttattgcggtattttatgtttgcgtaacgttattaaatgatttgtcgttatttaaatgtttaagtagttgttttgtcgtggtatcgcgcgg

SEQ ID NO: 27594 - DNA, 508 bp, Artificial Sequence
  chemically treated genomic DNA (Homo sapiens) CpG-island No: 27594
ccgcgcgataccacgacaaaacaactacttaaacatttaaataacgacaaatcatttaataacgttacgcaaacataaaataccgcaataacgaacgctaaaacgaaaaacaccgtactaatatataattctttccacacgatcgcacatatcataaaaataattaacgcgaaaaaaaacgataacaaataaatttcaaaatcgattaataaacacgatcgtactaataacgctaaaaataattatacttccaaaactactaaacgaacaaaaaaaacattatcaaaataaattcgcgactatcccgctaataccgaaaacgaacgatcgtaataaacctaatataataccaaccgccacccaaacgttaccgacgcaaccgccgaaaaacgcaacgaaaaaaatacgaacaaataataccgcaacaccgtcgctcgatccgaccactattacaaccaataacaccgaatttaaaccgaaacctacaccgatcgccccaccgaaaccg

SEQ ID NO: 27595 - DNA, 508 bp, Artificial Sequence
  chemically treated genomic DNA (Homo sapiens) CpG-island No: 27595
tcgcgcggtgttacggtagaataattgtttgagtatttgggtaacggtaaattatttgatagcgttgcgtaggtatgggatgtcgtaatggcggacgttaaagcggaagatatcgtgttggtgtgtggttttttttatacggtcgtatatgttatggaagtgattgacgcgaggagaagcggtggtaagtaagttttagaatcggttagtgggtacgatcgtgttggtggcgttgggggtgattgtatttttagggttgttggacgggtagaaaaaatattattaggatgagttcgcggttatttcgttggtgtcgaaagcgggcgatcgtgatgagtttgatatgatgttagtcgttatttaggcgttatcgacgtagtcgtcggaaggcgtagcggaagaggtgcgggtaggtgatgtcgtagtatcgtcgttcgattcggttattattgtagttaataatatcgagtttgaatcggaatttgtatcggtcgttttatcgaagtcg

SEQ ID NO: 27596 - DNA, 508 bp, Artificial Sequence
  chemically treated genomic DNA (Homo sapiens) CpG-island No: 27596
cgacttcgataaaacgaccgatacaaattccgattcaaactcgatattattaactacaataataaccgaatcgaacgacgatactacgacatcacctacccgcacctcttccgctacgccttccgacgactacgtcgataacgcctaaataacgactaacatcatatcaaactcatcacgatcgcccgctttcgacaccaacgaaataaccgcgaactcatcctaataatattttttctacccgtccaacaaccctaaaaatacaatcacccccaacgccaccaacacgatcgtacccactaaccgattctaaaacttacttaccaccgcttctcctcgcgtcaatcacttccataacatatacgaccgtataaaaaaaaccacacaccaacacgatatcttccgctttaacgtccgccattacgacatcccatacctacgcaacgctatcaaataatttaccgttacccaaatactcaaacaattattctaccgtaacaccgcgcga

SEQ ID NO: 27597 - DNA, 963 bp, Artificial Sequence
  chemically treated genomic DNA (Homo sapiens) CpG-island No: 27597
  misc_feature (19)..(19): n is either a, c, g or t
ttgtagcgcggaggtgagnttggtaggttttttttatgtcggtgtcggacggtcgtcgtcgattattattatgatatcgttttgtataattttttttcgtttgatcgttttgatcgtttgcgttttcgagataaatattcgtattcggtcggtgtggtggtatacgttattttcgtttattatcgacgggtcgatcgtcgtggttttgattatcgaatttttcggcgcgatgttgttcgtcgggaagtagatcgtcgaggttagttttttcgtttttgtttttttcggcggtaggattacgttattcggttttacgtcgttttgttcgcgtaggtattggcggaagcgcgttcggcgttcggacgtttgttattatttaaggttttcgtttatcgtttggtcggttacggttatggcgtttagatgtagtaggtcgaggtcgcgtaggtggagtattattttcggtacgtcgttcgcgaggaaggcgcgtacggtcgggtgatagttcgggtcgttgggtagtacgtttattagacgcggtattttacggttgatgcgcgtttagtgtttaacgttcgggatcgtgtagttcgtcgcgtgggcgatggtcggaatgtgtagtagtaaattggtggagtcgtcgaacgtcgcgtggattattatcgcgttttcgatggttttatcggagaggatatttcgcgtggtgatgtcgcggttatttagttcgttgatcgcgcgcgtcgattggcgggcgatttttagttatatcgtttgttcggacggcgttagcgcggagtgcggtagcgttagatttagcgttttcgcgattatttgcgaggtgttcgtcgtgtcgaggaattgatattcgtcgttcggcgaggcgtaggcgcgatagtttagttcgcggttttttgtagggagagttcgtggttggcgaaacgcgcgtcgatggtttgtattttg

SEQ ID NO: 27598 - DNA, 963 bp, Artificial Sequence
  chemically treated genomic DNA (Homo sapiens) CpG-island No: 27598
  misc_feature (945)..(945): n is either a, c, g or t
caaaatacaaaccatcgacgcgcgtttcgccaaccacgaactctccctacaaaaaaccgcgaactaaactatcgcgcctacgcctcgccgaacgacgaatatcaattcctcgacacgacgaacacctcgcaaataatcgcgaaaacgctaaatctaacgctaccgcactccgcgctaacgccgtccgaacaaacgatataactaaaaatcgcccgccaatcgacgcgcgcgatcaacgaactaaataaccgcgacatcaccacgcgaaatatcctctccgataaaaccatcgaaaacgcgataataatccacgcgacgttcgacgactccaccaatttactactacacattccgaccatcgcccacgcgacgaactacacgatcccgaacgttaaacactaaacgcgcatcaaccgtaaaataccgcgtctaataaacgtactacccaacgacccgaactatcacccgaccgtacgcgccttcctcgcgaacgacgtaccgaaaataatactccacctacgcgacctcgacctactacatctaaacgccataaccgtaaccgaccaaacgataaacgaaaaccttaaataataacaaacgtccgaacgccgaacgcgcttccgccaatacctacgcgaacaaaacgacgtaaaaccgaataacgtaatcctaccgccgaaaaaaacaaaaacgaaaaaactaacctcgacgatctacttcccgacgaacaacatcgcgccgaaaaattcgataatcaaaaccacgacgatcgacccgtcgataataaacgaaaataacgtataccaccacaccgaccgaatacgaatatttatctcgaaaacgcaaacgatcaaaacgatcaaacgaaaaaaaattatacaaaacgatatcataataataatcgacgacgaccgtccgacaccgacataaaaaaaacctaccaanctcacctccgcgctacaa

SEQ ID NO: 27599 - DNA, 963 bp, Artificial Sequence
  chemically treated genomic DNA (Homo sapiens) CpG-island No: 27599
  misc_feature (945)..(945): n is either a, c, g or t
taaggtgtagattatcggcgcgcgtttcgttaattacgaattttttttgtaggaggtcgcgaattgggttgtcgcgtttgcgtttcgtcgggcggcgggtgttagtttttcggtacggcgggtatttcgtaggtggtcgcggaggcgttgggtttggcgttgtcgtatttcgcgttggcgtcgttcgggtaggcggtgtggttggagatcgttcgttagtcggcgcgcgcggttagcgagttggatagtcgcggtattattacgcgggatatttttttcgataaagttatcgaaaacgcgatggtgatttacgcggcgttcggcggttttattaatttattgttgtatatttcggttatcgtttacgcggcgggttgtacgatttcggacgttgagtattggacgcgtattaatcgtaaagtgtcgcgtttggtgagcgtgttgtttaacggttcggattattattcgatcgtgcgcgtttttttcgcgggcggcgtgtcggaggtgatgttttatttgcgcgatttcggtttgttgtatttggacgttatgatcgtgatcggttagacggtgggcgagaattttgaatggtggtaggcgttcgagcgtcgggcgcgttttcgttagtgtttgcgcgagtaggacggcgtagagtcggatgacgtgattttgtcgtcggagaaggtaaaagcgaaagggttgatttcgacggtttgtttttcgacgggtaatatcgcgtcggaaggttcggtgattaaggttacggcgatcgattcgtcggtggtgggcgaagatggcgtatattattatatcggtcgggtgcgggtgtttgtttcggaagcgtaggcgattaaggcgattaagcgggaagagattgtgtagggcgatattatggtggtgatcggcggcggtcgttcggtatcggtatggaagagatttattagntttattttcgcgttataa

SEQ ID NO: 27600 - DNA, 963 bp, Artificial Sequence
  chemically treated genomic DNA (Homo sapiens) CpG-island No: 27600
  misc_feature (19)..(19): n is either a, c, g or t
ttataacgcgaaaataaanctaataaatctcttccataccgataccgaacgaccgccgccgatcaccaccataatatcgccctacacaatctcttcccgcttaatcgccttaatcgcctacgcttccgaaacaaacacccgcacccgaccgatataataatatacgccatcttcgcccaccaccgacgaatcgatcgccgtaaccttaatcaccgaaccttccgacgcgatattacccgtcgaaaaacaaaccgtcgaaatcaaccctttcgcttttaccttctccgacgacaaaatcacgtcatccgactctacgccgtcctactcgcgcaaacactaacgaaaacgcgcccgacgctcgaacgcctaccaccattcaaaattctcgcccaccgtctaaccgatcacgatcataacgtccaaatacaacaaaccgaaatcgcgcaaataaaacatcacctccgacacgccgcccgcgaaaaaaacgcgcacgatcgaataataatccgaaccgttaaacaacacgctcaccaaacgcgacactttacgattaatacgcgtccaatactcaacgtccgaaatcgtacaacccgccgcgtaaacgataaccgaaatatacaacaataaattaataaaaccgccgaacgccgcgtaaatcaccatcgcgttttcgataactttatcgaaaaaaatatcccgcgtaataataccgcgactatccaactcgctaaccgcgcgcgccgactaacgaacgatctccaaccacaccgcctacccgaacgacgccaacgcgaaatacgacaacgccaaacccaacgcctccgcgaccacctacgaaatacccgccgtaccgaaaaactaacacccgccgcccgacgaaacgcaaacgcgacaacccaattcgcgacctcctacaaaaaaaattcgtaattaacgaaacgcgcgccgataatctacacctta

SEQ ID NO: 27601 - DNA, 955 bp, Artificial Sequence
  chemically treated genomic DNA (Homo sapiens) CpG-island No: 27601
aatggattcgtcgttttaaaggggaaaaaaagaggtttttacgtaatttcgatttcgtatttagttttggcgttaataggtataggtatcgggcgaagcgaaatcggatttttgttagttagtttagttttttcgtcgttttaaaattgaagaagtatggtcggaagatttgttggcgaagaaatcggaattgcgtggtaaaacgttgtacgaagtgttgtatgttatatcggaagtgagtaaattttcggtattcgaattggcggaagattagttgaacgatgaatttcgcgagttgggtttttatttgtaaaaagggttgttcgaagagtacgtatggtttggtcgcggttacggttacgatttggtatcgttcgatgattattattaagcgcgcggtttgcgttggtcggtggtgaacggtaaagaaacgtagtggcgttatagcgaaggtaacgattcgtacgtgaaagcgggcgaaggttataagttttacggtaaatcggatggtaaagcggtgattttcgtattgttattcgaatcggcggcggaagtatcggatgaagagtacgatttgtggttttttatcggacgcgttttggagtattggtatatcggtagtatgattcgtcgtgtattagaattgtatcgcgttttttcggaagcggttttgtttatttattcgttggatgcgaaagcgcgcgatttgcgtcgtggcgataaagtgaaagtggtttttcgtcgtggcgaagtgatttcgattgttgaaacgcgcggtcgtaatcgttcgttatagggtttggtgtatatgtcgtttttcgacgtcgtatagttggttaataaattgacgttggatgcgatcgattcgttttcgaaagagacggattttaagaagtgcgcggttaaattggagaaggtgtaagttattatgtttcggttagcgaaattttaaaat

SEQ ID NO: 27602 - DNA, 955 bp, Artificial Sequence
  chemically treated genomic DNA (Homo sapiens) CpG-island No: 27602
attttaaaatttcgctaaccgaaacataataacttacaccttctccaatttaaccgcgcacttcttaaaatccgtctctttcgaaaacgaatcgatcgcatccaacgtcaatttattaaccaactatacgacgtcgaaaaacgacatatacaccaaaccctataacgaacgattacgaccgcgcgtttcaacaatcgaaatcacttcgccacgacgaaaaaccactttcactttatcgccacgacgcaaatcgcgcgctttcgcatccaacgaataaataaacaaaaccgcttccgaaaaaacgcgatacaattctaatacacgacgaatcatactaccgatataccaatactccaaaacgcgtccgataaaaaaccacaaatcgtactcttcatccgatacttccgccgccgattcgaataacaatacgaaaatcaccgctttaccatccgatttaccgtaaaacttataaccttcgcccgctttcacgtacgaatcgttaccttcgctataacgccactacgtttctttaccgttcaccaccgaccaacgcaaaccgcgcgcttaataataatcatcgaacgataccaaatcgtaaccgtaaccgcgaccaaaccatacgtactcttcgaacaaccctttttacaaataaaaacccaactcgcgaaattcatcgttcaactaatcttccgccaattcgaataccgaaaatttactcacttccgatataacatacaacacttcgtacaacgttttaccacgcaattccgatttcttcgccaacaaatcttccgaccatacttcttcaattttaaaacgacgaaaaaactaaactaactaacaaaaatccgatttcgcttcgcccgatacctatacctattaacgccaaaactaaatacgaaatcgaaattacgtaaaaacctctttttttcccctttaaaacgacgaatccatt

SEQ ID NO: 27603 - DNA, 955 bp, Artificial Sequence
  chemically treated genomic DNA (Homo sapiens) CpG-island No: 27603
attttgaggtttcgttgatcgggatataatggtttatattttttttagtttgatcgcgtattttttgaagttcgtttttttcgagagcggatcggtcgtatttagcgttagtttgttaattaattgtgcggcgtcgaagaacggtatgtatattaggttttgtggcggacggttacgatcgcgcgttttaataatcgagattatttcgttacggcgagaaattatttttattttgtcgttacggcgtagatcgcgcgttttcgtatttagcgggtgaataaataggatcgttttcgggaaggcgcggtgtagttttggtatacggcgagttatattgtcggtgtgttagtgttttagaacgcgttcggtagagagttataggtcgtattttttattcggtgttttcgtcgtcggttcgaatggtagtgcgaagattatcgttttgttattcggtttatcgtagaatttatagttttcgttcgtttttacgtacgggtcgttattttcgttgtaacgttattgcgtttttttatcgtttattatcggttagcgtagatcgcgcgtttagtggtagttatcgaacggtgttagatcgtgatcgtgatcgcgattaaattatgcgtatttttcgaatagttttttttgtagatagaagtttagttcgcgggatttatcgtttagttgatttttcgttagttcggatatcgggaatttgtttattttcggtgtggtatatagtatttcgtatagcgttttgttacgtagtttcggttttttcgttagtagatttttcggttatatttttttagttttgaagcggcgggagaattggattaattggtagagattcgatttcgtttcgttcggtgtttgtatttgttggcgttagagttgggtacggggtcggggttacgtaagggttttttttttttttttttggggcggcgggtttatt

SEQ ID NO: 27604 - DNA, 955 bp, Artificial Sequence
  chemically treated genomic DNA (Homo sapiens) CpG-island No: 27604
aataaacccgccgccccaaaaaaaaaaaaaaaaaacccttacgtaaccccgaccccgtacccaactctaacgccaacaaatacaaacaccgaacgaaacgaaatcgaatctctaccaattaatccaattctcccgccgcttcaaaactaaaaaaatataaccgaaaaatctactaacgaaaaaaccgaaactacgtaacaaaacgctatacgaaatactatataccacaccgaaaataaacaaattcccgatatccgaactaacgaaaaatcaactaaacgataaatcccgcgaactaaacttctatctacaaaaaaaactattcgaaaaatacgcataatttaatcgcgatcacgatcacgatctaacaccgttcgataactaccactaaacgcgcgatctacgctaaccgataataaacgataaaaaaacgcaataacgttacaacgaaaataacgacccgtacgtaaaaacgaacgaaaactataaattctacgataaaccgaataacaaaacgataatcttcgcactaccattcgaaccgacgacgaaaacaccgaataaaaaatacgacctataactctctaccgaacgcgttctaaaacactaacacaccgacaatataactcgccgtataccaaaactacaccgcgccttcccgaaaacgatcctatttattcacccgctaaatacgaaaacgcgcgatctacgccgtaacgacaaaataaaaataatttctcgccgtaacgaaataatctcgattattaaaacgcgcgatcgtaaccgtccgccacaaaacctaatatacataccgttcttcgacgccgcacaattaattaacaaactaacgctaaatacgaccgatccgctctcgaaaaaaacgaacttcaaaaaatacgcgatcaaactaaaaaaaatataaaccattatatcccgatcaacgaaacctcaaaat

SEQ ID NO: 27605 - DNA, 842 bp, Artificial Sequence
  chemically treated genomic DNA (Homo sapiens) CpG-island No: 27605
  misc_feature (476)..(476): n is either a, c, g or t
  misc_feature (482)..(483): n is either a, c, g or t
  misc_feature (487)..(487): n is either a, c, g or t
  misc_feature (490)..(490): n is either a, c, g or t
  misc_feature (492)..(492): n is either a, c, g or t
  misc_feature (494)..(494): n is either a, c, g or t
  misc_feature (496)..(496): n is either a, c, g or t
  misc_feature (507)..(507): n is either a, c, g or t
  misc_feature (510)..(510): n is either a, c, g or t
  misc_feature (515)..(516): n is either a, c, g or t
  misc_feature (520)..(520): n is either a, c, g or t
  misc_feature (553)..(555): n is either a, c, g or t
tcgcggcgacgcggtagatattgttgttgattcgattgaaggtacgcgtatgacggcgatgggttaggttaacgcgttggcggtgttggtagtaggcgataaaggttgtttttttaatgcgtcggatatgtatatggagaagttgattgtcgggtcgggagttaaaggtattattgatttgaatttgtcgttggcggataatttgcgtaatgtagcggcggcgttcggtaaatcgttgagcgaattgacggtaacgattttggttaaattacgttacgatgtcgttatcgttgaaatgtagtaattcggcgtacgcgtatttgttatttcggacggcgacgttgcggttttaatttttatttgtatgttagatagcgaagttgacgtgttgtacggtattggtggcgcgtcggaaggcgtagtttttgcggcggtgattcgcgtattagatggcgatatgaacggtcgtttgttgngcgcgnnttantgnantngntttaatagcgnttngatannacgntaattacgtaagtaatttcgttttcgtattggnnncgagtaggagttggtacgttgtaaagcgatgggtatcgaagtcggtaaagtattgcgtttgggcgatatggcgcgtagcgataacgttattttttttgttatcggtattattaaaggcgatttgttggaaggtattagtcgtaaaggtaatatcgcgattatcgaaacgttgttgattcgcggtaagttacgtattattcgtcgtatttagtttatttattatttggatcgtaaagattcggaaatgtaggtgtatattttttgattgatttgatcgattgagtttt

SEQ ID NO: 27606 - DNA, 842 bp, Artificial Sequence
  chemically treated genomic DNA (Homo sapiens) CpG-island No: 27606
  misc_feature (288)..(290): n is either a, c, g or t
  misc_feature (323)..(323): n is either a, c, g or t
  misc_feature (327)..(328): n is either a, c, g or t
  misc_feature (333)..(333): n is either a, c, g or t
  misc_feature (336)..(336): n is either a, c, g or t
  misc_feature (347)..(347): n is either a, c, g or t
  misc_feature (349)..(349): n is either a, c, g or t
  misc_feature (351)..(351): n is either a, c, g or t
  misc_feature (353)..(353): n is either a, c, g or t
  misc_feature (356)..(356): n is either a, c, g or t
  misc_feature (360)..(361): n is either a, c, g or t
  misc_feature (367)..(367): n is either a, c, g or t
aaaactcaatcgatcaaatcaatcaaaaaatatacacctacatttccgaatctttacgatccaaataataaataaactaaatacgacgaataatacgtaacttaccgcgaatcaacaacgtttcgataatcgcgatattacctttacgactaataccttccaacaaatcgcctttaataataccgataacaaaaaaaataacgttatcgctacgcgccatatcgcccaaacgcaatactttaccgacttcgatacccatcgctttacaacgtaccaactcctactcgnnnccaatacgaaaacgaaattacttacgtaattancgtnntatcnaancgctattaaancnantncantaanncgcgcncaacaaacgaccgttcatatcgccatctaatacgcgaatcaccgccgcaaaaactacgccttccgacgcgccaccaataccgtacaacacgtcaacttcgctatctaacatacaaataaaaattaaaaccgcaacgtcgccgtccgaaataacaaatacgcgtacgccgaattactacatttcaacgataacgacatcgtaacgtaatttaaccaaaatcgttaccgtcaattcgctcaacgatttaccgaacgccgccgctacattacgcaaattatccgccaacgacaaattcaaatcaataatacctttaactcccgacccgacaatcaacttctccatatacatatccgacgcattaaaaaaacaacctttatcgcctactaccaacaccgccaacgcgttaacctaacccatcgccgtcatacgcgtaccttcaatcgaatcaacaacaatatctaccgcgtcgccgcga

SEQ ID NO: 27607 - DNA, 842 bp, Artificial Sequence
  chemically treated genomic DNA (Homo sapiens) CpG-island No: 27607
  misc_feature (288)..(290): n is either a, c, g or t
  misc_feature (323)..(323): n is either a, c, g or t
  misc_feature (327)..(328): n is either a, c, g or t
  misc_feature (333)..(333): n is either a, c, g or t
  misc_feature (336)..(336): n is either a, c, g or t
  misc_feature (347)..(347): n is either a, c, g or t
  misc_feature (349)..(349): n is either a, c, g or t
  misc_feature (351)..(351): n is either a, c, g or t
  misc_feature (353)..(353): n is either a, c, g or t
  misc_feature (356)..(356): n is either a, c, g or t
  misc_feature (360)..(361): n is either a, c, g or t
  misc_feature (367)..(367): n is either a, c, g or t
aaggtttaatcgattaaattaattagaggatgtgtatttgtattttcgggtttttgcgatttagatagtggatggattgaatgcggcgaatggtgcgtgatttgtcgcggattagtagcgtttcggtagtcgcgatattgtttttgcggttaatgttttttagtagatcgtttttggtaatatcggtggtagagaagatgacgttatcgttgcgcgttatatcgtttaggcgtaatattttatcggtttcgatgtttatcgttttgtagcgtgttagtttttgttcgnnnttaatgcgggagcggagttgtttgcgtggttgncgtnntgttnggncgttgttggantngntntantganncgcgtntagtagacgatcgtttatgtcgttatttaatgcgcggattatcgtcgtagaaattacgtttttcggcgcgttattaatatcgtatagtacgttaatttcgttgtttggtatataggtgagaattgaggtcgtaacgtcgtcgttcggaatagtaaatacgcgtacgtcgagttgttgtattttagcgataacggtatcgtggcgtggtttagttagaatcgttatcgttagttcgtttaacggtttgtcgagcgtcgtcgttatattgcgtaggttattcgttagcggtaggtttagattaatggtgtttttggttttcggttcgataattagtttttttatatatatattcggcgtattgaggaagtagtttttatcgtttattgttagtatcgttagcgcgttagtttggtttatcgtcgttatgcgcgtgtttttaatcggattaatagtaatatttatcgcgtcgtcgcga

SEQ ID NO: 27608 - DNA, 842 bp, Artificial Sequence
  chemically treated genomic DNA (Homo sapiens) CpG-island No: 27608
  misc_feature (476)..(476): n is either a, c, g or t
  misc_feature (482)..(483): n is either a, c, g or t
  misc_feature (487)..(487): n is either a, c, g or t
  misc_feature (490)..(490): n is either a, c, g or t
  misc_feature (492)..(492): n is either a, c, g or t
  misc_feature (494)..(494): n is either a, c, g or t
  misc_feature (496)..(496): n is either a, c, g or t
  misc_feature (507)..(507): n is either a, c, g or t
  misc_feature (510)..(510): n is either a, c, g or t
  misc_feature (515)..(516): n is either a, c, g or t
  misc_feature (520)..(520): n is either a, c, g or t
  misc_feature (553)..(555): n is either a, c, g or t
tcgcgacgacgcgataaatattactattaatccgattaaaaacacgcgcataacgacgataaaccaaactaacgcgctaacgatactaacaataaacgataaaaactacttcctcaatacgccgaatatatatataaaaaaactaattatcgaaccgaaaaccaaaaacaccattaatctaaacctaccgctaacgaataacctacgcaatataacgacgacgctcgacaaaccgttaaacgaactaacgataacgattctaactaaaccacgccacgataccgttatcgctaaaatacaacaactcgacgtacgcgtatttactattccgaacgacgacgttacgacctcaattctcacctatataccaaacaacgaaattaacgtactatacgatattaataacgcgccgaaaaacgtaatttctacgacgataatccgcgcattaaataacgacataaacgatcgtctactanacgcgnntcantanancnantccaacaacgnccnaacannacgncaaccacgcaaacaactccgctcccgcattaannncgaacaaaaactaacacgctacaaaacgataaacatcgaaaccgataaaatattacgcctaaacgatataacgcgcaacgataacgtcatcttctctaccaccgatattaccaaaaacgatctactaaaaaacattaaccgcaaaaacaatatcgcgactaccgaaacgctactaatccgcgacaaatcacgcaccattcgccgcattcaatccatccactatctaaatcgcaaaaacccgaaaatacaaatacacatcctctaattaatttaatcgattaaacctt

SEQ ID NO: 27609 - DNA, 510 bp, Artificial Sequence
  chemically treated genomic DNA (Homo sapiens) CpG-island No: 27609
ttttttaataatttggtatattattcggcgggcggtagttagtatttcggggtttattagatgtttggtgtgtaaaatagcgcgtagtaggtttttagaaggttgtatacgttttagtacgtcgagattcgttattatatttttaatgtcgtagcgtagtacggtatcgttttttagtcgtttaattatttgttgcggaaatagcgtgtgaatattgttgatttatttaggggtggtgagatttgaggtattttatttacggaacgtttatacgttggagtcgttaggatcgcgttataaggtaatttaggcggggttattggcgggggtgtgtttcgttttatagggtggttcggcggttgttagaattattcgtcggtggtgttcggggttcgaatacgtcgtttacgggaattttcgttggggagttcggtcggttttttgttgtattgtacggtcgtgggtcgtcggttttgtttagggtgttttgagtgttcgtttcgtttttcg

SEQ ID NO: 27610 - DNA, 510 bp, Artificial Sequence
  chemically treated genomic DNA (Homo sapiens) CpG-island No: 27610
cgaaaaacgaaacgaacactcaaaacaccctaaacaaaaccgacgacccacgaccgtacaatacaacaaaaaaccgaccgaactccccaacgaaaattcccgtaaacgacgtattcgaaccccgaacaccaccgacgaataattctaacaaccgccgaaccaccctataaaacgaaacacacccccgccaataaccccgcctaaattaccttataacgcgatcctaacgactccaacgtataaacgttccgtaaataaaatacctcaaatctcaccacccctaaataaatcaacaatattcacacgctatttccgcaacaaataattaaacgactaaaaaacgataccgtactacgctacgacattaaaaatataataacgaatctcgacgtactaaaacgtatacaaccttctaaaaacctactacgcgctattttacacaccaaacatctaataaaccccgaaatactaactaccgcccgccgaataatataccaaattattaaaaaa

SEQ ID NO: 27611 - DNA, 510 bp, Artificial Sequence
  chemically treated genomic DNA (Homo sapiens) CpG-island No: 27611
cgaggggcggaacggatatttaggatattttgggtaaagtcggcggtttacggtcgtgtaatataatagggaatcggtcggattttttaacggggattttcgtggacgacgtgttcgaatttcgggtattatcggcgggtaattttggtaatcgtcgaattattttgtggggcggaatatattttcgttaatagtttcgtttgagttgttttatggcgcgattttgacggttttagcgtgtgaacgtttcgtgaataaggtgttttaaattttattatttttgagtggattaatagtatttatacgttgttttcgtagtaggtgattgagcggttggaaagcgatgtcgtgttgcgttacggtattgaagatgtggtgacgaatttcgacgtgttggaacgtatgtagttttttgaaagtttgttacgcgttgttttgtatattaaatatttgatgaatttcgaagtattggttgtcgttcgtcggatagtgtgttaggttgttgaagaa

SEQ ID NO: 27612 - DNA, 510 bp, Artificial Sequence
  chemically treated genomic DNA (Homo sapiens) CpG-island No: 27612
ttcttcaacaacctaacacactatccgacgaacgacaaccaatacttcgaaattcatcaaatatttaatatacaaaacaacgcgtaacaaactttcaaaaaactacatacgttccaacacgtcgaaattcgtcaccacatcttcaataccgtaacgcaacacgacatcgctttccaaccgctcaatcacctactacgaaaacaacgtataaatactattaatccactcaaaaataataaaatttaaaacaccttattcacgaaacgttcacacgctaaaaccgtcaaaatcgcgccataaaacaactcaaacgaaactattaacgaaaatatattccgccccacaaaataattcgacgattaccaaaattacccgccgataatacccgaaattcgaacacgtcgtccacgaaaatccccgttaaaaaatccgaccgattccctattatattacacgaccgtaaaccgccgactttacccaaaatatcctaaatatccgttccgcccctcg

SEQ ID NO: 27613 - DNA, 593 bp, Artificial Sequence
  chemically treated genomic DNA (Homo sapiens) CpG-island No: 27613
tttggcgcgcggattgtggcgatgtagggtatgagcgattagttttttatcggtgtcggattcgtcgttaattagtacgttaatagaagaacgcgaaagtcgatcgataatacggaatacgttttgtatggttggcgtttcgtcgatgatatcggtcgttgggtcgttaagttgaatattacgcggttgttgttgtttttggtaatgattgatagcgcgtttaattagcgttattgtttcgtcgatattaaacggtttgggtagataattaaacgttttttgttgataggcgttgacggtagtatttagatcggaatgtgcggttataatgatgatcggaagtattggatggcgttgtttaatttgtttgagtagcgttagttcgtttattttcggtatacggatatttgaaagtagtatattcggcgttttgttcgttagcgtttttagtatttttgcgtcgtttttaaacgtcgtataggttaaatttgttttagcgagcgtacgtttaagtatttaacggatggaattatcgttatcgattatttagattatttttcgttgtataaacgttatttttattttttgatagg

SEQ ID NO: 27614 - DNA, 593 bp, Artificial Sequence
  chemically treated genomic DNA (Homo sapiens) CpG-island No: 27614
cctatcaaaaaataaaaataacgtttatacaacgaaaaataatctaaataatcgataacgataattccatccgttaaatacttaaacgtacgctcgctaaaacaaatttaacctatacgacgtttaaaaacgacgcaaaaatactaaaaacgctaacgaacaaaacgccgaatatactactttcaaatatccgtataccgaaaataaacgaactaacgctactcaaacaaattaaacaacgccatccaatacttccgatcatcattataaccgcacattccgatctaaatactaccgtcaacgcctatcaacaaaaaacgtttaattatctacccaaaccgtttaatatcgacgaaacaataacgctaattaaacgcgctatcaatcattaccaaaaacaacaacaaccgcgtaatattcaacttaacgacccaacgaccgatatcatcgacgaaacgccaaccatacaaaacgtattccgtattatcgatcgactttcgcgttcttctattaacgtactaattaacgacgaatccgacaccgataaaaaactaatcgctcataccctacatcgccacaatccgcgcgccaaa

SEQ ID NO: 27615 - DNA, 593 bp, Artificial Sequence
  chemically treated genomic DNA (Homo sapiens) CpG-island No: 27615
tttattaggaaataaaggtgacgtttatgtaacgagggatagtttgggtagtcgatgacgatagttttattcgttgggtgtttgaacgtgcgttcgttggggtaggtttaatttgtacgacgtttgagaacggcgtagaagtgttggaggcgttggcgagtaaaacgtcggatgtgttgtttttagatattcgtatgtcgggaatggacgggttggcgttgtttaagtagattaaatagcgttatttaatgttttcggttattattatgatcgtatatttcgatttggatgttgtcgttagcgtttattaataaggggcgtttgattatttgtttaaatcgtttgatatcgacgaagtagtggcgttggttgagcgcgttattagttattattaggaatagtagtagtcgcgtaatgtttagtttaacggtttaacgatcgatattatcggcgaagcgttagttatgtaggacgtgtttcgtattatcggtcggttttcgcgtttttttattagcgtgttgattaacggcgaattcggtatcggtaaagaattggtcgtttatgttttgtatcgttatagttcgcgcgttaaa

SEQ ID NO: 27616 - DNA, 593 bp, Artificial Sequence
  chemically treated genomic DNA (Homo sapiens) CpG-island No: 27616
tttaacgcgcgaactataacgatacaaaacataaacgaccaattctttaccgataccgaattcgccgttaatcaacacgctaataaaaaaacgcgaaaaccgaccgataatacgaaacacgtcctacataactaacgcttcgccgataatatcgatcgttaaaccgttaaactaaacattacgcgactactactattcctaataataactaataacgcgctcaaccaacgccactacttcgtcgatatcaaacgatttaaacaaataatcaaacgccccttattaataaacgctaacgacaacatccaaatcgaaatatacgatcataataataaccgaaaacattaaataacgctatttaatctacttaaacaacgccaacccgtccattcccgacatacgaatatctaaaaacaacacatccgacgttttactcgccaacgcctccaacacttctacgccgttctcaaacgtcgtacaaattaaacctaccccaacgaacgcacgttcaaacacccaacgaataaaactatcgtcatcgactacccaaactatccctcgttacataaacgtcacctttatttcctaataaa

SEQ ID NO: 27617 - DNA, 574 bp, Artificial Sequence
  chemically treated genomic DNA (Homo sapiens) CpG-island No: 27617
aatatgtgttaatttggtttatggtagagtaagcgagaatacgtttgatgtcggtttgtattagcgcggtaaaatcggttagtagtagcgtaatcgtttcgataatatttattagatgtagaattttcggcgttattaggaataggtcgtgggtacgggcgattaggtagatattcgcggttattatggttgcggcgtggattagcgcggagataggcgtcgggttcgttatcgcgtcggtaagttatgtttgtaacggtaattgcgtagatttatcgatcgtatcgtttagtagtattagcgtcgtttatattagtatgttattgtcgttagtaaagtgcgttggtgttagttttattatttcgcggaagtttagggtgtttagttcgttgtaaagaatgaatagtgcgaaagcgaggaatacgttatttatacgggttacgacgaacgtttttattgtcgttgcgttatttttcggatcggtgtaatagaattcgattagtagataggagtataggtttacgtttttttagtcgaggtatattagtagtaggttgtcggtaagtattagaat

SEQ ID NO: 27618 - DNA, 574 bp, Artificial Sequence
  chemically treated genomic DNA (Homo sapiens) CpG-island No: 27618
attctaatacttaccgacaacctactactaatatacctcgactaaaaaaacgtaaacctatactcctatctactaatcgaattctattacaccgatccgaaaaataacgcaacgacaataaaaacgttcgtcgtaacccgtataaataacgtattcctcgctttcgcactattcattctttacaacgaactaaacaccctaaacttccgcgaaataataaaactaacaccaacgcactttactaacgacaataacatactaatataaacgacgctaatactactaaacgatacgatcgataaatctacgcaattaccgttacaaacataacttaccgacgcgataacgaacccgacgcctatctccgcgctaatccacgccgcaaccataataaccgcgaatatctacctaatcgcccgtacccacgacctattcctaataacgccgaaaattctacatctaataaatattatcgaaacgattacgctactactaaccgattttaccgcgctaatacaaaccgacatcaaacgtattctcgcttactctaccataaaccaaattaacacatatt

SEQ ID NO: 27619 - DNA, 574 bp, Artificial Sequence
  chemically treated genomic DNA (Homo sapiens) CpG-island No: 27619
gttttggtgtttgtcgataatttgttgttgatgtatttcggttgggaaggcgtgggtttgtgtttttatttgttgatcgggttttattatatcgattcgaagaatggcgtagcggtaatgaaagcgttcgtcgtgattcgtgtgggtgacgtgtttttcgttttcgtattgtttattttttataacgaattgggtattttgaattttcgcgaaatggtggaattggtattagcgtattttgttgacggtaataatatgttgatgtgggcgacgttgatgttgttgggcggtgcggtcggtaaatttgcgtagttgtcgttgtagatatggtttgtcgacgcgatggcgggttcgacgtttgttttcgcgttgatttacgtcgtaattatggtaatcgcgggtgtttatttgatcgttcgtatttacggtttgtttttgatgacgtcggaagttttgtatttggtgggtattgtcggggcggttacgttgttgttggtcggttttgtcgcgttggtatagatcgatattaaacgtgttttcgtttattttattatgagttagattggtatatgtt

SEQ ID NO: 27620 - DNA, 574 bp, Artificial Sequence
  chemically treated genomic DNA (Homo sapiens) CpG-island No: 27620
aacatataccaatctaactcataataaaataaacgaaaacacgtttaatatcgatctataccaacgcgacaaaaccgaccaacaacaacgtaaccgccccgacaatacccaccaaatacaaaacttccgacgtcatcaaaaacaaaccgtaaatacgaacgatcaaataaacacccgcgattaccataattacgacgtaaatcaacgcgaaaacaaacgtcgaacccgccatcgcgtcgacaaaccatatctacaacgacaactacgcaaatttaccgaccgcaccgcccaacaacatcaacgtcgcccacatcaacatattattaccgtcaacaaaatacgctaataccaattccaccatttcgcgaaaattcaaaatacccaattcgttataaaaaataaacaatacgaaaacgaaaaacacgtcacccacacgaatcacgacgaacgctttcattaccgctacgccattcttcgaatcgatataataaaacccgatcaacaaataaaaacacaaacccacgccttcccaaccgaaatacatcaacaacaaattatcgacaaacaccaaaac

SEQ ID NO: 27621 - DNA, 577 bp, Artificial Sequence
  chemically treated genomic DNA (Homo sapiens) CpG-island No: 27621
atttgtcggtgcgcggatggggatagagggggcgtttcgtttatttttgcgagtttagcgtttagtttgcgagtttttggttaagcgtttagttttacgcgttttcgcgcggtcgtcggggagggagtggtgaggagggggggtttgagcgggggcgcgggcgatttttttcgagggcgggcgggcgggtgcgttcgggtttttcgggcgggttggggcggcggcgcggcggagcgcggcgttgtagttatggcgggcggcgtgcggttgttttgggtgtcgttattggtgttgttggcgtagttagggtcgtagtttggattgggtcggttcggagagcgttttcgcgtgcgttttatttcggtcgtgtgcggtttgcgttgcgtttatgggtcgatcggttttcgttgtatttcgatttgcgcgtttcgtaacgttattagcgtggatagcggcgttttcggcggggcggtttcggggggattcggttttcgcgtttgtgagtgcggggtggtggtttcgagagagcggtttcgggggggaggaggatttttggggatggaggagatagtttttt

SEQ ID NO: 27622 - DNA, 577 bp, Artificial Sequence
  chemically treated genomic DNA (Homo sapiens) CpG-island No: 27622
aaaaaactatctcctccatccccaaaaatcctcctcccccccgaaaccgctctctcgaaaccaccaccccgcactcacaaacgcgaaaaccgaatccccccgaaaccgccccgccgaaaacgccgctatccacgctaataacgttacgaaacgcgcaaatcgaaatacaacgaaaaccgatcgacccataaacgcaacgcaaaccgcacacgaccgaaataaaacgcacgcgaaaacgctctccgaaccgacccaatccaaactacgaccctaactacgccaacaacaccaataacgacacccaaaacaaccgcacgccgcccgccataactacaacgccgcgctccgccgcgccgccgccccaacccgcccgaaaaacccgaacgcacccgcccgcccgccctcgaaaaaaatcgcccgcgcccccgctcaaaccccccctcctcaccactccctccccgacgaccgcgcgaaaacgcgtaaaactaaacgcttaaccaaaaactcgcaaactaaacgctaaactcgcaaaaataaacgaaacgccccctctatccccatccgcgcaccgacaaat

SEQ ID NO: 27623 - DNA, 577 bp, Artificial Sequence
  chemically treated genomic DNA (Homo sapiens) CpG-island No: 27623
ggaggattgttttttttatttttagggatttttttttttttcggagtcgttttttcgggattattatttcgtatttataggcgcggaagtcgggttttttcggggtcgtttcgtcgggagcgtcgttgtttacgttggtggcgttgcggggcgcgtaggtcggggtatagcgggagtcggtcggtttatggacgtagcgtaggtcgtatacgatcggggtgaagcgtacgcggagacgtttttcgagtcggtttagtttaggttgcggttttagttgcgttagtagtattaatagcgatatttagagtagtcgtacgtcgttcgttatggttgtagcgtcgcgtttcgtcgcgtcgtcgttttagttcgttcgaggggttcggacgtattcgttcgttcgttttcgggggaggtcgttcgcgttttcgtttaggttttttttttttattatttttttttcggcggtcgcgcgggggcgcgtggggttgggcgtttagttagaggttcgtaggttgggcgttagattcgtaggggtgagcggggcgttttttttgtttttattcgcgtatcgataagt

SEQ ID NO: 27624 - DNA, 577 bp, Artificial Sequence
  chemically treated genomic DNA (Homo sapiens) CpG-island No: 27624
acttatcgatacgcgaataaaaacaaaaaaaacgccccgctcacccctacgaatctaacgcccaacctacgaacctctaactaaacgcccaaccccacgcgcccccgcgcgaccgccgaaaaaaaaataataaaaaaaaaaaacctaaacgaaaacgcgaacgacctcccccgaaaacgaacgaacgaatacgtccgaacccctcgaacgaactaaaacgacgacgcgacgaaacgcgacgctacaaccataacgaacgacgtacgactactctaaatatcgctattaatactactaacgcaactaaaaccgcaacctaaactaaaccgactcgaaaaacgtctccgcgtacgcttcaccccgatcgtatacgacctacgctacgtccataaaccgaccgactcccgctataccccgacctacgcgccccgcaacgccaccaacgtaaacaacgacgctcccgacgaaacgaccccgaaaaaacccgacttccgcgcctataaatacgaaataataatcccgaaaaaacgactccgaaaaaaaaaaaaatccctaaaaataaaaaaaacaatcctcc

SEQ ID NO: 27625 - DNA, 677 bp, Artificial Sequence
  chemically treated genomic DNA (Homo sapiens) CpG-island No: 27625
cggtaaggcgtttttagaagtaattttttcggacgcggagttggaggggatttgaggttaggtgttacggagggaaagggagtttaggttaggacggatcgggggaaaggattcggcgatgtttataggtatgtttagttcgggattggttaatgggcgtggcggggcggtggtcgcgtcggggaaggcgggatggtgtttgcgtgtgggcggggtttttaggttaaggggcggggcggggcgggatttttttgtatatacggtaggcggcgggttaatgggcggggtcggggcggggagtcgaggtcgagggacgttttttcgttttcggaacggaattttttcgggagtcgaggaggttcgcgcgcgtgtatttcgtattatttttcggtttcgggttttggtcggcgttagatcgagttgtcgtcgttattatcgtagtagtagtagtcggggagttaggtttagttagggtcgcgggaggcgggggcgttcgggttttggatgtttcgtagcgcggcggttagcgtgagaagggcgggagaggggggttcgggtcgggggcggcgtcgttgttgatgtggcggagggtgggaggcggtcgcggcgttcggatggagagagggtgttaaggttggagagggtggtttcgggtgggggtttaggaataggtttaa

SEQ ID NO: 27626 - DNA, 677 bp, Artificial Sequence
  chemically treated genomic DNA (Homo sapiens) CpG-island No: 27626
ttaaacctattcctaaacccccacccgaaaccaccctctccaaccttaacaccctctctccatccgaacgccgcgaccgcctcccaccctccgccacatcaacaacgacgccgcccccgacccgaacccccctctcccgcccttctcacgctaaccgccgcgctacgaaacatccaaaacccgaacgcccccgcctcccgcgaccctaactaaacctaactccccgactactactactacgataataacgacgacaactcgatctaacgccgaccaaaacccgaaaccgaaaaataatacgaaatacacgcgcgcgaacctcctcgactcccgaaaaaattccgttccgaaaacgaaaaaacgtccctcgacctcgactccccgccccgaccccgcccattaacccgccgcctaccgtatatacaaaaaaatcccgccccgccccgccccttaacctaaaaaccccgcccacacgcaaacaccatcccgccttccccgacgcgaccaccgccccgccacgcccattaaccaatcccgaactaaacatacctataaacatcgccgaatcctttcccccgatccgtcctaacctaaactccctttccctccgtaacacctaacctcaaatcccctccaactccgcgtccgaaaaaattacttctaaaaacgccttaccg

SEQ ID NO: 27627 - DNA, 677 bp, Artificial Sequence
  chemically treated genomic DNA (Homo sapiens) CpG-island No: 27627
ttgggtttgtttttggatttttattcgggattattttttttagttttggtattttttttttattcgggcgtcgcggtcgttttttatttttcgttatattagtagcggcgtcgttttcgattcgagtttttttttttcgttttttttacgttggtcgtcgcgttgcgggatatttagggttcgggcgttttcgtttttcgcggttttggttgggtttggtttttcgattgttgttgttgcggtggtggcggcggtagttcggtttgacgtcggttagggttcggggtcgggggatggtgcgggatgtacgcgcgcgagttttttcggttttcgggaggatttcgtttcgggggcgggggagcgtttttcggtttcggtttttcgtttcgatttcgtttattggttcgtcgtttgtcgtatatgtagaaaggtttcgtttcgtttcgttttttggtttgaagatttcgtttatacgtagatattatttcgtttttttcggcgcggttatcgtttcgttacgtttattggttagtttcgagttgagtatgtttatgaatatcgtcgagttttttttttcggttcgttttggtttgggtttttttttttttcgtgatatttgattttagattttttttagtttcgcgttcgaaagagttgtttttagaggcgttttgtcg

SEQ ID NO: 27628 - DNA, 677 bp, Artificial Sequence
  chemically treated genomic DNA (Homo sapiens) CpG-island No: 27628
cgacaaaacgcctctaaaaacaactctttcgaacgcgaaactaaaaaaaatctaaaatcaaatatcacgaaaaaaaaaaaaacccaaaccaaaacgaaccgaaaaaaaaaactcgacgatattcataaacatactcaactcgaaactaaccaataaacgtaacgaaacgataaccgcgccgaaaaaaacgaaataatatctacgtataaacgaaatcttcaaaccaaaaaacgaaacgaaacgaaacctttctacatatacgacaaacgacgaaccaataaacgaaatcgaaacgaaaaaccgaaaccgaaaaacgctcccccgcccccgaaacgaaatcctcccgaaaaccgaaaaaactcgcgcgcgtacatcccgcaccatcccccgaccccgaaccctaaccgacgtcaaaccgaactaccgccgccaccaccgcaacaacaacaatcgaaaaaccaaacccaaccaaaaccgcgaaaaacgaaaacgcccgaaccctaaatatcccgcaacgcgacgaccaacgtaaaaaaaacgaaaaaaaaaaactcgaatcgaaaacgacgccgctactaatataacgaaaaataaaaaacgaccgcgacgcccgaataaaaaaaaaataccaaaactaaaaaaaataatcccgaataaaaatccaaaaacaaacccaa

SEQ ID NO: 27629 - DNA, 886 bp, Artificial Sequence
  chemically treated genomic DNA (Homo sapiens) CpG-island No: 27629
ggagaagcggaggaggaaagatagaggtgggaggttaatcggcgagtcggggagtcgaagggaggagggattaggtcggggcggggttttttatcgaggtaggaggcgaggttcgggttagcgcggtgtttcggaggatagatgtattcgaaggagtcgtcggtgttggtatagatgtcgttttggtaaaggtttttttcgttgtattcgttaacgtttgcgggatagggcgttcgaaggttcggtttatttttcgtttcgtttaatattttaggttatatttttttatcgtttttcggtttttttaggttttttacgttttttttaatttgttttacgttatttttttttttgtaaatatcgtttttcgacgggtttagaatagtttttttataattacggtttaaatatttagattcggtttttttatttttacgtttcgtttttttttattgtttcgagatttttattagttgttttttgattttgttggaatatttcggttaaaaattcgttttttttttttcgttttttttttttcgtttcgtttttttttgttttaagtttatttttttcggggttaggattagttcgggtacgaatcgaggtaagaggtttcgcggggttcgggtcggtagttaggggtataagtataggtaaaggagtcgttagtgttgaggtattcgtcgtgagggaagtagaaatcgttttttaggtattcgtttacgtttagggtacgcgggagattgggcggagttacgggattcggttttttagataagtttcgtttatatcgtagtaatttcgtttttattaatgttaggtttttaagttttttttatagcgttttggtttcgtttttatttttttagtcggttttgttttg

SEQ ID NO: 27630 - DNA, 886 bp, Artificial Sequence
  chemically treated genomic DNA (Homo sapiens) CpG-island No: 27630
caaaacaaaaccgactaaaaaaataaaaacgaaaccaaaacgctataaaaaaaacttaaaaacctaacattaataaaaacgaaattactacgatataaacgaaacttatctaaaaaaccgaatcccgtaactccgcccaatctcccgcgtaccctaaacgtaaacgaatacctaaaaaacgatttctacttccctcacgacgaatacctcaacactaacgactcctttacctatacttatacccctaactaccgacccgaaccccgcgaaacctcttacctcgattcgtacccgaactaatcctaaccccgaaaaaaataaacttaaaacaaaaaaaaacgaaacgaaaaaaaaaaaacgaaaaaaaaaaaacgaatttttaaccgaaatattccaacaaaatcaaaaaacaactaataaaaatctcgaaacaataaaaaaaaacgaaacgtaaaaataaaaaaaccgaatctaaatatttaaaccgtaattataaaaaaactattctaaacccgtcgaaaaacgatatttacaaaaaaaaaaataacgtaaaacaaattaaaaaaaacgtaaaaaacctaaaaaaaccgaaaaacgataaaaaaatataacctaaaatattaaacgaaacgaaaaataaaccgaaccttcgaacgccctatcccgcaaacgttaacgaatacaacgaaaaaaacctttaccaaaacgacatctataccaacaccgacgactccttcgaatacatctatcctccgaaacaccgcgctaacccgaacctcgcctcctacctcgataaaaaaccccgccccgacctaatccctcctcccttcgactccccgactcgccgattaacctcccacctctatctttcctcctccgcttctcc

SEQ ID NO: 27631 - DNA, 886 bp, Artificial Sequence
  chemically treated genomic DNA (Homo sapiens) CpG-island No: 27631
tagggtaaagtcggttggaaaggtggaggcgggattaaggcgttgtgggaggagtttagaaatttggtattggtgggggcggggttattgcgatgtgggcggagtttgtttgggaggtcgggtttcgtgatttcgtttaatttttcgcgtattttagacgtgaacgagtgtttggagggcgatttttgttttttttacggcgagtgttttaatattgacggtttttttgtttgtatttgtgtttttggttatcgattcggatttcgcggagttttttgtttcggttcgtattcgggttgattttggtttcggaaagggtgggtttagggtaggaaaaggcgggacggggagaagagggcgaaaaggggaaaacgagtttttagtcggggtattttagtaggattagggggtagttggtgggagtttcgaggtagtgagggggggcggggcgtggagatgaaagggtcgagtttgggtatttggatcgtgattgtaaagaagttgttttaaattcgtcggggggcggtgtttgtagggagggaagtagcgtgaggtaggttggggaaggcgtgagaggtttaggagagtcgaggggcggtggaggggtgtggtttagaatgttaggcggagcgggaggtgggtcgggttttcggacgttttgtttcgtagacgttgacgagtgtagcgaggaggatttttgttagagcggtatttgtattaatatcgacggttttttcgagtgtatttgtttttcgggatatcgcgttggttcggatttcgttttttgtttcggtgagaggtttcgtttcggtttgatttttttttttttcgatttttcgattcgtcgattggttttttatttttgttttttttttttcgttttttt

SEQ ID NO: 27632 - DNA, 886 bp, Artificial Sequence
  chemically treated genomic DNA (Homo sapiens) CpG-island No: 27632
aaaaaaacgaaaaaaaaaaaacaaaaataaaaaaccaatcgacgaatcgaaaaatcgaaaaaaaaaaaaatcaaaccgaaacgaaacctctcaccgaaacaaaaaacgaaatccgaaccaacgcgatatcccgaaaaacaaatacactcgaaaaaaccgtcgatattaatacaaataccgctctaacaaaaatcctcctcgctacactcgtcaacgtctacgaaacaaaacgtccgaaaacccgacccacctcccgctccgcctaacattctaaaccacacccctccaccgcccctcgactctcctaaacctctcacgccttccccaacctacctcacgctacttccctccctacaaacaccgccccccgacgaatttaaaacaacttctttacaatcacgatccaaatacccaaactcgaccctttcatctccacgccccgccccccctcactacctcgaaactcccaccaactaccccctaatcctactaaaataccccgactaaaaactcgttttccccttttcgccctcttctccccgtcccgccttttcctaccctaaacccaccctttccgaaaccaaaatcaacccgaatacgaaccgaaacaaaaaactccgcgaaatccgaatcgataaccaaaaacacaaatacaaacaaaaaaaccgtcaatattaaaacactcgccgtaaaaaaaacaaaaatcgccctccaaacactcgttcacgtctaaaatacgcgaaaaattaaacgaaatcacgaaacccgacctcccaaacaaactccgcccacatcgcaataaccccgcccccaccaataccaaatttctaaactcctcccacaacgccttaatcccgcctccacctttccaaccgactttacccta

SEQ ID NO: 27633 - DNA, 570 bp, Artificial Sequence
  chemically treated genomic DNA (Homo sapiens) CpG-island No: 27633
tgatagtcgtgaacgttttaggttaagtcggtttttcggtagtagattttttgcgttcggagttcgggtagcggggacgcgtattgcggggaagtgttgggtgagcgcgttttcgcgcggaggtaagtttcgggtttttttttacgggtttttttttatttcgttttcgcgtagttttcgaaagtagtaatcgaagttcgaggtatttgagtagtcgttttttcgcggcgcgttttgtgttaatatcgtgtagggcgttgtcgttttcgttcgcgtcgtcgttttcgttcgcgttatcgttttagcgttcgtttttttttaagggttagatatacgttttatttggtgtattattatcgacgttttttgcgggtgttttacgtggacgtttattatagatgttacgtttaggggaggtacggtcgggtaaacggatgtttatacgggtttttacggggtggggttagataaggcggggagggcgagttgggtaaaggtgttcgggaaggcgggaaatatgagggttaggggtaaagtgaaatgtttgataggggtcggaggggattttgg

SEQ ID NO: 27634 - DNA, 570 bp, Artificial Sequence
  chemically treated genomic DNA (Homo sapiens) CpG-island No: 27634
ccaaaatcccctccgacccctatcaaacatttcactttacccctaaccctcatatttcccgccttcccgaacacctttacccaactcgccctccccgccttatctaaccccaccccgtaaaaacccgtataaacatccgtttacccgaccgtacctcccctaaacgtaacatctataataaacgtccacgtaaaacacccgcaaaaaacgtcgataataatacaccaaataaaacgtatatctaacccttaaaaaaaaacgaacgctaaaacgataacgcgaacgaaaacgacgacgcgaacgaaaacgacaacgccctacacgatattaacacaaaacgcgccgcgaaaaaacgactactcaaatacctcgaacttcgattactactttcgaaaactacgcgaaaacgaaataaaaaaaaacccgtaaaaaaaaacccgaaacttacctccgcgcgaaaacgcgctcacccaacacttccccgcaatacgcgtccccgctacccgaactccgaacgcaaaaaatctactaccgaaaaaccgacttaacctaaaacgttcacgactatca

SEQ ID NO: 27635 - DNA, 570 bp, Artificial Sequence
  chemically treated genomic DNA (Homo sapiens) CpG-island No: 27635
ttagagtttttttcgatttttgttaagtattttattttgtttttgatttttatatttttcgttttttcgagtatttttgtttagttcgtttttttcgttttgtttagttttatttcgtaagaattcgtgtagatattcgtttgttcggtcgtgttttttttaggcgtggtatttatggtgagcgtttacgtggagtattcgtaggaggcgtcggtggtggtgtattaggtggagcgtgtgtttggtttttgggaggaggcggacgttgaggcggtggcgcgggcggaagcggcggcgcgggcggaggcggtagcgttttatacggtgttggtatagagcgcgtcgcgggaggacggttatttagatgtttcgggtttcggttattgttttcgggagttgcgcggaggcgaagtgagaggaggttcgtggggaggggttcggagtttgttttcgcgcgggggcgcgtttatttaatattttttcgtagtgcgcgttttcgttgttcgggtttcggacgtaggaggtttgttgtcgaggggtcggtttggtttggggcgtttacgattgtta

SEQ ID NO: 27636 - DNA, 570 bp, Artificial Sequence
  chemically treated genomic DNA (Homo sapiens) CpG-island No: 27636
taacaatcgtaaacgccccaaaccaaaccgacccctcgacaacaaacctcctacgtccgaaacccgaacaacgaaaacgcgcactacgaaaaaatattaaataaacgcgcccccgcgcgaaaacaaactccgaacccctccccacgaacctcctctcacttcgcctccgcgcaactcccgaaaacaataaccgaaacccgaaacatctaaataaccgtcctcccgcgacgcgctctataccaacaccgtataaaacgctaccgcctccgcccgcgccgccgcttccgcccgcgccaccgcctcaacgtccgcctcctcccaaaaaccaaacacacgctccacctaatacaccaccaccgacgcctcctacgaatactccacgtaaacgctcaccataaataccacgcctaaaaaaaacacgaccgaacaaacgaatatctacacgaattcttacgaaataaaactaaacaaaacgaaaaaaacgaactaaacaaaaatactcgaaaaaacgaaaaatataaaaatcaaaaacaaaataaaatacttaacaaaaatcgaaaaaaactctaa

SEQ ID NO: 27637 - DNA, 522 bp, Artificial Sequence
  chemically treated genomic DNA (Homo sapiens) CpG-island No: 27637
ttttattcgtacgttttttacgatcgacgtggaaggttataattagatttgcgagtagtagtatagaagttagttttatcgttagtacgtaaggttcgaatagcgtaatatttattgttttagtattgattggcgtatcgtcgatattttgatcgttaatatcgaggatggcgtaaataattattattagtatgatggtcgataaaattgtcggattaatttatatttgcggttttagttattggcgtttttgttcgatttttgaatcgtttaggttgagtattattattacgaatacgaatagtattataatggtattcgcgtagacgataatttttagcgttatcggcgaagtaagcgtttagtgagaagaatatttcggaaatcgttagtagcgaaattattaggttatagtagtgcgtgttcggattggttgggtgattattcgtacggtttagtttggtattagtttcggtttttacggattttatggtttttttacggatagttttgatttattgg

SEQ ID NO: 27638 - DNA, 522 bp, Artificial Sequence
  chemically treated genomic DNA (Homo sapiens) CpG-island No: 27638
ccaataaatcaaaactatccgtaaaaaaaccataaaatccgtaaaaaccgaaactaataccaaactaaaccgtacgaataatcacccaaccaatccgaacacgcactactataacctaataatttcgctactaacgatttccgaaatattcttctcactaaacgcttacttcgccgataacgctaaaaattatcgtctacgcgaataccattataatactattcgtattcgtaataataatactcaacctaaacgattcaaaaatcgaacaaaaacgccaataactaaaaccgcaaatataaattaatccgacaattttatcgaccatcatactaataataattatttacgccatcctcgatattaacgatcaaaatatcgacgatacgccaatcaatactaaaacaataaatattacgctattcgaaccttacgtactaacgataaaactaacttctatactactactcgcaaatctaattataaccttccacgtcgatcgtaaaaaacgtacgaataaaa

SEQ ID NO: 27639 - DNA, 522 bp, Artificial Sequence
  chemically treated genomic DNA (Homo sapiens) CpG-island No: 27639
ttagtgagttagagttgttcgtagagaggttatggagttcgtggaaatcggggttgatattagattggatcgtgcgagtgattatttaattaattcggatacgtattgttgtaatttgatgatttcgttgttggcgattttcggggtgttttttttattgggcgtttatttcgtcggtggcgttggaaattatcgtttacgcgggtgttattatggtgttgttcgtgttcgtggtgatgatgtttaatttgggcggtttagaaatcgaataggaacgttagtggttgaaatcgtaggtgtggattggttcggtaattttgtcggttattatgttggtggtgattgtttacgttattttcggtgttaacgattagggtatcgacggtacgttaattagtgttaaagtagtgggtattacgttgttcgggttttacgtattggcggtggaattggtttttatgttgttgttcgtaggtttggttgtggttttttacgtcggtcgtgaagagcgtgcgggtgaag

SEQ ID NO: 27640 - DNA, 522 bp, Artificial Sequence
  chemically treated genomic DNA (Homo sapiens) CpG-island No: 27640
cttcacccgcacgctcttcacgaccgacgtaaaaaaccacaaccaaacctacgaacaacaacataaaaaccaattccaccgccaatacgtaaaacccgaacaacgtaatacccactactttaacactaattaacgtaccgtcgataccctaatcgttaacaccgaaaataacgtaaacaatcaccaccaacataataaccgacaaaattaccgaaccaatccacacctacgatttcaaccactaacgttcctattcgatttctaaaccgcccaaattaaacatcatcaccacgaacacgaacaacaccataataacacccgcgtaaacgataatttccaacgccaccgacgaaataaacgcccaataaaaaaaacaccccgaaaatcgccaacaacgaaatcatcaaattacaacaatacgtatccgaattaattaaataatcactcgcacgatccaatctaatatcaaccccgatttccacgaactccataacctctctacgaacaactctaactcactaa

SEQ ID NO: 27641 - DNA, 654 bp, Artificial Sequence
  chemically treated genomic DNA (Homo sapiens) CpG-island No: 27641
ttgcgagtgggtgggttgtgcgtgggttgcgcggatgtgggtgtgcgtggtatgtgggtggggtgcgttgcgcgaatttagtttgcgtgtttaggttagtcggtttggtacgtcgtatgtggtgcgtagatatgtagagattggcgaacgttgtattcggtagttgggtattggtatatttttaggtgatagtcgattgagtttttgttcggcggcgattagtagagagtgtgcgtgttacgttgggtattgattcgatcgtatgttttgattttcgatgagttaattcgcggtattgatgttggtgtttacgtcgagattattcgtttgattgaaacgttatgcgtcgatggtttggcgttgttggtgatttttttcgaattggaagagttggtgggttatgtcgatcgggtgattattatgcgcgatcgtatataggtggcggagatttcgttggtagagtttttcgtttcggcgattatgaacgttattgcggcgtaaggagaatagtgtgatgttttaatttttttcggatattagtacgttaaaaaggcgttttcgttggtcgacggggatgtcgtagttggtagtattattgttggtgttgttggtcgatagtttggtagtttcgtatttttggtaggtgtattgtat

SEQ ID NO: 27642 - DNA, 654 bp, Artificial Sequence
  chemically treated genomic DNA (Homo sapiens) CpG-island No: 27642
atacaatacacctaccaaaaatacgaaactaccaaactatcgaccaacaacaccaacaataatactaccaactacgacatccccgtcgaccaacgaaaacgcctttttaacgtactaatatccgaaaaaaattaaaacatcacactattctccttacgccgcaataacgttcataatcgccgaaacgaaaaactctaccaacgaaatctccgccacctatatacgatcgcgcataataatcacccgatcgacataacccaccaactcttccaattcgaaaaaaatcaccaacaacgccaaaccatcgacgcataacgtttcaatcaaacgaataatctcgacgtaaacaccaacatcaataccgcgaattaactcatcgaaaatcaaaacatacgatcgaatcaatacccaacgtaacacgcacactctctactaatcgccgccgaacaaaaactcaatcgactatcacctaaaaatataccaatacccaactaccgaatacaacgttcgccaatctctacatatctacgcaccacatacgacgtaccaaaccgactaacctaaacacgcaaactaaattcgcgcaacgcaccccacccacataccacgcacacccacatccgcgcaacccacgcacaacccacccactcgcaa

SEQ ID NO: 27643 - DNA, 654 bp, Artificial Sequence
  chemically treated genomic DNA (Homo sapiens) CpG-island No: 27643
gtgtagtatatttgttagaaatgcggggttattaggttatcgattagtagtattagtaatagtgttattagttgcggtattttcgtcggttagcgaaagcgtttttttggcgtattggtgttcggaagagattgaggtattatattgttttttttacgtcgtaatggcgtttatgatcgtcggaacggaaagttttgttagcgggattttcgttatttgtatgcgatcgcgtatgataattattcgatcggtatagtttattagtttttttagttcggaggagattattagtagcgttagattatcggcgtatagcgttttaattaggcggatgatttcggcgtgggtattaatattaatgtcgcgggttggtttatcgaggattagaatatgcggtcgggttagtatttaacgtgatacgtatattttttgttgatcgtcgtcggatagaaatttaatcggttgttatttgaaggtgtgttaatgtttagttgtcggatatagcgttcgttaatttttgtatgtttacgtattatatgcgacgtgttagatcggttggtttggatacgtagattaaattcgcgtaacgtattttatttatatattacgtatatttatattcgcgtaatttacgtataatttatttattcgtaa

SEQ ID NO: 27644 - DNA, 654 bp, Artificial Sequence
  chemically treated genomic DNA (Homo sapiens) CpG-island No: 27644
ttacgaataaataaattatacgtaaattacgcgaatataaatatacgtaatatataaataaaatacgttacgcgaatttaatctacgtatccaaaccaaccgatctaacacgtcgcatataatacgtaaacatacaaaaattaacgaacgctatatccgacaactaaacattaacacaccttcaaataacaaccgattaaatttctatccgacgacgatcaacaaaaaatatacgtatcacgttaaatactaacccgaccgcatattctaatcctcgataaaccaacccgcgacattaatattaatacccacgccgaaatcatccgcctaattaaaacgctatacgccgataatctaacgctactaataatctcctccgaactaaaaaaactaataaactataccgatcgaataattatcatacgcgatcgcatacaaataacgaaaatcccgctaacaaaactttccgttccgacgatcataaacgccattacgacgtaaaaaaaacaatataatacctcaatctcttccgaacaccaatacgccaaaaaaacgctttcgctaaccgacgaaaataccgcaactaataacactattactaatactactaatcgataacctaataaccccgcatttctaacaaatatactacac

SEQ ID NO: 27645 - DNA, 1250 bp, Artificial Sequence
  chemically treated genomic DNA (Homo sapiens) CpG-island No: 27645
gttatgttttagtggatggatcgtcgcgcggcgtttcggtaaagtttagcgtaaagcggtgcggaatgtaggtaaagttttttattattagtgggttattcggtaggttatttagatcgtagtcgattatgtttagcgcggtatagatttcgttgatacgtatttttagacgggaaataacgtcgtagttttgttcgttgtggatttttattggtagtaggttatagtcgataaacgggtgatcggcgcgggtattacgggcgtgatcgttggtacggattatcgggtcgacgttattgaagtcgcgagcgattttcgggtttagacgattaatgtcgatagtgcgttgttttatgttcggagtgtttagtagtatatttattagtttttgtattttacgacgtatttgttgtgttagttggcgggtttggattatgtcgttttttagtagatcgcgacgaatttcgtcgattaagtttaggtcgtaggttttacgcgtatcggtaaggatttttgttatttttatggaggttttacgtacgcggaagaattgtataaagtcggagtcgaagtcggtaaagtgataggttaggttaaggttgagtagatgcgagtgtaagcgttttatttttagtagaatggcgcggattatttgcgtacgttttggtatttgaatatttatcgcgttttttatcgacgtggtgtaggcggtgttgtgggtaaagtcgtagatttcgtatatacggttagagaggaaggttatttcgttataatttatacgggttttcgttagtttttttatgtcgcgatggacgtagaatagacggtagtcggcgtcgataatgttttcgttatcgacgaatagacggaagtggttcggtttattagaagtgacgtgtagcggattaatcggtacgacgttgttttttttgtcgtttagttcgttgatgaattcgtaggttttagtatcggtggtcggtgtcggacgttgacgataatttatgttgtttttacgtagcggataaagtttattcggttagttattcggtagtattagacgacgtttatttcggttagaatttaaaattcgggaaattgttagataacgtcgggtaattaatttatttttcggtagggtttaatttttgttaaatttggattttttttcggttattttaagtatttcggttcgtcggaacgcgcggcgttacggacggatatttcggttagttggcgttaatttcgacgcg

SEQ ID NO: 27646 - DNA, 1250 bp, Artificial Sequence
  chemically treated genomic DNA (Homo sapiens) CpG-island No: 27646
cgcgtcgaaattaacgccaactaaccgaaatatccgtccgtaacgccgcgcgttccgacgaaccgaaatacttaaaataaccgaaaaaaaatccaaatttaacaaaaattaaaccctaccgaaaaataaattaattacccgacgttatctaacaatttcccgaattttaaattctaaccgaaataaacgtcgtctaatactaccgaataactaaccgaataaactttatccgctacgtaaaaacaacataaattatcgtcaacgtccgacaccgaccaccgatactaaaacctacgaattcatcaacgaactaaacgacaaaaaaaacaacgtcgtaccgattaatccgctacacgtcacttctaataaaccgaaccacttccgtctattcgtcgataacgaaaacattatcgacgccgactaccgtctattctacgtccatcgcgacataaaaaaactaacgaaaacccgtataaattataacgaaataaccttcctctctaaccgtatatacgaaatctacgactttacccacaacaccgcctacaccacgtcgataaaaaacgcgataaatattcaaataccaaaacgtacgcaaataatccgcgccattctactaaaaataaaacgcttacactcgcatctactcaaccttaacctaacctatcactttaccgacttcgactccgactttatacaattcttccgcgtacgtaaaacctccataaaaataacaaaaatccttaccgatacgcgtaaaacctacgacctaaacttaatcgacgaaattcgtcgcgatctactaaaaaacgacataatccaaacccgccaactaacacaacaaatacgtcgtaaaatacaaaaactaataaatatactactaaacactccgaacataaaacaacgcactatcgacattaatcgtctaaacccgaaaatcgctcgcgacttcaataacgtcgacccgataatccgtaccaacgatcacgcccgtaatacccgcgccgatcacccgtttatcgactataacctactaccaataaaaatccacaacgaacaaaactacgacgttatttcccgtctaaaaatacgtatcaacgaaatctataccgcgctaaacataatcgactacgatctaaataacctaccgaataacccactaataataaaaaactttacctacattccgcaccgctttacgctaaactttaccgaaacgccgcgcgacgatccatccactaaaacataac

SEQ ID NO: 27647 - DNA, 1250 bp, Artificial Sequence
  chemically treated genomic DNA (Homo sapiens) CpG-island No: 27647
cgcgtcgaagttgacgttaattaatcggaatattcgttcgtgacgtcgcgcgtttcggcgggtcggggtatttggggtgatcggaaaagggtttaggtttggtaaaagttaggttttgtcgggaagtaaattggttattcggcgttatttggtaatttttcgggttttggattttggtcggaatgaacgtcgtttggtgttgtcggatgattggtcggatgaattttattcgttgcgtaaagatagtatggattatcgttagcgttcggtatcgattatcgatgttgaaatttacgagtttattaacgaattgggcgataagaaaaataacgtcgtgtcgattggttcgttgtacgttatttttgatgaatcgggttattttcgtttgttcgtcgatggcgaaaatattatcgacgtcgattatcgtttgttttacgtttatcgcggtatggaaaaattggcggaaattcgtatgggttataacgaagtgatttttttttttgatcgtgtgtgcgggatttgcggttttgtttatagtatcgtttatattacgtcggtggaaaacgcgatgggtatttaggtgttagaacgtgcgtagatgattcgcgttattttgttggaggtagaacgtttgtattcgtatttgtttaattttggtttggtttgttattttatcggtttcgatttcggttttatgtagttttttcgcgtgcgtgaaatttttatgaaaatggtagagatttttatcggtgcgcgtaaaatttacggtttgaatttgatcggcgggattcgtcgcgatttgttgaaagacgatatgatttagattcgttagttggtataatagatgcgtcgtgaagtgtaggagttggtggatgtgttgttgagtatttcgaatatggaatagcgtattgtcggtattggtcgtttggattcggaaatcgttcgcgattttagtaacgtcggttcgatggttcgtgttagcggttacgttcgtgatattcgcgtcgattattcgtttgtcggttatggtttgttgttaatggaagtttatagcgagtagggttgcgacgttatttttcgtttgaaagtgcgtattaacgaagtttatatcgcgttgaatatgatcgattacggtttggataatttgtcgggtggtttattgatggtggaaggttttatttatatttcgtatcgttttgcgttgggttttgtcgaagcgtcgcgcggcgatttatttattggagtatgat

SEQ ID NO: 27648 - DNA, 1250 bp, Artificial Sequence
  chemically treated genomic DNA (Homo sapiens) CpG-island No: 27648
atcatactccaataaataaatcgccgcgcgacgcttcgacaaaacccaacgcaaaacgatacgaaatataaataaaaccttccaccatcaataaaccacccgacaaattatccaaaccgtaatcgatcatattcaacgcgatataaacttcgttaatacgcactttcaaacgaaaaataacgtcgcaaccctactcgctataaacttccattaacaacaaaccataaccgacaaacgaataatcgacgcgaatatcacgaacgtaaccgctaacacgaaccatcgaaccgacgttactaaaatcgcgaacgatttccgaatccaaacgaccaataccgacaatacgctattccatattcgaaatactcaacaacacatccaccaactcctacacttcacgacgcatctattataccaactaacgaatctaaatcatatcgtctttcaacaaatcgcgacgaatcccgccgatcaaattcaaaccgtaaattttacgcgcaccgataaaaatctctaccattttcataaaaatttcacgcacgcgaaaaaactacataaaaccgaaatcgaaaccgataaaataacaaaccaaaccaaaattaaacaaatacgaatacaaacgttctacctccaacaaaataacgcgaatcatctacgcacgttctaacacctaaatacccatcgcgttttccaccgacgtaatataaacgatactataaacaaaaccgcaaatcccgcacacacgatcaaaaaaaaaaatcacttcgttataacccatacgaatttccgccaatttttccataccgcgataaacgtaaaacaaacgataatcgacgtcgataatattttcgccatcgacgaacaaacgaaaataacccgattcatcaaaaataacgtacaacgaaccaatcgacacgacgttatttttcttatcgcccaattcgttaataaactcgtaaatttcaacatcgataatcgataccgaacgctaacgataatccatactatctttacgcaacgaataaaattcatccgaccaatcatccgacaacaccaaacgacgttcattccgaccaaaatccaaaacccgaaaaattaccaaataacgccgaataaccaatttacttcccgacaaaacctaacttttaccaaacctaaacccttttccgatcaccccaaataccccgacccgccgaaacgcgcgacgtcacgaacgaatattccgattaattaacgtcaacttcgacgcg

SEQ ID NO: 27649 - DNA, 541 bp, Artificial Sequence
  chemically treated genomic DNA (Homo sapiens) CpG-island No: 27649
tttcgagagtgtttaatatttttaaattaatcgaagtattattatattttaatatatacgatcgaatgattataatatcgattaacgtatacgttatttaaaaattcgcgtttttatagaaacggttttatacgagtttaacgtcgattaagcgttcgacggtatttttagttacgtatttacgtacgtataacggtaagtaattatttcggacggaatattatattacgatattatgatacgtaatcgcggaaatttatagcgatttattatttgcggtttttttttttatataattattcgaggaggcgtaggtggatattacgttcgacgacgacgcgcgcgagtaggacgaaaggcgaggtatattatcgagacggcgtgttacgtatagcgcgaggaataggacgacgttacgtatatataattatcgattcgcggcgacgttttaggacgatatgaggagaagtcgattttatagcgaggcgaaagtaaatcgtaggttcgggttcggcgcgggcgtattttaagttcgtattgg

SEQ ID NO: 27650 - DNA, 541 bp, Artificial Sequence
  chemically treated genomic DNA (Homo sapiens) CpG-island No: 27650
ccaatacgaacttaaaatacgcccgcgccgaacccgaacctacgatttactttcgcctcgctataaaatcgacttctcctcatatcgtcctaaaacgtcgccgcgaatcgataattatatatacgtaacgtcgtcctattcctcgcgctatacgtaacacgccgtctcgataatatacctcgcctttcgtcctactcgcgcgcgtcgtcgtcgaacgtaatatccacctacgcctcctcgaataattatataaaaaaaaaaaccgcaaataataaatcgctataaatttccgcgattacgtatcataatatcgtaatataatattccgtccgaaataattacttaccgttatacgtacgtaaatacgtaactaaaaataccgtcgaacgcttaatcgacgttaaactcgtataaaaccgtttctataaaaacgcgaatttttaaataacgtatacgttaatcgatattataatcattcgatcgtatatattaaaatataataatacttcgattaatttaaaaatattaaacactctcgaaa

SEQ ID NO: 27651 - DNA, 541 bp, Artificial Sequence
  chemically treated genomic DNA (Homo sapiens) CpG-island No: 27651
ttagtgcgggtttaggatgcgttcgcgtcgggttcgggtttgcggtttgttttcgtttcgttgtggggtcggtttttttttatatcgttttggggcgtcgtcgcgggtcggtggttgtgtgtgcgtggcgtcgttttgtttttcgcgttgtgcgtgatacgtcgtttcggtggtgtgtttcgtttttcgttttgttcgcgcgcgtcgtcgtcgggcgtggtgtttatttgcgttttttcgggtggttgtgtggggggggaaatcgtaggtggtaggtcgttgtgagttttcgcggttgcgtgttatgatgtcgtggtgtggtatttcgttcgggatggttgtttgtcgttgtgcgtgcgtggatgcgtgattgggggtgtcgtcgggcgtttggtcggcgttgggttcgtgtgaggtcgtttttgtgagggcgcgggtttttgggtagcgtgtgcgttggtcggtgttgtggttattcggtcgtgtgtgttggggtgtggtggtatttcgattggtttagggatgttaggtattttcggag

SEQ ID NO: 27652 - DNA, 541 bp, Artificial Sequence
  chemically treated genomic DNA (Homo sapiens) CpG-island No: 27652
ctccgaaaatacctaacatccctaaaccaatcgaaataccaccacaccccaacacacacgaccgaataaccacaacaccgaccaacgcacacgctacccaaaaacccgcgccctcacaaaaacgacctcacacgaacccaacgccgaccaaacgcccgacgacacccccaatcacgcatccacgcacgcacaacgacaaacaaccatcccgaacgaaataccacaccacgacatcataacacgcaaccgcgaaaactcacaacgacctaccacctacgatttccccccccacacaaccacccgaaaaaacgcaaataaacaccacgcccgacgacgacgcgcgcgaacaaaacgaaaaacgaaacacaccaccgaaacgacgtatcacgcacaacgcgaaaaacaaaacgacgccacgcacacacaaccaccgacccgcgacgacgccccaaaacgatataaaaaaaaaccgaccccacaacgaaacgaaaacaaaccgcaaacccgaacccgacgcgaacgcatcctaaacccgcactaa

SEQ ID NO: 27653 - DNA, 707 bp, Artificial Sequence
  chemically treated genomic DNA (Homo sapiens) CpG-island No: 27653
ttcgtcggtgtattacgtgtatttatgtatcgatttgattgattggttagggacgttttaagtatcgttaaacgtgcgaggttagaggttcgtaggatgcgacgaaatacgttggacggataggtgattatattattacgagagaacggtagaacgttatttaaagagcgttagtatagtattatgttaatatatttgttttcggattatattcgcgatagacgtagttaggaacgttacgttaggttaaggtaatgtggcgtttatgacggcggattttcgagaaggttttattatcgtgtgtcgcgttggttttcggtatattagttgaattagttgaataatataaggttattttagtttcgagtaacgatcggacggtataggtacgttcgtagatatggttgtgtgtgttttgaaatgtacggattttttcgtcggtgaaagttcgtttcgggtagttttcgtttcgattggaaggataagaagcggtttagagaggtaataaaagggttgaatttttttttgagacgatttttttaggaagttaaacgggttatgcgggacggaacgtgagtgaatattgggtaggtagtcgaatgtcgcgaaggtggggtagttatagtacggggaagcgagaataacgggagatatgaaagtttcgtaattatcgggggggggttaggatatagtgacggggtttagat

SEQ ID NO: 27654 - DNA, 707 bp, Artificial Sequence
  chemically treated genomic DNA (Homo sapiens) CpG-island No: 27654
atctaaaccccgtcactatatcctaacccccccccgataattacgaaactttcatatctcccgttattctcgcttccccgtactataactaccccaccttcgcgacattcgactacctacccaatattcactcacgttccgtcccgcataacccgtttaacttcctaaaaaaatcgtctcaaaaaaaaattcaacccttttattacctctctaaaccgcttcttatccttccaatcgaaacgaaaactacccgaaacgaactttcaccgacgaaaaaatccgtacatttcaaaacacacacaaccatatctacgaacgtacctataccgtccgatcgttactcgaaactaaaataaccttatattattcaactaattcaactaatataccgaaaaccaacgcgacacacgataataaaaccttctcgaaaatccgccgtcataaacgccacattaccttaacctaacgtaacgttcctaactacgtctatcgcgaatataatccgaaaacaaatatattaacataatactatactaacgctctttaaataacgttctaccgttctctcgtaataatataatcacctatccgtccaacgtatttcgtcgcatcctacgaacctctaacctcgcacgtttaacgatacttaaaacgtccctaaccaatcaatcaaatcgatacataaatacacgtaatacaccgacgaa

SEQ ID NO: 27655 - DNA, 707 bp, Artificial Sequence
  chemically treated genomic DNA (Homo sapiens) CpG-island No: 27655
gtttgggtttcgttattgtgttttgattttttttcggtggttgcgaggtttttatgtttttcgttattttcgttttttcgtattgtggttgttttattttcgcggtattcgattgtttgtttagtgtttatttacgtttcgtttcgtataattcgtttgattttttgaagaagtcgttttagggagagatttagtttttttgttatttttttggatcgttttttgtttttttagtcggagcgagagttattcggggcggatttttatcgacggaaagattcgtgtattttaaggtatatataattatatttgcgagcgtgtttatatcgttcggtcgttattcgggattgaaatggttttgtgttgtttagttggtttagttggtgtatcgggaattagcgcggtatacgataatgaggttttttcgggaattcgtcgttatggacgttatattgttttggtttggcgtgacgtttttgattgcgtttgtcgcggatgtggttcggaggtagatgtattggtatgatgttatattagcgttttttgagtggcgttttatcgttttttcgtggtaatgtgattatttgttcgtttagcgtgtttcgtcgtattttgcgagtttttaatttcgtacgtttggcgatatttggagcgtttttgattaattagttaaatcgatgtatagatgtacgtagtatatcggcggg

SEQ ID NO: 27656 - DNA, 707 bp, Artificial Sequence
  chemically treated genomic DNA (Homo sapiens) CpG-island No: 27656
cccgccgatatactacgtacatctatacatcgatttaactaattaatcaaaaacgctccaaatatcgccaaacgtacgaaattaaaaactcgcaaaatacgacgaaacacgctaaacgaacaaataatcacattaccacgaaaaaacgataaaacgccactcaaaaaacgctaatataacatcataccaatacatctacctccgaaccacatccgcgacaaacgcaatcaaaaacgtcacgccaaaccaaaacaatataacgtccataacgacgaattcccgaaaaaacctcattatcgtataccgcgctaattcccgatacaccaactaaaccaactaaacaacacaaaaccatttcaatcccgaataacgaccgaacgatataaacacgctcgcaaatataattatatataccttaaaatacacgaatctttccgtcgataaaaatccgccccgaataactctcgctccgactaaaaaaacaaaaaacgatccaaaaaaataacaaaaaaactaaatctctccctaaaacgacttcttcaaaaaatcaaacgaattatacgaaacgaaacgtaaataaacactaaacaaacaatcgaataccgcgaaaataaaacaaccacaatacgaaaaaacgaaaataacgaaaaacataaaaacctcgcaaccaccgaaaaaaaatcaaaacacaataacgaaacccaaac

SEQ ID NO: 27657 - DNA, 619 bp, Artificial Sequence
  chemically treated genomic DNA (Homo sapiens) CpG-island No: 27657
acgttatttatagcggtgcggagatggaaatcggttttaacgttagttatgtgttggatgttttgaacgcgttgaaatgcgaaaacgttcgtatgatgttgatcgattcggtttttagcgtgtagattgaagatgcggttagttagagcgcggtttatgttgttatgttaatgagattgtaatgttttttattcgtttgttgattcgcgattttcgtaatattgaaatcgcggatttcgttttatttttcggttttaattttttggtaggtgttaacggtagtggtaaaattagcgtgttggaagttatttatacgttcggttatggtcgggcgtttcgtagtttgtagattggtcgcgttattcgttatgagtaggaggcgtatgttttttacgggcgattatagggcgaagagcgcgagatagcgatcggtttaattaaagataaatagggcgatagtaaagttcgtatcgacggtatagacgggtataaggtcgcggaattggcgtatttgatgttaatgtagttgataacgttagaagggtttattttatttaacggcgggtttaaatatagaagagtatttttcgattgggggatgtttttataacgaatcggg

SEQ ID NO: 27658 - DNA, 619 bp, Artificial Sequence
  chemically treated genomic DNA (Homo sapiens) CpG-island No: 27658
cccgattcgttataaaaacatcccccaatcgaaaaatactcttctatatttaaacccgccgttaaataaaataaacccttctaacgttatcaactacattaacatcaaatacgccaattccgcgaccttatacccgtctataccgtcgatacgaactttactatcgccctatttatctttaattaaaccgatcgctatctcgcgctcttcgccctataatcgcccgtaaaaaacatacgcctcctactcataacgaataacgcgaccaatctacaaactacgaaacgcccgaccataaccgaacgtataaataacttccaacacgctaattttaccactaccgttaacacctaccaaaaaattaaaaccgaaaaataaaacgaaatccgcgatttcaatattacgaaaatcgcgaatcaacaaacgaataaaaaacattacaatctcattaacataacaacataaaccgcgctctaactaaccgcatcttcaatctacacgctaaaaaccgaatcgatcaacatcatacgaacgttttcgcatttcaacgcgttcaaaacatccaacacataactaacgttaaaaccgatttccatctccgcaccgctataaataacgt

SEQ ID NO: 27659 - DNA, 619 bp, Artificial Sequence
  chemically treated genomic DNA (Homo sapiens) CpG-island No: 27659
ttcggttcgttgtgaaagtattttttagtcgaggaatgtttttttgtatttgggttcgtcgttgagtaaagtaaatttttttggcgttattaattgtattggtattaggtgcgttagtttcgcgattttatgttcgtttgtatcgtcgatgcggattttgttgtcgttttgtttgtttttggttaagtcgatcgttgtttcgcgtttttcgttttgtaatcgttcgtggagaatatacgttttttgtttatggcgaatgacgcgattaatttgtaaattgcgaaacgttcgattatggtcgagcgtatagatggtttttagtacgttggttttgttattgtcgttggtatttattagaaagttaaagtcgggagataaggcgagattcgcggttttaatgttgcggaaatcgcggattaataagcgggtgagggatattatagttttattggtatgataatataagtcgcgttttggttggtcgtatttttaatttgtacgttggaaatcgaatcggttagtattatgcggacgttttcgtattttagcgcgtttagaatatttagtatataattgacgttgaagtcgatttttattttcgtatcgttataggtaacgt

SEQ ID NO: 27660 - DNA, 619 bp, Artificial Sequence
  chemically treated genomic DNA (Homo sapiens) CpG-island No: 27660
acgttacctataacgatacgaaaataaaaatcgacttcaacgtcaattatatactaaatattctaaacgcgctaaaatacgaaaacgtccgcataatactaaccgattcgatttccaacgtacaaattaaaaatacgaccaaccaaaacgcgacttatattatcataccaataaaactataatatccctcacccgcttattaatccgcgatttccgcaacattaaaaccgcgaatctcgccttatctcccgactttaactttctaataaataccaacgacaataacaaaaccaacgtactaaaaaccatctatacgctcgaccataatcgaacgtttcgcaatttacaaattaatcgcgtcattcgccataaacaaaaaacgtatattctccacgaacgattacaaaacgaaaaacgcgaaacaacgatcgacttaaccaaaaacaaacaaaacgacaacaaaatccgcatcgacgatacaaacgaacataaaatcgcgaaactaacgcacctaataccaatacaattaataacgccaaaaaaatttactttactcaacgacgaacccaaatacaaaaaaacattcctcgactaaaaaatactttcacaacgaaccgaa

SEQ ID NO: 27661 - DNA, 758 bp, Artificial Sequence
  chemically treated genomic DNA (Homo sapiens) CpG-island No: 27661
taagttgcgcggcgtatacgttatgatggcgggtttgacggaagaatagaaagcgtacggcgtgattattgtttttgcgggtaattacgcgtagggcgtcgcgtttttttttgcgcggttaggcgtgaaggttttgatcgttatgttaatcgttatcgtcgatattaaagtcgacgcggtgcgcggtttcggcggcgaagtgttgttttacggcgcgaattttgatgaagcgaaagttaaagcgatcgaattgttatagtagtaggggtttatttgggtgtcgtcgttcgattattcgatggtgattgtcgggtaaggtacgttggcgttggaattgttttagtaggacgtttatttcgatcgcgtatttgtgttagtcggcggcggcggtttggttgttggcgtggcggtgttgattaaataattgatgtcgtaaattaaagtgatcgtcgtagaagcggaagatttcgtttgtttgaaagtagcgttggatgcgggttattcggttgatttgtcgcgcgtagggttatttgttgaaggcgtagcggtaaaacgtatcggtgacgaaatttttcgtttatgttaggagtatttcgacgatattattatcgtcgatagcgatgcgatttgtgcggcgatgaaggattattcgaagatgtgcgcgcggtggggaatttttgggggttggggttggggaatgaaaatttttgtttgaaaattgggggaacgttggtaattttcgggttacgaaatttgag

SEQ ID NO: 27662 - DNA, 758 bp, Artificial Sequence
  chemically treated genomic DNA (Homo sapiens) CpG-island No: 27662
ctcaaatttcgtaacccgaaaattaccaacgttcccccaattttcaaacaaaaattttcattccccaaccccaacccccaaaaattccccaccgcgcgcacatcttcgaataatccttcatcgccgcacaaatcgcatcgctatcgacgataataatatcgtcgaaatactcctaacataaacgaaaaatttcgtcaccgatacgttttaccgctacgccttcaacaaataaccctacgcgcgacaaatcaaccgaataacccgcatccaacgctactttcaaacaaacgaaatcttccgcttctacgacgatcactttaatttacgacatcaattatttaatcaacaccgccacgccaacaaccaaaccgccgccgccgactaacacaaatacgcgatcgaaataaacgtcctactaaaacaattccaacgccaacgtaccttacccgacaatcaccatcgaataatcgaacgacgacacccaaataaacccctactactataacaattcgatcgctttaactttcgcttcatcaaaattcgcgccgtaaaacaacacttcgccgccgaaaccgcgcaccgcgtcgactttaatatcgacgataacgattaacataacgatcaaaaccttcacgcctaaccgcgcaaaaaaaaacgcgacgccctacgcgtaattacccgcaaaaacaataatcacgccgtacgctttctattcttccgtcaaacccgccatcataacgtatacgccgcgcaactta

SEQ ID NO: 27663 - DNA, 758 bp, Artificial Sequence
  chemically treated genomic DNA (Homo sapiens) CpG-island No: 27663
tttagatttcgtggttcggagattgttagcgtttttttaatttttaggtaaaaatttttattttttagttttagtttttagaggttttttatcgcgcgtatattttcgaataattttttatcgtcgtatagatcgtatcgttatcgacggtgatgatgtcgtcgagatatttttggtataaacggaaggtttcgttatcgatgcgttttatcgttacgtttttagtaaatagttttacgcgcggtagattaatcggatgattcgtatttagcgttgtttttaggtaggcggagtttttcgtttttacggcgattattttgatttgcggtattagttgtttgattagtatcgttacgttagtagttagatcgtcgtcgtcgattggtataaatacgcggtcgagatgggcgttttgttggagtagttttagcgttagcgtgttttgttcggtaattattatcggatggtcgaacggcggtatttaggtgaatttttgttgttgtgatagttcgatcgttttggttttcgttttattaaagttcgcgtcgtggagtagtatttcgtcgtcgaagtcgcgtatcgcgtcgattttgatgtcggcggtggcggttggtataacgattagggtttttacgtttaatcgcgtagaagaaaacgcgacgttttgcgcgtggttattcgtagaagtagtgattacgtcgtgcgttttttgttttttcgttaggttcgttattatggcgtatgcgtcgcgtagttta

SEQ ID NO: 27664 - DNA, 758 bp, Artificial Sequence
  chemically treated genomic DNA (Homo sapiens) CpG-island No: 27664
taaactacgcgacgcatacgccataataacgaacctaacgaaaaaacaaaaaacgcacgacgtaatcactacttctacgaataaccacgcgcaaaacgtcgcgttttcttctacgcgattaaacgtaaaaaccctaatcgttataccaaccgccaccgccgacatcaaaatcgacgcgatacgcgacttcgacgacgaaatactactccacgacgcgaactttaataaaacgaaaaccaaaacgatcgaactatcacaacaacaaaaattcacctaaataccgccgttcgaccatccgataataattaccgaacaaaacacgctaacgctaaaactactccaacaaaacgcccatctcgaccgcgtatttataccaatcgacgacgacgatctaactactaacgtaacgatactaatcaaacaactaataccgcaaatcaaaataatcgccgtaaaaacgaaaaactccgcctacctaaaaacaacgctaaatacgaatcatccgattaatctaccgcgcgtaaaactatttactaaaaacgtaacgataaaacgcatcgataacgaaaccttccgtttataccaaaaatatctcgacgacatcatcaccgtcgataacgatacgatctatacgacgataaaaaattattcgaaaatatacgcgcgataaaaaacctctaaaaactaaaactaaaaaataaaaatttttacctaaaaattaaaaaaacgctaacaatctccgaaccacgaaatctaaa

SEQ ID NO: 27665 - DNA, 634 bp, Artificial Sequence
  chemically treated genomic DNA (Homo sapiens) CpG-island No: 27665
ttcgttcggagcgtttcggcggttattgggtatgtttcgttgttaggtaagttcggggttgtaggtagtttgcgcgtcgggcggattttagttgcggtcgcgcgtatttttttttttaagtagggagcgggcgtatgatggcggtcgcggcggtagcggttgcggggagttttagtagcggcggcggcggcggcggcggtagcggtagcggtagtagtagtagcgatacgtttagtatcggcgaggaggaaaggatgcggcgttttttttagacgtgcgacggcgacggggacggatatattagtaggtacgcggggaggtacgaggaaatcgataggagcgagattagttttttcgcgcgtttttgatttttgttttgttttttcgttttaatttgcggtaagttgtttagaagttcgcgggaaaagttgtcgcgatttcgagagcgcgtagtcggttcggttacgaaggtcgaggggattgttttgttcgttttgcgggggtgttagttggtttaattttttttagcgttgtttttgtttaggcgttgggagatatttttttaggatgcgtattttttcgggggttcggagtgtttttttttgtgggaaaaggagttttggtcgtttgtttt

SEQ ID NO: 27666 - DNA, 634 bp, Artificial Sequence
  chemically treated genomic DNA (Homo sapiens) CpG-island No: 27666
aaaacaaacgaccaaaactccttttcccacaaaaaaaaacactccgaacccccgaaaaaatacgcatcctaaaaaaatatctcccaacgcctaaacaaaaacaacgctaaaaaaaattaaaccaactaacacccccgcaaaacgaacaaaacaatcccctcgaccttcgtaaccgaaccgactacgcgctctcgaaatcgcgacaacttttcccgcgaacttctaaacaacttaccgcaaattaaaacgaaaaaacaaaacaaaaatcaaaaacgcgcgaaaaaactaatctcgctcctatcgatttcctcgtacctccccgcgtacctactaatatatccgtccccgtcgccgtcgcacgtctaaaaaaaacgccgcatcctttcctcctcgccgatactaaacgtatcgctactactactaccgctaccgctaccgccgccgccgccgccgccgctactaaaactccccgcaaccgctaccgccgcgaccgccatcatacgcccgctccctacttaaaaaaaaaaatacgcgcgaccgcaactaaaatccgcccgacgcgcaaactacctacaaccccgaacttacctaacaacgaaacatacccaataaccgccgaaacgctccgaacgaa

SEQ ID NO: 27667 - DNA, 634 bp, Artificial Sequence
  chemically treated genomic DNA (Homo sapiens) CpG-island No: 27667
gggataagcggttagaatttttttttttatagggaagaatatttcgagttttcggaagagtgcgtattttaaggagatgttttttaacgtttagataaagatagcgttgggaaaagttggattaattggtattttcgtaaggcgaatagagtagttttttcggttttcgtggtcgagtcggttacgcgttttcggagtcgcggtaatttttttcgcgagtttttgagtaatttgtcgtaagttggggcgagggggtagagtaggggttaagggcgcgcggagggattgatttcgtttttgtcggttttttcgtattttttcgcgtatttgttgatgtattcgttttcgtcgtcgtcgtacgtttggaagaggcgtcgtattttttttttttcgtcggtgttggacgtgtcgttgttgttgttgtcgttgtcgttgtcgtcgtcgtcgtcgtcgtcgttgttggagtttttcgtagtcgttgtcgtcgcggtcgttattatgcgttcgttttttatttgggaggaggagtacgcgcgatcgtagttggaattcgttcggcgcgtaagttgtttgtagtttcgaatttgtttgataacggagtatgtttagtggtcgtcggggcgtttcgggcgag

SEQ ID NO: 27668 - DNA, 634 bp, Artificial Sequence
  chemically treated genomic DNA (Homo sapiens) CpG-island No: 27668
ctcgcccgaaacgccccgacgaccactaaacatactccgttatcaaacaaattcgaaactacaaacaacttacgcgccgaacgaattccaactacgatcgcgcgtactcctcctcccaaataaaaaacgaacgcataataacgaccgcgacgacaacgactacgaaaaactccaacaacgacgacgacgacgacgacgacaacgacaacgacaacaacaacaacgacacgtccaacaccgacgaaaaaaaaaaaatacgacgcctcttccaaacgtacgacgacgacgaaaacgaatacatcaacaaatacgcgaaaaaatacgaaaaaaccgacaaaaacgaaatcaatccctccgcgcgcccttaacccctactctaccccctcgccccaacttacgacaaattactcaaaaactcgcgaaaaaaattaccgcgactccgaaaacgcgtaaccgactcgaccacgaaaaccgaaaaaactactctattcgccttacgaaaataccaattaatccaacttttcccaacgctatctttatctaaacgttaaaaaacatctccttaaaatacgcactcttccgaaaactcgaaatattcttccctataaaaaaaaaaattctaaccgcttatccc

SEQ ID NO: 27669 - DNA, 993 bp, Artificial Sequence
  chemically treated genomic DNA (Homo sapiens) CpG-island No: 27669
ggtatgttggtcgttaagacgacggtgtcggtgttgggcgtgtcggtggttagtcgttatttgtagggcgtcgattttttgtattttatcgtgtagatgtttaagggtatttcggtcgttattttcgttatcggtacggtcggcgcggttaatgcggcgttgttcgtcgtggttatgttggcgatcggtaatgtggttttgttggttaagttggatgtttttcgcgcgaagtagacggcggcggtttaggttatgagcgaggaattgcgttgatggcggttttggttttcggcgtcgttattttcggcgttttcggtggcggttagttcggtcgtatgttcgtttacgtcgtttaggttttgggttatcgttgtatcgtgttcgatttcgacgttattagtttcgtcggcgtcgtggcggagaagtatgtgagggtcgattatttcgattttttcggtttggtttagatggcgcgcgattgtgacgttattattatcgagttcgagaacgtgtcggtcgtggttttggagattttggtcggtatgcgtacgggtcgtttcggtcgcggcggtcgtcgtcgtttgttaggatcgggtcgtcgagaaggtttatttcgaggtcgtcggcgtgttttgcgtttcgtatgtcgttattacgaacgagatcgagttggtcgtcgtcgatttcggtttgttgttcggtattttgaagattagtcgtatgggttatgacggtaagggttaggtgcgcgtgtttagcgtcgtcgagttggttcgggtttgggacgatttggggcgcgtgttttgcgtgttggagtagttgttgtcgttgaagttcgagtttagcgtgttggtggcgcgcggcgtcgacggttagatcgttaattttttcgtgtagtagaatttgtatcgcggcggtattttggtcgttatcgaggtttcggttttcgatgtgtcggtcgaggtcgagaagttggtcgtcgttgtcgcgcgt

SEQ ID NO: 27670 - DNA, 993 bp, Artificial Sequence
  chemically treated genomic DNA (Homo sapiens) CpG-island No: 27670
acgcgcgacaacgacgaccaacttctcgacctcgaccgacacatcgaaaaccgaaacctcgataacgaccaaaataccgccgcgatacaaattctactacacgaaaaaattaacgatctaaccgtcgacgccgcgcgccaccaacacgctaaactcgaacttcaacgacaacaactactccaacacgcaaaacacgcgccccaaatcgtcccaaacccgaaccaactcgacgacgctaaacacgcgcacctaacccttaccgtcataacccatacgactaatcttcaaaataccgaacaacaaaccgaaatcgacgacgaccaactcgatctcgttcgtaataacgacatacgaaacgcaaaacacgccgacgacctcgaaataaaccttctcgacgacccgatcctaacaaacgacgacgaccgccgcgaccgaaacgacccgtacgcataccgaccaaaatctccaaaaccacgaccgacacgttctcgaactcgataataataacgtcacaatcgcgcgccatctaaaccaaaccgaaaaaatcgaaataatcgaccctcacatacttctccgccacgacgccgacgaaactaataacgtcgaaatcgaacacgatacaacgataacccaaaacctaaacgacgtaaacgaacatacgaccgaactaaccgccaccgaaaacgccgaaaataacgacgccgaaaaccaaaaccgccatcaacgcaattcctcgctcataacctaaaccgccgccgtctacttcgcgcgaaaaacatccaacttaaccaacaaaaccacattaccgatcgccaacataaccacgacgaacaacgccgcattaaccgcgccgaccgtaccgataacgaaaataacgaccgaaatacccttaaacatctacacgataaaatacaaaaaatcgacgccctacaaataacgactaaccaccgacacgcccaacaccgacaccgtcgtcttaacgaccaacatacc

SEQ ID NO: 27671 - DNA, 993 bp, Artificial Sequence
  chemically treated genomic DNA (Homo sapiens) CpG-island No: 27671
gcgcgcggtagcgacggttagtttttcgatttcggtcggtatatcgggggtcgggatttcggtgacggttaggatgtcgtcgcggtgtaggttttgttgtacggggaagttgacgatttggtcgtcggcgtcgcgcgttattagtacgttgagttcgaattttagcggtagtagttgttttagtacgtagggtacgcgttttaggtcgttttaggttcgggttagttcggcggcgttggatacgcgtatttggtttttgtcgttatagtttatgcggttggtttttaggatgtcgggtagtaggtcggggtcgacggcggttagttcgatttcgttcgtgatgacggtatgcggggcgtagggtacgtcggcggtttcgaaatgagttttttcgacggttcggttttggtagacggcgacggtcgtcgcggtcggggcgattcgtgcgtatgtcggttagggtttttagggttacggtcggtacgttttcgaattcggtggtgatggcgttatagtcgcgcgttatttgggttaggtcgaaggaatcgaggtagtcggtttttatatgttttttcgttacggcgtcggcggggttgatggcgtcgggatcgagtacgatgtagcgatagtttagggtttgggcggcgtggacgaatatgcggtcgagttggtcgttatcgaggacgtcgagggtggcggcgtcgggaattagagtcgttattagcgtagtttttcgtttatggtttgggtcgtcgtcgtttgtttcgcgcggaaggtatttagtttggttagtagggttatattgtcggtcgttagtatggttacggcgaatagcgtcgtattggtcgcgtcggtcgtgtcgatggcgaaggtggcgatcgggatgtttttgggtatttgtacgatggaatgtagggagtcgacgttttgtagatggcggttggttatcggtacgtttagtatcggtatcgtcgttttggcggttagtatgtt

SEQ ID NO: 27672 - DNA, 993 bp, Artificial Sequence
  chemically treated genomic DNA (Homo sapiens) CpG-island No: 27672
aacatactaaccgccaaaacgacgataccgatactaaacgtaccgataaccaaccgccatctacaaaacgtcgactccctacattccatcgtacaaatacccaaaaacatcccgatcgccaccttcgccatcgacacgaccgacgcgaccaatacgacgctattcgccgtaaccatactaacgaccgacaatataaccctactaaccaaactaaataccttccgcgcgaaacaaacgacgacgacccaaaccataaacgaaaaactacgctaataacgactctaattcccgacgccgccaccctcgacgtcctcgataacgaccaactcgaccgcatattcgtccacgccgcccaaaccctaaactatcgctacatcgtactcgatcccgacgccatcaaccccgccgacgccgtaacgaaaaaacatataaaaaccgactacctcgattccttcgacctaacccaaataacgcgcgactataacgccatcaccaccgaattcgaaaacgtaccgaccgtaaccctaaaaaccctaaccgacatacgcacgaatcgccccgaccgcgacgaccgtcgccgtctaccaaaaccgaaccgtcgaaaaaactcatttcgaaaccgccgacgtaccctacgccccgcataccgtcatcacgaacgaaatcgaactaaccgccgtcgaccccgacctactacccgacatcctaaaaaccaaccgcataaactataacgacaaaaaccaaatacgcgtatccaacgccgccgaactaacccgaacctaaaacgacctaaaacgcgtaccctacgtactaaaacaactactaccgctaaaattcgaactcaacgtactaataacgcgcgacgccgacgaccaaatcgtcaacttccccgtacaacaaaacctacaccgcgacgacatcctaaccgtcaccgaaatcccgacccccgatataccgaccgaaatcgaaaaactaaccgtcgctaccgcgcgc

SEQ ID NO: 27673 - DNA, 669 bp, Artificial Sequence
  chemically treated genomic DNA (Homo sapiens) CpG-island No: 27673
tacgcgggaagggtgttgtaataatatttgttagcgttagcgatcgttacgtttaggtgttagagtcggaatcggatcgagaatttatagtttttcgtttgttagtgggttggagaggattagattacgtagttgttgtaggaataatggcgcgtgttgattgttatgatttttcgtacgtataattatatggttggtttacggcggtagttgtattattcgtcgtttagttagcgtttgttcggtaaaggcgtcgtagtttttatagagtaacgtttgtaatagaggatgtttcggatggtgcgtttgtagtattatttcgttttgtttattcgtacgttcggtacgatcggcgatttgggtgtaaagttgagcgaaacgttttgtcgagcgaaaatcggtagaaaatagcgcgtcgtttacgtttagtaatgtaattagcgttatattcgggaaatggtgatttttcgttagtatttgtgtattaattaaaattcgcgcgtcgtcgcgatgtatttttgttagttgttgttttagcgtttttttgcggttggtggtatcgcggtcgatacgagaaatgggtacgtcggggaataacggcgcgagcgtttgtttaagttgttcggtgtttagttttcggggattcgtgcgttgattcggagaaagttt

SEQ ID NO: 27674 - DNA, 669 bp, Artificial Sequence
  chemically treated genomic DNA (Homo sapiens) CpG-island No: 27674
aaactttctccgaatcaacgcacgaatccccgaaaactaaacaccgaacaacttaaacaaacgctcgcgccgttattccccgacgtacccatttctcgtatcgaccgcgataccaccaaccgcaaaaaaacgctaaaacaacaactaacaaaaatacatcgcgacgacgcgcgaattttaattaatacacaaatactaacgaaaaatcaccatttcccgaatataacgctaattacattactaaacgtaaacgacgcgctattttctaccgattttcgctcgacaaaacgtttcgctcaactttacacccaaatcgccgatcgtaccgaacgtacgaataaacaaaacgaaataatactacaaacgcaccatccgaaacatcctctattacaaacgttactctataaaaactacgacgcctttaccgaacaaacgctaactaaacgacgaataatacaactaccgccgtaaaccaaccatataattatacgtacgaaaaatcataacaatcaacacgcgccattattcctacaacaactacgtaatctaatcctctccaacccactaacaaacgaaaaactataaattctcgatccgattccgactctaacacctaaacgtaacgatcgctaacgctaacaaatattattacaacacccttcccgcgta

SEQ ID NO: 27675 - DNA, 669 bp, Artificial Sequence
  chemically treated genomic DNA (Homo sapiens) CpG-island No: 27675
gggtttttttcgggttaacgtacgggttttcgggggttgggtatcgaatagtttgaatagacgttcgcgtcgttgtttttcggcgtgtttatttttcgtatcgatcgcgatattattagtcgtaaaggggcgttggaatagtaattggtagaagtatatcgcggcggcgcgcggattttgattggtatataaatgttggcgaaaggttattatttttcggatgtgacgttggttgtattattggacgtggacggcgcgttgttttttgtcgattttcgttcggtagagcgtttcgtttagttttatatttaggtcgtcggtcgtgtcgggcgtgcgggtaaatagggcgaagtggtgttgtaaacgtattattcggaatattttttgttgtaaacgttgttttataaaggttacgacgtttttgtcgaataggcgttggttgagcggcgaatgatgtagttatcgtcgtggattagttatgtgattgtgcgtgcggaagattataataattagtacgcgttattgtttttgtaataattgcgtaatttgattttttttagtttattggtagacgagaaattgtgggttttcggttcggtttcggttttggtatttaaacgtggcggtcgttggcgttggtagatattgttgtagtatttttttcgcgtg

SEQ ID NO: 27676 - DNA, 669 bp, Artificial Sequence
  chemically treated genomic DNA (Homo sapiens) CpG-island No: 27676
cacgcgaaaaaaatactacaacaatatctaccaacgccaacgaccgccacgtttaaataccaaaaccgaaaccgaaccgaaaacccacaatttctcgtctaccaataaactaaaaaaaatcaaattacgcaattattacaaaaacaataacgcgtactaattattataatcttccgcacgcacaatcacataactaatccacgacgataactacatcattcgccgctcaaccaacgcctattcgacaaaaacgtcgtaacctttataaaacaacgtttacaacaaaaaatattccgaataatacgtttacaacaccacttcgccctatttacccgcacgcccgacacgaccgacgacctaaatataaaactaaacgaaacgctctaccgaacgaaaatcgacaaaaaacaacgcgccgtccacgtccaataatacaaccaacgtcacatccgaaaaataataacctttcgccaacatttatataccaatcaaaatccgcgcgccgccgcgatatacttctaccaattactattccaacgcccctttacgactaataatatcgcgatcgatacgaaaaataaacacgccgaaaaacaacgacgcgaacgtctattcaaactattcgatacccaacccccgaaaacccgtacgttaacccgaaaaaaaccc

SEQ ID NO: 27677 - DNA, 740 bp, Artificial Sequence
  chemically treated genomic DNA (Homo sapiens) CpG-island No: 27677
ggtaggcgggcgagaaggaaatttagaaaataatacgggcggagacgcgaattaaagaattaggcgggcgaatttagttgagaattttagagtgacgtgtatcgggtcgggaaggagaatcgaggttcggttcgggcggggacgagaagtagcgttcgggcgagcgaggatcgaggtcggcgcgggcgggcgcggtttttgtttttttttttcgcgcgtttcgcggttgtatcggttttatgagttcgcggtttttcgtcgttcgggtcgttcgtagtttttgatttgatttgttttcgttatggtcgaggtcgttttcggcgtcgggggtacgtttttggagggcgagcgtggtaagaggttttcgtcggagggcgagtttgtagtttcggcgttcggagttttgggtatgtgtgcggcggttggattagatagggttgtaggtgtttggggagttcgcgttaattatacggggaggaggattagggttaaacgtaatttggcgtggtgtttggacgaggggtcggtttttttcggtattgcggttgcggttcggcgggcggggttgggacggtgtttcgggttggggtttcggcgcggagacgcggatacgttttttcgagagttttaggtttgggttgcgttttgttattttcgggttgcgggatcgcggcgggttagggatgtgtttgagagagttttttcgcgaagaatatagaattatacggttttgggtttaa

SEQ ID NO: 27678 - DNA, 740 bp, Artificial Sequence
  chemically treated genomic DNA (Homo sapiens) CpG-island No: 27678
ttaaacccaaaaccgtataattctatattcttcgcgaaaaaactctctcaaacacatccctaacccgccgcgatcccgcaacccgaaaataacaaaacgcaacccaaacctaaaactctcgaaaaaacgtatccgcgtctccgcgccgaaaccccaacccgaaacaccgtcccaaccccgcccgccgaaccgcaaccgcaataccgaaaaaaaccgacccctcgtccaaacaccacgccaaattacgtttaaccctaatcctcctccccgtataattaacgcgaactccccaaacacctacaaccctatctaatccaaccgccgcacacatacccaaaactccgaacgccgaaactacaaactcgccctccgacgaaaacctcttaccacgctcgccctccaaaaacgtacccccgacgccgaaaacgacctcgaccataacgaaaacaaatcaaatcaaaaactacgaacgacccgaacgacgaaaaaccgcgaactcataaaaccgatacaaccgcgaaacgcgcgaaaaaaaaaaacaaaaaccgcgcccgcccgcgccgacctcgatcctcgctcgcccgaacgctacttctcgtccccgcccgaaccgaacctcgattctccttcccgacccgatacacgtcactctaaaattctcaactaaattcgcccgcctaattctttaattcgcgtctccgcccgtattattttctaaatttccttctcgcccgcctacc

SEQ ID NO: 27679 - DNA, 740 bp, Artificial Sequence
  chemically treated genomic DNA (Homo sapiens) CpG-island No: 27679
ttgaatttaggatcgtatgattttgtatttttcgcggagaggtttttttaagtatatttttggttcgtcgcgatttcgtagttcgggggtggtagggcgtagtttaagtttggggttttcggaggggcgtgttcgcgttttcgcgtcgggattttagttcgaagtatcgttttagtttcgttcgtcgggtcgtagtcgtagtgtcgggaggagtcggtttttcgtttagatattacgttaggttacgtttgattttgattttttttttcgtgtagttgacgcgggttttttaggtatttgtaattttgtttggtttagtcgtcgtatatatatttagaatttcggacgtcggggttgtaggttcgtttttcggcgggggttttttgttacgttcgttttttagggacgtgttttcggcgtcggaggcggtttcggttatggcgaggataggttaggttaggggttacggacggttcgggcgacggggagtcgcgggtttatggggtcggtgtagtcgcggagcgcgcgggaggaggagataaaggtcgcgttcgttcgcgtcggtttcggttttcgttcgttcgagcgttgtttttcgttttcgttcgagtcgaatttcgattttttttttcggttcgatgtacgttattttagggtttttagttgagttcgttcgtttagttttttggttcgcgttttcgttcgtgttgttttttgggtttttttttcgttcgtttatt

SEQ ID NO: 27680 - DNA, 740 bp, Artificial Sequence
  chemically treated genomic DNA (Homo sapiens) CpG-island No: 27680
aataaacgaacgaaaaaaaaacccaaaaaacaacacgaacgaaaacgcgaaccaaaaaactaaacgaacgaactcaactaaaaaccctaaaataacgtacatcgaaccgaaaaaaaaaatcgaaattcgactcgaacgaaaacgaaaaacaacgctcgaacgaacgaaaaccgaaaccgacgcgaacgaacgcgacctttatctcctcctcccgcgcgctccgcgactacaccgaccccataaacccgcgactccccgtcgcccgaaccgtccgtaacccctaacctaacctatcctcgccataaccgaaaccgcctccgacgccgaaaacacgtccctaaaaaacgaacgtaacaaaaaacccccgccgaaaaacgaacctacaaccccgacgtccgaaattctaaatatatatacgacgactaaaccaaacaaaattacaaatacctaaaaaacccgcgtcaactacacgaaaaaaaaaatcaaaatcaaacgtaacctaacgtaatatctaaacgaaaaaccgactcctcccgacactacgactacgacccgacgaacgaaactaaaacgatacttcgaactaaaatcccgacgcgaaaacgcgaacacgcccctccgaaaaccccaaacttaaactacgccctaccacccccgaactacgaaatcgcgacgaaccaaaaatatacttaaaaaaacctctccgcgaaaaatacaaaatcatacgatcctaaattcaa

SEQ ID NO: 27681 - DNA, 981 bp, Artificial Sequence
  chemically treated genomic DNA (Homo sapiens) CpG-island No: 27681
gcgttttttttttgtttgtcgtttttttatttgttcgtttatttgttcgtcggtttttttatagtttttgttcgttttgtttttgttttagagtttcgagcggtagttgtaggcggtgttggtttcgttcgcggttttgcggtttcgtttgtttttttttttttttcggggttttttgttcgcggttcgggttaaagtacgggtaggtggcgagttcgtgggttttcgtcggggtgggtagcgtggttgtgttgggggtttggcgcgtcgagttgagggcgtatgcgcggagggaatttggggtcgggggcggttagtaagtaggtgtaggcggttgggggcgtacgcggtttagtgtatcgatagagttcgcggtggggtggagacgcgttgggtttgttcgtgaggtgggcgaggagcgttgcgcgtgttaggttgtattttgtggttgagcgttgggggtttcgcgtcgaggcgcgtttaaagtagcggagttaggaatcggattcggcgtgtgtttgggtacggtgtttcggcggggcgtttagggagggtgagtttttcgatttcggcgtttcgtttgttttttacgcgttttttttttttttttttttgtttttagatgttggttacgttgttgattattcgttagtttttttagaacgtgcgcgaggttttgtagtcgtatttgtatcggcgtttgggtcgcggcgagttgggtttgcgggtcgtttgggagttggttcgagttttgtttggttttttgagttttcggcgttttgcgtttcgtcgtttcgaattttaggcggatgagggcgggggcggcggtagcgggggcgggggtcgtaggtgttttagcgggggttgcggggcgtcggaggaggaggaggaggcggcgttggtggagcggcggcgggcgggggaaggcggggaggagggggacgggtttttagggggtaaggaggaggacgaggacgacga

SEQ ID NO: 27682 - DNA, 981 bp, Artificial Sequence
  chemically treated genomic DNA (Homo sapiens) CpG-island No: 27682
tcgtcgtcctcgtcctcctccttaccccctaaaaacccgtccccctcctccccgccttcccccgcccgccgccgctccaccaacgccgcctcctcctcctcctccgacgccccgcaacccccgctaaaacacctacgacccccgcccccgctaccgccgcccccgccctcatccgcctaaaattcgaaacgacgaaacgcaaaacgccgaaaactcaaaaaaccaaacaaaactcgaaccaactcccaaacgacccgcaaacccaactcgccgcgacccaaacgccgatacaaatacgactacaaaacctcgcgcacgttctaaaaaaactaacgaataatcaacaacgtaaccaacatctaaaaacaaaaaaaaaaaaaaaaaaaacgcgtaaaaaacaaacgaaacgccgaaatcgaaaaactcaccctccctaaacgccccgccgaaacaccgtacccaaacacacgccgaatccgattcctaactccgctactttaaacgcgcctcgacgcgaaacccccaacgctcaaccacaaaatacaacctaacacgcgcaacgctcctcgcccacctcacgaacaaacccaacgcgtctccaccccaccgcgaactctatcgatacactaaaccgcgtacgcccccaaccgcctacacctacttactaaccgcccccgaccccaaattccctccgcgcatacgccctcaactcgacgcgccaaacccccaacacaaccacgctacccaccccgacgaaaacccacgaactcgccacctacccgtactttaacccgaaccgcgaacaaaaaaccccgaaaaaaaaaaaaaaacaaacgaaaccgcaaaaccgcgaacgaaaccaacaccgcctacaactaccgctcgaaactctaaaacaaaaacaaaacgaacaaaaactataaaaaaaccgacgaacaaataaacgaacaaataaaaaaacgacaaacaaaaaaaaaacgc

SEQ ID NO: 27683 - DNA, 981 bp, Artificial Sequence
  chemically treated genomic DNA (Homo sapiens) CpG-island No: 27683
tcgtcgttttcgtttttttttttgttttttggaggttcgtttttttttttttcgttttttttcgttcgtcgtcgttttattagcgtcgttttttttttttttttcggcgtttcgtagttttcgttgaggtatttgcggttttcgttttcgttgtcgtcgttttcgtttttattcgtttggggttcgaggcggcggggcgtagggcgtcggaggtttaggaggttaagtagggttcgggttagtttttagacggttcgtaggtttagttcgtcgcggtttaggcgtcggtataggtgcggttgtaggatttcgcgtacgttttggaggaattggcgggtgattagtagcgtggttagtatttgggggtaggaaggggaaggagagaggcgcgtggggggtaagcggggcgtcgggatcgggggatttattttttttgggcgtttcgtcggagtatcgtgtttagatatacgtcgaattcggtttttaatttcgttgttttggacgcgtttcgacgcgaggtttttagcgtttagttataaaatatagtttggtacgcgtagcgtttttcgtttattttacgggtaggtttagcgcgtttttattttatcgcgggttttgtcggtgtattgggtcgcgtgcgtttttagtcgtttgtatttgtttgttggtcgttttcgattttagatttttttcgcgtatgcgtttttagttcggcgcgttaggtttttagtatagttacgttgtttatttcggcgaggatttacgggttcgttatttgttcgtattttggttcgggtcgcgagtaggaggtttcggagggagaggaggagtaggcggaatcgtagggtcgcgagcgggattagtatcgtttgtagttgtcgttcgaggttttgggatagggataggacgagtaggagttgtgaagggatcgacggatagatggacggatagatggggggacgataggtagagagaggacgt

SEQ ID NO: 27684 - DNA, 981 bp, Artificial Sequence
  chemically treated genomic DNA (Homo sapiens) CpG-island No: 27684
acgtcctctctctacctatcgtccccccatctatccgtccatctatccgtcgatcccttcacaactcctactcgtcctatccctatcccaaaacctcgaacgacaactacaaacgatactaatcccgctcgcgaccctacgattccgcctactcctcctctccctccgaaacctcctactcgcgacccgaaccaaaatacgaacaaataacgaacccgtaaatcctcgccgaaataaacaacgtaactatactaaaaacctaacgcgccgaactaaaaacgcatacgcgaaaaaaatctaaaatcgaaaacgaccaacaaacaaatacaaacgactaaaaacgcacgcgacccaatacaccgacaaaacccgcgataaaataaaaacgcgctaaacctacccgtaaaataaacgaaaaacgctacgcgtaccaaactatattttataactaaacgctaaaaacctcgcgtcgaaacgcgtccaaaacaacgaaattaaaaaccgaattcgacgtatatctaaacacgatactccgacgaaacgcccaaaaaaaataaatcccccgatcccgacgccccgcttaccccccacgcgcctctctccttccccttcctacccccaaatactaaccacgctactaatcacccgccaattcctccaaaacgtacgcgaaatcctacaaccgcacctataccgacgcctaaaccgcgacgaactaaacctacgaaccgtctaaaaactaacccgaaccctacttaacctcctaaacctccgacgccctacgccccgccgcctcgaaccccaaacgaataaaaacgaaaacgacgacaacgaaaacgaaaaccgcaaatacctcaacgaaaactacgaaacgccgaaaaaaaaaaaaaaaacgacgctaataaaacgacgacgaacgaaaaaaaacgaaaaaaaaaaaaacgaacctccaaaaaacaaaaaaaaaaacgaaaacgacga

SEQ ID NO: 27685 - DNA, 524 bp, Artificial Sequence
  chemically treated genomic DNA (Homo sapiens) CpG-island No: 27685
ggcgtagcgtcgcgtatagttcgcgtttcggggtcgtttagaggtttatcgcgtcgtcgtcgtcgggtttttattcgttcgtttcgatttttttcggtgggcgttgagtcgggtaggtttttgggtttcgcggttcgatcgtttttttcggttgtttttgcgcgttcgcggttttttcggggagggcgcggcggttatttgttgcgggttttcggagcgagtgaagattagcgattcggcgtagttcgttcgcgggtcggatttttgttagcgttaggcgttttttttcgtcgtttagcgttaattatagttggagtttcggggaggaaggtcggttcggagatgcgcggttttttaaaggggtagcgcgttttttcggggttgcggttttaggttttagtttgggtatcggtttagcgcgttacgcgcgaatttttcggagcgaagtaacgttttgttggttttgttttattgttgtttttttataggtttggtttttaatttataagatgaatttttaggcg

SEQ ID NO: 27686 - DNA, 524 bp, Artificial Sequence
  chemically treated genomic DNA (Homo sapiens) CpG-island No: 27686
cgcctaaaaattcatcttataaattaaaaaccaaacctataaaaaaacaacaataaaacaaaaccaacaaaacgttacttcgctccgaaaaattcgcgcgtaacgcgctaaaccgatacccaaactaaaacctaaaaccgcaaccccgaaaaaacgcgctacccctttaaaaaaccgcgcatctccgaaccgaccttcctccccgaaactccaactataattaacgctaaacgacgaaaaaaaacgcctaacgctaacaaaaatccgacccgcgaacgaactacgccgaatcgctaatcttcactcgctccgaaaacccgcaacaaataaccgccgcgccctccccgaaaaaaccgcgaacgcgcaaaaacaaccgaaaaaaacgatcgaaccgcgaaacccaaaaacctacccgactcaacgcccaccgaaaaaaatcgaaacgaacgaataaaaacccgacgacgacgacgcgataaacctctaaacgaccccgaaacgcgaactatacgcgacgctacgcc

SEQ ID NO: 27687 - DNA, 524 bp, Artificial Sequence
  chemically treated genomic DNA (Homo sapiens) CpG-island No: 27687
cgtttggaagtttattttatagattgggggttaagtttgtaaaagaataatagtaaaatagagttaataggacgttgtttcgtttcgaagggttcgcgcgtagcgcgttgagtcggtgtttaggttggggtttggagtcgtagtttcgaaaaggcgcgttgtttttttaaaaggtcgcgtattttcgggtcggttttttttttcggggttttagttgtgattgacgttgggcggcgagaggaggcgtttggcgttaataaaagttcggttcgcgggcgagttgcgtcgggtcgttagtttttattcgtttcggggattcgtaataagtggtcgtcgcgtttttttcggggaagtcgcgggcgcgtaggggtagtcgaaggaggcggtcgagtcgcggagtttaggggtttgttcggtttagcgtttatcggaggggatcggggcgggcggatggggattcggcggcggcggcgcggtgagtttttgggcggtttcggggcgcgggttgtgcgcggcgttgcgtt

SEQ ID NO: 27688 - DNA, 524 bp, Artificial Sequence
  chemically treated genomic DNA (Homo sapiens) CpG-island No: 27688
aacgcaacgccgcgcacaacccgcgccccgaaaccgcccaaaaactcaccgcgccgccgccgccgaatccccatccgcccgccccgatcccctccgataaacgctaaaccgaacaaacccctaaactccgcgactcgaccgcctccttcgactacccctacgcgcccgcgacttccccgaaaaaaacgcgacgaccacttattacgaatccccgaaacgaataaaaactaacgacccgacgcaactcgcccgcgaaccgaacttttattaacgccaaacgcctcctctcgccgcccaacgtcaatcacaactaaaaccccgaaaaaaaaaaccgacccgaaaatacgcgaccttttaaaaaaacaacgcgccttttcgaaactacgactccaaaccccaacctaaacaccgactcaacgcgctacgcgcgaacccttcgaaacgaaacaacgtcctattaactctattttactattattcttttacaaacttaacccccaatctataaaataaacttccaaacg

SEQ ID NO: 27689 - DNA, 593 bp, Artificial Sequence
  chemically treated genomic DNA (Homo sapiens) CpG-island No: 27689
ttttatatcggtttttaatgttgtttcgttttttcgattttttttatcggttttattgcggttttggtttttgcggtttatagtatcggttttagtgcggtttcgttttttcggtttcgttatcgtttttattgtggtttagtattttggattttttttttcgagatttattttggtcgtaggggttgcgaataaggttgcgttcgatgggtttgcgcgcgtagaagcggtttagggggtaaggtttggcgttacgggcgggagattggtagttgcgggcgaggtgtagtagcgcgcggtcggtggcgtcgtggtcgcgggttaggattagtagttatagggtttggtcgtttattagggttcgttagtttcggtatatttggcggtagcgttcgagtagcgtgcgcggggggacgtggtttagtattattagaagtagttttgggggtagttggtttaggtttagcgttttttcgggtttcggtttcggcgcggggattcgggcggttcggtttttggagatcgaggcgtttatggttttttcgttaggttcggttgtggttgcgggagaggaagggttaaggcgttaggga

SEQ ID NO: 27690 - DNA, 593 bp, Artificial Sequence
  chemically treated genomic DNA (Homo sapiens) CpG-island No: 27690
tccctaacgccttaacccttcctctcccgcaaccacaaccgaacctaacgaaaaaaccataaacgcctcgatctccaaaaaccgaaccgcccgaatccccgcgccgaaaccgaaacccgaaaaaacgctaaacctaaaccaactacccccaaaactacttctaataatactaaaccacgtccccccgcgcacgctactcgaacgctaccgccaaatataccgaaactaacgaaccctaataaacgaccaaaccctataactactaatcctaacccgcgaccacgacgccaccgaccgcgcgctactacacctcgcccgcaactaccaatctcccgcccgtaacgccaaaccttaccccctaaaccgcttctacgcgcgcaaacccatcgaacgcaaccttattcgcaacccctacgaccaaaataaatctcgaaaaaaaaaatccaaaatactaaaccacaataaaaacgataacgaaaccgaaaaaacgaaaccgcactaaaaccgatactataaaccgcaaaaaccaaaaccgcaataaaaccgataaaaaaaatcgaaaaaacgaaacaacattaaaaaccgatataaaa

SEQ ID NO: 27691 - DNA, 593 bp, Artificial Sequence
  chemically treated genomic DNA (Homo sapiens) CpG-island No: 27691
tttttgacgttttgattttttttttttcgtagttatagtcgggtttggcggggggattatgggcgtttcggtttttaggggtcgggtcgttcgggttttcgcgtcggagtcggaattcgaagaggcgttggatttgagttaattatttttagagttgtttttggtggtgttgagttacgttttttcgcgtacgttgttcgggcgttgtcgttaagtgtgtcggggttggcgagttttggtggacggttaggttttgtggttgttgattttggttcgcgattacggcgttatcggtcgcgcgttgttgtatttcgttcgtagttgttagtttttcgttcgtaacgttaggttttgttttttgggtcgtttttgcgcgcgtagatttatcggacgtaattttattcgtaatttttgcggttaaggtggatttcggaagaggaagtttaggatgttgggttatagtgggagcggtagcggggtcggaggggcggggtcgtattgggatcggtattatgggtcgtaggggttagggtcgtagtgggatcggtgggaggagtcggagaggcggggtagtattgggagtcggtgtgagg

SEQ ID NO: 27692 - DNA, 593 bp, Artificial Sequence
  chemically treated genomic DNA (Homo sapiens) CpG-island No: 27692
cctcacaccgactcccaatactaccccgcctctccgactcctcccaccgatcccactacgaccctaacccctacgacccataataccgatcccaatacgaccccgcccctccgaccccgctaccgctcccactataacccaacatcctaaacttcctcttccgaaatccaccttaaccgcaaaaattacgaataaaattacgtccgataaatctacgcgcgcaaaaacgacccaaaaaacaaaacctaacgttacgaacgaaaaactaacaactacgaacgaaatacaacaacgcgcgaccgataacgccgtaatcgcgaaccaaaatcaacaaccacaaaacctaaccgtccaccaaaactcgccaaccccgacacacttaacgacaacgcccgaacaacgtacgcgaaaaaacgtaactcaacaccaccaaaaacaactctaaaaataattaactcaaatccaacgcctcttcgaattccgactccgacgcgaaaacccgaacgacccgacccctaaaaaccgaaacgcccataatccccccgccaaacccgactataactacgaaaaaaaaaaaatcaaaacgtcaaaaa

SEQ ID NO: 27693 - DNA, 534 bp, Artificial Sequence
  chemically treated genomic DNA (Homo sapiens) CpG-island No: 27693
ggcgttttcgtgtgcgtaagtaaggtagaggcgggattttcggcgttttttagtagcgattatttttattggcgttagggagtttttggagcgttgtgttgggatcgtggtggtgattggatttaggaggtcgagagtcgtttttttttttgtatagacgtgattttgtagttttttaacggcgttcgttgtttttaatttagtttattttacgtggttttatggcggcggtcgcgttaaggtttttcgtttaggtaattgtggcgtttttcgtgtttttcggttattttttagttatataagttttaaagtagcgagggagcggtatttgtttacggttttgtaattcggattcggcgtcgggatattgaggcgttttcgggagggatttttgttttagatattcgtgggatgcggtggggagagcgataggtatagggaggggcgcgggtaatggtttggagatggacggattcgggaggatggaatttggggtttataggcgtttgtagggaataatttgtgaggcggaat

SEQ ID NO: 27694 - DNA, 534 bp, Artificial Sequence
  chemically treated genomic DNA (Homo sapiens) CpG-island No: 27694
attccgcctcacaaattattccctacaaacgcctataaaccccaaattccatcctcccgaatccgtccatctccaaaccattacccgcgcccctccctatacctatcgctctccccaccgcatcccacgaatatctaaaacaaaaatccctcccgaaaacgcctcaatatcccgacgccgaatccgaattacaaaaccgtaaacaaataccgctccctcgctactttaaaacttatataactaaaaaataaccgaaaaacacgaaaaacgccacaattacctaaacgaaaaaccttaacgcgaccgccgccataaaaccacgtaaaataaactaaattaaaaacaacgaacgccgttaaaaaactacaaaatcacgtctatacaaaaaaaaaaacgactctcgacctcctaaatccaatcaccaccacgatcccaacacaacgctccaaaaactccctaacgccaataaaaataatcgctactaaaaaacgccgaaaatcccgcctctaccttacttacgcacacgaaaacgcc

SEQ ID NO: 27695 - DNA, 534 bp, Artificial Sequence
  chemically treated genomic DNA (Homo sapiens) CpG-island No: 27695
gtttcgttttataggttgttttttataggcgtttgtggattttaggttttattttttcggattcgtttatttttaggttattgttcgcgtttttttttgtatttgtcgttttttttatcgtattttacgggtgtttgaaatagggatttttttcgagagcgttttagtgtttcgacgtcgggttcgggttgtagagtcgtaaataggtgtcgttttttcgttgttttaggatttgtgtgattaggaggtgatcggagagtacggaaggcgttataattatttgaacggggaattttagcgcggtcgtcgttatgggattacgtggggtaagttgggttgagagtagcgggcgtcgttaaagagttgtagagttacgtttgtgtaaagagaagaacgattttcgattttttggatttagttattattacggttttaatatagcgttttaaggattttttaacgttaatggaaatggtcgttattaaagggcgtcgggagtttcgtttttattttatttgcgtatacggaaacgtt

SEQ ID NO: 27696 - DNA, 534 bp, Artificial Sequence
  chemically treated genomic DNA (Homo sapiens) CpG-island No: 27696
aacgtttccgtatacgcaaataaaataaaaacgaaactcccgacgccctttaataacgaccatttccattaacgttaaaaaatccttaaaacgctatattaaaaccgtaataataactaaatccaaaaaatcgaaaatcgttcttctctttacacaaacgtaactctacaactctttaacgacgcccgctactctcaacccaacttaccccacgtaatcccataacgacgaccgcgctaaaattccccgttcaaataattataacgccttccgtactctccgatcacctcctaatcacacaaatcctaaaacaacgaaaaaacgacacctatttacgactctacaacccgaacccgacgtcgaaacactaaaacgctctcgaaaaaaatccctatttcaaacacccgtaaaatacgataaaaaaaacgacaaatacaaaaaaaaacgcgaacaataacctaaaaataaacgaatccgaaaaaataaaacctaaaatccacaaacgcctataaaaaacaacctataaaacgaaac

SEQ ID NO: 27697 - DNA, 1031 bp, Artificial Sequence
  chemically treated genomic DNA (Homo sapiens) CpG-island No: 27697
tttagagatacgtggaatcgaggggttaatttcggtttaggttttttatcgtatcggattttggaatttacgattacgaaagttttattgtttcgcgattggttttcgggtcgtatgatattatagcgtttgatttatttttcgggtttcgattggttggtcgcgttattgtgacgttacggttagtttacgttttgattgtagatagtcggcgtttttttttttttatcgcgcgggttttagttatcggtgtttttttttatattcgtttttgcgtcggttgttattcgcgtttttttcgtcgtcgtcgttttgttgttgtttaaagttgttgtcgttttttgcgtataaaggtaaagtcgttagtttcgggaaatttcgtcgggggtcgtcgttcggttatgatattcgcgcgagcgcgcggtcgggaagcggttagagagaattgtcgttaggtttcggatttggtgtcgagaaagagttgtcggggtaattcgcgtttcgttcgcggtttttagtttcgtcggtttcggggtatagttcggtttttcgggcgcggggaaaggggtgcgggtgcgggcgcgggcggttcgttttacgtcgaggttgaggtagggcgttcgggagcgttttttgtgttgcggttttatttgtgcgcgttgataggcgtcgcggggtacgatatcgtgtttatattagacgcggagggatggatttgttcgtttgggttttttcgttttgggggtcggagcgcgcggcgggagagtcgggggagcgttttcggagggagcgcgttttttttggagtcggcgaaattcgggtgagttcgaagagtttgtgcgagggtttgcgggtatcgggcgtcgttggggggatttttcggttttttttttttgttttgtttttttcgttttcgttaattttgcggatttttcgttcgtttttcggagggaagtttgttagttcgggatcgttttagtttttattgaaattagataacggtagtttttggtatttagggagggatgagg

SEQ ID NO: 27698 - DNA, 1031 bp, Artificial Sequence
  chemically treated genomic DNA (Homo sapiens) CpG-island No: 27698
cctcatccctccctaaataccaaaaactaccgttatctaatttcaataaaaactaaaacgatcccgaactaacaaacttccctccgaaaaacgaacgaaaaatccgcaaaattaacgaaaacgaaaaaaacaaaacaaaaaaaaaaaaccgaaaaatccccccaacgacgcccgatacccgcaaaccctcgcacaaactcttcgaactcacccgaatttcgccgactccaaaaaaaacgcgctccctccgaaaacgctcccccgactctcccgccgcgcgctccgacccccaaaacgaaaaaacccaaacgaacaaatccatccctccgcgtctaatataaacacgatatcgtaccccgcgacgcctatcaacgcgcacaaataaaaccgcaacacaaaaaacgctcccgaacgccctacctcaacctcgacgtaaaacgaaccgcccgcgcccgcacccgcacccctttccccgcgcccgaaaaaccgaactataccccgaaaccgacgaaactaaaaaccgcgaacgaaacgcgaattaccccgacaactctttctcgacaccaaatccgaaacctaacgacaattctctctaaccgcttcccgaccgcgcgctcgcgcgaatatcataaccgaacgacgacccccgacgaaatttcccgaaactaacgactttacctttatacgcaaaaaacgacaacaactttaaacaacaacaaaacgacgacgacgaaaaaaacgcgaataacaaccgacgcaaaaacgaatataaaaaaaaacaccgataactaaaacccgcgcgataaaaaaaaaaaaacgccgactatctacaatcaaaacgtaaactaaccgtaacgtcacaataacgcgaccaaccaatcgaaacccgaaaaataaatcaaacgctataatatcatacgacccgaaaaccaatcgcgaaacaataaaactttcgtaatcgtaaattccaaaatccgatacgataaaaaacctaaaccgaaattaacccctcgattccacgtatctctaaa

SEQ ID NO: 27699 - DNA, 1031 bp, Artificial Sequence
  chemically treated genomic DNA (Homo sapiens) CpG-island No: 27699
ttttatttttttttgagtattaagggttgtcgttgtttggttttaataaaaattgaagcggtttcgagttagtaggttttttttcgaggggcggacggaaggttcgtagggttaacggaagcggagagaataggataaaaaggaaaggtcggagagtttttttagcggcgttcggtgttcgtagattttcgtataggtttttcgaatttattcgggtttcgtcgattttaaagaaagcgcgtttttttcgagagcgttttttcggttttttcgtcgcgcgtttcggtttttagggcgggaggatttaggcggatagatttattttttcgcgtttggtgtgggtacggtgtcgtgtttcgcggcgtttgttagcgcgtataggtgggatcgtagtatagagaacgttttcgagcgttttgttttagtttcggcgtggggcgagtcgttcgcgttcgtattcgtattttttttttcgcgttcgaggagtcgggttgtatttcggagtcggcggagttggaggtcgcgggcggagcgcgggttgtttcggtagttttttttcggtattaggttcgagatttaacggtagttttttttgatcgtttttcggtcgcgcgttcgcgcgggtgttatggtcgagcggcggttttcgacgaagtttttcggagttgacggttttatttttatacgtaaggggcggtagtagttttgagtagtagtaaggcggcggcggcggagggagcgcgggtggtagtcggcgtagaggcggatgtagaaggagatatcggtggttaggattcgcgcgatgggaagaggaaggcgtcggttatttataattagaacgtgggttgatcgtgacgttataatggcgcggttagttaatcgggattcgaaggatgaattaagcgttatgatgttatgcggttcgggagttaatcgcgggataatagaattttcgtgatcgtaaattttagaattcgatgcggtggagagtttaggtcggggttggtttttcggttttacgtgtttttggg

SEQ ID NO: 27700 - DNA, 1031 bp, Artificial Sequence
  chemically treated genomic DNA (Homo sapiens) CpG-island No: 27700
cccaaaaacacgtaaaaccgaaaaaccaaccccgacctaaactctccaccgcatcgaattctaaaatttacgatcacgaaaattctattatcccgcgattaactcccgaaccgcataacatcataacgcttaattcatccttcgaatcccgattaactaaccgcgccattataacgtcacgatcaacccacgttctaattataaataaccgacgccttcctcttcccatcgcgcgaatcctaaccaccgatatctccttctacatccgcctctacgccgactaccacccgcgctccctccgccgccgccgccttactactactcaaaactactaccgccccttacgtataaaaataaaaccgtcaactccgaaaaacttcgtcgaaaaccgccgctcgaccataacacccgcgcgaacgcgcgaccgaaaaacgatcaaaaaaaactaccgttaaatctcgaacctaataccgaaaaaaaactaccgaaacaacccgcgctccgcccgcgacctccaactccgccgactccgaaatacaacccgactcctcgaacgcgaaaaaaaaaatacgaatacgaacgcgaacgactcgccccacgccgaaactaaaacaaaacgctcgaaaacgttctctatactacgatcccacctatacgcgctaacaaacgccgcgaaacacgacaccgtacccacaccaaacgcgaaaaaataaatctatccgcctaaatcctcccgccctaaaaaccgaaacgcgcgacgaaaaaaccgaaaaaacgctctcgaaaaaaacgcgctttctttaaaatcgacgaaacccgaataaattcgaaaaacctatacgaaaatctacgaacaccgaacgccgctaaaaaaactctccgacctttcctttttatcctattctctccgcttccgttaaccctacgaaccttccgtccgcccctcgaaaaaaaacctactaactcgaaaccgcttcaatttttattaaaaccaaacaacgacaacccttaatactcaaaaaaaaataaaa

SEQ ID NO: 27701 - DNA, 539 bp, Artificial Sequence
  chemically treated genomic DNA (Homo sapiens) CpG-island No: 27701
aacgcggtgggtatattcgcgttaggcgggtattagggtttgtttggggtttttttttttattcgcgcgggtggatatcgttaattgtttgtggttagggcggtgcgtcgttattttcgcggtattcggtttttttcgttagttttgcgttattcggtttttttcgttcgtttcgcgttttcggcggggttcgtttcgttttttcgcggcggttattttatttatttcgcggttgtatttattaattatcgtttattaatagcgtcgtatttggcgatggggcggggtttcgcgaggagtacgttcgcgtttttttcgttttgagttcgttttcgggtcgggtaattttcgggtaatgattagatttcgttttcgcgttgattttttttggggatatcgggtgggggtggaggaggcgttgagttagggagaggagggttgtgcggttcggattacgtaattttgggatcggagggtggttgaggttttgagggaagaatggaaggcggttttgatttttggtgtttttacgtttttta

SEQ ID NO: 27702 - DNA, 539 bp, Artificial Sequence
  chemically treated genomic DNA (Homo sapiens) CpG-island No: 27702
taaaaaacgtaaaaacaccaaaaatcaaaaccgccttccattcttccctcaaaacctcaaccaccctccgatcccaaaattacgtaatccgaaccgcacaaccctcctctccctaactcaacgcctcctccacccccacccgatatccccaaaaaaaatcaacgcgaaaacgaaatctaatcattacccgaaaattacccgacccgaaaacgaactcaaaacgaaaaaaacgcgaacgtactcctcgcgaaaccccgccccatcgccaaatacgacgctattaataaacgataattaataaatacaaccgcgaaataaataaaataaccgccgcgaaaaaacgaaacgaaccccgccgaaaacgcgaaacgaacgaaaaaaaccgaataacgcaaaactaacgaaaaaaaccgaataccgcgaaaataacgacgcaccgccctaaccacaaacaattaacgatatccacccgcgcgaataaaaaaaaaaaccccaaacaaaccctaatacccgcctaacgcgaatatacccaccgcgtt

SEQ ID NO: 27703 - DNA, 539 bp, Artificial Sequence
  chemically treated genomic DNA (Homo sapiens) CpG-island No: 27703
tgaagggcgtggaagtattagaagttaaggtcgttttttattttttttttaaggttttaattatttttcgattttaaggttgcgtggttcgggtcgtataatttttttttttttagtttagcgttttttttatttttattcgatgtttttaggaagggttagcgcggggacgaggtttggttattgttcgggaattattcggttcgggagcgagtttaaggcggggagggcgcgagcgtgtttttcgcgaggtttcgttttatcgttagatgcggcgttgttggtgagcggtgattggtgggtgtagtcgcggaatgaatggggtgatcgtcgcgggggagcggggcgggtttcgtcgagggcgcggggcgggcgaaaggagtcgagtggcgtagggttggcgagaggagtcgagtgtcgcgggggtggcggcgtatcgttttgattataggtagttaacggtgtttattcgcgcgagtggaggagggggttttaggtaggttttggtattcgtttggcgcgagtgtgtttatcgcgtt

SEQ ID NO: 27704 - DNA, 539 bp, Artificial Sequence
  chemically treated genomic DNA (Homo sapiens) CpG-island No: 27704
aacgcgataaacacactcgcgccaaacgaataccaaaacctacctaaaaccccctcctccactcgcgcgaataaacaccgttaactacctataatcaaaacgatacgccgccacccccgcgacactcgactcctctcgccaaccctacgccactcgactcctttcgcccgccccgcgccctcgacgaaacccgccccgctcccccgcgacgatcaccccattcattccgcgactacacccaccaatcaccgctcaccaacaacgccgcatctaacgataaaacgaaacctcgcgaaaaacacgctcgcgccctccccgccttaaactcgctcccgaaccgaataattcccgaacaataaccaaacctcgtccccgcgctaacccttcctaaaaacatcgaataaaaataaaaaaaacgctaaactaaaaaaaaaaaaattatacgacccgaaccacgcaaccttaaaatcgaaaaataattaaaaccttaaaaaaaaaataaaaaacgaccttaacttctaatacttccacgcccttca

SEQ ID NO: 27705 - DNA, 819 bp, Artificial Sequence
  chemically treated genomic DNA (Homo sapiens) CpG-island No: 27705
tcgttttcgtagttcgacggttaatgaagaggcgggtcgcggtttgggcggttaatgggcgcggtggggcggtgcgggttacggtttggggttttcgcgcgtttttcgttcgtagtggaagtcgacgtcgcgttcgtatgttcgtaggcgtcgcgtagtcgtcgttatcgtcgttagttcgtgcgttttcggcgcgtattcgtcgcgtttttattttcgtcgtcggttaggggcgcgttcggtcgtttcggatagtgtttcgttgcggtttcgcggcgatggttattaagatcgataaagaggtttgtcgggcggcgtataatttggtgcgcgacgacggttcggtcgttatttggtaggaattttttattcgtttttacgtttcgtttttcgggttcgcgcggggtttcgtgtatcgagtcggtttttaggcgggacggattcgggtttttcgcgttgtttttttcgttttatttcgggacggcgtgttaggttttcgcgggttttttcgtggttagcgcgtttgttagattgttttttgtaagcgtcgcgtcgcgcggttattagcgttgatgtgtgtgtgtgtttttttttttttttaatttaaagggtgatttttaaatatgacggttttattatcgttttcggcgagtagggagcggagtattagtattttatttagtagtgtataggtagggaggcgcgtttgcgggcggatgcgcggtcgttgggaggttgtttgtattcggggagtttcggttagagcgaattcgggaggaatcgtggttatatggggtgtttttggttatggcgtgggag

SEQ ID NO: 27706 - DNA, 819 bp, Artificial Sequence
  chemically treated genomic DNA (Homo sapiens) CpG-island No: 27706
ctcccacgccataaccaaaaacaccccatataaccacgattcctcccgaattcgctctaaccgaaactccccgaatacaaacaacctcccaacgaccgcgcatccgcccgcaaacgcgcctccctacctatacactactaaataaaatactaatactccgctccctactcgccgaaaacgataataaaaccgtcatatttaaaaatcaccctttaaattaaaaaaaaaaaaaaacacacacacacatcaacgctaataaccgcgcgacgcgacgcttacaaaaaacaatctaacaaacgcgctaaccacgaaaaaacccgcgaaaacctaacacgccgtcccgaaataaaacgaaaaaaacaacgcgaaaaacccgaatccgtcccgcctaaaaaccgactcgatacacgaaaccccgcgcgaacccgaaaaacgaaacgtaaaaacgaataaaaaattcctaccaaataacgaccgaaccgtcgtcgcgcaccaaattatacgccgcccgacaaacctctttatcgatcttaataaccatcgccgcgaaaccgcaacgaaacactatccgaaacgaccgaacgcgcccctaaccgacgacgaaaataaaaacgcgacgaatacgcgccgaaaacgcacgaactaacgacgataacgacgactacgcgacgcctacgaacatacgaacgcgacgtcgacttccactacgaacgaaaaacgcgcgaaaaccccaaaccgtaacccgcaccgccccaccgcgcccattaaccgcccaaaccgcgacccgcctcttcattaaccgtcgaactacgaaaacga

SEQ ID NO: 27707 - DNA, 819 bp, Artificial Sequence
  chemically treated genomic DNA (Homo sapiens) CpG-island No: 27707
tttttacgttatggttaggggtattttatgtggttacggtttttttcgggttcgttttggtcggggtttttcgggtgtagataattttttaacgatcgcgtattcgttcgtaggcgcgtttttttatttgtgtattgttggatgaagtgttggtatttcgttttttgttcgtcggggacgatggtggagtcgttatatttaaaagttattttttgggttgggagaagaaaaaaatatatatatatattagcgttggtggtcgcgcgacgcggcgtttgtagaggataatttaatagacgcgttggttacggagaagttcgcgggggtttggtacgtcgtttcggaataaggcgaggaagatagcgcgggaggttcgaattcgtttcgtttggaggtcggttcggtgtacgaggtttcgcgcgagttcggggagcggggcgtggagacgaatgaaaagtttttattagatgacggtcgagtcgtcgtcgcgtattaggttgtacgtcgttcggtaagtttttttgtcgattttggtggttatcgtcgcggagtcgtagcgggatattgttcggggcggtcgagcgcgtttttggtcggcggcggggatgggagcgcggcgggtacgcgtcgagggcgtacgggttggcggcggtggcgacggttacgcggcgtttgcgagtatgcgagcgcggcgtcggtttttattgcggacggagagcgcgcggggattttaggtcgtggttcgtatcgttttatcgcgtttattggtcgtttaggtcgcggttcgtttttttattggtcgtcgggttgcgggggcgg

SEQ ID NO: 27708 - DNA, 819 bp, Artificial Sequence
  chemically treated genomic DNA (Homo sapiens) CpG-island No: 27708
ccgcccccgcaacccgacgaccaataaaaaaacgaaccgcgacctaaacgaccaataaacgcgataaaacgatacgaaccacgacctaaaatccccgcgcgctctccgtccgcaataaaaaccgacgccgcgctcgcatactcgcaaacgccgcgtaaccgtcgccaccgccgccaacccgtacgccctcgacgcgtacccgccgcgctcccatccccgccgccgaccaaaaacgcgctcgaccgccccgaacaatatcccgctacgactccgcgacgataaccaccaaaatcgacaaaaaaacttaccgaacgacgtacaacctaatacgcgacgacgactcgaccgtcatctaataaaaacttttcattcgtctccacgccccgctccccgaactcgcgcgaaacctcgtacaccgaaccgacctccaaacgaaacgaattcgaacctcccgcgctatcttcctcgccttattccgaaacgacgtaccaaacccccgcgaacttctccgtaaccaacgcgtctattaaattatcctctacaaacgccgcgtcgcgcgaccaccaacgctaatatatatatatatttttttcttctcccaacccaaaaaataacttttaaatataacgactccaccatcgtccccgacgaacaaaaaacgaaataccaacacttcatccaacaatacacaaataaaaaaacgcgcctacgaacgaatacgcgatcgttaaaaaattatctacacccgaaaaaccccgaccaaaacgaacccgaaaaaaaccgtaaccacataaaatacccctaaccataacgtaaaaa

SEQ ID NO: 27709 - DNA, 648 bp, Artificial Sequence
  chemically treated genomic DNA (Homo sapiens) CpG-island No: 27709
  misc_feature (227)..(227): n is either a, c, g or t
  misc_feature (263)..(263): n is either a, c, g or t
cgttaacgagacgagggcggtttatattattataaagagtaattagtcgaaagttataatatattcgtataacgacgttagaatagacgattagaaacgtcgtaatattatatagataggaagtacgaatatacgatataataaattaacgcgtatcgcggtataacgtaattacgagaacgaacgtatacgacgacgataaagaaataagcgcgtataaataacgnagcgagaaatcgttaaaagaacgaagtatagcgcgncgttaaattagcgtaacggaatagagaagattacgacgacgatcgataatcgtacgacgtatagtattcgcggcggaaagatagtaagaaggaataagattaggcgaaacgacgaaaaggagacgcgtagcgattcggaagttatacgacgaagtattaagcgtcgcgtagaaattataaaagagagaggaaacgcgtatataagtaagacgaaagtatagagttttagcgcgatattatacgtaaatatatattacgaaagaagtagcggcgtattacgtatacggttagacgagcgcgtaggtacggagtaataatagatatatacgtaaaagagaagtagaatagaacgaaagagaaatacgaaaatatatagatagttaaa

SEQ ID NO: 27710 - DNA, 648 bp, Artificial Sequence
  chemically treated genomic DNA (Homo sapiens) CpG-island No: 27710
  misc_feature (386)..(386): n is either a, c, g or t
  misc_feature (422)..(422): n is either a, c, g or t
tttaactatctatatattttcgtatttctctttcgttctattctacttctcttttacgtatatatctattattactccgtacctacgcgctcgtctaaccgtatacgtaatacgccgctacttctttcgtaatatatatttacgtataatatcgcgctaaaactctatactttcgtcttacttatatacgcgtttcctctctcttttataatttctacgcgacgcttaatacttcgtcgtataacttccgaatcgctacgcgtctccttttcgtcgtttcgcctaatcttattccttcttactatctttccgccgcgaatactatacgtcgtacgattatcgatcgtcgtcgtaatcttctctattccgttacgctaatttaacgncgcgctatacttcgttcttttaacgatttctcgctncgttatttatacgcgcttatttctttatcgtcgtcgtatacgttcgttctcgtaattacgttataccgcgatacgcgttaatttattatatcgtatattcgtacttcctatctatataatattacgacgtttctaatcgtctattctaacgtcgttatacgaatatattataactttcgactaattactctttataataatataaaccgccctcgtctcgttaacg

SEQ ID NO: 27711 - DNA, 648 bp, Artificial Sequence
  chemically treated genomic DNA (Homo sapiens) CpG-island No: 27711
  misc_feature (386)..(386): n is either a, c, g or t
  misc_feature (422)..(422): n is either a, c, g or t
tttggttgtttgtgtgttttcgtgtttttttttcgttttgttttgttttttttttgcgtgtgtgtttgttgttgtttcgtgtttgcgcgttcgtttggtcgtgtgcgtggtgcgtcgttgtttttttcgtggtgtgtgtttgcgtgtggtgtcgcgttggggttttgtgttttcgttttgtttgtgtgcgcgtttttttttttttttgtggtttttgcgcggcgtttggtgtttcgtcgtgtggttttcgggtcgttgcgcgtttttttttcgtcgtttcgtttggttttgtttttttttgttgttttttcgtcgcgggtgttgtgcgtcgtgcggttgtcggtcgtcgtcgtggttttttttgtttcgttgcgttggtttggcgncgcgttgtgtttcgtttttttggcggtttttcgttncgttgtttgtgcgcgtttgtttttttgtcgtcgtcgtgtgcgttcgttttcgtggttgcgttgtgtcgcggtgcgcgttggtttgttgtgtcgtgtgttcgtgttttttgtttgtgtggtgttgcggcgtttttggtcgtttgttttggcgtcgttgtgcgggtgtgttgtggttttcggttggttgttttttgtggtggtgtgggtcgttttcgtttcgttggcg

SEQ ID NO: 27712 - DNA, 648 bp, Artificial Sequence
  chemically treated genomic DNA (Homo sapiens) CpG-island No: 27712
  misc_feature (227)..(227): n is either a, c, g or t
  misc_feature (263)..(263): n is either a, c, g or t
cgccaacgaaacgaaaacgacccacaccaccacaaaaaacaaccaaccgaaaaccacaacacacccgcacaacgacgccaaaacaaacgaccaaaaacgccgcaacaccacacaaacaaaaaacacgaacacacgacacaacaaaccaacgcgcaccgcgacacaacgcaaccacgaaaacgaacgcacacgacgacgacaaaaaaacaaacgcgcacaaacaacgnaacgaaaaaccgccaaaaaaacgaaacacaacgcgncgccaaaccaacgcaacgaaacaaaaaaaaccacgacgacgaccgacaaccgcacgacgcacaacacccgcgacgaaaaaacaacaaaaaaaaacaaaaccaaacgaaacgacgaaaaaaaaacgcgcaacgacccgaaaaccacacgacgaaacaccaaacgccgcgcaaaaaccacaaaaaaaaaaaaaaacgcgcacacaaacaaaacgaaaacacaaaaccccaacgcgacaccacacgcaaacacacaccacgaaaaaaacaacgacgcaccacgcacacgaccaaacgaacgcgcaaacacgaaacaacaacaaacacacacgcaaaaaaaaaacaaaacaaaacgaaaaaaaaacacgaaaacacacaaacaaccaaa

SEQ ID NO: 27713 - DNA, 983 bp, Artificial Sequence
  chemically treated genomic DNA (Homo sapiens) CpG-island No: 27713
tcgtttttttatttttaataatattacgtatcgtttcgttattttttagtatttgcgtatcggtgtcgattagagcgggaaaattatcgttattttatatgaaagttggtttggaaatttgttcggcggtacgtcggaaacggcggtatagtaaagcgaattattttacgtcggggcgaatcgttatatcggtttgcggttcgttacgtttgatttgtcggaagggaacgttatgcgtgcgttcggcgaagttttcggtttgatggcgttcgaaatcgcgatcgacgaattggcggaaaaagcgggtatcgatttcgtcgagtttcgtattttgaatgatatttaggttgatttcgtcgattcgacgcgttgtttttttcgtcgttagtttatcgagtgtttgcgtatcggagcggataaatttggttggaagtagcgtaacgttattatcgggataggtgcgcgacggggagtggttagtcggttacggtgttgcggcgggttttcgtaataattttgttggaaaaatcgggtgttcgggtttatttcgaataaaacggtatcgttatcgtagaaacggatatgatcgatattggtatcggtagttatattattttggtttagacggtagcggaaatgtttggcgtatcgttggagtaggttgcggtttatttcggcgattttagtttttcggtttttgcgggttttggtggataatggggcgcgaatatttttattttcggcgtttacgtcgtttgtatgaagtttcgcgaaatgattgtttcggtagtcgggtttgattttgagtagtcgtagtttgtcgacggtaagattattaacggtattcgaagcgttacgttatatgaagttatcgtaggcggtagattgatagcggaagagagtattgaattcggaatattgagtaaagagtattagtagtcgatttttgtcgggtattttgtggaggtcggcgtgtatagcgt

SEQ ID NO: 27714 - DNA, 983 bp, Artificial Sequence
  chemically treated genomic DNA (Homo sapiens) CpG-island No: 27714
acgctatacacgccgacctccacaaaatacccgacaaaaatcgactactaatactctttactcaatattccgaattcaatactctcttccgctatcaatctaccgcctacgataacttcatataacgtaacgcttcgaataccgttaataatcttaccgtcgacaaactacgactactcaaaatcaaacccgactaccgaaacaatcatttcgcgaaacttcatacaaacgacgtaaacgccgaaaataaaaatattcgcgccccattatccaccaaaacccgcaaaaaccgaaaaactaaaatcgccgaaataaaccgcaacctactccaacgatacgccaaacatttccgctaccgtctaaaccaaaataatataactaccgataccaatatcgatcatatccgtttctacgataacgataccgttttattcgaaataaacccgaacacccgatttttccaacaaaattattacgaaaacccgccgcaacaccgtaaccgactaaccactccccgtcgcgcacctatcccgataataacgttacgctacttccaaccaaatttatccgctccgatacgcaaacactcgataaactaacgacgaaaaaaacaacgcgtcgaatcgacgaaatcaacctaaatatcattcaaaatacgaaactcgacgaaatcgatacccgctttttccgccaattcgtcgatcgcgatttcgaacgccatcaaaccgaaaacttcgccgaacgcacgcataacgttcccttccgacaaatcaaacgtaacgaaccgcaaaccgatataacgattcgccccgacgtaaaataattcgctttactataccgccgtttccgacgtaccgccgaacaaatttccaaaccaactttcatataaaataacgataattttcccgctctaatcgacaccgatacgcaaatactaaaaaataacgaaacgatacgtaatattattaaaaataaaaaaacga

SEQ ID NO: 27715 - DNA, 983 bp, Artificial Sequence
  chemically treated genomic DNA (Homo sapiens) CpG-island No: 27715
gcgttatgtacgtcgatttttataaaatgttcggtaaaggtcgattgttggtattttttgtttagtgtttcgaatttaatgttttttttcgttgttagtttgtcgtttgcggtggttttatgtagcgtggcgtttcgggtatcgttggtaattttgtcgtcggtaaattgcgattgtttaggattaaattcgattgtcgaggtaattatttcgcgaagttttatataggcggcgtaaacgtcggaggtggaggtattcgcgttttattgtttattagaattcgtagaaatcgggaaattggaatcgtcgaggtgaatcgtaatttgttttagcggtacgttaagtattttcgttgtcgtttgggttagaatggtgtagttgtcggtgttaatgtcggttatgttcgtttttacggtaacggtgtcgttttgttcgaggtgaattcgagtattcgatttttttagtaagattattgcgaaagttcgtcgtaatatcgtggtcgattagttatttttcgtcgcgtatttgtttcggtggtggcgttgcgttgtttttagttaaatttattcgtttcggtgcgtaagtattcgataagttgacggcgagagaagtagcgcgtcgggtcggcggggttaatttgagtgttatttaggatgcgaaattcgacgggatcgatgttcgtttttttcgttagttcgtcgatcgcgatttcgagcgttattagatcgggggtttcgtcgggcgtacgtatggcgttttttttcggtaaattaagcgtggcgagtcgtaggtcggtatgacgattcgtttcggcgtagagtaattcgttttgttgtatcgtcgttttcggcgtgtcgtcgggtaggtttttagattagtttttatgtgagatagcggtgattttttcgttttggtcggtatcgatacgtaagtgttgaagggtggcggggcggtgcgtggtgttattgggaatagaggggcgg

SEQ ID NO: 27716 - DNA, 983 bp, Artificial Sequence
  chemically treated genomic DNA (Homo sapiens) CpG-island No: 27716
ccgcccctctattcccaataacaccacgcaccgccccgccacccttcaacacttacgtatcgataccgaccaaaacgaaaaaatcaccgctatctcacataaaaactaatctaaaaacctacccgacgacacgccgaaaacgacgatacaacaaaacgaattactctacgccgaaacgaatcgtcataccgacctacgactcgccacgcttaatttaccgaaaaaaaacgccatacgtacgcccgacgaaacccccgatctaataacgctcgaaatcgcgatcgacgaactaacgaaaaaaacgaacatcgatcccgtcgaatttcgcatcctaaataacactcaaattaaccccgccgacccgacgcgctacttctctcgccgtcaacttatcgaatacttacgcaccgaaacgaataaatttaactaaaaacaacgcaacgccaccaccgaaacaaatacgcgacgaaaaataactaatcgaccacgatattacgacgaactttcgcaataatcttactaaaaaaatcgaatactcgaattcacctcgaacaaaacgacaccgttaccgtaaaaacgaacataaccgacattaacaccgacaactacaccattctaacccaaacgacaacgaaaatacttaacgtaccgctaaaacaaattacgattcacctcgacgattccaatttcccgatttctacgaattctaataaacaataaaacgcgaatacctccacctccgacgtttacgccgcctatataaaacttcgcgaaataattacctcgacaatcgaatttaatcctaaacaatcgcaatttaccgacgacaaaattaccaacgatacccgaaacgccacgctacataaaaccaccgcaaacgacaaactaacaacgaaaaaaaacattaaattcgaaacactaaacaaaaaataccaacaatcgacctttaccgaacattttataaaaatcgacgtacataacgc

SEQ ID NO: 27717 - DNA, 1151 bp, Artificial Sequence
  chemically treated genomic DNA (Homo sapiens) CpG-island No: 27717
tatgaatacggtcgagcgtagtttttttcgggtcgtttattttataggtcgggttcgcgacgtcgttatttttcgggatttttatatttggagagtttaatttcgttgggggcgttttcggcgacgtttcggttttatcgtttgttttaggagtaaacgtttcgtcgcggacgatcgagcggatttttcggggggcgtcgattttcgtcggttcgggcgagcgttcggggggttgggggcgttcgggaggtttttcgtcgcggttaatagtttcgtttagggttggtcgttgttcggcgttcgcgagggttcgtattgggcgtttttcgagtcggttcgcgatttttaaggtggtcgtcggggttcggtaggcgttttttttttcgtaaacgtttgttcgagcgcgcgtttcgtttcgagtgtttttagcgttcggttcgcggggcggcgcggcggcgggggttttacggggttttcggcggtcgaggcggcgtaggtcgtaggtttcgggtcggggggttttcgaaggtgtcgggtttcgggcggcgcgtttttttcgtcgcggtcgtcgcgcgtgtggaggaggcggagcggcgaggggggtttagtttatttaaggtcgcggtagtaagtgtcgttattcgcgtttttttcgtcgtttcgcgttttattcgcgggcgtttcgggtcgtttttttttttcgcgttcgatacgtcgtcgttattttgtttatttttttttttttttttgcgtcgtcgcggatatcgtacgttcggtcgtagggtacgttttttcgcgaggacgacgtgtttattcgttggttgaatttgttattttcggttttttgttcgtttcgtcgtcgttgacgattggagcgtttggattcggtcgggcgttcgagcggcgattggtcggcgtttggtttcgttcgaggggtggatatagcgcgtttattggttttcggagacgttcgttacgggtagggggcgggaagtaggtatggggagacgaggttacggttgtgatttcggtggggttcgggaagggggtcgtaggttacgggtgttaacggtttttttgaacggtcgtagggtgggttgagttcggtgggcgggaatttgggtttgcggatttggaaggagcggggttat

SEQ ID NO: 27718 - DNA, 1151 bp, Artificial Sequence
  chemically treated genomic DNA (Homo sapiens) CpG-island No: 27718
ataaccccgctccttccaaatccgcaaacccaaattcccgcccaccgaactcaacccaccctacgaccgttcaaaaaaaccgttaacacccgtaacctacgacccccttcccgaaccccaccgaaatcacaaccgtaacctcgtctccccatacctacttcccgccccctacccgtaacgaacgtctccgaaaaccaataaacgcgctatatccacccctcgaacgaaaccaaacgccgaccaatcgccgctcgaacgcccgaccgaatccaaacgctccaatcgtcaacgacgacgaaacgaacaaaaaaccgaaaataacaaattcaaccaacgaataaacacgtcgtcctcgcgaaaaaacgtaccctacgaccgaacgtacgatatccgcgacgacgcaaaaaaaaaaaaaaaaataaacaaaataacgacgacgtatcgaacgcgaaaaaaaaaaacgacccgaaacgcccgcgaataaaacgcgaaacgacgaaaaaaacgcgaataacgacacttactaccgcgaccttaaataaactaaacccccctcgccgctccgcctcctccacacgcgcgacgaccgcgacgaaaaaaacgcgccgcccgaaacccgacaccttcgaaaaccccccgacccgaaacctacgacctacgccgcctcgaccgccgaaaaccccgtaaaacccccgccgccgcgccgccccgcgaaccgaacgctaaaaacactcgaaacgaaacgcgcgctcgaacaaacgtttacgaaaaaaaaaacgcctaccgaaccccgacgaccaccttaaaaatcgcgaaccgactcgaaaaacgcccaatacgaaccctcgcgaacgccgaacaacgaccaaccctaaacgaaactattaaccgcgacgaaaaacctcccgaacgcccccaaccccccgaacgctcgcccgaaccgacgaaaatcgacgccccccgaaaaatccgctcgatcgtccgcgacgaaacgtttactcctaaaacaaacgataaaaccgaaacgtcgccgaaaacgcccccaacgaaattaaactctccaaatataaaaatcccgaaaaataacgacgtcgcgaacccgacctataaaataaacgacccgaaaaaaactacgctcgaccgtattcata

SEQ ID NO: 27719 - DNA, 1151 bp, Artificial Sequence
  chemically treated genomic DNA (Homo sapiens) CpG-island No: 27719
gtggtttcgttttttttaggttcgtaagtttaggttttcgtttatcgggtttagtttattttgcggtcgtttagggaggtcgttggtattcgtgatttacgatttttttttcgagttttatcgaggttatagtcgtggtttcgtttttttatgtttgtttttcgttttttgttcgtgacgggcgttttcgaggattaatgagcgcgttgtatttatttttcgggcggggttaagcgtcgattaatcgtcgttcgggcgttcggtcgggtttaaacgttttaatcgttagcggcggcggggcgggtagagggtcggggatggtaggtttaattaacgggtgggtacgtcgttttcgcgaggaggcgtgttttgcggtcgggcgtgcggtgttcgcggcggcgtagggagggggagggaggtaaataagatggcggcggcgtgtcgggcgcggaagggggaggcggttcggggcgttcgcgagtgaggcgcggggcggcgaagggagcgcgggtggcggtatttgttgtcgcggttttggatgggttgggtttttttcgtcgtttcgttttttttatacgcgcggcggtcgcggcgagggggacgcgtcgttcggggttcggtattttcgggaatttttcggttcggagtttgcggtttgcgtcgtttcggtcgtcgggagtttcgtggagttttcgtcgtcgcgtcgtttcgcggatcggacgttgagggtattcggggcggggcgcgcgttcgggtagacgtttgcggggaggggggcgtttgtcgggtttcggcgattattttgggggtcgcgggtcggttcggggggcgtttagtgcgggttttcgcgggcgtcgggtagcgattagttttgagcggagttgttggtcgcggcgggaggtttttcggacgtttttagtttttcgaacgttcgttcgggtcggcgggagtcggcgtttttcgggaggttcgttcggtcgttcgcggcggagcgtttgtttttgggataggcggtgggatcggggcgtcgtcggagacgtttttagcgaagttgggttttttaggtgtgggggtttcggggggtagcgacgtcgcggattcggtttgtgggatgggcggttcggagaagattgcgttcggtcgtgtttata

SEQ ID NO: 27720 - DNA, 1151 bp, Artificial Sequence
  chemically treated genomic DNA (Homo sapiens) CpG-island No: 27720
tataaacacgaccgaacgcaatcttctccgaaccgcccatcccacaaaccgaatccgcgacgtcgctaccccccgaaacccccacacctaaaaaacccaacttcgctaaaaacgtctccgacgacgccccgatcccaccgcctatcccaaaaacaaacgctccgccgcgaacgaccgaacgaacctcccgaaaaacgccgactcccgccgacccgaacgaacgttcgaaaaactaaaaacgtccgaaaaacctcccgccgcgaccaacaactccgctcaaaactaatcgctacccgacgcccgcgaaaacccgcactaaacgccccccgaaccgacccgcgacccccaaaataatcgccgaaacccgacaaacgcccccctccccgcaaacgtctacccgaacgcgcgccccgccccgaataccctcaacgtccgatccgcgaaacgacgcgacgacgaaaactccacgaaactcccgacgaccgaaacgacgcaaaccgcaaactccgaaccgaaaaattcccgaaaataccgaaccccgaacgacgcgtccccctcgccgcgaccgccgcgcgtataaaaaaaacgaaacgacgaaaaaaacccaacccatccaaaaccgcgacaacaaataccgccacccgcgctcccttcgccgccccgcgcctcactcgcgaacgccccgaaccgcctcccccttccgcgcccgacacgccgccgccatcttatttacctccctccccctccctacgccgccgcgaacaccgcacgcccgaccgcaaaacacgcctcctcgcgaaaacgacgtacccacccgttaattaaacctaccatccccgaccctctacccgccccgccgccgctaacgattaaaacgtttaaacccgaccgaacgcccgaacgacgattaatcgacgcttaaccccgcccgaaaaataaatacaacgcgctcattaatcctcgaaaacgcccgtcacgaacaaaaaacgaaaaacaaacataaaaaaacgaaaccacgactataacctcgataaaactcgaaaaaaaaatcgtaaatcacgaataccaacgacctccctaaacgaccgcaaaataaactaaacccgataaacgaaaacctaaacttacgaacctaaaaaaaacgaaaccac

SEQ ID NO: 27721 - DNA, 508 bp, Artificial Sequence
  chemically treated genomic DNA (Homo sapiens) CpG-island No: 27721
gcgtataacgttaggtttgcggcgattacgcgaagtggcgcgggggagtttggtagtttcgagtttaatttttaggaaagatgagttgtgaggcgtttttttttacgtcgttagttcgcggatcgttgttattcgtcgttatcgtcgcgtcgcgtcgcgcgttattattagcgtcgtcggaagtagaagcgcggagtaacggtcgcggaaggggcgtggtttcgggaggggtttcgaggggtgggcggggtcgggagtgcgagtcggacggggcgtagcgaggggatcggttggtgaggttttggaggtttttcgttatcgaggggcgttttgtattttttttttttttttatgtttttcgtcgcgtagacgttttggggtaggtttttacgtttttttggacggaggaggttagatgagatgtaggaacgtttgttgatggagagtagggtagtcggtttcgaaagtatcgggtttaattttttttatcgatttaaatttttaaaat

SEQ ID NO: 27722 - DNA, 508 bp, Artificial Sequence
  chemically treated genomic DNA (Homo sapiens) CpG-island No: 27722
attttaaaaatttaaatcgataaaaaaaattaaacccgatactttcgaaaccgactaccctactctccatcaacaaacgttcctacatctcatctaacctcctccgtccaaaaaaacgtaaaaacctaccccaaaacgtctacgcgacgaaaaacataaaaaaaaaaaaaaaatacaaaacgcccctcgataacgaaaaacctccaaaacctcaccaaccgatcccctcgctacgccccgtccgactcgcactcccgaccccgcccacccctcgaaacccctcccgaaaccacgccccttccgcgaccgttactccgcgcttctacttccgacgacgctaataataacgcgcgacgcgacgcgacgataacgacgaataacaacgatccgcgaactaacgacgtaaaaaaaaacgcctcacaactcatctttcctaaaaattaaactcgaaactaccaaactcccccgcgccacttcgcgtaatcgccgcaaacctaacgttatacgc

SEQ ID NO: 27723 - DNA, 508 bp, Artificial Sequence
  chemically treated genomic DNA (Homo sapiens) CpG-island No: 27723
attttagaagtttaagtcggtgaaggaaattggattcggtattttcggagtcggttgttttgttttttattagtaggcgtttttgtattttatttgatttttttcgtttagaaaggcgtagggatttgttttaggacgtttgcgcggcgaggagtatgggagaagagagggagtgtagggcgtttttcggtggcggggagtttttaggattttattaatcggttttttcgttgcgtttcgttcggttcgtattttcggtttcgtttatttttcggggtttttttcgagattacgtttttttcgcggtcgttgtttcgcgtttttgttttcggcggcgttggtggtggcgcgcggcgcggcgcggcgatggcggcgggtggtagcgattcgcgggttggcgacgtagaggaggacgttttatagtttattttttttaaaggttgggttcggggttgttagattttttcgcgttatttcgcgtggtcgtcgtaggtttggcgttatgcgt

SEQ ID NO: 27724 - DNA, 508 bp, Artificial Sequence
  chemically treated genomic DNA (Homo sapiens) CpG-island No: 27724
acgcataacgccaaacctacgacgaccacgcgaaataacgcgaaaaaatctaacaaccccgaacccaacctttaaaaaaaataaactataaaacgtcctcctctacgtcgccaacccgcgaatcgctaccacccgccgccatcgccgcgccgcgccgcgcgccaccaccaacgccgccgaaaacaaaaacgcgaaacaacgaccgcgaaaaaaacgtaatctcgaaaaaaaccccgaaaaataaacgaaaccgaaaatacgaaccgaacgaaacgcaacgaaaaaaccgattaataaaatcctaaaaactccccgccaccgaaaaacgccctacactccctctcttctcccatactcctcgccgcgcaaacgtcctaaaacaaatccctacgcctttctaaacgaaaaaaatcaaataaaatacaaaaacgcctactaataaaaaacaaaacaaccgactccgaaaataccgaatccaatttccttcaccgacttaaacttctaaaat

SEQ ID NO: 27725 - DNA, 954 bp, Artificial Sequence
  chemically treated genomic DNA (Homo sapiens) CpG-island No: 27725
aaaaagagaagaggaggaggagaaagtgcgcgtgtgaagagtgttaagaaaacgataggatagagcggggaggggaaaagcgggtcgagggatagggtgaaaggtgagaaacgagggtatgaggaaagagggttcggggcgttggggagttggggagacgatggagcgacgggtagagtagtttgggtcgagtcgcgggggtggaatttagacgtcgggcgggggagggggcggcggggcggcgggacggtgggtgggggttattaggcggcgtcggagattattaaattttatagcgagcgagtttgttttttggagggagtgtagataaggattaggagcgggagtcgagtttcgcggttcggggtacggcgtcgttcgttttttttcggtagtgtttttcgattttttgtttttcgttgggatatggtttgaggtttcgttcgtcgttcgggatttttttttttcgttgttttcggattttcgttttaggatcgcggggttttttttcggtttcgtcgttcgtttcggcgagaataggttcggcgggtaaggcggcggcggatcgagggaggtttggttcggtagcggggagaagggtgcggcgtagttcgagttttttatttttttttttggtttagacgcggttggggcggacgggatttttcgcgttttgttttttttttttgttttatggagttatgcgtttgggtgggggttttcgagagaagttggtttgcgggcgggtcggacgcgttgcgcggacggggcggggcgaaggaggtcggcgggcggaggaggaagcggcggggcggcggcggcggcggcggtcgggaagaattagaggtatttttcgggcggttggaggattgagtcgagtcgggattcgagtttttcggtattttagtagttatcggaggtagtgaggtaatggaggaagaatgtagggagttt

SEQ ID NO: 27726 - DNA, 954 bp, Artificial Sequence
  chemically treated genomic DNA (Homo sapiens) CpG-island No: 27726
aaactccctacattcttcctccattacctcactacctccgataactactaaaataccgaaaaactcgaatcccgactcgactcaatcctccaaccgcccgaaaaatacctctaattcttcccgaccgccgccgccgccgccgccccgccgcttcctcctccgcccgccgacctccttcgccccgccccgtccgcgcaacgcgtccgacccgcccgcaaaccaacttctctcgaaaacccccacccaaacgcataactccataaaacaaaaaaaaaaaacaaaacgcgaaaaatcccgtccgccccaaccgcgtctaaaccaaaaaaaaaaataaaaaactcgaactacgccgcacccttctccccgctaccgaaccaaacctccctcgatccgccgccgccttacccgccgaacctattctcgccgaaacgaacgacgaaaccgaaaaaaaaccccgcgatcctaaaacgaaaatccgaaaacaacgaaaaaaaaaaatcccgaacgacgaacgaaacctcaaaccatatcccaacgaaaaacaaaaaatcgaaaaacactaccgaaaaaaaacgaacgacgccgtaccccgaaccgcgaaactcgactcccgctcctaatccttatctacactccctccaaaaaacaaactcgctcgctataaaatttaataatctccgacgccgcctaataacccccacccaccgtcccgccgccccgccgccccctcccccgcccgacgtctaaattccacccccgcgactcgacccaaactactctacccgtcgctccatcgtctccccaactccccaacgccccgaaccctctttcctcataccctcgtttctcacctttcaccctatccctcgacccgcttttcccctccccgctctatcctatcgttttcttaacactcttcacacgcgcactttctcctcctcctcttctcttttt

SEQ ID NO: 27727 - DNA, 954 bp, Artificial Sequence
  chemically treated genomic DNA (Homo sapiens) CpG-island No: 27727
ggattttttatattttttttttattattttattgttttcggtggttgttgggatatcggaggattcgggtttcggttcgatttagttttttagtcgttcggggaatatttttagtttttttcggtcgtcgtcgtcgtcgtcgtttcgtcgttttttttttcgttcgtcggtttttttcgtttcgtttcgttcgcgtagcgcgttcggttcgttcgtaggttagtttttttcgggagtttttatttaggcgtatggttttatgaagtaagaggaggaggtagagcgcgagaggtttcgttcgttttagtcgcgtttgggttaggagaaaaggtgggaaattcgggttgcgtcgtattttttttttcgttgtcgggttaggtttttttcggttcgtcgtcgttttgttcgtcgggtttgttttcgtcggggcgggcggcggggtcgggaagagatttcgcggttttggggcgagggttcgggggtagcgggggggaggagtttcgggcggcgggcggggttttaggttatgttttagcggagggtagggggtcgggaggtattgtcggggaggggcgggcggcgtcgtgtttcgggtcgcgaggttcggttttcgtttttggtttttgtttgtattttttttaggaagtaggttcgttcgttgtaaagtttggtggttttcggcgtcgtttggtggtttttatttatcgtttcgtcgtttcgtcgttttttttttcgttcggcgtttggattttattttcgcggttcggtttaagttgttttattcgtcgttttatcgtttttttaattttttagcgtttcggattttttttttttatattttcgttttttattttttattttgtttttcggttcgtttttttttttttcgttttgttttgtcgtttttttaatattttttatacgcgtatttttttttttttttttttttttttt

SEQ ID NO: 27728 - DNA, 954 bp, Artificial Sequence
  chemically treated genomic DNA (Homo sapiens) CpG-island No: 27728
aaaaaaaaaaaaaaaaaaaaaaaaaatacgcgtataaaaaatattaaaaaaacgacaaaacaaaacgaaaaaaaaaaaaacgaaccgaaaaacaaaataaaaaataaaaaacgaaaatataaaaaaaaaaaatccgaaacgctaaaaaattaaaaaaacgataaaacgacgaataaaacaacttaaaccgaaccgcgaaaataaaatccaaacgccgaacgaaaaaaaaaacgacgaaacgacgaaacgataaataaaaaccaccaaacgacgccgaaaaccaccaaactttacaacgaacgaacctacttcctaaaaaaaatacaaacaaaaaccaaaaacgaaaaccgaacctcgcgacccgaaacacgacgccgcccgcccctccccgacaatacctcccgaccccctaccctccgctaaaacataacctaaaaccccgcccgccgcccgaaactcctcccccccgctacccccgaaccctcgccccaaaaccgcgaaatctcttcccgaccccgccgcccgccccgacgaaaacaaacccgacgaacaaaacgacgacgaaccgaaaaaaacctaacccgacaacgaaaaaaaaaatacgacgcaacccgaatttcccaccttttctcctaacccaaacgcgactaaaacgaacgaaacctctcgcgctctacctcctcctcttacttcataaaaccatacgcctaaataaaaactcccgaaaaaaactaacctacgaacgaaccgaacgcgctacgcgaacgaaacgaaacgaaaaaaaccgacgaacgaaaaaaaaaacgacgaaacgacgacgacgacgacgaccgaaaaaaactaaaaatattccccgaacgactaaaaaactaaatcgaaccgaaacccgaatcctccgatatcccaacaaccaccgaaaacaataaaataataaaaaaaaaatataaaaaatcc

SEQ ID NO: 27729 - DNA, 678 bp, Artificial Sequence
  chemically treated genomic DNA (Homo sapiens) CpG-island No: 27729
tttattcgtgcgttttattggttggtgttggttttacggggttgaattttggacgttgtttgttattcgtgggatcgagttttaggtagttggaataaagagagatatcgggggaaagtcgcgagaaggttagcgtttttggttgggagtagagttagtcgagtagggcgttcggttgttaaaattggtcggcgtagtgtacgttgggtcgtttcggagcggtcgtagagttcgtcgggagtcgtagttcgggacgggttcgtagtattgttcgcgacgtagttcgggattcgcgtcgggttgtcggtcgggttgttgttaggtatcgtcgagcgttagttatttagtattgagttgttagcggttgttttttttaagtattttcgtttacgtcgtttcgtttcgtttcgtttgatcggtcgtagttttggatattagttttaaatcgagtcgattacggtttagtttcgttcgcggcgaagtgcgcggggttcggtgttagtcgttcgtttttggtcgggttagttttttgatgtatcggggacggcgcgtttattcgatttttcgaggggcggtagggttttatttgtgtttttcgttttcgagtttttagttagagttggttttagcggaatatttattgtgtaggattatttaataagtcgattgattatattt

SEQ ID NO: 27730 - DNA, 678 bp, Artificial Sequence
  chemically treated genomic DNA (Homo sapiens) CpG-island No: 27730
aaatataatcaatcgacttattaaataatcctacacaataaatattccgctaaaaccaactctaactaaaaactcgaaaacgaaaaacacaaataaaaccctaccgcccctcgaaaaatcgaataaacgcgccgtccccgatacatcaaaaaactaacccgaccaaaaacgaacgactaacaccgaaccccgcgcacttcgccgcgaacgaaactaaaccgtaatcgactcgatttaaaactaatatccaaaactacgaccgatcaaacgaaacgaaacgaaacgacgtaaacgaaaatacttaaaaaaaacaaccgctaacaactcaatactaaataactaacgctcgacgatacctaacaacaacccgaccgacaacccgacgcgaatcccgaactacgtcgcgaacaatactacgaacccgtcccgaactacgactcccgacgaactctacgaccgctccgaaacgacccaacgtacactacgccgaccaattttaacaaccgaacgccctactcgactaactctactcccaaccaaaaacgctaaccttctcgcgactttcccccgatatctctctttattccaactacctaaaactcgatcccacgaataacaaacaacgtccaaaattcaaccccgtaaaaccaacaccaaccaataaaacgcacgaataaa

SEQ ID NO: 27731 - DNA, 678 bp, Artificial Sequence
  chemically treated genomic DNA (Homo sapiens) CpG-island No: 27731
gaatgtgattaatcggtttgttgaataattttgtatagtaggtatttcgttgaagttaattttagttgggggttcgagagcgaaagatatagatggggttttgtcgtttttcgaagagtcggatgggcgcgtcgttttcggtgtattaagaggttggttcggttaggggcgagcggttggtatcgaatttcgcgtatttcgtcgcgggcggggttgggtcgtagtcggttcgatttaaggttggtatttaaggttgcggtcggttaggcgaggcgaggcgaggcgacgtgagcgagggtgtttagggagaatagtcgttggtagtttaatgttgggtggttaacgttcgacggtgtttggtagtaattcggtcgataattcgacgcggatttcgagttgcgtcgcggataatgttgcgggttcgtttcggattacgattttcgacgggttttgcgatcgtttcggggcggtttagcgtgtattgcgtcggttagttttgatagtcgggcgttttattcggttagttttgtttttagttagggacgttggttttttcgcggttttttttcgatgtttttttttattttagttgtttgaaattcggttttacgaatggtaggtagcgtttaaaatttaatttcgtaaagttagtattagttaataaagcgtacggatgga

SEQ ID NO: 27732 - DNA, 678 bp, Artificial Sequence
  chemically treated genomic DNA (Homo sapiens) CpG-island No: 27732
tccatccgtacgctttattaactaatactaactttacgaaattaaattttaaacgctacctaccattcgtaaaaccgaatttcaaacaactaaaataaaaaaaaacatcgaaaaaaaaccgcgaaaaaaccaacgtccctaactaaaaacaaaactaaccgaataaaacgcccgactatcaaaactaaccgacgcaatacacgctaaaccgccccgaaacgatcgcaaaacccgtcgaaaatcgtaatccgaaacgaacccgcaacattatccgcgacgcaactcgaaatccgcgtcgaattatcgaccgaattactaccaaacaccgtcgaacgttaaccacccaacattaaactaccaacgactattctccctaaacaccctcgctcacgtcgcctcgcctcgcctcgcctaaccgaccgcaaccttaaataccaaccttaaatcgaaccgactacgacccaaccccgcccgcgacgaaatacgcgaaattcgataccaaccgctcgcccctaaccgaaccaacctcttaatacaccgaaaacgacgcgcccatccgactcttcgaaaaacgacaaaaccccatctatatctttcgctctcgaacccccaactaaaattaacttcaacgaaatacctactatacaaaattattcaacaaaccgattaatcacattc

SEQ ID NO: 27733 - DNA, 514 bp, Artificial Sequence
  chemically treated genomic DNA (Homo sapiens) CpG-island No: 27733
cggcgagttcgttgtttttttttgagtgtgtttgcgcgtaagtcggggagcgggtgagtgtatcggtcgttgtagttagttcggcgggttcggagtcgggagcgggggttttgggaatttcgatttgggggtgggcggtgggcgggcggcggcgttttggcgcggttgggatgtattttgagcggcgtttttcgttgtagcgcgcgggcggttcgagtttcggcggcggcggtagcggcggcggcgacgttgatattttttattatggatagtttcgatttagttttgttttaggaatgggatttcgagttattgtggtaagttttcgtgtcggtcgtttcgggcgggcgggagcgggcgaggggcggcgcgcggttcgcgcggtttttatttgggtcgggggttatcggcggtcggtcgtcgtgggggtggggtgggtcgggggcgtttgtttcgttagtttttttttgttttttcgggtgggatgcgtggtcgtttgttcgtttgttttttt

SEQ ID NO: 27734 - DNA, 514 bp, Artificial Sequence
  chemically treated genomic DNA (Homo sapiens) CpG-island No: 27734
aaaaaaacaaacgaacaaacgaccacgcatcccacccgaaaaaacaaaaaaaaactaacgaaacaaacgcccccgacccaccccacccccacgacgaccgaccgccgataacccccgacccaaataaaaaccgcgcgaaccgcgcgccgcccctcgcccgctcccgcccgcccgaaacgaccgacacgaaaacttaccacaataactcgaaatcccattcctaaaacaaaactaaatcgaaactatccataataaaaaatatcaacgtcgccgccgccgctaccgccgccgccgaaactcgaaccgcccgcgcgctacaacgaaaaacgccgctcaaaatacatcccaaccgcgccaaaacgccgccgcccgcccaccgcccacccccaaatcgaaattcccaaaacccccgctcccgactccgaacccgccgaactaactacaacgaccgatacactcacccgctccccgacttacgcgcaaacacactcaaaaaaaaacaacgaactcgccg

SEQ ID NO: 27735 - DNA, 514 bp, Artificial Sequence
  chemically treated genomic DNA (Homo sapiens) CpG-island No: 27735
ggggaaatagacgggtaggcggttacgtattttattcggggaggtagaaaagggttggcgaggtaggcgttttcgatttattttatttttacggcggtcggtcgtcggtagttttcggtttaggtgaggatcgcgcgggtcgcgcgtcgtttttcgttcgttttcgttcgttcgaagcggtcggtacggggatttattatagtgattcgaggttttatttttggagtagggttaagtcgaagttgtttatggtgggaggtgttagcgtcgtcgtcgtcgttatcgtcgtcgtcgaggttcgggtcgttcgcgcgttgtaacgaaaggcgtcgtttaaggtgtattttagtcgcgttagagcgtcgtcgttcgtttatcgtttatttttaggtcggggtttttaaggttttcgttttcgatttcgggttcgtcgggttggttgtagcggtcggtgtatttattcgtttttcggtttgcgcgtaggtatatttaagagagagtagcgagttcgtcg

SEQ ID NO: 27736 - DNA, 514 bp, Artificial Sequence
  chemically treated genomic DNA (Homo sapiens) CpG-island No: 27736
cgacgaactcgctactctctcttaaatatacctacgcgcaaaccgaaaaacgaataaatacaccgaccgctacaaccaacccgacgaacccgaaatcgaaaacgaaaaccttaaaaaccccgacctaaaaataaacgataaacgaacgacgacgctctaacgcgactaaaatacaccttaaacgacgcctttcgttacaacgcgcgaacgacccgaacctcgacgacgacgataacgacgacgacgacgctaacacctcccaccataaacaacttcgacttaaccctactccaaaaataaaacctcgaatcactataataaatccccgtaccgaccgcttcgaacgaacgaaaacgaacgaaaaacgacgcgcgacccgcgcgatcctcacctaaaccgaaaactaccgacgaccgaccgccgtaaaaataaaataaatcgaaaacgcctacctcgccaacccttttctacctccccgaataaaatacgtaaccgcctacccgtctatttcccc

SEQ ID NO: 27737 - DNA, 652 bp, Artificial Sequence
  chemically treated genomic DNA (Homo sapiens) CpG-island No: 27737
tcggttgcgggcgcgggggttcgggggtagatcgagagaattttttttgggcgagggtatttttcggatcgttagcgggagggtagggaagacgggagaggaaaggaaagggtttttggttcggtaagagggcggagggtcgttgttttgcggcgtggagaagcggggttcggcgtcgggtatatcgtttttttcgggggtggtagcggtcggtcgtacgttttttgtaagttagaggcggcgataagtcggttggggttcgggagtacgtttttttttcgagtttggttttgagggagggcgtaggttgtcgaggcggtaattttttttttcgtttaatttcggagagcgtgaggtcggtcggtttcgggttgtcgcgcggggatgttcgtcgttcgggtgggggaggcgcgaggtcggtttcggttcgttttttttttacgcggtcgcgttcggcggttcgttcgcgttttttttttcgttcgcgtcgtcgcggggtcgggtcgtcgatttcggtcggtcgggcgtggggttaggcggcgacggcggcgggcgtgtcggcggtttggggttttatttgaggttgtgtattagttttcggcgtgattggtttttcggtagattattcggttggatattttggtgtttgtgt

SEQ ID NO: 27738 - DNA, 652 bp, Artificial Sequence
  chemically treated genomic DNA (Homo sapiens) CpG-island No: 27738
acacaaacaccaaaatatccaaccgaataatctaccgaaaaaccaatcacgccgaaaactaatacacaacctcaaataaaaccccaaaccgccgacacgcccgccgccgtcgccgcctaaccccacgcccgaccgaccgaaatcgacgacccgaccccgcgacgacgcgaacgaaaaaaaaaacgcgaacgaaccgccgaacgcgaccgcgtaaaaaaaaaacgaaccgaaaccgacctcgcgcctcccccacccgaacgacgaacatccccgcgcgacaacccgaaaccgaccgacctcacgctctccgaaattaaacgaaaaaaaaaattaccgcctcgacaacctacgccctccctcaaaaccaaactcgaaaaaaaaacgtactcccgaaccccaaccgacttatcgccgcctctaacttacaaaaaacgtacgaccgaccgctaccacccccgaaaaaaacgatatacccgacgccgaaccccgcttctccacgccgcaaaacaacgaccctccgccctcttaccgaaccaaaaaccctttcctttcctctcccgtcttccctaccctcccgctaacgatccgaaaaataccctcgcccaaaaaaaattctctcgatctacccccgaacccccgcgcccgcaaccga

SEQ ID NO: 27739 - DNA, 652 bp, Artificial Sequence
  chemically treated genomic DNA (Homo sapiens) CpG-island No: 27739
gtataggtattaagatgtttaatcgagtggtttgtcgagaagttagttacgtcgggagttggtatatagttttaggtagggttttaggtcgtcggtacgttcgtcgtcgtcgtcgtttggttttacgttcggtcggtcgaggtcggcggttcggtttcgcggcggcgcgggcggggaagagggcgcggacgggtcgtcgggcgcgatcgcgtggggagggagcgagtcgaggtcggtttcgcgttttttttattcgggcggcgggtattttcgcgcggtagttcggggtcggtcggttttacgtttttcggagttgggcgagagggagagttgtcgtttcggtagtttgcgtttttttttaggattaggttcgaggaaggaacgtgttttcggattttagtcgatttgtcgtcgtttttggtttgtaggaagcgtgcggtcggtcgttgttattttcgggaaggacggtgtgttcggcgtcgagtttcgtttttttacgtcgtagggtagcgatttttcgtttttttgtcgagttagggattttttttttttttttttcgttttttttgttttttcgttggcggttcggggagtgttttcgtttagagggagttttttcggtttgttttcgagttttcgcgttcgtagtcgg

SEQ ID NO: 27740 - DNA, 652 bp, Artificial Sequence
  chemically treated genomic DNA (Homo sapiens) CpG-island No: 27740
ccgactacgaacgcgaaaactcgaaaacaaaccgaaaaaactccctctaaacgaaaacactccccgaaccgccaacgaaaaaacaaaaaaaacgaaaaaaaaaaaaaaaaaatccctaactcgacaaaaaaacgaaaaatcgctaccctacgacgtaaaaaaacgaaactcgacgccgaacacaccgtccttcccgaaaataacaacgaccgaccgcacgcttcctacaaaccaaaaacgacgacaaatcgactaaaatccgaaaacacgttccttcctcgaacctaatcctaaaaaaaaacgcaaactaccgaaacgacaactctccctctcgcccaactccgaaaaacgtaaaaccgaccgaccccgaactaccgcgcgaaaatacccgccgcccgaataaaaaaaacgcgaaaccgacctcgactcgctccctccccacgcgatcgcgcccgacgacccgtccgcgccctcttccccgcccgcgccgccgcgaaaccgaaccgccgacctcgaccgaccgaacgtaaaaccaaacgacgacgacgacgaacgtaccgacgacctaaaaccctacctaaaactatataccaactcccgacgtaactaacttctcgacaaaccactcgattaaacatcttaatacctatac

SEQ ID NO: 27741 - DNA, 587 bp, Artificial Sequence
  chemically treated genomic DNA (Homo sapiens) CpG-island No: 27741
gtttcggagcggattgtagggttcgcggggcggcgggagttataaagttattgtgtaaaaatttattagtttcgggaagtcggagtgggggtgttaggtttttcgttttagtcgtcgaggatttcgggggcgggggagttgtaagtttttcgagagggagcggagatcgtcgggaggttattcgtacgtttttggttttcggagttgttattagttcgtcgattttaggcgtgcgttcgttagttcgtagtagtttttgttttttttttattttaataagtagggaagtttcgcgttttaacgtcgaaaggttagcgagtcgttgtattttacgttaagtttatttaataagcgttttcgttcgtatttttagtttcgggttttacgttgtttttgaggggtattttcgttttatttcgcgattaaatttattcgtttgggttgtgttttttcggttatttttttgtttatttagacgtttgtttcgcggcgggtagttttgttttttttatttttttgttcgttcgttttttttttttatattttcggagatcgtttgatttggggagggggggcggttagagatg

SEQ ID NO: 27742 - DNA, 587 bp, Artificial Sequence
  chemically treated genomic DNA (Homo sapiens) CpG-island No: 27742
catctctaaccgccccccctccccaaatcaaacgatctccgaaaatataaaaaaaaaaaacgaacgaacaaaaaaataaaaaaaacaaaactacccgccgcgaaacaaacgtctaaataaacaaaaaaataaccgaaaaaacacaacccaaacgaataaatttaatcgcgaaataaaacgaaaatacccctcaaaaacaacgtaaaacccgaaactaaaaatacgaacgaaaacgcttattaaataaacttaacgtaaaatacaacgactcgctaacctttcgacgttaaaacgcgaaacttccctacttattaaaataaaaaaaaaacaaaaactactacgaactaacgaacgcacgcctaaaatcgacgaactaataacaactccgaaaaccaaaaacgtacgaataacctcccgacgatctccgctccctctcgaaaaacttacaactcccccgcccccgaaatcctcgacgactaaaacgaaaaacctaacacccccactccgacttcccgaaactaataaatttttacacaataactttataactcccgccgccccgcgaaccctacaatccgctccgaaac

SEQ ID NO: 27743 - DNA, 587 bp, Artificial Sequence
  chemically treated genomic DNA (Homo sapiens) CpG-island No: 27743
tatttttagtcgttttttttttttaaattaggcgattttcggagatgtgaagaaggggggcgagcggataggaagatgaagggagtaaagttgttcgtcgcgggataggcgtttaggtgaataagaaaatgatcgaagaaatatagtttagacgagtaagtttggtcgcggggtggaacgagggtgttttttaggagtagcgtggggttcggggttgaggatgcggacggagacgtttattgggtgaatttggcgtggggtgtagcgattcgttgatttttcggcgttgggacgcgaggtttttttgtttgttgaagtgaggagagggtaaaaattgttgcgggttggcgggcgtacgtttagggtcggcgggttggtggtagtttcgggggttaagggcgtgcgggtgatttttcggcggttttcgttttttttcggaggatttatagttttttcgttttcgaaattttcggcggttagagcggaagatttgatatttttatttcggtttttcggggttggtgggtttttgtatagtgattttgtgattttcgtcgtttcgcgagttttgtagttcgtttcggagt

SEQ ID NO: 27744 - DNA, 587 bp, Artificial Sequence
  chemically treated genomic DNA (Homo sapiens) CpG-island No: 27744
actccgaaacgaactacaaaactcgcgaaacgacgaaaatcacaaaatcactatacaaaaacccaccaaccccgaaaaaccgaaataaaaatatcaaatcttccgctctaaccgccgaaaatttcgaaaacgaaaaaactataaatcctccgaaaaaaaacgaaaaccgccgaaaaatcacccgcacgcccttaacccccgaaactaccaccaacccgccgaccctaaacgtacgcccgccaacccgcaacaatttttaccctctcctcacttcaacaaacaaaaaaacctcgcgtcccaacgccgaaaaatcaacgaatcgctacaccccacgccaaattcacccaataaacgtctccgtccgcatcctcaaccccgaaccccacgctactcctaaaaaacaccctcgttccaccccgcgaccaaacttactcgtctaaactatatttcttcgatcattttcttattcacctaaacgcctatcccgcgacgaacaactttactcccttcatcttcctatccgctcgccccccttcttcacatctccgaaaatcgcctaatttaaaaaaaaaaaacgactaaaaata

SEQ ID NO: 27745 - DNA, 527 bp, Artificial Sequence
  chemically treated genomic DNA (Homo sapiens) CpG-island No: 27745
gagggcgtcgtagtagaaggggaagtagggcgcgggatagggtttgggggaaggggtgtaaaggtaggttgcgcggggagtgaacgtcgtagcgtcgtgcgggagaggcgggcggaggtttcgggggttcgggagcgggtagagggggcgagatttgggaaggggacggcggtgggggagagtaggagaaaaataagcgcgtttcggagcggtagggattgttgcgaggaggaggagagcgtcggtcgcgggtgggggggtttagttcggggtcgttttcggggggtcgggttaattacggtttcggggagcggtcggcggtcgggggaggtgcgtttgggaggcggtgtagggcgtttcgttcgagttttatttttcgattttatcgatttattttatattggatttttatcgtcgttaataggaggaggaagtagggcggaagcgatgacgtttttttagcggttagaggtggtggagtgtaaaaagttttttatttgcgatcgaaaaaaagggagaagaaaaaa

SEQ ID NO: 27746 - DNA, 527 bp, Artificial Sequence
  chemically treated genomic DNA (Homo sapiens) CpG-island No: 27746
ttttttcttctccctttttttcgatcgcaaataaaaaactttttacactccaccacctctaaccgctaaaaaaacgtcatcgcttccgccctacttcctcctcctattaacgacgataaaaatccaatataaaataaatcgataaaatcgaaaaataaaactcgaacgaaacgccctacaccgcctcccaaacgcacctcccccgaccgccgaccgctccccgaaaccgtaattaacccgaccccccgaaaacgaccccgaactaaacccccccacccgcgaccgacgctctcctcctcctcgcaacaatccctaccgctccgaaacgcgcttatttttctcctactctcccccaccgccgtccccttcccaaatctcgccccctctacccgctcccgaacccccgaaacctccgcccgcctctcccgcacgacgctacgacgttcactccccgcgcaacctacctttacaccccttcccccaaaccctatcccgcgccctacttccccttctactacgacgccctc

SEQ ID NO: 27747 - DNA, 527 bp, Artificial Sequence
  chemically treated genomic DNA (Homo sapiens) CpG-island No: 27747
tttttttttttttttttttttcggtcgtaagtaggaagttttttgtattttattatttttggtcgttgggaagacgttatcgttttcgttttattttttttttttgttggcggcggtgagaatttaatatggagtaaatcggtggagtcgagagatggggttcggacggggcgttttgtatcgttttttaggcgtatttttttcggtcgtcgatcgtttttcggaatcgtgattggttcggtttttcgggggcgatttcggattgagtttttttattcgcggtcggcgtttttttttttttcgtagtagtttttgtcgtttcgaggcgcgtttgttttttttttgtttttttttatcgtcgttttttttttaaatttcgttttttttgttcgttttcgagttttcggagttttcgttcgtttttttcgtacggcgttgcggcgtttatttttcgcgtagtttgtttttgtatttttttttttaaattttatttcgcgttttgtttttttttttgttgcggcgttttt

SEQ ID NO: 27748 - DNA, 527 bp, Artificial Sequence
  chemically treated genomic DNA (Homo sapiens) CpG-island No: 27748
aaaaacgccgcaacaaaaaaaaaaacaaaacgcgaaataaaatttaaaaaaaaaaatacaaaaacaaactacgcgaaaaataaacgccgcaacgccgtacgaaaaaaacgaacgaaaactccgaaaactcgaaaacgaacaaaaaaaacgaaatttaaaaaaaaaacgacgataaaaaaaaacaaaaaaaaaacaaacgcgcctcgaaacgacaaaaactactacgaaaaaaaaaaaaacgccgaccgcgaataaaaaaactcaatccgaaatcgcccccgaaaaaccgaaccaatcacgattccgaaaaacgatcgacgaccgaaaaaaatacgcctaaaaaacgatacaaaacgccccgtccgaaccccatctctcgactccaccgatttactccatattaaattctcaccgccgccaacaaaaaaaaaaaataaaacgaaaacgataacgtcttcccaacgaccaaaaataataaaatacaaaaaacttcctacttacgaccgaaaaaaaaaaaaaaaaaaaaa

SEQ ID NO: 27749 - DNA, 808 bp, Artificial Sequence
  chemically treated genomic DNA (Homo sapiens) CpG-island No: 27749
tttttaaaggcgttcgcggttcgggcggttcgggttggggaggcggtggcggcgggagttgtttttttttcgggcggcggcgttgattgatttcgcgaattgggtttttgtgtaaattgaggttaaataaatatagatggagcgtagcgggcgttttttagaaatgttggtaaggaggtagcgattttagatgatattttgagcgtttcgggaacggatagttcggcgtttttcgaagtcggcggcgtagttgttcggggcgagggggagaaagggagagagggagggggagggcgggcgaagcgggagagttagagatttttcggcgttgaggcggcggcggttcgggtagttttacgtttttgtttcgcgcgtcgttcgcgttatgaagtatatttcggttttcgaggacgggtcgtggaagatcgtgtgcgtgaaggagttgaacggttttaagaagtttaagcggaaaggtaaggagtcgcggcgcgcgaacggttataaaatttttcgattggatttggaagcgttcgagtttcgcgtcgtagttattaacgggttgcgggataggatttatcggttgtagcggtttcggtatcggttcggtgttagttttagtggcgtcggtcgtttttttaagagggggtacggatatagtcggggagcgcgggggttttcgggcgtacgaggttttcgacgcgcggaaacgttcgttgttttaggcgtagtggggttaggattttttacgtcgtcgtcgtcgtcgttttttgcgttttagagttaggtatttgggggtttagaggtatag

SEQ ID NO: 27750 - DNA, 808 bp, Artificial Sequence
  chemically treated genomic DNA (Homo sapiens) CpG-island No: 27750
ctatacctctaaacccccaaatacctaactctaaaacgcaaaaaacgacgacgacgacgacgtaaaaaatcctaaccccactacgcctaaaacaacgaacgtttccgcgcgtcgaaaacctcgtacgcccgaaaacccccgcgctccccgactatatccgtaccccctcttaaaaaaacgaccgacgccactaaaactaacaccgaaccgataccgaaaccgctacaaccgataaatcctatcccgcaacccgttaataactacgacgcgaaactcgaacgcttccaaatccaatcgaaaaattttataaccgttcgcgcgccgcgactccttacctttccgcttaaacttcttaaaaccgttcaactccttcacgcacacgatcttccacgacccgtcctcgaaaaccgaaatatacttcataacgcgaacgacgcgcgaaacaaaaacgtaaaactacccgaaccgccgccgcctcaacgccgaaaaatctctaactctcccgcttcgcccgccctccccctccctctctccctttctccccctcgccccgaacaactacgccgccgacttcgaaaaacgccgaactatccgttcccgaaacgctcaaaatatcatctaaaatcgctacctccttaccaacatttctaaaaaacgcccgctacgctccatctatatttatttaacctcaatttacacaaaaacccaattcgcgaaatcaatcaacgccgccgcccgaaaaaaaaacaactcccgccgccaccgcctccccaacccgaaccgcccgaaccgcgaacgcctttaaaaa

SEQ ID NO: 27751 - DNA, 808 bp, Artificial Sequence
  chemically treated genomic DNA (Homo sapiens) CpG-island No: 27751
ttgtgtttttgggtttttaggtgtttggttttggggcgtaggaggcggcggcggcggcggcgtggggagttttggttttattgcgtttagggtaacgagcgttttcgcgcgtcggagatttcgtgcgttcgagagttttcgcgtttttcggttgtgttcgtgtttttttttgggggaacggtcggcgttattgggattggtatcggatcggtatcgggatcgttgtagtcgatgggttttgtttcgtagttcgttggtggttacggcgcggggttcgggcgtttttaagtttagtcggaaagttttatagtcgttcgcgcgtcgcggttttttgttttttcgtttgagttttttaaggtcgtttagtttttttacgtatacggttttttacggttcgttttcgaggatcgggatgtgttttatggcgcgggcggcgcgcgaggtaggggcgtggggttgttcgggtcgtcgtcgttttagcgtcgaggagtttttggttttttcgtttcgttcgttttttttttttttttttttttttttttttttcgtttcgggtagttgcgtcgtcggtttcgggaagcgtcgggttgttcgttttcggagcgtttagagtgttatttgaagtcgttgtttttttgttagtatttttggagaacgttcgttgcgttttatttgtgtttgtttagttttagtttatatagaagtttagttcgcgagattagttagcgtcgtcgttcggagaggaggtagttttcgtcgttatcgtttttttagttcgggtcgttcgagtcgcgagcgtttttaaaga

SEQ ID NO: 27752 - DNA, 808 bp, Artificial Sequence
  chemically treated genomic DNA (Homo sapiens) CpG-island No: 27752
tctttaaaaacgctcgcgactcgaacgacccgaactaaaaaaacgataacgacgaaaactacctcctctccgaacgacgacgctaactaatctcgcgaactaaacttctatataaactaaaactaaacaaacacaaataaaacgcaacgaacgttctccaaaaatactaacaaaaaaacaacgacttcaaataacactctaaacgctccgaaaacgaacaacccgacgcttcccgaaaccgacgacgcaactacccgaaacgaaaaaaaaaaaaaaaaaaaaaaaaaaaaaaaacgaacgaaacgaaaaaaccaaaaactcctcgacgctaaaacgacgacgacccgaacaaccccacgcccctacctcgcgcgccgcccgcgccataaaacacatcccgatcctcgaaaacgaaccgtaaaaaaccgtatacgtaaaaaaactaaacgaccttaaaaaactcaaacgaaaaaacaaaaaaccgcgacgcgcgaacgactataaaactttccgactaaacttaaaaacgcccgaaccccgcgccgtaaccaccaacgaactacgaaacaaaacccatcgactacaacgatcccgataccgatccgataccaatcccaataacgccgaccgttcccccaaaaaaaaacacgaacacaaccgaaaaacgcgaaaactctcgaacgcacgaaatctccgacgcgcgaaaacgctcgttaccctaaacgcaataaaaccaaaactccccacgccgccgccgccgccgcctcctacgccccaaaaccaaacacctaaaaacccaaaaacacaa

SEQ ID NO: 27753 - DNA, 639 bp, Artificial Sequence
  chemically treated genomic DNA (Homo sapiens) CpG-island No: 27753
gggtaattatttaagggtgtgcggattcgaggcggttagtagaggtttaacgttttcgttagtggtcgtgtatataaatgtgtaaacgtttgtgacgggttgcggggatttagggtgtttcgtcggattcgtggcggaatttttaggcgtagttagtcgtacgggttcggttttcgttcggttttggtaaaaatgttttttcgggtttcgaatttttcggcgttttttttcgagattagttttatttagggaagtcggaggtttcgcggtttttatcgtggtttaggtcggttttatcgtttagtagttcgtttttgttttcggggtatagtaaggagggcgttttttcggggttgcggttttttgaattcggggagttttcggtttcgttaggattcgcggagttcgttcggggttcggttgcggagtcgagtgtgggtggcgggtggggttgaaggcgagtgggggaggtaggaggggatggaggggcgggggcgggagtcgggcgttaagtttggaagtttggttgtttatttaaacgattttttttttagattcgagacgttaatgagataagattaaattttttttttcgtagtgcgtgtgtggggtgtgtgtgtgtgtgtgtgggtgggtggg

SEQ ID NO: 27754 - DNA, 639 bp, Artificial Sequence
  chemically treated genomic DNA (Homo sapiens) CpG-island No: 27754
cccacccacccacacacacacacacacaccccacacacgcactacgaaaaaaaaaatttaatcttatctcattaacgtctcgaatctaaaaaaaaaatcgtttaaataaacaaccaaacttccaaacttaacgcccgactcccgcccccgcccctccatcccctcctacctcccccactcgccttcaaccccacccgccacccacactcgactccgcaaccgaaccccgaacgaactccgcgaatcctaacgaaaccgaaaactccccgaattcaaaaaaccgcaaccccgaaaaaacgccctccttactataccccgaaaacaaaaacgaactactaaacgataaaaccgacctaaaccacgataaaaaccgcgaaacctccgacttccctaaataaaactaatctcgaaaaaaaacgccgaaaaattcgaaacccgaaaaaacatttttaccaaaaccgaacgaaaaccgaacccgtacgactaactacgcctaaaaattccgccacgaatccgacgaaacaccctaaatccccgcaacccgtcacaaacgtttacacatttatatacacgaccactaacgaaaacgttaaacctctactaaccgcctcgaatccgcacacccttaaataattaccc

SEQ ID NO: 27755 - DNA, 639 bp, Artificial Sequence
  chemically treated genomic DNA (Homo sapiens) CpG-island No: 27755
tttatttatttatatatatatatatatattttatatacgtattacgagaaggggagtttgattttgttttattggcgtttcgggtttgaaaggaaaatcgtttgggtaaatagttaagtttttaggtttaacgttcggttttcgttttcgtttttttatttttttttgttttttttattcgtttttaattttattcgttatttatattcggtttcgtagtcgggtttcgagcgagtttcgcgagttttggcgagatcgagggtttttcgggtttaaagggtcgtagtttcgagggaacgttttttttgttgtgtttcgggggtagaagcggattgttgggcggtgggatcggtttgggttacggtaggaatcgcgaaattttcggtttttttaaatagagttggtttcgggggagggcgtcggggagttcggagttcggagggatatttttgttaagatcgagcggaagtcgagttcgtgcggttggttgcgtttaggagtttcgttacgggttcgacggggtattttgggttttcgtagttcgttataggcgtttgtatatttgtgtgtacgattattggcgggggcgttgagtttttgttagtcgtttcgggttcgtatatttttgggtgattattt

SEQ ID NO: 27756 - DNA, 639 bp, Artificial Sequence
  chemically treated genomic DNA (Homo sapiens) CpG-island No: 27756
aaataatcacccaaaaatatacgaacccgaaacgactaacaaaaactcaacgcccccgccaataatcgtacacacaaatatacaaacgcctataacgaactacgaaaacccaaaataccccgtcgaacccgtaacgaaactcctaaacgcaaccaaccgcacgaactcgacttccgctcgatcttaacaaaaatatccctccgaactccgaactccccgacgccctcccccgaaaccaactctatttaaaaaaaccgaaaatttcgcgattcctaccgtaacccaaaccgatcccaccgcccaacaatccgcttctacccccgaaacacaacaaaaaaaacgttccctcgaaactacgaccctttaaacccgaaaaaccctcgatctcgccaaaactcgcgaaactcgctcgaaacccgactacgaaaccgaatataaataacgaataaaattaaaaacgaataaaaaaaacaaaaaaaaataaaaaaacgaaaacgaaaaccgaacgttaaacctaaaaacttaactatttacccaaacgattttcctttcaaacccgaaacgccaataaaacaaaatcaaactccccttctcgtaatacgtatataaaatatatatatatatatataaataaataaa

SEQ ID NO: 27757 - DNA, 582 bp, Artificial Sequence
  chemically treated genomic DNA (Homo sapiens) CpG-island No: 27757
cgagcggagtttgtagttgtttggagttcgagttttcggtggcggcggcggtagttttttagttagttttggcgtcgaaagagttttttttttcgggaagttggttttttttttttcgcgttagttagcgagttcgtttagtcgtcggttttttttatttcgatcgttaatttttagttttagtcgtcgtttttttttttttcgggattcgtttttttttagaggtcgttaagttagggggaatcgatgtttcgattggggttgaaattcggtttttgcgtttttattttttattcgtcgcgcgttttcggtttttttttgggcgttcgttttttttatattttcgttcggtgtttaggattcgggcgttttcgtattttagtttagggcgagcgcgtcggttcgtagtttcggcgtgtttcggtaggtgtagttcggcgttacgagcgtttttcgggttttaaagttgggagacgttagtaaaaagaaaggggtggtcggaggaggggggaagaaggagtggggaagagggacgggaagcggtaatgggtttttaaatagaacgaaaaaaattttaaatgt

SEQ ID NO: 27758 - DNA, 582 bp, Artificial Sequence
  chemically treated genomic DNA (Homo sapiens) CpG-island No: 27758
acatttaaaatttttttcgttctatttaaaaacccattaccgcttcccgtccctcttccccactccttcttcccccctcctccgaccacccctttctttttactaacgtctcccaactttaaaacccgaaaaacgctcgtaacgccgaactacacctaccgaaacacgccgaaactacgaaccgacgcgctcgccctaaactaaaatacgaaaacgcccgaatcctaaacaccgaacgaaaatataaaaaaaacgaacgcccaaaaaaaaaccgaaaacgcgcgacgaataaaaaataaaaacgcaaaaaccgaatttcaaccccaatcgaaacatcgattccccctaacttaacgacctctaaaaaaaaacgaatcccgaaaaaaaaaaaaacgacgactaaaactaaaaattaacgatcgaaataaaaaaaaccgacgactaaacgaactcgctaactaacgcgaaaaaaaaaaaaccaacttcccgaaaaaaaaaactctttcgacgccaaaactaactaaaaaactaccgccgccgccaccgaaaactcgaactccaaacaactacaaactccgctcg

SEQ ID NO: 27759 - DNA, 582 bp, Artificial Sequence
  chemically treated genomic DNA (Homo sapiens) CpG-island No: 27759
gtatttggagtttttttcgttttgtttgggaatttattgtcgtttttcgttttttttttttattttttttttttttttttttcggttatttttttttttttgttggcgttttttaattttagggttcggggggcgttcgtggcgtcgggttgtatttgtcggggtacgtcgggattgcgggtcggcgcgttcgttttgggttggggtgcggaagcgttcgagttttgggtatcgggcgagagtgtgagaggagcggacgtttaggagggagtcgaggacgcgcggcgggtagggggtaggggcgtaggaatcgggttttagttttagtcgggatatcggttttttttggtttggcggtttttggagggagacgagtttcggggagaaggagggcggcgattggggttagggattggcgatcggagtggggagggtcggcggttgagcgagttcgttggttgacgcgaggagggggaggttaatttttcgggagaaggggttttttcggcgttagggttggttagggagttgtcgtcgtcgttatcgagggttcggattttaggtagttgtaggtttcgttcg

SEQ ID NO: 27760 - DNA, 582 bp, Artificial Sequence
  chemically treated genomic DNA (Homo sapiens) CpG-island No: 27760
cgaacgaaacctacaactacctaaaatccgaaccctcgataacgacgacgacaactccctaaccaaccctaacgccgaaaaaaccccttctcccgaaaaattaacctccccctcctcgcgtcaaccaacgaactcgctcaaccgccgaccctccccactccgatcgccaatccctaaccccaatcgccgccctccttctccccgaaactcgtctccctccaaaaaccgccaaaccaaaaaaaaccgatatcccgactaaaactaaaacccgattcctacgcccctaccccctacccgccgcgcgtcctcgactccctcctaaacgtccgctcctctcacactctcgcccgatacccaaaactcgaacgcttccgcaccccaacccaaaacgaacgcgccgacccgcaatcccgacgtaccccgacaaatacaacccgacgccacgaacgccccccgaaccctaaaattaaaaaacgccaacaaaaaaaaaaaaataaccgaaaaaaaaaaaaaaaaaaaataaaaaaaaaaaacgaaaaacgacaataaattcccaaacaaaacgaaaaaaactccaaatac

SEQ ID NO: 27761 - DNA, 601 bp, Artificial Sequence
  chemically treated genomic DNA (Homo sapiens) CpG-island No: 27761
ggagagtacgcggaggtcgaggtattgtatttcgtttatattcgtcggtgcgtttgcgcggtttttagcgacgagagtttcgggaggtaattatcgcgagatttggggtcgcggcgatttcgggtggaggcgacgttggggttgtttgggtttttatttttgtttttggagtttacggtcggcgtttgttataatttagtattaggattgagcgggcggacgttcgtttttttagaaaggtttaggcgaggtttaggacgagggcggcggagaacgcggggagaagtttattcgtgaggagttagttgtcgcgacggtgcggagagattttcgggaattaagttttttgcgcgattttcgggcgcgggtcgtcgttttttatttcgtcgtttttttttttacgttttttattcgtatttagagatttaggatagataggaattttttattcgtgattttagttggcgggaaattcgcgatttgggaagggaaggggttacggttgcgtagggttatagtatcgcgatttttattttagtgttacggcgtaggtttttggtggtgttttttatttgtgaaaaacgtttaaatatgtggaaga

SEQ ID NO: 27762 - DNA, 601 bp, Artificial Sequence
  chemically treated genomic DNA (Homo sapiens) CpG-island No: 27762
tcttccacatatttaaacgtttttcacaaataaaaaacaccaccaaaaacctacgccgtaacactaaaataaaaatcgcgatactataaccctacgcaaccgtaaccccttcccttcccaaatcgcgaatttcccgccaactaaaatcacgaataaaaaattcctatctatcctaaatctctaaatacgaataaaaaacgtaaaaaaaaaaacgacgaaataaaaaacgacgacccgcgcccgaaaatcgcgcaaaaaacttaattcccgaaaatctctccgcaccgtcgcgacaactaactcctcacgaataaacttctccccgcgttctccgccgccctcgtcctaaacctcgcctaaacctttctaaaaaaacgaacgtccgcccgctcaatcctaatactaaattataacaaacgccgaccgtaaactccaaaaacaaaaataaaaacccaaacaaccccaacgtcgcctccacccgaaatcgccgcgaccccaaatctcgcgataattacctcccgaaactctcgtcgctaaaaaccgcgcaaacgcaccgacgaatataaacgaaatacaatacctcgacctccgcgtactctcc

SEQ ID NO: 27763 - DNA, 601 bp, Artificial Sequence
  chemically treated genomic DNA (Homo sapiens) CpG-island No: 27763
ttttttatatatttaaacgttttttataagtgaaaaatattattaagagtttgcgtcgtgatattgagatgggagtcgcggtattgtggttttacgtagtcgtgattttttttttttttaggtcgcggatttttcgttagttaaaattacgagtggaaaatttttatttgttttaagtttttgggtgcgaatgaggaacgtggaaggagagacggcggggtgagaggcggcggttcgcgttcgaggatcgcgtagagggtttggttttcggaaattttttcgtatcgtcgcggtagttggttttttacgggtgggttttttttcgcgtttttcgtcgttttcgttttaggtttcgtttaggtttttttagaaagacgaacgttcgttcgtttagttttagtgttgggttatgataagcgtcgatcgtgagttttagaggtaaagataggagtttaaataattttaacgtcgtttttattcggggtcgtcgcggttttaggtttcgcgatagttatttttcgggattttcgtcgttggaggtcgcgtaagcgtatcggcgaatgtaagcggagtatagtgtttcggttttcgcgtatttttt

SEQ ID NO: 27764 - DNA, 601 bp, Artificial Sequence
  chemically treated genomic DNA (Homo sapiens) CpG-island No: 27764
aaaaaatacgcgaaaaccgaaacactatactccgcttacattcgccgatacgcttacgcgacctccaacgacgaaaatcccgaaaaataactatcgcgaaacctaaaaccgcgacgaccccgaataaaaacgacgttaaaattatttaaactcctatctttacctctaaaactcacgatcgacgcttatcataacccaacactaaaactaaacgaacgaacgttcgtctttctaaaaaaacctaaacgaaacctaaaacgaaaacgacgaaaaacgcgaaaaaaaacccacccgtaaaaaaccaactaccgcgacgatacgaaaaaatttccgaaaaccaaaccctctacgcgatcctcgaacgcgaaccgccgcctctcaccccgccgtctctccttccacgttcctcattcgcacccaaaaacttaaaacaaataaaaattttccactcgtaattttaactaacgaaaaatccgcgacctaaaaaaaaaaaaaatcacgactacgtaaaaccacaataccgcgactcccatctcaatatcacgacgcaaactcttaataatatttttcacttataaaaaacgtttaaatatataaaaaa

SEQ ID NO: 27765 - DNA, 533 bp, Artificial Sequence
  chemically treated genomic DNA (Homo sapiens) CpG-island No: 27765
ttagtttcgtttgttttacgtttcgtttcgttttttttttttacgtttagggggcgtggtaattcggagttttttttttatttagggtacgtgatttgttagttcgcggagagggaagaatatggtcgtcgggtgtggtgagggcgacgcgtttgtagtcgtcgttttttgttttttcgttttttgatatcgtttgtagtcgagcgggttcgtttcgtcggagttgaggattaggttgggagatcgttagtgtggaggtcggttcgcgaagttttgtcgcgggattggggaggagtcgggggcgaggtcgggttcggggagtcgggcggggaggtgggatagtcgaggagtgcgcggaaggggcgagttcgaatcgggggtttcggggagggtatggcgcggtttcggacgttcgggtttcggttttcggggcgagttcgcgttttttggagcgtcgggaagttttcgattttggagtttttggtggtttgttttttgagggggttttcgggtgggttggggtgaagggtgtt

SEQ ID NO: 27766 - DNA, 533 bp, Artificial Sequence
  chemically treated genomic DNA (Homo sapiens) CpG-island No: 27766
aacacccttcaccccaacccacccgaaaaccccctcaaaaaacaaaccaccaaaaactccaaaatcgaaaacttcccgacgctccaaaaaacgcgaactcgccccgaaaaccgaaacccgaacgtccgaaaccgcgccataccctccccgaaacccccgattcgaactcgccccttccgcgcactcctcgactatcccacctccccgcccgactccccgaacccgacctcgcccccgactcctccccaatcccgcgacaaaacttcgcgaaccgacctccacactaacgatctcccaacctaatcctcaactccgacgaaacgaacccgctcgactacaaacgatatcaaaaaacgaaaaaacaaaaaacgacgactacaaacgcgtcgccctcaccacacccgacgaccatattcttccctctccgcgaactaacaaatcacgtaccctaaataaaaaaaaaactccgaattaccacgccccctaaacgtaaaaaaaaaaaacgaaacgaaacgtaaaacaaacgaaactaa

SEQ ID NO: 27767 - DNA, 533 bp, Artificial Sequence
  chemically treated genomic DNA (Homo sapiens) CpG-island No: 27767
aatattttttattttaatttattcgagggtttttttaggagatagattattagagattttaaggtcggagatttttcggcgttttaggaaacgcggattcgtttcgaaagtcggggttcgagcgttcggggtcgcgttatgtttttttcgggattttcggttcgagttcgtttttttcgcgtatttttcggttgttttattttttcgttcgatttttcgagttcggtttcgttttcgatttttttttaatttcgcggtaaagtttcgcggatcggtttttatattgacggttttttaatttggtttttagtttcggcggaacgggttcgttcggttgtaggcgatgttagaggacggggaagtaagagacggcgattgtaagcgcgtcgtttttattatattcggcggttatattttttttttttcgcgaattgatagattacgtgttttgggtaggggagggatttcgggttgttacgttttttgggcgtggaggggaggggcggggcggggcgtagagtaggcggggttgg

SEQ ID NO: 27768 - DNA, 533 bp, Artificial Sequence
  chemically treated genomic DNA (Homo sapiens) CpG-island No: 27768
ccaaccccgcctactctacgccccgccccgcccctcccctccacgcccaaaaaacgtaacaacccgaaatccctcccctacccaaaacacgtaatctatcaattcgcgaaaaaaaaaaaatataaccgccgaatataataaaaacgacgcgcttacaatcgccgtctcttacttccccgtcctctaacatcgcctacaaccgaacgaacccgttccgccgaaactaaaaaccaaattaaaaaaccgtcaatataaaaaccgatccgcgaaactttaccgcgaaattaaaaaaaaatcgaaaacgaaaccgaactcgaaaaatcgaacgaaaaaataaaacaaccgaaaaatacgcgaaaaaaacgaactcgaaccgaaaatcccgaaaaaaacataacgcgaccccgaacgctcgaaccccgactttcgaaacgaatccgcgtttcctaaaacgccgaaaaatctccgaccttaaaatctctaataatctatctcctaaaaaaaccctcgaataaattaaaataaaaaatatt

SEQ ID NO: 27769 - DNA, 1142 bp, Artificial Sequence
  chemically treated genomic DNA (Homo sapiens) CpG-island No: 27769
  misc_feature (196)..(196): n is either a, c, g or t
tgttacgcgtcgtgcgtttgtcgggcgcgtcgcggagttaggcgagtcgggggttatcgcggggggcgggggcgtgcggacggacggatcgacggatatattcgcgagtattttaatttcggattcggcgcgcggtatcggttattttttcgggtcggggaaattgcgtacggggttcggtttggcgaggtaggantgggtttcgtttttttttattcgttattttcgtttattcgggtttcgtgattggtttcgtcgtttttggttgcgcgtcgaagttcgtttttttcgtagttaaagtagacggtattcggagcggagcgagttagaagggagtatggttttcgcgtcggtacggttagttttcgcgtcgtcgtcgtcgttttcgttatcgcggatttcgtcgtagttttagtttcggtttcggtttcgtagcgttcgttcgtagtttcggcgatcgcgcgtttgagcgtagttttcgttcggagttcgagtcgcgagttcggagttagtttttagtttcgcggtcgtcgcggttgcggggagagggcgggggcgatgttgtcggagtcgtcgtcgtcgtcgtcgtttcgatgagagtcgcgtcgtatcgtttatagtcgtataggttgataggtaggaggatcgatttttttttttcgggtattttttttgggttgtcgggaggcggcggcggcggaggaggaggaggaacgaggggagaaggcggagagtaggaacgcgaggaggaggatttggattcgtttttttcggttaggattcgagcggttttagttatcgttattcgtcggcgttgttcgttttttattagtttttttgcgtttattcgcgatttcgggttttttgcgcgtcgggtcggggtcggagtcgcgcgtcggaggtaagagtcgggtcgggttggagcgtttcggatgcggcgtcggagggagatttaggttttggtcgtcgcgtggggtcgggtcgggtcgggcgtgggagcggggtcggaattcggaattttgggttcggtttcggcggcggcggcggcgataggagtttttcgcgtttggattcgtaggttgtaggagtttttgcgtttgcgttgttttagggggaaaaaaagggggggaaaaaattttttg

SEQ ID NO: 27770 - DNA, 1142 bp, Artificial Sequence
  chemically treated genomic DNA (Homo sapiens) CpG-island No: 27770
  misc_feature (947)..(947): n is either a, c, g or t
caaaaaattttttccccccctttttttccccctaaaacaacgcaaacgcaaaaactcctacaacctacgaatccaaacgcgaaaaactcctatcgccgccgccgccgccgaaaccgaacccaaaattccgaattccgaccccgctcccacgcccgacccgacccgaccccacgcgacgaccaaaacctaaatctccctccgacgccgcatccgaaacgctccaacccgacccgactcttacctccgacgcgcgactccgaccccgacccgacgcgcaaaaaacccgaaatcgcgaataaacgcaaaaaaactaataaaaaacgaacaacgccgacgaataacgataactaaaaccgctcgaatcctaaccgaaaaaaacgaatccaaatcctcctcctcgcgttcctactctccgccttctcccctcgttcctcctcctcctccgccgccgccgcctcccgacaacccaaaaaaaatacccgaaaaaaaaaaatcgatcctcctacctatcaacctatacgactataaacgatacgacgcgactctcatcgaaacgacgacgacgacgacgactccgacaacatcgcccccgccctctccccgcaaccgcgacgaccgcgaaactaaaaactaactccgaactcgcgactcgaactccgaacgaaaactacgctcaaacgcgcgatcgccgaaactacgaacgaacgctacgaaaccgaaaccgaaactaaaactacgacgaaatccgcgataacgaaaacgacgacgacgacgcgaaaactaaccgtaccgacgcgaaaaccatactcccttctaactcgctccgctccgaataccgtctactttaactacgaaaaaaacgaacttcgacgcgcaaccaaaaacgacgaaaccaatcacgaaacccgaataaacgaaaataacgaataaaaaaaaacgaaacccantcctacctcgccaaaccgaaccccgtacgcaatttccccgacccgaaaaaataaccgataccgcgcgccgaatccgaaattaaaatactcgcgaatatatccgtcgatccgtccgtccgcacgcccccgccccccgcgataacccccgactcgcctaactccgcgacgcgcccgacaaacgcacgacgcgtaaca

SEQ ID NO: 27771 - DNA, 1142 bp, Artificial Sequence
  chemically treated genomic DNA (Homo sapiens) CpG-island No: 27771
  misc_feature (947)..(947): n is either a, c, g or t
taggaagttttttttttttttttttttttttttggagtagcgtaggcgtaagggtttttgtagtttgcgagtttagacgcgggaggtttttgtcgtcgtcgtcgtcgtcgaagtcgagtttagggtttcgggtttcggtttcgtttttacgttcggttcggttcggttttacgcggcggttaggatttgggttttttttcggcgtcgtattcgaggcgttttagttcggttcggtttttattttcggcgcgcggtttcggtttcggttcgacgcgtagagagttcggggtcgcgggtgggcgtaggagggttgatggagagcggatagcgtcggcgggtagcggtggttggggtcgttcgggttttggtcggaggaaacggatttaggttttttttttcgcgtttttgtttttcgtttttttttttcgtttttttttttttttcgtcgtcgtcgtttttcggtagtttagggaggatgttcgggagagggaagtcggtttttttgtttgttagtttgtgcggttatgagcggtgcggcgcggtttttatcgaggcggcggcggcggcggcggtttcggtagtatcgttttcgtttttttttcgtagtcgcggcggtcgcggggttgagggttggtttcgggttcgcggttcgggtttcgggcgggggttgcgtttaagcgcgcgatcgtcggggttgcggacgggcgttgcggagtcggggtcggggttggagttgcggcgagattcgcggtggcggggacggcggcggcggcgcgggggttggtcgtgtcggcgcggggattatgtttttttttggttcgtttcgtttcgggtatcgtttgttttagttgcgagggaggcgggtttcggcgcgtagttaggggcggcggagttaattacggggttcgagtgggcgggggtggcgggtggggaagagcggagtttanttttgtttcgttaggtcgggtttcgtgcgtagttttttcggttcgagggaataatcggtgtcgcgcgtcgggttcgaggttggagtgttcgcgggtgtgttcgtcggttcgttcgttcgtacgttttcgtttttcgcggtggttttcggttcgtttggtttcgcggcgcgttcggtagacgtacggcgcgtggta

SEQ ID NO: 27772 - DNA, 1142 bp, Artificial Sequence
  chemically treated genomic DNA (Homo sapiens) CpG-island No: 27772
  misc_feature (196)..(196): n is either a, c, g or t
taccacgcgccgtacgtctaccgaacgcgccgcgaaaccaaacgaaccgaaaaccaccgcgaaaaacgaaaacgtacgaacgaacgaaccgacgaacacacccgcgaacactccaacctcgaacccgacgcgcgacaccgattattccctcgaaccgaaaaaactacgcacgaaacccgacctaacgaaacaaaantaaactccgctcttccccacccgccacccccgcccactcgaaccccgtaattaactccgccgcccctaactacgcgccgaaacccgcctccctcgcaactaaaacaaacgatacccgaaacgaaacgaaccaaaaaaaaacataatccccgcgccgacacgaccaacccccgcgccgccgccgccgtccccgccaccgcgaatctcgccgcaactccaaccccgaccccgactccgcaacgcccgtccgcaaccccgacgatcgcgcgcttaaacgcaacccccgcccgaaacccgaaccgcgaacccgaaaccaaccctcaaccccgcgaccgccgcgactacgaaaaaaaaacgaaaacgatactaccgaaaccgccgccgccgccgccgcctcgataaaaaccgcgccgcaccgctcataaccgcacaaactaacaaacaaaaaaaccgacttccctctcccgaacatcctccctaaactaccgaaaaacgacgacgacgaaaaaaaaaaaaaaacgaaaaaaaaaaacgaaaaacaaaaacgcgaaaaaaaaaacctaaatccgtttcctccgaccaaaacccgaacgaccccaaccaccgctacccgccgacgctatccgctctccatcaaccctcctacgcccacccgcgaccccgaactctctacgcgtcgaaccgaaaccgaaaccgcgcgccgaaaataaaaaccgaaccgaactaaaacgcctcgaatacgacgccgaaaaaaaacccaaatcctaaccgccgcgtaaaaccgaaccgaaccgaacgtaaaaacgaaaccgaaacccgaaaccctaaactcgacttcgacgacgacgacgacgacaaaaacctcccgcgtctaaactcgcaaactacaaaaacccttacgcctacgctactccaaaaaaaaaaaaaaaaaaaaaaaaaacttccta

SEQ ID NO: 27773 - DNA, 820 bp, Artificial Sequence
  chemically treated genomic DNA (Homo sapiens) CpG-island No: 27773
tacggggacggcgaagcggttaggaggtggtgtcgttggggaggggttgttgatgtgtgggatagggtggatttggagatgtgtagtgtgggagtgtgaacgcgcgtttcgatggtttcggggggtcgggggagtttagggttcgcgtttcggttttcgtggtttggagcgggttgagagcgttagggttatttgcggtcgtcgcgcgggtgttcgcgttgggtagcgtcggtttcgggttttaagggagggacgtgttcgtttggggtcggagcgcggggttgggagtcggggtaggtcggaggtggtttttagggtaggtcgtttttgcgttgtttggggaaggcggggacgcgttgtttgtttgcggttagtcgtttcggaggagggggtggcggttacgcgcgagtttcggatgtttgggtttattcgttgagaagttagttgtcgtttttgggttgtggaattaagcggtagacgcggttcgttggcgggttttcgcgcgggtttttagagatgttgatgggtaaggagttgtcgtcgtcgtcgttgttattttcgtcgttttgtaaacgtttttttttttttttttcgtgtttgcgtcgcggcgcgtttcgggcgaatcgtggacgtaggtatttatgtagtattaggcgagatttcggcgttggagggattagatcgtggaggacgtcgagttgttgttgtttgcgaaatttttatttcggtagtttagcggtatttcggttcgttgttgtaggttttagtttttttttagtttagtaacgttgggattcggattttttttgtaatgatagat

SEQ ID NO: 27774 - DNA, 820 bp, Artificial Sequence
  chemically treated genomic DNA (Homo sapiens) CpG-island No: 27774
atctatcattacaaaaaaaatccgaatcccaacgttactaaactaaaaaaaaactaaaacctacaacaacgaaccgaaataccgctaaactaccgaaataaaaatttcgcaaacaacaacaactcgacgtcctccacgatctaatccctccaacgccgaaatctcgcctaatactacataaatacctacgtccacgattcgcccgaaacgcgccgcgacgcaaacacgaaaaaaaaaaaaaaaaacgtttacaaaacgacgaaaataacaacgacgacgacgacaactccttacccatcaacatctctaaaaacccgcgcgaaaacccgccaacgaaccgcgtctaccgcttaattccacaacccaaaaacgacaactaacttctcaacgaataaacccaaacatccgaaactcgcgcgtaaccgccaccccctcctccgaaacgactaaccgcaaacaaacaacgcgtccccgccttccccaaacaacgcaaaaacgacctaccctaaaaaccacctccgacctaccccgactcccaaccccgcgctccgaccccaaacgaacacgtccctcccttaaaacccgaaaccgacgctacccaacgcgaacacccgcgcgacgaccgcaaataaccctaacgctctcaacccgctccaaaccacgaaaaccgaaacgcgaaccctaaactcccccgaccccccgaaaccatcgaaacgcgcgttcacactcccacactacacatctccaaatccaccctatcccacacatcaacaacccctccccaacgacaccacctcctaaccgcttcgccgtccccgta

SEQ ID NO: 27775 - DNA, 820 bp, Artificial Sequence
  chemically treated genomic DNA (Homo sapiens) CpG-island No: 27775
atttgttattgtaagaggagttcgaattttagcgttgttggattggagagaggttggaatttgtagtagcgggtcgggatgtcgttgagttgtcgaagtggaagtttcgtaggtagtagtagttcggcgttttttacggtttggtttttttagcgtcgaggtttcgtttaatgttatataaatatttgcgtttacgattcgttcggggcgcgtcgcggcgtaagtacgggagggagggaggagaacgtttgtagagcggcggggatggtagcggcggcggcggtagttttttatttattagtatttttgggggttcgcgcgagggttcgttaacggatcgcgtttgtcgtttggttttatagtttagggacgataattggttttttagcgggtggatttaggtattcgagattcgcgcgtggtcgttattttttttttcgagacggttggtcgtaggtaggtagcgcgttttcgttttttttaggtaacgtagaggcgatttgttttaagagttattttcgatttatttcggtttttagtttcgcgtttcggttttaggcgagtacgttttttttttggggttcggggtcgacgttgtttagcgcgggtattcgcgcggcgatcgtagataattttagcgtttttagttcgttttaggttacggagatcgggacgcgagttttgggttttttcggtttttcgaggttatcggggcgcgcgtttatatttttatattatatatttttaggtttattttgttttatatattaataatttttttttaacgatattattttttggtcgtttcgtcgttttcgtg

SEQ ID NO: 27776 - DNA, 820 bp, Artificial Sequence
  chemically treated genomic DNA (Homo sapiens) CpG-island No: 27776
cacgaaaacgacgaaacgaccaaaaaataatatcgttaaaaaaaaattattaatatataaaacaaaataaacctaaaaatatataatataaaaatataaacgcgcgccccgataacctcgaaaaaccgaaaaaacccaaaactcgcgtcccgatctccgtaacctaaaacgaactaaaaacgctaaaattatctacgatcgccgcgcgaatacccgcgctaaacaacgtcgaccccgaaccccaaaaaaaaaacgtactcgcctaaaaccgaaacgcgaaactaaaaaccgaaataaatcgaaaataactcttaaaacaaatcgcctctacgttacctaaaaaaaacgaaaacgcgctacctacctacgaccaaccgtctcgaaaaaaaaaataacgaccacgcgcgaatctcgaatacctaaatccacccgctaaaaaaccaattatcgtccctaaactataaaaccaaacgacaaacgcgatccgttaacgaaccctcgcgcgaacccccaaaaatactaataaataaaaaactaccgccgccgccgctaccatccccgccgctctacaaacgttctcctccctccctcccgtacttacgccgcgacgcgccccgaacgaatcgtaaacgcaaatatttatataacattaaacgaaacctcgacgctaaaaaaaccaaaccgtaaaaaacgccgaactactactacctacgaaacttccacttcgacaactcaacgacatcccgacccgctactacaaattccaacctctctccaatccaacaacgctaaaattcgaactcctcttacaataacaaat

SEQ ID NO: 27777 - DNA, 574 bp, Artificial Sequence
  chemically treated genomic DNA (Homo sapiens) CpG-island No: 27777
agtgtcgcggtaaggtaggtgtcgggcgggagttaattcgggagcggaggaaggggtcgttaggtcggtttgtatggttagggacggggattttgcggcgttcgttttttttttagtttcgggagttcgtaggtcgcgggcgtgaggggagggggagttatcgtcgtgacgcggtcgtttttgcgggaaaacgtcgtgtttcgggtattgtattagcggcggggagggggtttcggcggtgataggttcgcggcgtagtggcggtgttgtgtttcgtagggaagtcgcgggaattagagcgggggaagcggtgcgcgcgcgtttcggggagatcggttttttcgtttttttttgttcgcggggattcggttaattcggggcgttttcgcgttattttgaaatttttaagttgttcggcgtggggcgagataggggcggttttttttttcggcgttttttagaaagtttgtcgggcggggagggggtatttacgtttttcggcgtcgcgggtagtcgtttttcggtttcgggttttagtttttcgatgcgtttcgtttcggcgtaggcggttatt

SEQ ID NO: 27778 - DNA, 574 bp, Artificial Sequence
  chemically treated genomic DNA (Homo sapiens) CpG-island No: 27778
aataaccgcctacgccgaaacgaaacgcatcgaaaaactaaaacccgaaaccgaaaaacgactacccgcgacgccgaaaaacgtaaataccccctccccgcccgacaaactttctaaaaaacgccgaaaaaaaaaaccgcccctatctcgccccacgccgaacaacttaaaaatttcaaaataacgcgaaaacgccccgaattaaccgaatccccgcgaacaaaaaaaaacgaaaaaaccgatctccccgaaacgcgcgcgcaccgcttcccccgctctaattcccgcgacttccctacgaaacacaacaccgccactacgccgcgaacctatcaccgccgaaaccccctccccgccgctaatacaatacccgaaacacgacgttttcccgcaaaaacgaccgcgtcacgacgataactccccctcccctcacgcccgcgacctacgaactcccgaaactaaaaaaaaaacgaacgccgcaaaatccccgtccctaaccatacaaaccgacctaacgaccccttcctccgctcccgaattaactcccgcccgacacctaccttaccgcgacact

SEQ ID NO: 27779 - DNA, 574 bp, Artificial Sequence
  chemically treated genomic DNA (Homo sapiens) CpG-island No: 27779
ggtggtcgtttgcgtcgaggcggagcgtatcgaggagttggaattcgaggtcgaggagcggttgttcgcggcgtcggaggacgtgagtgtttttttttcgttcggtaaattttttagggggcgtcggggggaaaagtcgtttttgtttcgttttacgtcgggtaatttggaggttttagggtgacgcgggagcgtttcggattggtcgggttttcgcgggtaggagggggcggagggatcggttttttcgaaacgcgcgcgtatcgtttttttcgttttggttttcgcggtttttttgcgggatatagtatcgttattgcgtcgcggatttgttatcgtcggagtttttttttcgtcgttggtgtagtgttcgggatacggcgttttttcgtagaggcggtcgcgttacggcggtgattttttttttttttacgttcgcgatttgcgagttttcggagttggggaaggagcggacgtcgtagagttttcgtttttggttatgtaagtcggtttggcgattttttttttcgttttcggattagttttcgttcggtatttgttttgtcgcgatatt

SEQ ID NO: 27780 - DNA, 574 bp, Artificial Sequence
  chemically treated genomic DNA (Homo sapiens) CpG-island No: 27780
aatatcgcgacaaaacaaataccgaacgaaaactaatccgaaaacgaaaaaaaaaatcgccaaaccgacttacataaccaaaaacgaaaactctacgacgtccgctccttccccaactccgaaaactcgcaaatcgcgaacgtaaaaaaaaaaaaaatcaccgccgtaacgcgaccgcctctacgaaaaaacgccgtatcccgaacactacaccaacgacgaaaaaaaaactccgacgataacaaatccgcgacgcaataacgatactatatcccgcaaaaaaaccgcgaaaaccaaaacgaaaaaaacgatacgcgcgcgtttcgaaaaaaccgatccctccgccccctcctacccgcgaaaacccgaccaatccgaaacgctcccgcgtcaccctaaaacctccaaattacccgacgtaaaacgaaacaaaaacgacttttccccccgacgccccctaaaaaatttaccgaacgaaaaaaaaacactcacgtcctccgacgccgcgaacaaccgctcctcgacctcgaattccaactcctcgatacgctccgcctcgacgcaaacgaccacc

SEQ ID NO: 27781 - DNA, 1095 bp, Artificial Sequence
  chemically treated genomic DNA (Homo sapiens) CpG-island No: 27781
gcgttttagcgtagattattattcgtcgttttttcgatttttttttcggagtttttaacgttggtttgtttttcggggtttttttttcgtaattttacgcgatgtttttttcgttcgcggtttttttttttttttcgcgttttattatttttttttagtagcgttttcgcgagtaaggtcgcgttttttaggcgttcgttttcgggggtttttggcggaggggtttttaggtttattacgttttcgcggataaagggtgacgtagcggatttcgtttttgtttcgcgggttcggtcgtttcgtttatttatacgaagaggttgtttgagagtaggtattgggttatatcgcgggttcggggtttttcggcgttcggtcgggcgggcgtcggcggtttaggttgtagcgaggtcgttagttggttcggttcgtcggggtcggtttcgggttggttgagcgcgcggtaggcgttgatgatggtgtttagtagggttaggtcgttgaggttcgtgtaggtgcggaggttgggttaggggaagcgttcgaggaagagtagcggtatggcggtagcggcgatttttggtttttaggtttttttgcgttgcggtcgggtttttgcggcggtttcgcgaacggcgtttacgggttttggcgtcgttgtcgttgtcgttgtcgttgtcgttgtcgtcgtcgtcgtcgcgtcgggtcgggtcgggtcgtttttggttgttggcgtcgtttcgtttcgcgttgttttcgttgttgtttttgtcggcgcggaagagtttgggcgggttcgggataggtcgtcgtttttagcgggacgttggcgggacgggcgtaggggcgcggttttcgtttttcgtttttagcggtcgcgtcgtcgtttagcgggcgtagtttcgggttttaggtcggggggcgggtatttagtattattcgtcgttcgtattacggtttggttgggttcgtagatatagagggtatttgtttcggtcgcggcgtaggggttattcgggttcgtaggcgttggtaggcgggtagggttttagggcgcggggtattttggttattaggtcgtcggttatttgtttt

SEQ ID NO: 27782 - DNA, 1095 bp, Artificial Sequence
  chemically treated genomic DNA (Homo sapiens) CpG-island No: 27782
aaaacaaataaccgacgacctaataaccaaaataccccgcgccctaaaaccctacccgcctaccaacgcctacgaacccgaataacccctacgccgcgaccgaaacaaataccctctatatctacgaacccaaccaaaccgtaatacgaacgacgaataatactaaatacccgccccccgacctaaaacccgaaactacgcccgctaaacgacgacgcgaccgctaaaaacgaaaaacgaaaaccgcgcccctacgcccgtcccgccaacgtcccgctaaaaacgacgacctatcccgaacccgcccaaactcttccgcgccgacaaaaacaacaacgaaaacaacgcgaaacgaaacgacgccaacaaccaaaaacgacccgacccgacccgacgcgacgacgacgacgacaacgacaacgacaacgacaacgacaacgacgccaaaacccgtaaacgccgttcgcgaaaccgccgcaaaaacccgaccgcaacgcaaaaaaacctaaaaaccaaaaatcgccgctaccgccataccgctactcttcctcgaacgcttcccctaacccaacctccgcacctacacgaacctcaacgacctaaccctactaaacaccatcatcaacgcctaccgcgcgctcaaccaacccgaaaccgaccccgacgaaccgaaccaactaacgacctcgctacaacctaaaccgccgacgcccgcccgaccgaacgccgaaaaaccccgaacccgcgatataacccaatacctactctcaaacaacctcttcgtataaataaacgaaacgaccgaacccgcgaaacaaaaacgaaatccgctacgtcaccctttatccgcgaaaacgtaataaacctaaaaacccctccgccaaaaacccccgaaaacgaacgcctaaaaaacgcgaccttactcgcgaaaacgctactaaaaaaaaataataaaacgcgaaaaaaaaaaaaaaaccgcgaacgaaaaaaacatcgcgtaaaattacgaaaaaaaaaccccgaaaaacaaaccaacgttaaaaactccgaaaaaaaaatcgaaaaaacgacgaataataatctacgctaaaacgc

SEQ ID NO: 27783 - DNA, 1095 bp, Artificial Sequence
  chemically treated genomic DNA (Homo sapiens) CpG-island No: 27783
ggggtaagtggtcgacggtttggtggttagggtgtttcgcgttttgaggttttgttcgtttgttagcgtttgcgagttcgagtgatttttgcgtcgcggtcggagtaggtgttttttgtgtttgcgggtttagttaagtcgtggtgcggacggcggatgatgttgggtgttcgtttttcggtttgaggttcggggttacgttcgttaggcggcggcgcgatcgttgggggcgggggacgaaggtcgcgtttttgcgttcgtttcgttagcgtttcgttgggggcggcggtttgtttcgagttcgtttaggttttttcgcgtcggtaggggtagtagcgggagtagcgcggggcggagcggcgttagtagttaggagcggttcggttcggttcggcgcggcggcggcggcggtagcggtagcggtagcggtagcggtagcgacgttagagttcgtgggcgtcgttcgcgaggtcgtcgtagaggttcggtcgtagcgtagggaagtttgggggttagaggtcgtcgttgtcgttatgtcgttgttttttttcgagcgttttttttggtttagttttcgtatttatacgggttttagcggtttggttttgttgggtattattattagcgtttatcgcgcgtttagttagttcgaggtcggtttcggcgagtcggattagttaacggtttcgttgtagtttgagtcgtcggcgttcgttcggtcgagcgtcgggggatttcgggttcgcgatgtggtttagtatttgtttttagatagttttttcgtgtgggtgagcgaggcggtcgggttcgcggggtaggggcggggttcgttgcgttattttttattcgcgggggcgtggtgggtttaggggttttttcgttagggattttcgagggcgagcgtttggggggcgcggttttgttcgcgggagcgttgttgagggagagtggtgaggcgcggggagggggagggggtcgcgggcgggaggaatatcgcgtggggttgcgaggaggaggtttcgaggggtaggttagcgttgagggtttcgggaagggggtcggggaggcggcgggtgatggtttgcgttggggcgt

SEQ ID NO: 27784 - DNA, 1095 bp, Artificial Sequence
  chemically treated genomic DNA (Homo sapiens) CpG-island No: 27784
acgccccaacgcaaaccatcacccgccgcctccccgacccccttcccgaaaccctcaacgctaacctacccctcgaaacctcctcctcgcaaccccacgcgatattcctcccgcccgcgaccccctccccctccccgcgcctcaccactctccctcaacaacgctcccgcgaacaaaaccgcgccccccaaacgctcgccctcgaaaatccctaacgaaaaaacccctaaacccaccacgcccccgcgaataaaaaataacgcaacgaaccccgcccctaccccgcgaacccgaccgcctcgctcacccacacgaaaaaactatctaaaaacaaatactaaaccacatcgcgaacccgaaatcccccgacgctcgaccgaacgaacgccgacgactcaaactacaacgaaaccgttaactaatccgactcgccgaaaccgacctcgaactaactaaacgcgcgataaacgctaataataatacccaacaaaaccaaaccgctaaaacccgtataaatacgaaaactaaaccaaaaaaaacgctcgaaaaaaaacaacgacataacgacaacgacgacctctaacccccaaacttccctacgctacgaccgaacctctacgacgacctcgcgaacgacgcccacgaactctaacgtcgctaccgctaccgctaccgctaccgctaccgccgccgccgccgcgccgaaccgaaccgaaccgctcctaactactaacgccgctccgccccgcgctactcccgctactacccctaccgacgcgaaaaaacctaaacgaactcgaaacaaaccgccgcccccaacgaaacgctaacgaaacgaacgcaaaaacgcgaccttcgtcccccgcccccaacgatcgcgccgccgcctaacgaacgtaaccccgaacctcaaaccgaaaaacgaacacccaacatcatccgccgtccgcaccacgacttaactaaacccgcaaacacaaaaaacacctactccgaccgcgacgcaaaaatcactcgaactcgcaaacgctaacaaacgaacaaaacctcaaaacgcgaaacaccctaaccaccaaaccgtcgaccacttacccc

SEQ ID NO: 27785 - DNA, 640 bp, Artificial Sequence
  chemically treated genomic DNA (Homo sapiens) CpG-island No: 27785
ttttcgttcgcgggtttttgttttatttttattattttttcgttttttggcgtggttatttttgattttttcgttgtagtcgcgacggtgttcggtttcgtttttacgttacgggtttgggatttcgtttttcgagttttttgggttttttttatatatttcggtgttacgaatatcgttgtcgcggggtttcgaacggaaggaggtgattttttttgtttagttgcggttattcgaatttgggggataaggttttcgatatttcggggcgcggggttttttacgatttttgcgcggtttttatttgttatcgtttttttttcgtcgagtagcggtcgtcggtttggggttttcgagatagtgttagtatcgtagtggtcgcggttgtcggggataggggttttttcgtttcgtttcgggttgtttatgtcgggtttagtcgcgtagattttcgtttataaataataatttttacggtttttcgtaattttagtttcgtttttcgttttttttagcgtagtgacgttagagttatagttcgtaagtttcgcgagaatttgtagcgtatttgattggttttttagttcgtgattttcgtatttgtttggtttttgtaaatgtagcggatagcggttgttat

SEQ ID NO: 27786 - DNA, 640 bp, Artificial Sequence
  chemically treated genomic DNA (Homo sapiens) CpG-island No: 27786
ataacaaccgctatccgctacatttacaaaaaccaaacaaatacgaaaatcacgaactaaaaaaccaatcaaatacgctacaaattctcgcgaaacttacgaactataactctaacgtcactacgctaaaaaaaacgaaaaacgaaactaaaattacgaaaaaccgtaaaaattattatttataaacgaaaatctacgcgactaaacccgacataaacaacccgaaacgaaacgaaaaaacccctatccccgacaaccgcgaccactacgatactaacactatctcgaaaaccccaaaccgacgaccgctactcgacgaaaaaaaaacgataacaaataaaaaccgcgcaaaaatcgtaaaaaaccccgcgccccgaaatatcgaaaaccttatcccccaaattcgaataaccgcaactaaacaaaaaaaatcacctccttccgttcgaaaccccgcgacaacgatattcgtaacaccgaaatatataaaaaaaacccaaaaaactcgaaaaacgaaatcccaaacccgtaacgtaaaaacgaaaccgaacaccgtcgcgactacaacgaaaaaatcaaaaataaccacgccaaaaaacgaaaaaataataaaaataaaacaaaaacccgcgaacgaaaa

SEQ ID NO: 27787 - DNA, 640 bp, Artificial Sequence
  chemically treated genomic DNA (Homo sapiens) CpG-island No: 27787
gtgataatcgttattcgttatatttatagaagttaaataaatacggaagttacgagttgaagaattaattaggtgcgttgtaggttttcgcgagatttgcgggttgtggttttggcgttattgcgttggagagagcgaggggcggagttggggttgcgggggatcgtgagggttgttgtttgtaggcggaggtttgcgcgattagattcgatatgagtagttcggagcgggacgaggggatttttgttttcgatagtcgcggttattgcgatgttgatattgtttcggggattttagatcggcgatcgttgttcggcgaggagaaggcggtgataggtgagggtcgcgtagggatcgtggggagtttcgcgtttcgagatgtcgagggttttgttttttagattcgggtggtcgtagttaggtagggagagttattttttttcgttcggggtttcgcggtagcggtgttcgtgatatcgaaatatgtggagaaggtttaagaaattcggggagcggagttttaggttcgtgacgtgaagacggaatcgggtatcgtcgcggttgtagcggaaaagttagaagtggttacgttagggagcgaggaggtgatggaggtggagtagaagttcgcgggcgaaga

SEQ ID NO: 27788 - DNA, 640 bp, Artificial Sequence
  chemically treated genomic DNA (Homo sapiens) CpG-island No: 27788
tcttcgcccgcgaacttctactccacctccatcacctcctcgctccctaacgtaaccacttctaacttttccgctacaaccgcgacgatacccgattccgtcttcacgtcacgaacctaaaactccgctccccgaatttcttaaaccttctccacatatttcgatatcacgaacaccgctaccgcgaaaccccgaacgaaaaaaaataactctccctacctaactacgaccacccgaatctaaaaaacaaaaccctcgacatctcgaaacgcgaaactccccacgatccctacgcgaccctcacctatcaccgccttctcctcgccgaacaacgatcgccgatctaaaatccccgaaacaatatcaacatcgcaataaccgcgactatcgaaaacaaaaatcccctcgtcccgctccgaactactcatatcgaatctaatcgcgcaaacctccgcctacaaacaacaaccctcacgatcccccgcaaccccaactccgcccctcgctctctccaacgcaataacgccaaaaccacaacccgcaaatctcgcgaaaacctacaacgcacctaattaattcttcaactcgtaacttccgtatttatttaacttctataaatataacgaataacgattatcac

SEQ ID NO: 27789 - DNA, 896 bp, Artificial Sequence
  chemically treated genomic DNA (Homo sapiens) CpG-island No: 27789
cggcggaagagatgcgggaattacggggttttgattttgaggttttggatttggaaggcgtttgtatataaagaaataataaagttaagttttcgcggttcgattagtagagtacgaaacggggtttttttttttagttcgggtggaaacgtttttattttgttatttcgtttatagtaggttttttattcgttggagtcgtttggatagttttcgcggggtacgttcgaggtttttcggaggaattataagttttatgaagtttcggggcgcgggcggtgatgacgaagttttcgtcgattggtcgtacggggcggggcgcgtaggtttttttcgagaggaggggcggggcgtggggcggggcgagtagcggcggattggcgggtacgttttttcgttcgcggtttttttttcgtttttttttatcgttttttttggtttttcggttagagggtcggagcgagaagatggcgaagacgtacgattatttttttaagtttttgttgatcggcgattcgggggtaggtaagatttgttttttgtttcgttttttagaggacgtttttaatattatttttatttttattatcggtgagggaggggtcgcggttcgggatcgggtagagaattggggggcgggtattaggggacggggaaagggcggggggcgtttgggagttcgggagaggagatttcggggattgtaaggtggcgggggtattgagaggggcgagggcgtgagggagaggggcgagggcgtgagggagagaggcgagcgggaacgtgaggttaagggcgaagggggaatttgggggtaaaggaacgggaaggggaatagaggaataaggattaggggtattgggggaacgagagggttcggagattgatagggaggg

SEQ ID NO: 27790 - DNA, 896 bp, Artificial Sequence
  chemically treated genomic DNA (Homo sapiens) CpG-island No: 27790
ccctccctatcaatctccgaaccctctcgttcccccaatacccctaatccttattcctctattccccttcccgttcctttacccccaaattcccccttcgcccttaacctcacgttcccgctcgcctctctccctcacgccctcgcccctctccctcacgccctcgcccctctcaatacccccgccaccttacaatccccgaaatctcctctcccgaactcccaaacgccccccgccctttccccgtcccctaatacccgccccccaattctctacccgatcccgaaccgcgacccctccctcaccgataataaaaataaaaataatattaaaaacgtcctctaaaaaacgaaacaaaaaacaaatcttacctacccccgaatcgccgatcaacaaaaacttaaaaaaataatcgtacgtcttcgccatcttctcgctccgaccctctaaccgaaaaaccaaaaaaaacgataaaaaaaaacgaaaaaaaaaccgcgaacgaaaaaacgtacccgccaatccgccgctactcgccccgccccacgccccgcccctcctctcgaaaaaaacctacgcgccccgccccgtacgaccaatcgacgaaaacttcgtcatcaccgcccgcgccccgaaacttcataaaacttataattcctccgaaaaacctcgaacgtaccccgcgaaaactatccaaacgactccaacgaataaaaaacctactataaacgaaataacaaaataaaaacgtttccacccgaactaaaaaaaaaaaccccgtttcgtactctactaatcgaaccgcgaaaacttaactttattatttctttatatacaaacgccttccaaatccaaaacctcaaaatcaaaaccccgtaattcccgcatctcttccgccg

SEQ ID NO: 27791 - DNA, 896 bp, Artificial Sequence
  chemically treated genomic DNA (Homo sapiens) CpG-island No: 27791
ttttttttgttagttttcgaattttttcgtttttttaatatttttagtttttgtttttttgttttttttttcgtttttttgtttttaagtttttttttcgtttttagttttacgttttcgttcgttttttttttttacgttttcgttttttttttttacgttttcgttttttttagtgttttcgttattttgtagttttcggggttttttttttcgggtttttaagcgtttttcgtttttttttcgttttttagtattcgttttttaattttttattcggtttcgggtcgcggttttttttttatcgatggtggagatgaaggtggtgttgaaggcgttttttgagaagcggaataggaggtaggttttgtttattttcgagtcgtcgattagtaggagtttgaagagataatcgtacgttttcgttattttttcgtttcggttttttgatcggggagttagaggaggcggtggagagaggcggggagggggtcgcgggcgagggggcgtgttcgttaattcgtcgttgttcgtttcgttttacgtttcgttttttttttcggagaaggtttgcgcgtttcgtttcgtgcggttaatcggcgagggtttcgttattatcgttcgcgtttcgggattttatgggatttgtagttttttcggggagtttcgggcgtgtttcgcgaggattgtttaggcggttttagcggataaaagatttgttatgggcggggtgatagggtggaggcgtttttattcgagttgggaagggaggtttcgtttcgtattttgttggtcgagtcgcgggaatttaattttgttatttttttgtgtgtagacgttttttaaatttaggattttagaattagagtttcgtagttttcgtatttttttcgtcg

SEQ ID NO: 27792 - DNA, 896 bp, Artificial Sequence
  chemically treated genomic DNA (Homo sapiens) CpG-island No: 27792
cgacgaaaaaaatacgaaaactacgaaactctaattctaaaatcctaaatttaaaaaacgtctacacacaaaaaaataacaaaattaaattcccgcgactcgaccaacaaaatacgaaacgaaacctcccttcccaactcgaataaaaacgcctccaccctatcaccccgcccataacaaatcttttatccgctaaaaccgcctaaacaatcctcgcgaaacacgcccgaaactccccgaaaaaactacaaatcccataaaatcccgaaacgcgaacgataataacgaaaccctcgccgattaaccgcacgaaacgaaacgcgcaaaccttctccgaaaaaaaaaacgaaacgtaaaacgaaacgaacaacgacgaattaacgaacacgccccctcgcccgcgaccccctccccgcctctctccaccgcctcctctaactccccgatcaaaaaaccgaaacgaaaaaataacgaaaacgtacgattatctcttcaaactcctactaatcgacgactcgaaaataaacaaaacctacctcctattccgcttctcaaaaaacgccttcaacaccaccttcatctccaccatcgataaaaaaaaaaccgcgacccgaaaccgaataaaaaattaaaaaacgaatactaaaaaacgaaaaaaaaacgaaaaacgcttaaaaacccgaaaaaaaaaaccccgaaaactacaaaataacgaaaacactaaaaaaaacgaaaacgtaaaaaaaaaaaacgaaaacgtaaaaaaaaaaaacgaacgaaaacgtaaaactaaaaacgaaaaaaaaacttaaaaacaaaaaaacgaaaaaaaaaacaaaaaaacaaaaactaaaaatattaaaaaaacgaaaaaattcgaaaactaacaaaaaaaa

SEQ ID NO: 27793 - DNA, 791 bp, Artificial Sequence
  chemically treated genomic DNA (Homo sapiens) CpG-island No: 27793
tttcgcggtcggtattggaattcgatcggagtgtatttgtggggttgcggcgatggttggggttttaacgtcgtcgaggacgttcgtttcgggagtaggagttgcggcgtggttttggcgttttcggatattcggtagggcggagggtttaacggtggggttcgcgtttatcgttttgagttcgtttttgcgttcggcgtttttagtttacgtttcgtttagttttttaggttttagcgtttatttttacgtttcgtttcgtttcgcgatttacggatttcgttttcgagtttcgttttcgtttttacgtgtttcgttttcgagtttcgttttcgttttcgtgtttgtttatgagtcgcgtttcgtttttcgcgtttcgtttagttttttatttcgagttttatttatcgaatttcgttcgcgtcgggagtatttcgcgtttttaacgggttttcgggtcggttttcgcggtggttatgattgcggtcgtgtttttcggttgcgtttttattgttttcgggtttgcgttcgttttttatgtttttattatcgttatcgagtcgttgcgtattattttttttatcgtcgggtgaggcggtcgcgtcgggaaattcggacgtcggggtttttttttttcgttggggttattcgcgattttcggcgtttttatcgcgcggttcgattttgttgcgttttagacgggaggagggttgagagggggagagcggagattcggttttttaaaggcgtttcgtttttttaggaagaagcgtatattgggggttagggtt

SEQ ID NO: 27794 - DNA, 791 bp, Artificial Sequence
  chemically treated genomic DNA (Homo sapiens) CpG-island No: 27794
aaccctaacccccaatatacgcttcttcctaaaaaaacgaaacgcctttaaaaaaccgaatctccgctctccccctctcaaccctcctcccgtctaaaacgcaacaaaatcgaaccgcgcgataaaaacgccgaaaatcgcgaataaccccaacgaaaaaaaaaaaccccgacgtccgaatttcccgacgcgaccgcctcacccgacgataaaaaaaataatacgcaacgactcgataacgataataaaaacataaaaaacgaacgcaaacccgaaaacaataaaaacgcaaccgaaaaacacgaccgcaatcataaccaccgcgaaaaccgacccgaaaacccgttaaaaacgcgaaatactcccgacgcgaacgaaattcgataaataaaactcgaaataaaaaactaaacgaaacgcgaaaaacgaaacgcgactcataaacaaacacgaaaacgaaaacgaaactcgaaaacgaaacacgtaaaaacgaaaacgaaactcgaaaacgaaatccgtaaatcgcgaaacgaaacgaaacgtaaaaataaacgctaaaacctaaaaaactaaacgaaacgtaaactaaaaacgccgaacgcaaaaacgaactcaaaacgataaacgcgaaccccaccgttaaaccctccgccctaccgaatatccgaaaacgccaaaaccacgccgcaactcctactcccgaaacgaacgtcctcgacgacgttaaaaccccaaccatcgccgcaaccccacaaatacactccgatcgaattccaataccgaccgcgaaa

SEQ ID NO: 27795 - DNA, 791 bp, Artificial Sequence
  chemically treated genomic DNA (Homo sapiens) CpG-island No: 27795
ggttttgatttttagtgtgcgtttttttttaagagggcgaggcgtttttggggagtcggattttcgtttttttttttttaatttttttttcgtttgaaacgtaataaggtcgagtcgcgcggtgggggcgtcgagggtcgcgggtaattttagcgggggaggggagtttcggcgttcgggtttttcgacgcgatcgttttattcggcgatgaggaagatgatacgtaacggttcggtggcgatggtgaagatataaagggcgagcgtaggttcgaaggtaatgaaggcgtagtcgaagaatacggtcgtagttatggttatcgcggaaatcgattcgggggttcgttggggacgcgagatgttttcggcgcgggcggggttcggtgggtggggttcggggtggggggttaagcgggacgcggggggcggggcgcggtttatgggtaggtacggggacgggggcggggttcgggggcggggtacgtgggggcgggggcggggttcggaggcggggttcgtgggtcgcggggcgaggcggggcgtgggggtaaacgttagggtttgggggattgggcggggcgtgggttgagggcgtcgggcgtaggggcgggtttaaggcggtgagcgcggattttatcgttgggtttttcgttttatcgggtgttcggaagcgttagggttacgtcgtagtttttgttttcgaggcgggcgttttcggcgacgttagggttttagttatcgtcgtagttttatagatatatttcgatcgggttttagtgtcggtcgcgagg

SEQ ID NO: 27796 - DNA, 791 bp, Artificial Sequence
  chemically treated genomic DNA (Homo sapiens) CpG-island No: 27796
cctcgcgaccgacactaaaacccgatcgaaatatatctataaaactacgacgataactaaaaccctaacgtcgccgaaaacgcccgcctcgaaaacaaaaactacgacgtaaccctaacgcttccgaacacccgataaaacgaaaaacccaacgataaaatccgcgctcaccgccttaaacccgcccctacgcccgacgccctcaacccacgccccgcccaatcccccaaaccctaacgtttacccccacgccccgcctcgccccgcgacccacgaaccccgcctccgaaccccgcccccgcccccacgtaccccgcccccgaaccccgcccccgtccccgtacctacccataaaccgcgccccgccccccgcgtcccgcttaaccccccaccccgaaccccacccaccgaaccccgcccgcgccgaaaacatctcgcgtccccaacgaacccccgaatcgatttccgcgataaccataactacgaccgtattcttcgactacgccttcattaccttcgaacctacgctcgccctttatatcttcaccatcgccaccgaaccgttacgtatcatcttcctcatcgccgaataaaacgatcgcgtcgaaaaacccgaacgccgaaactcccctcccccgctaaaattacccgcgaccctcgacgcccccaccgcgcgactcgaccttattacgtttcaaacgaaaaaaaaattaaaaaaaaaaaaacgaaaatccgactccccaaaaacgcctcgccctcttaaaaaaaaacgcacactaaaaatcaaaacc

SEQ ID NO: 27797 - DNA, 501 bp, Artificial Sequence
  chemically treated genomic DNA (Homo sapiens) CpG-island No: 27797
atttggcgtttcgtcgtttagggattttttaggcgttttgttcgagtcgagttttaggggttagtagatcgggtttagcggtttcgtcggcgtcgtttgagttagttcgggtttttagtcgagtttacgtgggatttaggcgtttcgtagggcgggtatcgggtattgggtattttttttggtcgcgtattatcggtttagggtaggttcgggtataatttcgggattttttcggcgtttgcggttgggcggtcgtgagttttgtttcgttcgtcgtttcgcgtttatttttttgcggttttaagttttcgggacgtaatttcgtgcggcgtttgcgagcggttgggcggtggtttttcgggggcggggcggcggcgtttcgttttttttttatttgcgcgcgggcggtcgggaggcggggttgggttttagggggcgtggtcgggtttatgggggcggggtttggacgtagtttttgtttagtcggttttttgggttttt

SEQ ID NO: 27798 - DNA, 501 bp, Artificial Sequence
  chemically treated genomic DNA (Homo sapiens) CpG-island No: 27798
aaaaacccaaaaaaccgactaaacaaaaactacgtccaaaccccgcccccataaacccgaccacgccccctaaaacccaaccccgcctcccgaccgcccgcgcgcaaataaaaaaaaaacgaaacgccgccgccccgcccccgaaaaaccaccgcccaaccgctcgcaaacgccgcacgaaattacgtcccgaaaacttaaaaccgcaaaaaaataaacgcgaaacgacgaacgaaacaaaactcacgaccgcccaaccgcaaacgccgaaaaaatcccgaaattatacccgaacctaccctaaaccgataatacgcgaccaaaaaaaatacccaatacccgatacccgccctacgaaacgcctaaatcccacgtaaactcgactaaaaacccgaactaactcaaacgacgccgacgaaaccgctaaacccgatctactaacccctaaaactcgactcgaacaaaacgcctaaaaaatccctaaacgacgaaacgccaaat

SEQ ID NO: 27799 - DNA, 501 bp, Artificial Sequence
  chemically treated genomic DNA (Homo sapiens) CpG-island No: 27799
aggaatttaggaagtcgattgagtaaagattgcgtttaggtttcgtttttatgagttcggttacgttttttggagtttagtttcgtttttcggtcgttcgcgcgtaggtagggaagaggcggagcgtcgtcgtttcgttttcgaggagttatcgtttagtcgttcgtaggcgtcgtacggagttgcgtttcggggatttggggtcgtagggaggtgagcgcggggcgacgagcggggtaggatttacggtcgtttagtcgtaggcgtcggaagggtttcgaggttgtgttcgagtttgttttgaatcggtggtgcgcggttaggaagggtgtttagtgttcggtgttcgttttgcgaagcgtttgggttttacgtgggttcggttggaggttcgggttggtttagacggcgtcggcggggtcgttggattcggtttgttggtttttagggttcggttcggataggacgtttaaggggtttttgggcgacggggcgttagat

SEQ ID NO: 27800 - DNA, 501 bp, Artificial Sequence
  chemically treated genomic DNA (Homo sapiens) CpG-island No: 27800
atctaacgccccgtcgcccaaaaaccccttaaacgtcctatccgaaccgaaccctaaaaaccaacaaaccgaatccaacgaccccgccgacgccgtctaaaccaacccgaacctccaaccgaacccacgtaaaacccaaacgcttcgcaaaacgaacaccgaacactaaacacccttcctaaccgcgcaccaccgattcaaaacaaactcgaacacaacctcgaaacccttccgacgcctacgactaaacgaccgtaaatcctaccccgctcgtcgccccgcgctcacctccctacgaccccaaatccccgaaacgcaactccgtacgacgcctacgaacgactaaacgataactcctcgaaaacgaaacgacgacgctccgcctcttccctacctacgcgcgaacgaccgaaaaacgaaactaaactccaaaaaacgtaaccgaactcataaaaacgaaacctaaacgcaatctttactcaatcgacttcctaaattcct

SEQ ID NO: 27801 - DNA, 725 bp, Artificial Sequence
  chemically treated genomic DNA (Homo sapiens) CpG-island No: 27801
tcgcggcggtttcgcgagttcgtcgggtgggtttagtttagcgtacgtcggagtcgagcgtagggggcggggaagggatttgttgtagttgtagtcgtttgggcgtttttggagcgcgcggtgattttttcggtcggttcgttttatgtagtttcgttgcggaagtgtagcggggggaggcggcggttatcgcggtattaagtacgagaggtcggggttcggttttttgtagtattaggttttgggagtcgcgcggcgcgttttagtggttcgattcgtcgtggttcggcgtttatcgtagtttgtatgtttcgcgtgcgttttgttcggttttcgtagttttttgttcgtatcgttgtagtcgggcgtcggagtaatatgtttattcgagtgatatttgtcgtggttaattttatgggcggtattatggttggtagttaggttcgagtacggcgtttgtattgcggaggttcggatttgtttttgcgtttttttacggcggttagattttttggggttgttttaggacgaggtggagtgtagcgtcgattatatcgttcgttttatttttattttaaggagattcggcggttgtttgggttattggttattagatgagttagcgatatcgcggcgtttgtttttttcgcggtttttttcgtacggtttagttttttttttttgtttcggttttagggttttatagcgtcggcgttaggtttatt

SEQ ID NO: 27802 - DNA, 725 bp, Artificial Sequence
  chemically treated genomic DNA (Homo sapiens) CpG-island No: 27802
aataaacctaacgccgacgctataaaaccctaaaaccgaaacaaaaaaaaaaaactaaaccgtacgaaaaaaaccgcgaaaaaaacaaacgccgcgatatcgctaactcatctaataaccaataacccaaacaaccgccgaatctccttaaaataaaaataaaacgaacgatataatcgacgctacactccacctcgtcctaaaacaaccccaaaaaatctaaccgccgtaaaaaaacgcaaaaacaaatccgaacctccgcaatacaaacgccgtactcgaacctaactaccaaccataataccgcccataaaattaaccacgacaaatatcactcgaataaacatattactccgacgcccgactacaacgatacgaacaaaaaactacgaaaaccgaacaaaacgcacgcgaaacatacaaactacgataaacgccgaaccacgacgaatcgaaccactaaaacgcgccgcgcgactcccaaaacctaatactacaaaaaaccgaaccccgacctctcgtacttaataccgcgataaccgccgcctccccccgctacacttccgcaacgaaactacataaaacgaaccgaccgaaaaaatcaccgcgcgctccaaaaacgcccaaacgactacaactacaacaaatcccttccccgccccctacgctcgactccgacgtacgctaaactaaacccacccgacgaactcgcgaaaccgccgcga

SEQ ID NO: 27803 - DNA, 725 bp, Artificial Sequence
  chemically treated genomic DNA (Homo sapiens) CpG-island No: 27803
gataggtttggcgtcggcgttgtgagattttgaggtcggagtaggagagagaggttggatcgtgcggggaaggtcgcgaggagagtaggcgtcgcggtgtcgttgatttatttggtagttagtggtttaggtagtcgtcgagtttttttgggatgaggatggggcggacgatgtggtcggcgttgtattttatttcgttttgagatagttttaggaaatttggtcgtcgtggggaaacgtaggggtaggttcgagttttcgtagtgtagacgtcgtgttcgggtttggttgttagttatgatgtcgtttatgaaattggttacggtagatgttattcgagtgagtatattatttcggcgttcggttgtagcggtgcgagtaggaggttgcgggggtcgggtaaggcgtacgcggggtatgtaggttgcggtgggcgtcgggttacggcgagtcgggttattgggacgcgtcgcgcggtttttagagtttagtgttgtagggggtcgagtttcggtttttcgtgtttagtgtcgcggtggtcgtcgttttttttcgttatattttcgtaacggagttgtatggagcgggtcgatcgggggagttatcgcgcgttttaggagcgtttaggcggttgtagttgtagtaggtttttttttcgttttttgcgttcggtttcggcgtgcgttgaattgagtttattcggcgagttcgcggagtcgtcgcgg

SEQ ID NO: 27804 - DNA, 725 bp, Artificial Sequence
  chemically treated genomic DNA (Homo sapiens) CpG-island No: 27804
ccgcgacgactccgcgaactcgccgaataaactcaattcaacgcacgccgaaaccgaacgcaaaaaacgaaaaaaaaacctactacaactacaaccgcctaaacgctcctaaaacgcgcgataactcccccgatcgacccgctccatacaactccgttacgaaaatataacgaaaaaaaacgacgaccaccgcgacactaaacacgaaaaaccgaaactcgaccccctacaacactaaactctaaaaaccgcgcgacgcgtcccaataacccgactcgccgtaacccgacgcccaccgcaacctacataccccgcgtacgccttacccgacccccgcaacctcctactcgcaccgctacaaccgaacgccgaaataatatactcactcgaataacatctaccgtaaccaatttcataaacgacatcataactaacaaccaaacccgaacacgacgtctacactacgaaaactcgaacctacccctacgtttccccacgacgaccaaatttcctaaaactatctcaaaacgaaataaaatacaacgccgaccacatcgtccgccccatcctcatcccaaaaaaactcgacgactacctaaaccactaactaccaaataaatcaacgacaccgcgacgcctactctcctcgcgaccttccccgcacgatccaacctctctctcctactccgacctcaaaatctcacaacgccgacgccaaacctatc

SEQ ID NO: 27805 - DNA, 864 bp, Artificial Sequence
  chemically treated genomic DNA (Homo sapiens) CpG-island No: 27805
gggaggttacgttttattacgtgatcgtagttttagcgcggcggggtcggcgttttttggttgtcgttattttcggttttttgttagtcgcgagcgaacgattaagagggtgttcgattgttagagtcgagcgaagcgtgagtgcgtcggattttttatttttatttttcggggattttatttttttagtcgggtcgtgagttgttttcggttttttatttttttcgtcggtaatggtcgcgggaaatggcggttttgttttatttttttttttttttcggcgttttcggttttttttttcgtttttgattttacgtttgacgcgttgtgggttttttcgcggtagatttttgttttcggggagtcgagtcgaggttggcgggcgttgcggttcggggcggtagattgagggcggtcggggagtgaggagtcgcggggagagagtcgcggcgttttcgggataatgcggcggcggtttgtttaggtggggcgcgtgcggttatttatttttttttcgtttttcgttttgagcggggcgttttggagattgggagagcggatgcgggcgggagggggtcgggggaagaacggttgatgtgtagggggagggaacgtttcgagagaagaaaatggcgtttggtgtaaatttcgtttttttttacgtcgtttttttcgtatttcgtcgttttttacgtttttttcgattaatttgttttttttcgttcgagcggttgttagttacggggttttagcggtttgttggggtcgcgcgattttttttttggttttgtgtttgttatttttttgttatatcgaagtcgtgtgttttttagttttggtttatttttatttcgtttttttttg

SEQ ID NO: 27806 - DNA, 864 bp, Artificial Sequence
  chemically treated genomic DNA (Homo sapiens) CpG-island No: 27806
caaaaaaaaacgaaataaaaataaaccaaaactaaaaaacacacgacttcgatataacaaaaaaataacaaacacaaaaccaaaaaaaaaatcgcgcgaccccaacaaaccgctaaaaccccgtaactaacaaccgctcgaacgaaaaaaaacaaattaatcgaaaaaaacgtaaaaaacgacgaaatacgaaaaaaacgacgtaaaaaaaaacgaaatttacaccaaacgccattttcttctctcgaaacgttccctccccctacacatcaaccgttcttcccccgaccccctcccgcccgcatccgctctcccaatctccaaaacgccccgctcaaaacgaaaaacgaaaaaaaaataaataaccgcacgcgccccacctaaacaaaccgccgccgcattatcccgaaaacgccgcgactctctccccgcgactcctcactccccgaccgccctcaatctaccgccccgaaccgcaacgcccgccaacctcgactcgactccccgaaaacaaaaatctaccgcgaaaaaacccacaacgcgtcaaacgtaaaatcaaaaacgaaaaaaaaaaccgaaaacgccgaaaaaaaaaaaaaaataaaacaaaaccgccatttcccgcgaccattaccgacgaaaaaaataaaaaaccgaaaacaactcacgacccgactaaaaaaataaaatccccgaaaaataaaaataaaaaatccgacgcactcacgcttcgctcgactctaacaatcgaacaccctcttaatcgttcgctcgcgactaacaaaaaaccgaaaataacgacaaccaaaaaacgccgaccccgccgcgctaaaactacgatcacgtaataaaacgtaacctccc

SEQ ID NO: 27807 - DNA, 864 bp, Artificial Sequence
  chemically treated genomic DNA (Homo sapiens) CpG-island No: 27807
tagaaaaaaacgaggtgaaaatgaattaggattgaagggtatacgatttcggtataataggaaggtgataagtataagattagggaaggggtcgcgcggttttagtaagtcgttagaatttcgtggttagtagtcgttcgggcgaggggagataggttggtcggagggggcgtgggaggcggcgaagtgcggagaagacggcgtgggaaggggcgggatttgtattaagcgttatttttttttttcgaagcgttttttttttttgtatattagtcgtttttttttcggttttttttcgttcgtattcgtttttttagtttttagagcgtttcgtttagggcgaggggcgggggaagagtaggtaatcgtacgcgttttatttaggtaggtcgtcgtcgtattgtttcggggacgtcgcgatttttttttcgcgattttttatttttcggtcgtttttaatttatcgtttcgggtcgtagcgttcgttagtttcgattcggtttttcggggataggagtttatcgcggaagggtttatagcgcgttaggcgtggagttagaaacggagaagggggtcggggacgtcgaggggaagggggaggtaaggtagagtcgttatttttcgcggttattgtcggcgagaggagtggagggtcgaaggtagtttacggttcggttgggagggtggggttttcgaggagtaggggtagggggttcggcgtatttacgtttcgttcggttttagtagtcgaatatttttttggtcgttcgttcgcgattgatagagaatcggaagtgacggtagttaggagacgtcggtttcgtcgcgttggggttgcggttacgtgatggggcgtggtttttt

SEQ ID NO: 27808 - DNA, 864 bp, Artificial Sequence
  chemically treated genomic DNA (Homo sapiens) CpG-island No: 27808
aaaaaaccacgccccatcacgtaaccgcaaccccaacgcgacgaaaccgacgtctcctaactaccgtcacttccgattctctatcaatcgcgaacgaacgaccaaaaaaatattcgactactaaaaccgaacgaaacgtaaatacgccgaaccccctacccctactcctcgaaaaccccaccctcccaaccgaaccgtaaactaccttcgaccctccactcctctcgccgacaataaccgcgaaaaataacgactctaccttacctcccccttcccctcgacgtccccgacccccttctccgtttctaactccacgcctaacgcgctataaacccttccgcgataaactcctatccccgaaaaaccgaatcgaaactaacgaacgctacgacccgaaacgataaattaaaaacgaccgaaaaataaaaaatcgcgaaaaaaaaatcgcgacgtccccgaaacaatacgacgacgacctacctaaataaaacgcgtacgattacctactcttcccccgcccctcgccctaaacgaaacgctctaaaaactaaaaaaacgaatacgaacgaaaaaaaaccgaaaaaaaaacgactaatatacaaaaaaaaaaaacgcttcgaaaaaaaaaaataacgcttaatacaaatcccgccccttcccacgccgtcttctccgcacttcgccgcctcccacgccccctccgaccaacctatctcccctcgcccgaacgactactaaccacgaaattctaacgacttactaaaaccgcgcgaccccttccctaatcttatacttatcaccttcctattataccgaaatcgtatacccttcaatcctaattcattttcacctcgtttttttcta

SEQ ID NO: 27809 - DNA, 550 bp, Artificial Sequence
  chemically treated genomic DNA (Homo sapiens) CpG-island No: 27809
  misc_feature (539)..(539): n is either a, c, g or t
gtggcggttttttcggcggtcgtaggaggttattttagttaaagggtcgttgaaggttttgaggtttttacgtttttatattttcgtcgtttttatattttttttattgggggtcgtttttcgtcgcgggtcgggtcgggtcgggtaaggcggggcggggcggggcgggagaggtcgcggggttgggtcgggttaggtttgtagcgggtcggggttttgggatggttggggacgggcgcgggggcgtcgtatcgataggattcgggtcgaggggagagtaaggggcgaatagagagaaggtaggatgtcgttatttatattgggtcgtagcgtcgtcgtcgtcgtttcgttttgtggtgaatttaaagtagttgtcggtcgttattttggtatttttttttagtcggttgggtattgcggcgggtacgaagagtcgggttttatggcgggataagagatatagaggagtcgagacgtcgagggagggtagggagagaaagagagaggcgtcgtgagagtaagttggcggggttttaggnatcgtcgcgtt

SEQ ID NO: 27810 - DNA, 550 bp, Artificial Sequence
  chemically treated genomic DNA (Homo sapiens) CpG-island No: 27810
  misc_feature (12)..(12): n is either a, c, g or t
aacgcgacgatncctaaaaccccgccaacttactctcacgacgcctctctctttctctccctaccctccctcgacgtctcgactcctctatatctcttatcccgccataaaacccgactcttcgtacccgccgcaatacccaaccgactaaaaaaaaataccaaaataacgaccgacaactactttaaattcaccacaaaacgaaacgacgacgacgacgctacgacccaatataaataacgacatcctaccttctctctattcgccccttactctcccctcgacccgaatcctatcgatacgacgcccccgcgcccgtccccaaccatcccaaaaccccgacccgctacaaacctaacccgacccaaccccgcgacctctcccgccccgccccgccccgccttacccgacccgacccgacccgcgacgaaaaacgacccccaataaaaaaaatataaaaacgacgaaaatataaaaacgtaaaaacctcaaaaccttcaacgaccctttaactaaaataacctcctacgaccgccgaaaaaaccgccac

SEQ ID NO: 27811 - DNA, 550 bp, Artificial Sequence
  chemically treated genomic DNA (Homo sapiens) CpG-island No: 27811
  misc_feature (12)..(12): n is either a, c, g or t
ggcgcggcggtntttgaggtttcgttagtttgtttttacggcgtttttttttttttttttttgttttttttcggcgtttcggtttttttgtgttttttgtttcgttatgggattcgatttttcgtgttcgtcgtagtgtttagtcggttgggggaagatgttaaaatggcgatcggtaattattttggatttattataggacggggcggcggcggcggcgttgcggtttaatataggtaacggtattttgttttttttttgttcgttttttgtttttttttcggttcggattttgtcgatgcgacgttttcgcgttcgtttttagttattttagagtttcggttcgttgtaggtttggttcggtttagtttcgcggtttttttcgtttcgtttcgtttcgttttgttcggttcggttcggttcgcggcggagagcggtttttagtaggggagatgtagagacggcggaggtgtagggacgtggaggttttagggtttttagcggttttttaattaaaatggttttttgcggtcgtcgagggagtcgttat

SEQ ID NO: 27812 - DNA, 550 bp, Artificial Sequence
  chemically treated genomic DNA (Homo sapiens) CpG-island No: 27812
  misc_feature (539)..(539): n is either a, c, g or t
ataacgactccctcgacgaccgcaaaaaaccattttaattaaaaaaccgctaaaaaccctaaaacctccacgtccctacacctccgccgtctctacatctcccctactaaaaaccgctctccgccgcgaaccgaaccgaaccgaacaaaacgaaacgaaacgaaacgaaaaaaaccgcgaaactaaaccgaaccaaacctacaacgaaccgaaactctaaaataactaaaaacgaacgcgaaaacgtcgcatcgacaaaatccgaaccgaaaaaaaaacaaaaaacgaacaaaaaaaaaacaaaataccgttacctatattaaaccgcaacgccgccgccgccgccccgtcctataataaatccaaaataattaccgatcgccattttaacatcttcccccaaccgactaaacactacgacgaacacgaaaaatcgaatcccataacgaaacaaaaaacacaaaaaaaccgaaacgccgaaaaaaaacaaaaaaaaaaaaaaaaaaacgccgtaaaaacaaactaacgaaacctcaaanaccgccgcgcc

SEQ ID NO: 27813 - DNA, 806 bp, Artificial Sequence
  chemically treated genomic DNA (Homo sapiens) CpG-island No: 27813
gcgttatcgtttattgcgggggtggaggtatagcgttatcgtttattgcgggggtggaggtatagcgttatcgtttattgcgggggtggaggtatagcgttatcgtttattgcgggggtggaggtatagcgttatcgtttattgcgggggtggaggtatagcgttatcgtttattgcgggggtggaggtatagcgttatcgtttattgcgggggtggaggtatagcgttatcgtttattgcgggggtggaggtatagcgttatcgtttattgcgggggtggaggtatagcgttatcgtttattgcggcggtggaggtatagcgttatcgtttattgcgggggtggaggtatagcgttatcgtttattgcggcggtggaggtatagcgttatcgtttattgcggcggtggaggtatagcgttatcgtttattgcggcggtggaggtatagcgttatcgtttattgcggcggtggaggtatagcgttatcgtttattgcggcggtggaggtatagcgttatcgtttattgcggcggtggaggtatagcgttatcgtttattgcgggggtggaggtatagcgttatcgtttattgcgggggtggaggtatagcgttatcgtttattgcggcggtggaggtatagcgttatcgtttattgcggcggtggaggtatagcgttatcgtttattgcggcggtggaggtatagcgttatcgtttattgcggcggtggaggtatagttttattgtttattgtagcggtggaggtagtagtttttttgaggttatggttttgttatatacgtttta

SEQ ID NO: 27814 - DNA, 806 bp, Artificial Sequence
  chemically treated genomic DNA (Homo sapiens) CpG-island No: 27814
taaaacgtatataacaaaaccataacctcaaaaaaactactacctccaccgctacaataaacaataaaactatacctccaccgccgcaataaacgataacgctatacctccaccgccgcaataaacgataacgctatacctccaccgccgcaataaacgataacgctatacctccaccgccgcaataaacgataacgctatacctccacccccgcaataaacgataacgctatacctccacccccgcaataaacgataacgctatacctccaccgccgcaataaacgataacgctatacctccaccgccgcaataaacgataacgctatacctccaccgccgcaataaacgataacgctatacctccaccgccgcaataaacgataacgctatacctccaccgccgcaataaacgataacgctatacctccaccgccgcaataaacgataacgctatacctccacccccgcaataaacgataacgctatacctccaccgccgcaataaacgataacgctatacctccacccccgcaataaacgataacgctatacctccacccccgcaataaacgataacgctatacctccacccccgcaataaacgataacgctatacctccacccccgcaataaacgataacgctatacctccacccccgcaataaacgataacgctatacctccacccccgcaataaacgataacgctatacctccacccccgcaataaacgataacgctatacctccacccccgcaataaacgataacgctatacctccacccccgcaataaacgataacgc

SEQ ID NO: 27815 - DNA, 806 bp, Artificial Sequence
  chemically treated genomic DNA (Homo sapiens) CpG-island No: 27815
tggagcgtatgtagtaggattatgattttaagggaattgttatttttatcgttatagtgaatagtgagattgtatttttatcgtcgtagtgaacggtgacgttgtatttttatcgtcgtagtgaacggtgacgttgtatttttatcgtcgtagtgaacggtgacgttgtatttttatcgtcgtagtgaacggtgacgttgtatttttattttcgtagtgaacggtgacgttgtatttttattttcgtagtgaacggtgacgttgtatttttatcgtcgtagtgaacggtgacgttgtatttttatcgtcgtagtgaacggtgacgttgtatttttatcgtcgtagtgaacggtgacgttgtatttttatcgtcgtagtgaacggtgacgttgtatttttatcgtcgtagtgaacggtgacgttgtatttttatcgtcgtagtgaacggtgacgttgtatttttattttcgtagtgaacggtgacgttgtatttttatcgtcgtagtgaacggtgacgttgtatttttattttcgtagtgaacggtgacgttgtatttttattttcgtagtgaacggtgacgttgtatttttattttcgtagtgaacggtgacgttgtatttttattttcgtagtgaacggtgacgttgtatttttattttcgtagtgaacggtgacgttgtatttttattttcgtagtgaacggtgacgttgtatttttattttcgtagtgaacggtgacgttgtatttttattttcgtagtgaacggtgacgttgtatttttattttcgtagtgaacggtgacgt

SEQ ID NO: 27816 - DNA, 806 bp, Artificial Sequence
  chemically treated genomic DNA (Homo sapiens) CpG-island No: 27816
acgtcaccgttcactacgaaaataaaaatacaacgtcaccgttcactacgaaaataaaaatacaacgtcaccgttcactacgaaaataaaaatacaacgtcaccgttcactacgaaaataaaaatacaacgtcaccgttcactacgaaaataaaaatacaacgtcaccgttcactacgaaaataaaaatacaacgtcaccgttcactacgaaaataaaaatacaacgtcaccgttcactacgaaaataaaaatacaacgtcaccgttcactacgaaaataaaaatacaacgtcaccgttcactacgacgataaaaatacaacgtcaccgttcactacgaaaataaaaatacaacgtcaccgttcactacgacgataaaaatacaacgtcaccgttcactacgacgataaaaatacaacgtcaccgttcactacgacgataaaaatacaacgtcaccgttcactacgacgataaaaatacaacgtcaccgttcactacgacgataaaaatacaacgtcaccgttcactacgacgataaaaatacaacgtcaccgttcactacgaaaataaaaatacaacgtcaccgttcactacgaaaataaaaatacaacgtcaccgttcactacgacgataaaaatacaacgtcaccgttcactacgacgataaaaatacaacgtcaccgttcactacgacgataaaaatacaacgtcaccgttcactacgacgataaaaatacaatctcactattcactataacgataaaaataacaattcccttaaaatcataatcctactacatacgctcca

SEQ ID NO: 27817 - DNA, 549 bp, Artificial Sequence
  chemically treated genomic DNA (Homo sapiens) CpG-island No: 27817
  misc_feature (322)..(322): n is either a, c, g or t
tggcgtgggggagggggcggggaatcgtagtcgtttaaagggaggaggcgggcggtcgggcgggggcgttttttttggttcggggcgttttggagagggcgtgcggcgcgggtttcggtttttttcgtcgggattttattgttttgtagagggtgggggttggggggggggcggtcgttttcggggcgttgttgagttttgaatttttcgtcgtcgagattttttattagtgcgttttttttcgttcggtcgcggatcgcgtttttttttttttttttgtttttttttcggtcggagcgcgagaggggggggggcgcgtcgntttatttttttattttcgtattttcgtattttttttcgtaattttttttcggtcggttcgttcgtttcgcgtttagtttcgttttcggtcggagcgggttttttatatataattgattcggtcgttacgaaaagtgtatttgtttttttttttttttttttcgcggtcgttcgggtcggttttcgggggtgagggggtcgcgagggagggaggcgggaggggggagt

SEQ ID NO: 27818 - DNA, 549 bp, Artificial Sequence
  chemically treated genomic DNA (Homo sapiens) CpG-island No: 27818
  misc_feature (228)..(228): n is either a, c, g or t
actcccccctcccgcctccctccctcgcgaccccctcacccccgaaaaccgacccgaacgaccgcgaaaaaaaaaaaaaaaaaaacaaatacacttttcgtaacgaccgaatcaattatatataaaaaacccgctccgaccgaaaacgaaactaaacgcgaaacgaacgaaccgaccgaaaaaaaattacgaaaaaaaatacgaaaatacgaaaataaaaaaataaancgacgcgcccccccccctctcgcgctccgaccgaaaaaaaaacaaaaaaaaaaaaaaaaacgcgatccgcgaccgaacgaaaaaaaacgcactaataaaaaatctcgacgacgaaaaattcaaaactcaacaacgccccgaaaacgaccgccccccccccaacccccaccctctacaaaacaataaaatcccgacgaaaaaaaccgaaacccgcgccgcacgccctctccaaaacgccccgaaccaaaaaaaacgcccccgcccgaccgcccgcctcctccctttaaacgactacgattccccgccccctcccccacgcca

SEQ ID NO: 27819 - DNA, 549 bp, Artificial Sequence
  chemically treated genomic DNA (Homo sapiens) CpG-island No: 27819
  misc_feature (228)..(228): n is either a, c, g or t
gtttttttttttcgtttttttttttcgcggtttttttattttcgggagtcggttcgggcggtcgcggagggggagggggaggggataagtgtatttttcgtaacgatcgaattaattgtgtgtgaagagttcgtttcggtcggggacggggttgagcgcggggcgggcgggtcggtcgggggaggattgcggaggggggtgcgggggtgcgggggtgggagggtaggncggcgcgtttttttttttttcgcgtttcggtcggggagggagtaaggaggggggggggggcgcggttcgcgatcgggcgggggggaacgtattaatggagggtttcggcgacggaaagtttaaagtttagtagcgtttcgggagcggtcgttttttttttagtttttattttttgtagaataatgaggtttcggcgggggagatcggggttcgcgtcgtacgttttttttagggcgtttcgggttagaggggacgttttcgttcggtcgttcgttttttttttttaggcggttgcggtttttcgtttttttttttacgtta

SEQ ID NO: 27820 - DNA, 549 bp, Artificial Sequence
  chemically treated genomic DNA (Homo sapiens) CpG-island No: 27820
  misc_feature (322)..(322): n is either a, c, g or t
taacgtaaaaaaaaaaacgaaaaaccgcaaccgcctaaaaaaaaaaaacgaacgaccgaacgaaaacgtcccctctaacccgaaacgccctaaaaaaaacgtacgacgcgaaccccgatctcccccgccgaaacctcattattctacaaaaaataaaaactaaaaaaaaaacgaccgctcccgaaacgctactaaactttaaactttccgtcgccgaaaccctccattaatacgttcccccccgcccgatcgcgaaccgcgcccccccccccctccttactccctccccgaccgaaacgcgaaaaaaaaaaaaacgcgccgncctaccctcccacccccgcacccccgcacccccctccgcaatcctcccccgaccgacccgcccgccccgcgctcaaccccgtccccgaccgaaacgaactcttcacacacaattaattcgatcgttacgaaaaatacacttatcccctccccctccccctccgcgaccgcccgaaccgactcccgaaaataaaaaaaccgcgaaaaaaaaaaacgaaaaaaaaaaac

SEQ ID NO: 27821 - DNA, 618 bp, Artificial Sequence
  chemically treated genomic DNA (Homo sapiens) CpG-island No: 27821
  misc_feature (116)..(116): n is either a, c, g or t
ttcgagagtggagggggggtaataaaggttaaattgtgggggttcgcgcgttaattatgtttgttttgttttgttttttgagagtcggtttttatttgttttttcgggttcgtcgnattcgttggggggcggtgattgtcgcgtagcgtcgcggtattgtgttacggtcgttcggtgtgtagcgggttcggtatcgcgtttcggcgagggaggcgttttttggcggcggggcgggggtcgggttcgggttgtcgcggtcgttacgagaagggaagtggattgtgtttggggatgtgaggacgggaagcgttgagtgttagggaggggtttttcggcgcggcgcggggagttgagacgcggtttgtagagttgagtttattttagtaggttcgggtttttttcgggaggggacggggtgttttttttaggtgtatcgtttgatcggaagtcgcgggcgttggcggtttttggcgaaggggttttttttaatgaggggatacggcggggcgggggtagtcggtcgtttcgagggcgcgcgtaggggttaagttggatttatattttcgtttttttttttttttttttattttgtttttaaggttggatattttggatagg

SEQ ID NO: 27822 - DNA, 618 bp, Artificial Sequence
  chemically treated genomic DNA (Homo sapiens) CpG-island No: 27822
  misc_feature (503)..(503): n is either a, c, g or t
cctatccaaaatatccaaccttaaaaacaaaataaaaaaaaaaaaaaaaaaacgaaaatataaatccaacttaacccctacgcgcgccctcgaaacgaccgactacccccgccccgccgtatcccctcattaaaaaaaaccccttcgccaaaaaccgccaacgcccgcgacttccgatcaaacgatacacctaaaaaaaacaccccgtcccctcccgaaaaaaacccgaacctactaaaataaactcaactctacaaaccgcgtctcaactccccgcgccgcgccgaaaaacccctccctaacactcaacgcttcccgtcctcacatccccaaacacaatccacttcccttctcgtaacgaccgcgacaacccgaacccgacccccgccccgccgccaaaaaacgcctccctcgccgaaacgcgataccgaacccgctacacaccgaacgaccgtaacacaataccgcgacgctacgcgacaatcaccgccccccaacgaatncgacgaacccgaaaaaacaaataaaaaccgactctcaaaaaacaaaacaaaacaaacataattaacgcgcgaacccccacaatttaacctttattaccccccctccactctcgaa

SEQ ID NO: 27823 - DNA, 618 bp, Artificial Sequence
  chemically treated genomic DNA (Homo sapiens) CpG-island No: 27823
  misc_feature (503)..(503): n is either a, c, g or t
tttatttaaagtgtttagttttgaagataaggtggagggaggagagagagggcggaggtgtaaatttaatttaatttttgcgcgcgttttcgaggcggtcggttgttttcgtttcgtcgtgtttttttattaaggaaggttttttcgttaggggtcgttaacgttcgcggttttcggttagacggtgtatttgagagggatatttcgttttttttcgggagggattcgggtttgttgaagtgggtttaattttgtaaatcgcgttttaatttttcgcgtcgcgtcggggaatttttttttgatatttaacgtttttcgtttttatatttttaaatatagtttattttttttttcgtggcggtcgcggtaattcgagttcggttttcgtttcgtcgttagagaacgtttttttcgtcgggacgcggtgtcgagttcgttgtatatcgagcggtcgtggtataatatcgcggcgttgcgcgataattatcgttttttagcgaatncggcgaattcgggagaatagatggagatcgatttttaaaaaataaagtaaaataaatataattggcgcgcgggtttttatagtttagtttttattgttttttttttattttcggg

SEQ ID NO: 27824 - DNA, 618 bp, Artificial Sequence
  chemically treated genomic DNA (Homo sapiens) CpG-island No: 27824
  misc_feature (116)..(116): n is either a, c, g or t
cccgaaaataaaaaaaaaacaataaaaactaaactataaaaacccgcgcgccaattatatttattttactttattttttaaaaatcgatctccatctattctcccgaattcgccgnattcgctaaaaaacgataattatcgcgcaacgccgcgatattataccacgaccgctcgatatacaacgaactcgacaccgcgtcccgacgaaaaaaacgttctctaacgacgaaacgaaaaccgaactcgaattaccgcgaccgccacgaaaaaaaaaataaactatatttaaaaatataaaaacgaaaaacgttaaatatcaaaaaaaaattccccgacgcgacgcgaaaaattaaaacgcgatttacaaaattaaacccacttcaacaaacccgaatccctcccgaaaaaaaacgaaatatccctctcaaatacaccgtctaaccgaaaaccgcgaacgttaacgacccctaacgaaaaaaccttccttaataaaaaaacacgacgaaacgaaaacaaccgaccgcctcgaaaacgcgcgcaaaaattaaattaaatttacacctccgccctctctctcctccctccaccttatcttcaaaactaaacactttaaataaa

SEQ ID NO: 27825 - DNA, 732 bp, Artificial Sequence
  chemically treated genomic DNA (Homo sapiens) CpG-island No: 27825
cgtttttcgggttttagggacgcgggtatttgtggggcggggttgtcgggtttcggggttcgattttttcgggcggtcggagcgagattcgggttgggaaagtaggtacgtggcgtattttcgtatttttcgttttatttttacggtagggtttttagtgtttgattaagtttaagttcgagtttttcggcgcgttgtttatcggttgttttttcgcgttttttttttttttttattcgtatcgtttcgttttttattttttttttgttttttttttattatttagtttatatttttttcgttttttttttcgtttttcgcgtaattcgaagtgttcgggaggcgtttatttgttcgatttaaatatttacgcgatttttagcgttcgtagtacgcgtgttagttttcgaatcgacgacggttattcgtgttttttagtattatatagagtaagggttcgtgaaggcgtagcgaagacgaggtacggggaacgtaatatagaataatttcgcgcggacgtcggtaatagagatagagaataggaaatagaagttgggcggttggtagagcggagacggaacgaaaacgcgacgacggaagatcgacgcgagagggggagataagaacggataagggcgaggagaatagatatggtagacgcgagaaaagaaataaagacgtataggtatatagaaataaagtcggtaatagataagtatatcgaagagaaat

SEQ ID NO: 27826 - DNA, 732 bp, Artificial Sequence
  chemically treated genomic DNA (Homo sapiens) CpG-island No: 27826
atttctcttcgatatacttatctattaccgactttatttctatatacctatacgtctttatttcttttctcgcgtctaccatatctattctcctcgcccttatccgttcttatctccccctctcgcgtcgatcttccgtcgtcgcgttttcgttccgtctccgctctaccaaccgcccaacttctatttcctattctctatctctattaccgacgtccgcgcgaaattattctatattacgttccccgtacctcgtcttcgctacgccttcacgaacccttactctatataatactaaaaaacacgaataaccgtcgtcgattcgaaaactaacacgcgtactacgaacgctaaaaatcgcgtaaatatttaaatcgaacaaataaacgcctcccgaacacttcgaattacgcgaaaaacgaaaaaaaaaacgaaaaaaatataaactaaataataaaaaaaaaacaaaaaaaaaataaaaaacgaaacgatacgaataaaaaaaaaaaaaaaacgcgaaaaaacaaccgataaacaacgcgccgaaaaactcgaacttaaacttaatcaaacactaaaaaccctaccgtaaaaataaaacgaaaaatacgaaaatacgccacgtacctactttcccaacccgaatctcgctccgaccgcccgaaaaaatcgaaccccgaaacccgacaaccccgccccacaaatacccgcgtccctaaaacccgaaaaacg

SEQ ID NO: 27827 - DNA, 732 bp, Artificial Sequence
  chemically treated genomic DNA (Homo sapiens) CpG-island No: 27827
gttttttttcgatgtgtttgtttgttgtcggttttgtttttgtgtgtttgtgcgtttttgttttttttttcgcgtttgttatgtttgtttttttcgtttttgttcgtttttgtttttttttttcgcgtcgatttttcgtcgtcgcgttttcgtttcgttttcgttttgttagtcgtttagtttttgttttttgttttttgtttttgttatcgacgttcgcgcgagattattttgtattgcgtttttcgtatttcgttttcgttgcgtttttacggatttttgttttgtgtggtgttggggagtacgaatgatcgtcgtcggttcgggggttggtacgcgtgttgcgggcgttgggggtcgcgtagatgtttgggtcgaataggtgagcgtttttcggatatttcgggttgcgcggggggcggggaggagggcggagggggtgtaaattaagtggtgggaaagagataaaggaagagtgaagagcgagacggtgcggatggggaagggggaggggcgcgaaggggtagtcggtgggtagcgcgtcgaggagttcgagtttgaatttgattaagtattgggggttttgtcgtgggggtggggcgggggatacggagatgcgttacgtgtttgtttttttagttcgggtttcgtttcggtcgttcgggggagtcgaatttcgaggttcggtagtttcgttttataagtattcgcgtttttgggattcgaaagacg

SEQ ID NO: 27828 - DNA, 732 bp, Artificial Sequence
  chemically treated genomic DNA (Homo sapiens) CpG-island No: 27828
cgtctttcgaatcccaaaaacgcgaatacttataaaacgaaactaccgaacctcgaaattcgactcccccgaacgaccgaaacgaaacccgaactaaaaaaacaaacacgtaacgcatctccgtatcccccgccccacccccacgacaaaacccccaatacttaatcaaattcaaactcgaactcctcgacgcgctacccaccgactaccccttcgcgcccctcccccttccccatccgcaccgtctcgctcttcactcttcctttatctctttcccaccacttaatttacaccccctccgccctcctccccgccccccgcgcaacccgaaatatccgaaaaacgctcacctattcgacccaaacatctacgcgacccccaacgcccgcaacacgcgtaccaacccccgaaccgacgacgatcattcgtactccccaacaccacacaaaacaaaaatccgtaaaaacgcaacgaaaacgaaatacgaaaaacgcaatacaaaataatctcgcgcgaacgtcgataacaaaaacaaaaaacaaaaaacaaaaactaaacgactaacaaaacgaaaacgaaacgaaaacgcgacgacgaaaaatcgacgcgaaaaaaaaaaacaaaaacgaacaaaaacgaaaaaaacaaacataacaaacgcgaaaaaaaaaacaaaaacgcacaaacacacaaaaacaaaaccgacaacaaacaaacacatcgaaaaaaaac

SEQ ID NO: 27829 - DNA, 808 bp, Artificial Sequence
  chemically treated genomic DNA (Homo sapiens) CpG-island No: 27829
taggtacggaggggagggcgtagaagagggttggtattagtagcgcggtttagtttttcgaacggattgatgggattgatgggagagattttttgtatttttcggggatgtgcgtttcggaggatgcgaattagtttgcgtatagggcgttttggggatagcgttgtttaagtataggtttgggtgatggttggtggggttcgggtcgatatttttttttttcgttttcggatttttgtatatacgcgttgttcggcgtagtcgtttttgttcggcgttttttttcgggatatttagcgagaggggtgatcgggcggcggcgggagaggcgtacgttttcgggcgcgggcgaatttgcgtatttggtatttgttatatagcgaaagtatcggttagcgagcggaggggcgttttcgtttttttttttcggagcggatcgagatcgagtacgttttcgcgggtcggtagcgtcgcggagagagtgggtgggtaggcgagggaggggaagggagaggaaggagggagggagggagagggcgaggcgcgttttcgcgagcggggcgcgttcgcgcgggttgtcgggatcgttcgtcgtcgttgtggtaatgttcgttatgttggttatggcgtagggagcggatcgggcgggcgagcggcggatttagtgtgtggaggtagtcgcggtagggggggttgttttcgggcggggtgggcgtttatgttgttgtcggggtagttgaggaggaggaggagcgggtcggtcgcgttgtattgaggaaggaggtggaggaggcggcgggagtttttt

SEQ ID NO: 27830 - DNA, 808 bp, Artificial Sequence
  chemically treated genomic DNA (Homo sapiens) CpG-island No: 27830
aaaaaactcccgccgcctcctccacctccttcctcaatacaacgcgaccgacccgctcctcctcctcctcaactaccccgacaacaacataaacgcccaccccgcccgaaaacaaccccccctaccgcgactacctccacacactaaatccgccgctcgcccgcccgatccgctccctacgccataaccaacataacgaacattaccacaacgacgacgaacgatcccgacaacccgcgcgaacgcgccccgctcgcgaaaacgcgcctcgccctctccctccctccctccttcctctcccttcccctccctcgcctacccacccactctctccgcgacgctaccgacccgcgaaaacgtactcgatctcgatccgctccgaaaaaaaaaaacgaaaacgcccctccgctcgctaaccgatactttcgctatataacaaataccaaatacgcaaattcgcccgcgcccgaaaacgtacgcctctcccgccgccgcccgatcacccctctcgctaaatatcccgaaaaaaaacgccgaacaaaaacgactacgccgaacaacgcgtatatacaaaaatccgaaaacgaaaaaaaaaaatatcgacccgaaccccaccaaccatcacccaaacctatacttaaacaacgctatccccaaaacgccctatacgcaaactaattcgcatcctccgaaacgcacatccccgaaaaatacaaaaaatctctcccatcaatcccatcaatccgttcgaaaaactaaaccgcgctactaataccaaccctcttctacgccctcccctccgtaccta

SEQ ID NO: 27831 - DNA, 808 bp, Artificial Sequence
  chemically treated genomic DNA (Homo sapiens) CpG-island No: 27831
ggaggattttcgtcgttttttttatttttttttttagtgtagcgcggtcggttcgtttttttttttttttagttgtttcggtaatagtatgggcgtttatttcgttcgaaaatagttttttttgtcgcggttgtttttatatattagattcgtcgttcgttcgttcgattcgttttttgcgttatggttaatatggcggatattattatagcggcggcgagcgatttcggtagttcgcgcgagcgcgtttcgttcgcgggaacgcgtttcgtttttttttttttttttttttttttttttttttttttttttcgtttgtttatttatttttttcgcggcgttgtcggttcgcgggagcgtgttcggtttcggttcgtttcggggagagggggcgggggcgttttttcgttcgttggtcggtgttttcgttgtgtggtaggtgttaggtgcgtaagttcgttcgcgttcgggagcgtgcgtttttttcgtcgtcgttcggttatttttttcgttgggtgtttcggaggaaggcgtcgggtaaagacggttgcgtcgagtagcgcgtgtgtgtagaagttcgggagcgggaagggaaaatgtcgattcggattttattagttattatttaagtttgtatttggatagcgttatttttaaggcgttttgtgcgtaagttaattcgtatttttcgaggcgtatattttcgagaggtgtaagaggttttttttattagttttattagttcgttcggaggattggatcgcgttgttggtgttagtttttttttacgttttttttttcgtatttg

SEQ ID NO: 27832 - DNA, 808 bp, Artificial Sequence
  chemically treated genomic DNA (Homo sapiens) CpG-island No: 27832
caaatacgaaaaaaaaaacgtaaaaaaaaactaacaccaacaacgcgatccaatcctccgaacgaactaataaaactaataaaaaaaacctcttacacctctcgaaaatatacgcctcgaaaaatacgaattaacttacgcacaaaacgccttaaaaataacgctatccaaatacaaacttaaataataactaataaaatccgaatcgacattttcccttcccgctcccgaacttctacacacacgcgctactcgacgcaaccgtctttacccgacgccttcctccgaaacacccaacgaaaaaaataaccgaacgacgacgaaaaaaacgcacgctcccgaacgcgaacgaacttacgcacctaacacctaccacacaacgaaaacaccgaccaacgaacgaaaaaacgcccccgccccctctccccgaaacgaaccgaaaccgaacacgctcccgcgaaccgacaacgccgcgaaaaaaataaataaacaaacgaaaaaaaaaaaaaaaaaaaaaaaaaaaaaaaaaaaaaaaaacgaaacgcgttcccgcgaacgaaacgcgctcgcgcgaactaccgaaatcgctcgccgccgctataataatatccgccatattaaccataacgcaaaaaacgaatcgaacgaacgaacgacgaatctaatatataaaaacaaccgcgacaaaaaaaactattttcgaacgaaataaacgcccatactattaccgaaacaactaaaaaaaaaaaaaaacgaaccgaccgcgctacactaaaaaaaaaaataaaaaaaacgacgaaaatcctcc

SEQ ID NO: 27833 - DNA, 747 bp, Artificial Sequence
  chemically treated genomic DNA (Homo sapiens) CpG-island No: 27833
  misc_feature (263)..(263): n is either a, c, g or t
  misc_feature (433)..(433): n is either a, c, g or t
tcgttttttttttaagttcggattcgaggtttcgttcgtcggtttttttgatttagggtttcggatagaagcgtaatgtagtttgcgttttatttttttttttcgtttcgttatttcgatttcggttcggagtcgtcgatattttttacgtagtaggggtagaaagggacgcggggtggggggaagtcgaggatttgcgaggcggtcgcgggagtatagcgagcggttttggcgtttttcgggaagaaggcgtttcgcgcggntcgtagtaggtttcgttagttgcgtcgttcggtacgcgtttcgttttcgtcgcggtatttattttcgcggaggttgttcggatttttttcggtcgcggtggagacgaggatcgagtcgggcgttttttttttttatttcggtttcgcggcgggttcgaattttagatcgntcgagcgttacggtttcgttgttcgcggagttagaaataggcgatttcgggttttgcggttcggaggcgagaagcgcgcgggagcggttttttaggacgcgggtttcgagtcgcgattttatttacgtaggtatttaaggtaacgtgggttgtaattttgatggaggtttgacgttagggaaggtgcgaaaattagattttttttgacgtaggagcgcgggatcgttttttgttcgtttatttatttatttatttttttattcgggcggaggagttttttttttttttttagaagtttttaaagcggatatttt

SEQ ID NO: 27834 - DNA, 747 bp, Artificial Sequence
  chemically treated genomic DNA (Homo sapiens) CpG-island No: 27834
  misc_feature (315)..(315): n is either a, c, g or t
  misc_feature (485)..(485): n is either a, c, g or t
aaaatatccgctttaaaaacttctaaaaaaaaaaaaaaaactcctccgcccgaataaaaaaataaataaataaataaacgaacaaaaaacgatcccgcgctcctacgtcaaaaaaaatctaattttcgcaccttccctaacgtcaaacctccatcaaaattacaacccacgttaccttaaatacctacgtaaataaaatcgcgactcgaaacccgcgtcctaaaaaaccgctcccgcgcgcttctcgcctccgaaccgcaaaacccgaaatcgcctatttctaactccgcgaacaacgaaaccgtaacgctcgancgatctaaaattcgaacccgccgcgaaaccgaaataaaaaaaaaaaacgcccgactcgatcctcgtctccaccgcgaccgaaaaaaatccgaacaacctccgcgaaaataaataccgcgacgaaaacgaaacgcgtaccgaacgacgcaactaacgaaacctactacganccgcgcgaaacgccttcttcccgaaaaacgccaaaaccgctcgctatactcccgcgaccgcctcgcaaatcctcgacttccccccaccccgcgtccctttctacccctactacgtaaaaaatatcgacgactccgaaccgaaatcgaaataacgaaacgaaaaaaaaaaataaaacgcaaactacattacgcttctatccgaaaccctaaatcaaaaaaaccgacgaacgaaacctcgaatccgaacttaaaaaaaaaacga

SEQ ID NO: 27835 - DNA, 747 bp, Artificial Sequence
  chemically treated genomic DNA (Homo sapiens) CpG-island No: 27835
  misc_feature (315)..(315): n is either a, c, g or t
  misc_feature (485)..(485): n is either a, c, g or t
gaagtgttcgttttaagagtttttggaggggaggaaggggttttttcgttcgggtgggagagtgagtgagtgggtgggcgggtagggggcggtttcgcgtttttgcgttagaaggggtttggttttcgtattttttttgacgttaaatttttattagggttgtaatttacgttgttttggatgtttgcgtgagtggagtcgcgattcggggttcgcgttttgagagatcgttttcgcgcgtttttcgttttcggatcgtagggttcgaagtcgtttatttttggtttcgcgggtagcggggtcgtggcgttcgancggtttgggattcgggttcgtcgcggaatcggaataagaagggagagcgttcggttcggttttcgtttttatcgcggtcggaaggaattcgggtagttttcgcggaggtgagtgtcgcggcgggggcggagcgcgtgtcgggcgacgtagttagcggggtttgttacgantcgcgcggggcgtttttttttcgagggacgttaggatcgttcgttgtgttttcgcggtcgtttcgtaggttttcggtttttttttatttcgcgtttttttttgtttttgttgcgtgagaggtgtcggcggtttcgggtcgggatcgaggtggcggggcgagggaaggaggtggggcgtaggttgtattgcgtttttgttcggggttttgggttagaggggtcggcggacgaggtttcgggttcgggtttggggagggggcgg

SEQ ID NO: 27836 - DNA, 747 bp, Artificial Sequence
  chemically treated genomic DNA (Homo sapiens) CpG-island No: 27836
  misc_feature (263)..(263): n is either a, c, g or t
  misc_feature (433)..(433): n is either a, c, g or t
ccgccccctccccaaacccgaacccgaaacctcgtccgccgacccctctaacccaaaaccccgaacaaaaacgcaatacaacctacgccccacctccttccctcgccccgccacctcgatcccgacccgaaaccgccgacacctctcacgcaacaaaaacaaaaaaaaacgcgaaataaaaaaaaaccgaaaacctacgaaacgaccgcgaaaacacaacgaacgatcctaacgtccctcgaaaaaaaaacgccccgcgcgantcgtaacaaaccccgctaactacgtcgcccgacacgcgctccgcccccgccgcgacactcacctccgcgaaaactacccgaattccttccgaccgcgataaaaacgaaaaccgaaccgaacgctctcccttcttattccgattccgcgacgaacccgaatcccaaaccgntcgaacgccacgaccccgctacccgcgaaaccaaaaataaacgacttcgaaccctacgatccgaaaacgaaaaacgcgcgaaaacgatctctcaaaacgcgaaccccgaatcgcgactccactcacgcaaacatccaaaacaacgtaaattacaaccctaataaaaatttaacgtcaaaaaaaatacgaaaaccaaaccccttctaacgcaaaaacgcgaaaccgccccctacccgcccacccactcactcactctcccacccgaacgaaaaaaccccttcctcccctccaaaaactcttaaaacgaacacttc

SEQ ID NO: 27837 - DNA, 1197 bp, Artificial Sequence
  chemically treated genomic DNA (Homo sapiens) CpG-island No: 27837
  misc_feature (442)..(442): n is either a, c, g or t
  misc_feature (445)..(445): n is either a, c, g or t
  misc_feature (448)..(448): n is either a, c, g or t
  misc_feature (453)..(456): n is either a, c, g or t
  misc_feature (459)..(459): n is either a, c, g or t
  misc_feature (462)..(463): n is either a, c, g or t
  misc_feature (467)..(468): n is either a, c, g or t
  misc_feature (470)..(470): n is either a, c, g or t
  misc_feature (472)..(472): n is either a, c, g or t
  misc_feature (850)..(850): n is either a, c, g or t
  misc_feature (901)..(901): n is either a, c, g or t
agggtcgcgagaaggagagtgcgtcgggttgatggttagcggtgtttcgggggtcgatgtcgggcgggatcggcggcgcgggggtggggcgacggcggggcggcggtcgagtagtagaggggcgtttcgtagaggtcggggggggcgcggggtttcgcgtcgttttgttagtagtcgtttcgtcgtttttttcggttcgttcgtaatcgtcgcgggattcgtcggttcgggtttttggaattttttacgggggatagtcgatcgggggcgtcggggttcgttttcgtattcgattcggacggcggtagtagggggagggatggtgtatcgaggaagttaaggttttattattttgttcggcgggtcggcggttcgttggttcgttggttcggagaagtgttgcgtttaggttggttcgtaggaaacggcggcggcggtttanttntanttttnnnnttnttnnttgnnantntttttttataggggaggggtaggcggttcgcgggtttcgcgtcggtcgggcgattgggtacgcgagggagcgggtagggtagggggaaataaattaaggtcgagatttagagtcggagagcgcgggaggagtagcggcgagaggtaggagaggtagagaagaagaaaggagggagagagggggcgaagacggtcgggaaattcggggttgtagtttcgcgtcgcgtcggagtcgtgacggatttattgtagcggtcgcgttgattcgtaattttaaggtacgaaaaaaggggagggtagagagggaggggaaagcggagtgttgtagcgtcggggcgggggcgggttttcgcgagcgtcgtatattcgggaatttgtngtttcgttgcgggcgagtgtcgcgtgttttggcgagttttggttggggaantttgagcgcgcggattacgttcgttttttagtcggtcgttttttgcgtgtagggtggggggaggttaggggcgggggcgcggacgtcggtgacgtcgcgtggcggagttttttcggttatgtggttggaggcgggcggggaagaaggtaaggttgggaggggaaggaggaaatgcgagggtttttcggcgggaggaagcgcgaggggtgcgcgagtgttagcgaaagggggataggggttttggagtggaagttttgcgggagaggaggagtagaggagtagttttagggtgttag

SEQ ID NO: 27838 - DNA, 1197 bp, Artificial Sequence
  chemically treated genomic DNA (Homo sapiens) CpG-island No: 27838
  misc_feature (297)..(297): n is either a, c, g or t
  misc_feature (348)..(348): n is either a, c, g or t
  misc_feature (726)..(726): n is either a, c, g or t
  misc_feature (728)..(728): n is either a, c, g or t
  misc_feature (730)..(731): n is either a, c, g or t
  misc_feature (735)..(736): n is either a, c, g or t
  misc_feature (739)..(739): n is either a, c, g or t
  misc_feature (742)..(745): n is either a, c, g or t
  misc_feature (750)..(750): n is either a, c, g or t
  misc_feature (753)..(753): n is either a, c, g or t
  misc_feature (756)..(756): n is either a, c, g or t
ctaacaccctaaaactactcctctactcctcctctcccgcaaaacttccactccaaaacccctatccccctttcgctaacactcgcgcacccctcgcgcttcctcccgccgaaaaaccctcgcatttcctccttcccctcccaaccttaccttcttccccgcccgcctccaaccacataaccgaaaaaactccgccacgcgacgtcaccgacgtccgcgcccccgcccctaacctccccccaccctacacgcaaaaaacgaccgactaaaaaacgaacgtaatccgcgcgctcaaanttccccaaccaaaactcgccaaaacacgcgacactcgcccgcaacgaaacnacaaattcccgaatatacgacgctcgcgaaaacccgcccccgccccgacgctacaacactccgctttcccctccctctctaccctccccttttttcgtaccttaaaattacgaatcaacgcgaccgctacaataaatccgtcacgactccgacgcgacgcgaaactacaaccccgaatttcccgaccgtcttcgccccctctctccctcctttcttcttctctacctctcctacctctcgccgctactcctcccgcgctctccgactctaaatctcgaccttaatttatttccccctaccctacccgctccctcgcgtacccaatcgcccgaccgacgcgaaacccgcgaaccgcctacccctcccctataaaaaaanantnncaannaanaannnnaaaantanaantaaaccgccgccgccgtttcctacgaaccaacctaaacgcaacacttctccgaaccaacgaaccaacgaaccgccgacccgccgaacaaaataataaaaccttaacttcctcgatacaccatccctccccctactaccgccgtccgaatcgaatacgaaaacgaaccccgacgcccccgatcgactatcccccgtaaaaaattccaaaaacccgaaccgacgaatcccgcgacgattacgaacgaaccgaaaaaaacgacgaaacgactactaacaaaacgacgcgaaaccccgcgccccccccgacctctacgaaacgcccctctactactcgaccgccgccccgccgtcgccccacccccgcgccgccgatcccgcccgacatcgacccccgaaacaccgctaaccatcaacccgacgcactctccttctcgcgaccct

SEQ ID NO: 27839 - DNA, 1197 bp, Artificial Sequence
  chemically treated genomic DNA (Homo sapiens) CpG-island No: 27839
  misc_feature (297)..(297): n is either a, c, g or t
  misc_feature (348)..(348): n is either a, c, g or t
  misc_feature (726)..(726): n is either a, c, g or t
  misc_feature (728)..(728): n is either a, c, g or t
  misc_feature (730)..(731): n is either a, c, g or t
  misc_feature (735)..(736): n is either a, c, g or t
  misc_feature (739)..(739): n is either a, c, g or t
  misc_feature (742)..(745): n is either a, c, g or t
  misc_feature (750)..(750): n is either a, c, g or t
  misc_feature (753)..(753): n is either a, c, g or t
  misc_feature (756)..(756): n is either a, c, g or t
ttgatattttaagattgtttttttgttttttttttttcgtaaggtttttattttagggtttttgtttttttttcgttagtattcgcgtatttttcgcgttttttttcgtcggggaattttcgtattttttttttttttttttagttttgttttttttttcgttcgtttttagttatatgatcggaagggtttcgttacgcgacgttatcgacgttcgcgttttcgtttttggtttttttttattttgtacgtaaggggcggtcggttgaggggcgaacgtggttcgcgcgtttaggnttttttaattagagttcgttagagtacgcggtattcgttcgtagcggggtngtaggttttcggatgtgcggcgttcgcggaagttcgttttcgtttcggcgttgtagtatttcgtttttttttttttttttgttttttttttttttcgtgttttgaggttgcgggttagcgcgatcgttgtagtgagttcgttacggtttcggcgcgacgcgaggttgtagtttcgagtttttcggtcgttttcgtttttttttttttttttttttttttttttgttttttttgtttttcgtcgttgtttttttcgcgtttttcggttttgaatttcgattttaatttatttttttttattttgttcgttttttcgcgtgtttaatcgttcggtcggcgcggagttcgcgagtcgtttattttttttttatgggagggngntnntagnnggngannnnagggntgnagntgggtcgtcgtcgtcgttttttgcgagttagtttgagcgtaatattttttcgagttagcgagttagcgagtcgtcgattcgtcgagtaaaatggtgagattttggttttttcgatgtattatttttttttttattgtcgtcgttcgggtcgggtgcgggggcgagtttcgacgttttcggtcggttgtttttcgtggaaaattttagagattcgggtcggcgggtttcgcggcggttgcgggcgagtcggagagggcggcggggcggttgttgataggacggcgcggggtttcgcgtttttttcggtttttgcggggcgtttttttgttgttcggtcgtcgtttcgtcgtcgttttattttcgcgtcgtcggtttcgttcggtatcgattttcggggtatcgttgattattagttcggcgtattttttttttcgcgatttt

SEQ ID NO: 27840 - DNA, 1197 bp, Artificial Sequence
  chemically treated genomic DNA (Homo sapiens) CpG-island No: 27840
  misc_feature (442)..(442): n is either a, c, g or t
  misc_feature (445)..(445): n is either a, c, g or t
  misc_feature (448)..(448): n is either a, c, g or t
  misc_feature (453)..(456): n is either a, c, g or t
  misc_feature (459)..(459): n is either a, c, g or t
  misc_feature (462)..(463): n is either a, c, g or t
  misc_feature (467)..(468): n is either a, c, g or t
  misc_feature (470)..(470): n is either a, c, g or t
  misc_feature (472)..(472): n is either a, c, g or t
  misc_feature (850)..(850): n is either a, c, g or t
  misc_feature (901)..(901): n is either a, c, g or t
aaaatcgcgaaaaaaaaaatacgccgaactaataatcaacgataccccgaaaatcgataccgaacgaaaccgacgacgcgaaaataaaacgacgacgaaacgacgaccgaacaacaaaaaaacgccccgcaaaaaccgaaaaaaacgcgaaaccccgcgccgtcctatcaacaaccgccccgccgccctctccgactcgcccgcaaccgccgcgaaacccgccgacccgaatctctaaaattttccacgaaaaacaaccgaccgaaaacgtcgaaactcgcccccgcacccgacccgaacgacgacaataaaaaaaaaaataatacatcgaaaaaaccaaaatctcaccattttactcgacgaatcgacgactcgctaactcgctaactcgaaaaaatattacgctcaaactaactcgcaaaaaacgacgacgacgacccanctncanccctnnnntcnccnnctannancnccctcccataaaaaaaaaataaacgactcgcgaactccgcgccgaccgaacgattaaacacgcgaaaaaacgaacaaaataaaaaaaaataaattaaaatcgaaattcaaaaccgaaaaacgcgaaaaaaacaacgacgaaaaacaaaaaaaacaaaaaaaaaaaaaaaaaaaaaaaaaaaaacgaaaacgaccgaaaaactcgaaactacaacctcgcgtcgcgccgaaaccgtaacgaactcactacaacgatcgcgctaacccgcaacctcaaaacacgaaaaaaaaaaaaaacaaaaaaaaaaaaaaaaacgaaatactacaacgccgaaacgaaaacgaacttccgcgaacgccgcacatccgaaaacctacnaccccgctacgaacgaataccgcgtactctaacgaactctaattaaaaaancctaaacgcgcgaaccacgttcgcccctcaaccgaccgccccttacgtacaaaataaaaaaaaaccaaaaacgaaaacgcgaacgtcgataacgtcgcgtaacgaaacccttccgatcatataactaaaaacgaacgaaaaaaaaaacaaaactaaaaaaaaaaaaaaaaaatacgaaaattccccgacgaaaaaaaacgcgaaaaatacgcgaatactaacgaaaaaaaaacaaaaaccctaaaataaaaaccttacgaaaaaaaaaaaacaaaaaaacaatcttaaaatatcaa

SEQ ID NO: 27841 - DNA, 603 bp, Artificial Sequence
  chemically treated genomic DNA (Homo sapiens) CpG-island No: 27841
  misc_feature (265)..(265): n is either a, c, g or t
  misc_feature (336)..(337): n is either a, c, g or t
cgttttattaaagtttttgtatatttttttttacgttgcgtttttgttatttacgtagttgtttttttgagcgtttcgcgtgtataaacgcgttttcggtttttacgcgtcggtggcgttgtttcgttgaggtggcgtcgggggagtcgtagaggcggcgggggagggagtgcggaggagaggattcgtgagttgcggggatttggggtcgtcgagtttttggggaagttgggtttcgtttttttcgggcgtttggcgtcgaaangtgtcgcgatggacgcgaacgttattcgttgttgttgtcggttgttgattgttatcgcggcgggagcggtnngttgtgtcggagttcggcgtttgttaggttttaataggtttcgggttaatttgcgggtacgtttatcggttatcgtcggttacgttaatcgcgtcgcgggttcggggcgcgtttttcgtcggtttttttcgcgttaattttttttatttattcgtcgtttaggaagcggaattcggagtttttttttttttttttttcgtttaattcgtaagaggcgggttttttttttttgtatttttattttttttattttttttttttttttg

SEQ ID NO: 27842 - DNA, 603 bp, Artificial Sequence
  chemically treated genomic DNA (Homo sapiens) CpG-island No: 27842
  misc_feature (267)..(268): n is either a, c, g or t
  misc_feature (339)..(339): n is either a, c, g or t
caaaaaaaaaaaaaaaataaaaaaaataaaaatacaaaaaaaaaaaacccgcctcttacgaattaaacgaaaaaaaaaaaaaaaaaaactccgaattccgcttcctaaacgacgaataaataaaaaaaattaacgcgaaaaaaaccgacgaaaaacgcgccccgaacccgcgacgcgattaacgtaaccgacgataaccgataaacgtacccgcaaattaacccgaaacctattaaaacctaacaaacgccgaactccgacacaacnnaccgctcccgccgcgataacaatcaacaaccgacaacaacaacgaataacgttcgcgtccatcgcgacacntttcgacgccaaacgcccgaaaaaaacgaaacccaacttccccaaaaactcgacgaccccaaatccccgcaactcacgaatcctctcctccgcactccctcccccgccgcctctacgactcccccgacgccacctcaacgaaacaacgccaccgacgcgtaaaaaccgaaaacgcgtttatacacgcgaaacgctcaaaaaaacaactacgtaaataacaaaaacgcaacgtaaaaaaaaatatacaaaaactttaataaaacg

SEQ ID NO: 27843 - DNA, 603 bp, Artificial Sequence
  chemically treated genomic DNA (Homo sapiens) CpG-island No: 27843
  misc_feature (267)..(268): n is either a, c, g or t
  misc_feature (339)..(339): n is either a, c, g or t
tagaggagggaagggggtgggaagagtgggggtgtaagagagaaaaattcgttttttgcgagttgagcgaggaagaggggggggaaggtttcgagtttcgttttttgaacggcgggtggatagagaaggttggcgcggggaagatcggcgggaggcgcgtttcgggttcgcggcgcgattggcgtgatcggcgatggtcggtgagcgtattcgtaggttaattcggagtttgttgagatttggtaggcgtcgagtttcggtatagtnngtcgttttcgtcgcggtggtagttagtagtcggtagtagtagcgggtgacgttcgcgtttatcgcgatatntttcggcgttaggcgttcggggagaacggagtttagtttttttaaaagttcggcggttttaggttttcgtagtttacgggttttttttttcgtattttttttttcgtcgtttttgcggttttttcggcgttattttagcgaggtagcgttatcgacgcgtaaggatcgggggcgcgtttgtgtacgcgggacgtttagaggagtagttgcgtgggtagtagaagcgtagcgtgggagaggatgtgtaggggttttaatggggcg

SEQ ID NO: 27844 - DNA, 603 bp, Artificial Sequence
  chemically treated genomic DNA (Homo sapiens) CpG-island No: 27844
  misc_feature (265)..(265): n is either a, c, g or t
  misc_feature (336)..(337): n is either a, c, g or t
cgccccattaaaacccctacacatcctctcccacgctacgcttctactacccacgcaactactcctctaaacgtcccgcgtacacaaacgcgcccccgatccttacgcgtcgataacgctacctcgctaaaataacgccgaaaaaaccgcaaaaacgacgaaaaaaaaaatacgaaaaaaaaaacccgtaaactacgaaaacctaaaaccgccgaacttttaaaaaaactaaactccgttctccccgaacgcctaacgccgaaanatatcgcgataaacgcgaacgtcacccgctactactaccgactactaactaccaccgcgacgaaaacgacnnactataccgaaactcgacgcctaccaaatctcaacaaactccgaattaacctacgaatacgctcaccgaccatcgccgatcacgccaatcgcgccgcgaacccgaaacgcgcctcccgccgatcttccccgcgccaaccttctctatccacccgccgttcaaaaaacgaaactcgaaaccttcccccccctcttcctcgctcaactcgcaaaaaacgaatttttctctcttacacccccactcttcccacccccttccctcctcta

SEQ ID NO: 27845 - DNA, 550 bp, Artificial Sequence
  chemically treated genomic DNA (Homo sapiens) CpG-island No: 27845
tgggaacgcgtagggttagttcgggtttaagggaggcgttttggttttcgaggaagggtcgtaagttcgtagtttttcggcgtttttggtcggaagatataaatgattcgagaagttgcgaggtttttcggtggcggggacggggggtatttcgacggagttttcggatttttttcgttttaggacgattttgttcgtatcgagtttcggtttagttgtcgcgttttagtttacgtcggcgtttgcgtatttattatgcggttcgcggttcgcgagatttcggtttttatttttcgagcgacggatatagacgcggcgcgggagttagtggattgattgatagcggttttagttcgcgtttcgacgtttcgtttgttcggtcgggaacgtcgttagggggtagtgtagttttcgtagttcgggcggcgttttttttcgtattggcggaggacgcggtcgttggaggcgatatttttataagtagcgtggaggcgatatttttataagtagcgttatttgacggaatttttataataattcgttttataga

SEQ ID NO: 27846 - DNA, 550 bp, Artificial Sequence
  chemically treated genomic DNA (Homo sapiens) CpG-island No: 27846
tctataaaacgaattattataaaaattccgtcaaataacgctacttataaaaatatcgcctccacgctacttataaaaatatcgcctccaacgaccgcgtcctccgccaatacgaaaaaaaacgccgcccgaactacgaaaactacactaccccctaacgacgttcccgaccgaacaaacgaaacgtcgaaacgcgaactaaaaccgctatcaatcaatccactaactcccgcgccgcgtctatatccgtcgctcgaaaaataaaaaccgaaatctcgcgaaccgcgaaccgcataataaatacgcaaacgccgacgtaaactaaaacgcgacaactaaaccgaaactcgatacgaacaaaatcgtcctaaaacgaaaaaaatccgaaaactccgtcgaaataccccccgtccccgccaccgaaaaacctcgcaacttctcgaatcatttatatcttccgaccaaaaacgccgaaaaactacgaacttacgacccttcctcgaaaaccaaaacgcctcccttaaacccgaactaaccctacgcgttccca

SEQ ID NO: 27847 - DNA, 550 bp, Artificial Sequence
  chemically treated genomic DNA (Homo sapiens) CpG-island No: 27847
tttgtaaaacgggttgttgtgagggtttcgttagataacgttgtttgtggaggtgtcgtttttacgttgtttgtggaggtgtcgtttttaacggtcgcgtttttcgttagtgcgggagggggcgtcgttcgggttgcggggattgtattgttttttggcggcgttttcggtcggataggcggggcgtcggggcgcgggttggggtcgttgttagttagtttattggttttcgcgtcgcgtttgtgttcgtcgttcggagggtggaagtcggggtttcgcgggtcgcgggtcgtatggtaggtgcgtaggcgtcggcgtgggttagggcgcggtagttgggtcggggttcggtgcgggtagggtcgttttagggcgggaagggttcgagggtttcgtcggggtgtttttcgttttcgttatcggggagtttcgtaatttttcgggttatttgtgtttttcggttaggggcgtcggggggttgcgggtttgcgattttttttcgaggattagggcgttttttttgaattcgggttggttttgcgcgttttta

SEQ ID NO: 27848 - DNA, 550 bp, Artificial Sequence
  chemically treated genomic DNA (Homo sapiens) CpG-island No: 27848
taaaaacgcgcaaaaccaacccgaattcaaaaaaaacgccctaatcctcgaaaaaaaatcgcaaacccgcaaccccccgacgcccctaaccgaaaaacacaaataacccgaaaaattacgaaactccccgataacgaaaacgaaaaacaccccgacgaaaccctcgaacccttcccgccctaaaacgaccctacccgcaccgaaccccgacccaactaccgcgccctaacccacgccgacgcctacgcacctaccatacgacccgcgacccgcgaaaccccgacttccaccctccgaacgacgaacacaaacgcgacgcgaaaaccaataaactaactaacaacgaccccaacccgcgccccgacgccccgcctatccgaccgaaaacgccgccaaaaaacaatacaatccccgcaacccgaacgacgccccctcccgcactaacgaaaaacgcgaccgttaaaaacgacacctccacaaacaacgtaaaaacgacacctccacaaacaacgttatctaacgaaaccctcacaacaacccgttttacaaa

SEQ ID NO: 27849 - DNA, 776 bp, Artificial Sequence
  chemically treated genomic DNA (Homo sapiens) CpG-island No: 27849
gtttttatagtagcgatagttttaacggagagatttttagttgtcgttttagtgttttttttacggttggaaacggcgaggacgttaatatagtttttattgggcgggacgcgatttaaacggtttaacgatttcgagcgttggggttcgtaacggcgtcgatatacgcgtttttacggattggtcgtttttaacgagtgttatttatttttcgattgttttttcgttatggagcgtcgtatcgcgtgatcgttattaatttttcgaattttggggtatttcggttttttttcgcgttaatttggacgacgatttgggatatcgcgcgtatttggattagcgaatttaaaatttcgtttttcgcgttagatcgtagtaaaatgttcgttttacgcgtaggcgtagtacgtgcggttttttttttatttcggtttaagatttacgtttttaggttttcgtatcgttcgttttttttagggtcgcggtttaggattggtttaggggttgcgcgggttttgattgggcgaggcggagttattagggcgtcgtatttttacgtggtcgtttttttcgcgcgttttggatttggggtaatagttgagagggcgttattagcgtgtcggcgtttgcggtttttttcgggttgtttttaggcgtcgtgttcgcgttcgttacgcgcggtggtttgtaggggcgtatcgcgatagttttaaaggaaaatttgttagggataagggttgttgtgggtagcgagggttatagatttatgtgtgttt

SEQ ID NO: 27850 - DNA, 776 bp, Artificial Sequence
  chemically treated genomic DNA (Homo sapiens) CpG-island No: 27850
aaacacacataaatctataaccctcgctacccacaacaacccttatccctaacaaattttcctttaaaactatcgcgatacgcccctacaaaccaccgcgcgtaacgaacgcgaacacgacgcctaaaaacaacccgaaaaaaaccgcaaacgccgacacgctaataacgccctctcaactattaccccaaatccaaaacgcgcgaaaaaaacgaccacgtaaaaatacgacgccctaataactccgcctcgcccaatcaaaacccgcgcaacccctaaaccaatcctaaaccgcgaccctaaaaaaaacgaacgatacgaaaacctaaaaacgtaaatcttaaaccgaaataaaaaaaaaaccgcacgtactacgcctacgcgtaaaacgaacattttactacgatctaacgcgaaaaacgaaattttaaattcgctaatccaaatacgcgcgatatcccaaatcgtcgtccaaattaacgcgaaaaaaaaccgaaataccccaaaattcgaaaaattaataacgatcacgcgatacgacgctccataacgaaaaaacaatcgaaaaataaataacactcgttaaaaacgaccaatccgtaaaaacgcgtatatcgacgccgttacgaaccccaacgctcgaaatcgttaaaccgtttaaatcgcgtcccgcccaataaaaactatattaacgtcctcgccgtttccaaccgtaaaaaaaacactaaaacgacaactaaaaatctctccgttaaaactatcgctactataaaaac

SEQ ID NO: 27851 - DNA, 776 bp, Artificial Sequence
  chemically treated genomic DNA (Homo sapiens) CpG-island No: 27851
gaatatatatgagtttataattttcgttgtttatagtagtttttgtttttaataggtttttttttaaggttgtcgcggtgcgtttttgtaagttatcgcgcgtgacggacgcgggtacgacgtttggggatagttcgaagaaaatcgtaggcgtcgatacgttggtgacgtttttttagttattgttttagatttaaggcgcgcggggaagacggttacgtaaagatacggcgttttggtgatttcgtttcgtttaattagagttcgcgtaatttttgaattaattttgagtcgcgattttgggaggggcgggcggtgcgggagtttgggggcgtgagttttgagtcggggtggagggggggtcgtacgtgttgcgtttgcgcgtggagcggatattttgttgcggtttagcgcgggaggcggggttttgggttcgttggtttaggtgcgcgcggtgttttaggtcgtcgtttaggttggcgcgggagaaggtcgaggtgttttagagttcgaggagttggtgacggttacgcggtgcgacgttttatggcggaggggtagtcggaaagtgaatagtattcgttaaaagcgattagttcgtaagggcgcgtgtgtcggcgtcgttacggattttagcgttcggggtcgttaaatcgtttaagtcgcgtttcgtttagtgagggttatgttagcgttttcgtcgtttttagtcgtgaaggaggtattgagacgatagttgagggttttttcgttaaggttgtcgttgttgtaggggt

SEQ ID NO: 27852 - DNA, 776 bp, Artificial Sequence
  chemically treated genomic DNA (Homo sapiens) CpG-island No: 27852
acccctacaacaacgacaaccttaacgaaaaaaccctcaactatcgtctcaatacctccttcacgactaaaaacgacgaaaacgctaacataaccctcactaaacgaaacgcgacttaaacgatttaacgaccccgaacgctaaaatccgtaacgacgccgacacacgcgcccttacgaactaatcgcttttaacgaatactattcactttccgactacccctccgccataaaacgtcgcaccgcgtaaccgtcaccaactcctcgaactctaaaacacctcgaccttctcccgcgccaacctaaacgacgacctaaaacaccgcgcgcacctaaaccaacgaacccaaaaccccgcctcccgcgctaaaccgcaacaaaatatccgctccacgcgcaaacgcaacacgtacgaccccccctccaccccgactcaaaactcacgcccccaaactcccgcaccgcccgcccctcccaaaatcgcgactcaaaattaattcaaaaattacgcgaactctaattaaacgaaacgaaatcaccaaaacgccgtatctttacgtaaccgtcttccccgcgcgccttaaatctaaaacaataactaaaaaaacgtcaccaacgtatcgacgcctacgattttcttcgaactatccccaaacgtcgtacccgcgtccgtcacgcgcgataacttacaaaaacgcaccgcgacaaccttaaaaaaaaacctattaaaaacaaaaactactataaacaacgaaaattataaactcatatatattc

SEQ ID NO: 27853 - DNA, 1276 bp, Artificial Sequence
  chemically treated genomic DNA (Homo sapiens) CpG-island No: 27853
acgtgggggtatttggtaggttattacgtgttcgaaatatagcgtaaaaggtacgcggtagagttatttttcggggtttattacgtgtcggtttgttaggtcggggcggagatattcgagcgtagtcgggatttcgattagggtcgatatcgttatttttcggtttaaggtattcggtttttttggagattttaggatttacgcggcgcggtttacgtggtaggtcgcgttttcgggtacgtgcgttaggagtcgagttttagttcgtacgcgtcgtaaaagtttggttttatttttttatttcgaggtttagcgtttttttttcgcgtttagtgattttgtttttttcgtcgcgttcgtcgtttttagtatttgtagaagttttttatttcgttattaagtagttagaagtcgcgagatttttttattaatcgcgcgagatttttcgtagtatggcgttttagaacgcgttcgggattgcgcgtaggttttttttttcgcggcgtcgcgttcgtttttcggaaagtaggtttatacgtttgcgttcgcgtttaaggtcgtttattttcgcgagttttattatgatggcggcggagtgtgaagcggataagtggcgtagatgagtttagaagaagttaagcgacggcgatggcggtcgcgggtgttgaagatttcggagtacgtatattcgaaggttagcgagagttcgagattgaggcgaaagattgagtttgtttagtaatcgtttgtggaaaggcgacgacggcgttttcgtgatttcgcgtcgattaattaaagttcgcggtcgtttttatgagttaatcgcgagtttttaatcgtgaacggcgcggggcggggagtaggcgggtcgaggcggttacgggagggggaggggttggtaacggcgtcgtgggggcggggttcgttttgtgtaaggttcgcgttgattgggtcgtgggcgcgcgggtttcggtttgcgtcgtgggattggcgtttttggcgtcggttgtgaggggagcgcgggggtggtggaatcgggcggttttcggttcgttaatgtggttgggttcgtaggtttgggtagttttggagttttttagagatttcgcgttcggtttcggtacgtatttacgtcgcggtttttggtggttttggagcgaggagttcgttagtatcggaagtttagggatcgcggagttttcgttggtttttttggaggtatagtttatttttgtttgttcgcgagtatggggtcggtagtttttcggttgtaggt

SEQ ID NO: 27854 - DNA, 1276 bp, Artificial Sequence
  chemically treated genomic DNA (Homo sapiens) CpG-island No: 27854
acctacaaccgaaaaactaccgaccccatactcgcgaacaaacaaaaataaactatacctccaaaaaaaccaacgaaaactccgcgatccctaaacttccgatactaacgaactcctcgctccaaaaccaccaaaaaccgcgacgtaaatacgtaccgaaaccgaacgcgaaatctctaaaaaactccaaaactacccaaacctacgaacccaaccacattaacgaaccgaaaaccgcccgattccaccacccccgcgctcccctcacaaccgacgccaaaaacgccaatcccacgacgcaaaccgaaacccgcgcgcccacgacccaatcaacgcgaaccttacacaaaacgaaccccgcccccacgacgccgttaccaacccctccccctcccgtaaccgcctcgacccgcctactccccgccccgcgccgttcacgattaaaaactcgcgattaactcataaaaacgaccgcgaactttaattaatcgacgcgaaatcacgaaaacgccgtcgtcgcctttccacaaacgattactaaacaaactcaatctttcgcctcaatctcgaactctcgctaaccttcgaatatacgtactccgaaatcttcaacacccgcgaccgccatcgccgtcgcttaacttcttctaaactcatctacgccacttatccgcttcacactccgccgccatcataataaaactcgcgaaaataaacgaccttaaacgcgaacgcaaacgtataaacctactttccgaaaaacgaacgcgacgccgcgaaaaaaaaaacctacgcgcaatcccgaacgcgttctaaaacgccatactacgaaaaatctcgcgcgattaataaaaaaatctcgcgacttctaactacttaataacgaaataaaaaacttctacaaatactaaaaacgacgaacgcgacgaaaaaaacaaaatcactaaacgcgaaaaaaaaacgctaaacctcgaaataaaaaaataaaaccaaacttttacgacgcgtacgaactaaaactcgactcctaacgcacgtacccgaaaacgcgacctaccacgtaaaccgcgccgcgtaaatcctaaaatctccaaaaaaaccgaataccttaaaccgaaaaataacgatatcgaccctaatcgaaatcccgactacgctcgaatatctccgccccgacctaacaaaccgacacgtaataaaccccgaaaaataactctaccgcgtaccttttacgctatatttcgaacacgtaataacctaccaaatacccccacgt

SEQ ID NO: 27855 - DNA, 1276 bp, Artificial Sequence
  chemically treated genomic DNA (Homo sapiens) CpG-island No: 27855
gtttgtagtcggggggttgtcggttttatgttcgcgggtaagtagggataagttgtgtttttaaaagggttaacgggaatttcgcggtttttgaattttcggtgttggcggatttttcgttttagggttattaggagtcgcggcgtgagtgcgtgtcgggatcgagcgcggggtttttgaggaattttaaggttgtttaagtttacggatttagttatattggcgaatcggagatcgttcgattttattattttcgcgttttttttatagtcggcgttaaaaacgttagttttacgacgtaggtcgggattcgcgcgtttacggtttaattagcgcggattttgtataaagcgagtttcgtttttacggcgtcgttgttagtttttttttttttcgtggtcgtttcggttcgtttatttttcgtttcgcgtcgtttacggttagaggttcgcgattggtttatggggacggtcgcgagttttggttggtcggcgcggagttacgagggcgtcgtcgtcgtttttttataggcgattattgggtaggtttagtttttcgttttagtttcgagttttcgttggttttcgggtgtacgtgtttcgggatttttagtattcgcggtcgttatcgtcgtcgtttggttttttttggatttatttgcgttatttgttcgttttatatttcgtcgttattatggtgaagttcgcgaaggtaaacggttttgagcgcgagcgtagacgtgtaggtttgtttttcgaggggcgagcgcggcgtcgcggggaggagggtttgcgcgtagtttcgggcgcgttttagggcgttatgttgcgggaagtttcgcgcgattagtggggaggtttcgcggtttttggttatttggtggcgaggtgaagagtttttgtaggtgttgggggcggcgaacgcggcgggaaagatagagttattgagcgcggggagggggcgttgggtttcggggtggagagatgagattaaatttttgcgacgcgtacgagttgggattcgatttttgacgtacgtgttcgggagcgcggtttgttacgtgggtcgcgtcgcgtgggttttggaatttttagagggatcgggtgttttgggtcgggaaatggcggtatcggttttagtcggagtttcggttgcgttcggatgttttcgtttcggtttggtaagtcgatacgtggtgggtttcggaaggtggttttgtcgcgtgttttttgcgttgtgtttcgggtacgtggtggtttattaggtatttttacgt

SEQ ID NO: 27856 - DNA, 1276 bp, Artificial Sequence
  chemically treated genomic DNA (Homo sapiens) CpG-island No: 27856
acgtaaaaatacctaataaaccaccacgtacccgaaacacaacgcaaaaaacacgcgacaaaaccaccttccgaaacccaccacgtatcgacttaccaaaccgaaacgaaaacatccgaacgcaaccgaaactccgactaaaaccgataccgccatttcccgacccaaaacacccgatccctctaaaaattccaaaacccacgcgacgcgacccacgtaacaaaccgcgctcccgaacacgtacgtcaaaaatcgaatcccaactcgtacgcgtcgcaaaaatttaatctcatctctccaccccgaaacccaacgccccctccccgcgctcaataactctatctttcccgccgcgttcgccgcccccaacacctacaaaaactcttcacctcgccaccaaataaccaaaaaccgcgaaacctccccactaatcgcgcgaaacttcccgcaacataacgccctaaaacgcgcccgaaactacgcgcaaaccctcctccccgcgacgccgcgctcgcccctcgaaaaacaaacctacacgtctacgctcgcgctcaaaaccgtttaccttcgcgaacttcaccataataacgacgaaatataaaacgaacaaataacgcaaataaatccaaaaaaaaccaaacgacgacgataacgaccgcgaatactaaaaatcccgaaacacgtacacccgaaaaccaacgaaaactcgaaactaaaacgaaaaactaaacctacccaataatcgcctataaaaaaacgacgacgacgccctcgtaactccgcgccgaccaaccaaaactcgcgaccgtccccataaaccaatcgcgaacctctaaccgtaaacgacgcgaaacgaaaaataaacgaaccgaaacgaccacgaaaaaaaaaaaaactaacaacgacgccgtaaaaacgaaactcgctttatacaaaatccgcgctaattaaaccgtaaacgcgcgaatcccgacctacgtcgtaaaactaacgtttttaacgccgactataaaaaaaacgcgaaaataataaaatcgaacgatctccgattcgccaatataactaaatccgtaaacttaaacaaccttaaaattcctcaaaaaccccgcgctcgatcccgacacgcactcacgccgcgactcctaataaccctaaaacgaaaaatccgccaacaccgaaaattcaaaaaccgcgaaattcccgttaacccttttaaaaacacaacttatccctacttacccgcgaacataaaaccgacaaccccccgactacaaac

SEQ ID NO: 27857 - DNA, 694 bp, Artificial Sequence
  chemically treated genomic DNA (Homo sapiens) CpG-island No: 27857
  misc_feature (691)..(692): n is either a, c, g or t
cggcgtttcgagatttttcgacgttttttacgggttcggggtcgcgtatcgcgaatatttttcgtcgtcgtcgtcgcgttcgttcgtttattcgttttcgggaaattgaggtcggcggcgcgcgcgggggtattttttatttcgggagtttcggcgttcgtttgtggttacggaggagggggagttcgggtttacgttttcgtttaggttttcgacgtttttagttttatttattatagcgatatggcggttcgggcggagcggcggaggggcgagcggttcgtagttttgggcgttacggttcgggtcggcgggacggcgggcgggtggggacggagatcgggtcgcgttttcgtcgcgattttttttttttcggtcgcgggaggaggggtcggtagggcggtggtttaggtgttttaattttttcggcgtttagggttcgtttcgcgcgttggcggggattattttattttttcgagacggtttttaggttttttaagcgcgtttagtagatagtgtatggtcgaggcggggtttcggaatttacgggggttatttttaatttcggggacgtttgtttttggcggagtttttcggggcggggggagggcggtcgtcggttttttttgtatttgtgcgaaatttgaatattcggttttttttaagatttttggggtattttttttaatanngg

SEQ ID NO: 27858 - DNA, 694 bp, Artificial Sequence
  chemically treated genomic DNA (Homo sapiens) CpG-island No: 27858
  misc_feature (3)..(4): n is either a, c, g or t
ccnntattaaaaaaaataccccaaaaatcttaaaaaaaaccgaatattcaaatttcgcacaaatacaaaaaaaaccgacgaccgccctccccccgccccgaaaaactccgccaaaaacaaacgtccccgaaattaaaaataacccccgtaaattccgaaaccccgcctcgaccatacactatctactaaacgcgcttaaaaaacctaaaaaccgtctcgaaaaaataaaataatccccgccaacgcgcgaaacgaaccctaaacgccgaaaaaattaaaacacctaaaccaccgccctaccgacccctcctcccgcgaccgaaaaaaaaaaaatcgcgacgaaaacgcgacccgatctccgtccccacccgcccgccgtcccgccgacccgaaccgtaacgcccaaaactacgaaccgctcgcccctccgccgctccgcccgaaccgccatatcgctataataaataaaactaaaaacgtcgaaaacctaaacgaaaacgtaaacccgaactccccctcctccgtaaccacaaacgaacgccgaaactcccgaaataaaaaatacccccgcgcgcgccgccgacctcaatttcccgaaaacgaataaacgaacgaacgcgacgacgacgacgaaaaatattcgcgatacgcgaccccgaacccgtaaaaaacgtcgaaaaatctcgaaacgccg

SEQ ID NO: 27859 - DNA, 694 bp, Artificial Sequence
  chemically treated genomic DNA (Homo sapiens) CpG-island No: 27859
  misc_feature (3)..(4): n is either a, c, g or t
ttnntattaagggaggtgttttaagggttttaaaggagatcgggtgtttagatttcgtataagtataggagggatcggcgatcgtttttttttcgtttcgggaggtttcgttagggataggcgttttcgggattggaggtgattttcgtgggtttcgaagtttcgtttcggttatgtattgtttattaggcgcgtttggggagtttaggggtcgtttcggagaaatggggtggttttcgttagcgcgcggggcgggttttgggcgtcgaaggggttaaggtatttgggttatcgttttgtcggttttttttttcgcggtcgggaagaggaaagtcgcggcgggggcgcggttcggttttcgtttttattcgttcgtcgtttcgtcggttcgagtcgtggcgtttagagttgcgagtcgttcgttttttcgtcgtttcgttcgggtcgttatgtcgttgtggtgagtggggttgggggcgtcgggggtttgggcgggggcgtgggttcgggttttttttttttcgtggttatagacgggcgtcgggattttcgggataggagatgttttcgcgcgcgtcgtcggttttagtttttcgggggcggatgggcgggcgggcgcggcggcggcggcgggagatgttcgcggtacgcggtttcggattcgtgggggacgtcgaggggtttcggggcgtcg

SEQ ID NO: 27860 - DNA, 694 bp, Artificial Sequence
  chemically treated genomic DNA (Homo sapiens) CpG-island No: 27860
  misc_feature (691)..(692): n is either a, c, g or t
cgacgccccgaaacccctcgacgtcccccacgaatccgaaaccgcgtaccgcgaacatctcccgccgccgccgccgcgcccgcccgcccatccgcccccgaaaaactaaaaccgacgacgcgcgcgaaaacatctcctatcccgaaaatcccgacgcccgtctataaccacgaaaaaaaaaaaacccgaacccacgcccccgcccaaacccccgacgcccccaaccccactcaccacaacgacataacgacccgaacgaaacgacgaaaaaacgaacgactcgcaactctaaacgccacgactcgaaccgacgaaacgacgaacgaataaaaacgaaaaccgaaccgcgcccccgccgcgactttcctcttcccgaccgcgaaaaaaaaaaccgacaaaacgataacccaaataccttaaccccttcgacgcccaaaacccgccccgcgcgctaacgaaaaccaccccatttctccgaaacgacccctaaactccccaaacgcgcctaataaacaatacataaccgaaacgaaacttcgaaacccacgaaaatcacctccaatcccgaaaacgcctatccctaacgaaacctcccgaaacgaaaaaaaaacgatcgccgatccctcctatacttatacgaaatctaaacacccgatctcctttaaaacccttaaaacacctcccttaatannaa

SEQ ID NO: 27861 - DNA, 825 bp, Artificial Sequence
  chemically treated genomic DNA (Homo sapiens) CpG-island No: 27861
tcgtcgtcgtcgcggagtagattaataggcgaacgcggagtatagcgtagcgcgggcggtagcgcggttttaagttcggtttagttttcgatgcgcgtcggagttcgcgggcggcgttgagttgggcggttcgggggtcggttttttttttcgttcgtgtttcgcgggttattatgttttttttttagttgggatattaatatattcgttcgttttattcgttcgagcgttcgggggtcgttggcggtagcggcggtagcgcgggggttcggggcggtttgggtgtcggagtttcggagttgaacgtttcggggtttttgtttaacgtgttttcgttcgtgtacggggcgttttacgtcgcggtcgttgcggtcgtcgtcgtttaaggttacggcgtttttttgttttacgtcgcggagttgtttattttttcgtagttggtaagagttcgcggagttagggaaggaggggttggcgttggggcgtagggcgagttgagcgcgcgggggtcggattagaggggtgtaggttaggaggggggaggtagcgatggttggggtttattcgcgtttttttcgcgcgtgttttttttttttttatgtgcgtatagggcgcgtagtatgagttgaaggatagtttcggggtgtagtattcggtcgcggttgtcgcgttttcgtattcgtatttcgttttttattcgtatggttagtattagttcggggattcgtttcgttttaagaacgttattagggagagtattagtacgttgaaggtttggtttaacgagtatcgtaagaatttttattttattaagggcgagaagat

SEQ ID NO: 27862 - DNA, 825 bp, Artificial Sequence
  chemically treated genomic DNA (Homo sapiens) CpG-island No: 27862
atcttctcgcccttaataaaataaaaattcttacgatactcgttaaaccaaaccttcaacgtactaatactctccctaataacgttcttaaaacgaaacgaatccccgaactaatactaaccatacgaataaaaaacgaaatacgaatacgaaaacgcgacaaccgcgaccgaatactacaccccgaaactatccttcaactcatactacgcgccctatacgcacataaaaaaaaaaaaaacacgcgcgaaaaaaacgcgaataaaccccaaccatcgctacctcccccctcctaacctacacccctctaatccgacccccgcgcgctcaactcgccctacgccccaacgccaacccctccttccctaactccgcgaactcttaccaactacgaaaaaataaacaactccgcgacgtaaaacaaaaaaacgccgtaaccttaaacgacgacgaccgcaacgaccgcgacgtaaaacgccccgtacacgaacgaaaacacgttaaacaaaaaccccgaaacgttcaactccgaaactccgacacccaaaccgccccgaacccccgcgctaccgccgctaccgccaacgacccccgaacgctcgaacgaataaaacgaacgaatatattaatatcccaactaaaaaaaaaacataataacccgcgaaacacgaacgaaaaaaaaaaccgacccccgaaccgcccaactcaacgccgcccgcgaactccgacgcgcatcgaaaactaaaccgaacttaaaaccgcgctaccgcccgcgctacgctatactccgcgttcgcctattaatctactccgcgacgacgacga

SEQ ID NO: 27863 - DNA, 825 bp, Artificial Sequence
  chemically treated genomic DNA (Homo sapiens) CpG-island No: 27863
attttttcgtttttggtggggtaggggtttttgcggtgttcgttgagttaggtttttagcgtgttggtgttttttttggtggcgtttttgggacgggacgggttttcgaattggtattggttatacgggtagaaggcggggtgcgggtgcggaaacgcggtagtcgcggtcggatgttgtatttcggggttgttttttagtttatattgcgcgttttgtacgtatatggagaaggaagggatacgcgcggagggagcgcgagtgagttttagttatcgttgtttttttttttttggtttgtatttttttagttcggttttcgcgcgtttagttcgttttgcgttttagcgttaatttttttttttttggtttcgcgggtttttattagttgcgggaagatgggtagtttcgcggcgtagggtaggaaggcgtcgtagttttgggcggcggcggtcgtagcggtcgcggcgtagggcgtttcgtatacggacgagagtacgttggatagggatttcgaggcgtttagtttcgaggtttcggtatttaggtcgtttcgggttttcgcgttgtcgtcgttgtcgttagcggttttcgggcgttcggacgggtaaagcgggcggatgtattggtattttagttgggggaaggatatggtggttcgcggggtacggacggagaggggggtcgattttcgggtcgtttagtttagcgtcgttcgcgggtttcggcgcgtatcgggggttgggtcgggtttggggtcgcgttgtcgttcgcgttgcgttgtgtttcgcgttcgtttattgatttgtttcgcggcggcgacgg

SEQ ID NO: 27864 - DNA, 825 bp, Artificial Sequence
  chemically treated genomic DNA (Homo sapiens) CpG-island No: 27864
ccgtcgccgccgcgaaacaaatcaataaacgaacgcgaaacacaacgcaacgcgaacgacaacgcgaccccaaacccgacccaacccccgatacgcgccgaaacccgcgaacgacgctaaactaaacgacccgaaaatcgacccccctctccgtccgtaccccgcgaaccaccatatccttcccccaactaaaataccaatacatccgcccgctttacccgtccgaacgcccgaaaaccgctaacgacaacgacgacaacgcgaaaacccgaaacgacctaaataccgaaacctcgaaactaaacgcctcgaaatccctatccaacgtactctcgtccgtatacgaaacgccctacgccgcgaccgctacgaccgccgccgcccaaaactacgacgccttcctaccctacgccgcgaaactacccatcttcccgcaactaataaaaacccgcgaaaccaaaaaaaaaaaaattaacgctaaaacgcaaaacgaactaaacgcgcgaaaaccgaactaaaaaaatacaaaccaaaaaaaaaaaaacaacgataactaaaactcactcgcgctccctccgcgcgtatcccttccttctccatatacgtacaaaacgcgcaatataaactaaaaaacaaccccgaaatacaacatccgaccgcgactaccgcgtttccgcacccgcaccccgccttctacccgtataaccaataccaattcgaaaacccgtcccgtcccaaaaacgccaccaaaaaaaacaccaacacgctaaaaacctaactcaacgaacaccgcaaaaacccctaccccaccaaaaacgaaaaaat

SEQ ID NO: 27865 - DNA, 1082 bp, Artificial Sequence
  chemically treated genomic DNA (Homo sapiens) CpG-island No: 27865
acgcgcgtcggcgttttaagaaggagaataagatgatttgggcgtttcgtagtcgtattgacgaggagggaaacgtttatgggagcgagcgcgaggaggaagacgaagaggaggacgaggaggattgtaaacgcgagttagagttggaggaggaggagttcgggggggaggaggaggatattgggggcgagggtttggttgacgattacgaggacgaggagatcgatttggagaatttagacggcgcggttatcgagtttgatttgtttttggttggggcggcgcgtagggatggcgatttaagtttgggatttatttcggattttaaaaatagcgattcggaagatagttttgacggtttagaggatcggttattatcggttttgagtttggttttagcgttattattagtggtcgtggtttcgtcgtttttgtcgtcgtttttcgtgagtttggatttttgcgttttcgtattagttttcgttttcgttttgtagaagtttaagatttggtttttcgcggagattgttataagttcggataattcgcgtcgttcgtttttcggcgcgggggggtttttatcgggggtagcggtcgcgtttttcgttttgtagtttttttcggtcgtcgacgttgtagtcgtttatagattggttttagcgtcgttgggtaagttttcggtttggattaatcggtcgtttttaggtttatcgttcggttttcgtttgtattcgttttttttgttgggttttgttttttcgtatttgttgggatttttcggagtcgcgggttattcggttgtcgtcgtcgttttcgttcggttagcggagttcgaaggcggaataggtgattgttgagcgttgggcgcggagcgggggcgggttttgcgggtagtgtcggagttggtcgggaggggtagggttcggggggcgtagggcgcgcgtttttttttatttttgttttttgcggttttgggcgtcggtatcgagcgttttaaaggttttttttttttttttttcgttttttttagatcgttgtagtgttttggaagtggagaaaaagttatttaagatagtttttta

SEQ ID NO: 27866 - DNA, 1082 bp, Artificial Sequence
  chemically treated genomic DNA (Homo sapiens) CpG-island No: 27866
taaaaaactatcttaaataactttttctccacttccaaaacactacaacgatctaaaaaaaacgaaaaaaaaaaaaaaaaaacctttaaaacgctcgataccgacgcccaaaaccgcaaaaaacaaaaataaaaaaaaacgcgcgccctacgccccccgaaccctacccctcccgaccaactccgacactacccgcaaaacccgcccccgctccgcgcccaacgctcaacaatcacctattccgccttcgaactccgctaaccgaacgaaaacgacgacgacaaccgaataacccgcgactccgaaaaatcccaacaaatacgaaaaaacaaaacccaacaaaaaaaacgaatacaaacgaaaaccgaacgataaacctaaaaacgaccgattaatccaaaccgaaaacttacccaacgacgctaaaaccaatctataaacgactacaacgtcgacgaccgaaaaaaactacaaaacgaaaaacgcgaccgctacccccgataaaaacccccccgcgccgaaaaacgaacgacgcgaattatccgaacttataacaatctccgcgaaaaaccaaatcttaaacttctacaaaacgaaaacgaaaactaatacgaaaacgcaaaaatccaaactcacgaaaaacgacgacaaaaacgacgaaaccacgaccactaataataacgctaaaaccaaactcaaaaccgataataaccgatcctctaaaccgtcaaaactatcttccgaatcgctatttttaaaatccgaaataaatcccaaacttaaatcgccatccctacgcgccgccccaaccaaaaacaaatcaaactcgataaccgcgccgtctaaattctccaaatcgatctcctcgtcctcgtaatcgtcaaccaaaccctcgcccccaatatcctcctcctcccccccgaactcctcctcctccaactctaactcgcgtttacaatcctcctcgtcctcctcttcgtcttcctcctcgcgctcgctcccataaacgtttccctcctcgtcaatacgactacgaaacgcccaaatcatcttattctccttcttaaaacgccgacgcgcgt

SEQ ID NO: 27867 - DNA, 1082 bp, Artificial Sequence
  chemically treated genomic DNA (Homo sapiens) CpG-island No: 27867
tggaaagttgttttgagtaattttttttttatttttaaggtattatagcgatttaagggaagcgggggaagaaaaaggagggtttttagagcgttcggtgtcggcgtttagggtcgtagaaagtaggagtggagagggacgcgcgttttgcgtttttcgggttttgtttttttcggttagtttcggtattattcgtagagttcgttttcgtttcgcgtttagcgtttagtagttatttgtttcgttttcgggtttcgttggtcgagcgaaggcggcggcggtagtcgggtggttcgcggtttcgggaagttttagtaggtgcggaggggtagagtttagtagggagagcgggtgtaggcgggggtcgggcggtgggtttggaaacggtcggttggtttaagtcgggaatttgtttagcggcgttgagattagtttgtgagcggttgtagcgtcggcggtcggagagagttgtagggcggaaggcgcgatcgttgttttcggtggagattttttcgcgtcgggaggcgagcggcgcgggttgttcgggtttgtggtagttttcgcgagggattagattttgggtttttgtagggcggaggcgggggttggtgcgggagcgtaggggtttaggtttacggggggcgacggtagagacggcgaggttacggttattggtggtggcgttggagttagatttaggatcggtagtggtcggttttttaagtcgttagagttatttttcgagtcgttatttttggagttcgaaatgggttttaggtttaggtcgttatttttgcgcgtcgttttagttagggatagattaggttcggtggtcgcgtcgtttaagttttttaaatcgattttttcgttttcgtggtcgttagttaggttttcgtttttagtgttttttttttttttttcgagtttttttttttttagttttagttcgcgtttgtagtttttttcgttttttttttcgttttttttttcgcgttcgtttttataagcgttttttttttcgttagtgcggttgcgaggcgtttaagttattttatttttttttttgaggcgtcggcgcgcgt

SEQ ID NO: 27868 - DNA, 1082 bp, Artificial Sequence
  chemically treated genomic DNA (Homo sapiens) CpG-island No: 27868
acgcgcgccgacgcctcaaaaaaaaaaataaaataacttaaacgcctcgcaaccgcactaacgaaaaaaaaaacgcttataaaaacgaacgcgaaaaaaaaaacgaaaaaaaaaacgaaaaaaactacaaacgcgaactaaaactaaaaaaaaaaaaactcgaaaaaaaaaaaaaaaacactaaaaacgaaaacctaactaacgaccacgaaaacgaaaaaatcgatttaaaaaacttaaacgacgcgaccaccgaacctaatctatccctaactaaaacgacgcgcaaaaataacgacctaaacctaaaacccatttcgaactccaaaaataacgactcgaaaaataactctaacgacttaaaaaaccgaccactaccgatcctaaatctaactccaacgccaccaccaataaccgtaacctcgccgtctctaccgtcgccccccgtaaacctaaacccctacgctcccgcaccaacccccgcctccgccctacaaaaacccaaaatctaatccctcgcgaaaactaccacaaacccgaacaacccgcgccgctcgcctcccgacgcgaaaaaatctccaccgaaaacaacgatcgcgccttccgccctacaactctctccgaccgccgacgctacaaccgctcacaaactaatctcaacgccgctaaacaaattcccgacttaaaccaaccgaccgtttccaaacccaccgcccgacccccgcctacacccgctctccctactaaactctacccctccgcacctactaaaacttcccgaaaccgcgaaccacccgactaccgccgccgccttcgctcgaccaacgaaacccgaaaacgaaacaaataactactaaacgctaaacgcgaaacgaaaacgaactctacgaataataccgaaactaaccgaaaaaaacaaaacccgaaaaacgcaaaacgcgcgtccctctccactcctactttctacgaccctaaacgccgacaccgaacgctctaaaaaccctcctttttcttcccccgcttcccttaaatcgctataataccttaaaaataaaaaaaaaattactcaaaacaactttcca

SEQ ID NO: 27869 - DNA, 588 bp, Artificial Sequence
  chemically treated genomic DNA (Homo sapiens) CpG-island No: 27869
attatttcgcgcgtttcggggaggtataggaagcgcgtatatttttcgaagttacggaataagatacggtttaatattgtatattttcgaagttcggcggtagtagagcggagttcgataggattgggttatgcggatttagcggttagcgtcgcgttttgggagtttttttcgcgaagggggtgattaaggtgcggcggcgttttaggggcgagtggggaggggattgtgtcggtttttgcgttattttgcgggcgtatagagggttggcgaatcgttagtggatattcggtaaagtcgttttttagttggttcgtttttttagttttttttttagaggttaaagagacgttttttcggttttttagcgttcgttttttttgttaacggtgtttttggggtttaggtttttttttagttcgtaaatttagattgaggtttcgttttggttttgtttatagcgtttttagacgtggagttcgtttattttcgcggatttggatttgaggtcggaatattgaatgattttataaggagagtatttcgatattttaatagtttacgttttataagtttagttgtggtatt

SEQ ID NO: 27870 - DNA, 588 bp, Artificial Sequence
  chemically treated genomic DNA (Homo sapiens) CpG-island No: 27870
aataccacaactaaacttataaaacgtaaactattaaaatatcgaaatactctccttataaaatcattcaatattccgacctcaaatccaaatccgcgaaaataaacgaactccacgtctaaaaacgctataaacaaaaccaaaacgaaacctcaatctaaatttacgaactaaaaaaaaacctaaaccccaaaaacaccgttaacaaaaaaaacgaacgctaaaaaaccgaaaaaacgtctctttaacctctaaaaaaaaaactaaaaaaacgaaccaactaaaaaacgactttaccgaatatccactaacgattcgccaaccctctatacgcccgcaaaataacgcaaaaaccgacacaatcccctccccactcgcccctaaaacgccgccgcaccttaatcacccccttcgcgaaaaaaactcccaaaacgcgacgctaaccgctaaatccgcataacccaatcctatcgaactccgctctactaccgccgaacttcgaaaatatacaatattaaaccgtatcttattccgtaacttcgaaaaatatacgcgcttcctatacctccccgaaacgcgcgaaataat

SEQ ID NO: 27871 - DNA, 588 bp, Artificial Sequence
  chemically treated genomic DNA (Homo sapiens) CpG-island No: 27871
ggtgttatagttaagtttgtgaggcgtgagttgttgaggtgtcggagtgttttttttgtaaagttatttaatgtttcggttttaggtttaagttcgcgaggatgggcgggttttacgtttgggggcgttgtgagtagggttagagcgaaattttagtttgagtttacgaattgggaaggagtttgaattttagaaatatcgttaataaagagggcgaacgttagggagtcgaggagacgtttttttggtttttggggaaggggttggaggagcgagttagttgagaagcggttttgtcgggtgtttattagcggttcgttagttttttgtgcgttcgtagagtgacgtagaggtcgatatagttttttttttattcgtttttggggcgtcgtcgtattttgattatttttttcgcggagggaatttttaaggcgcggcgttggtcgttgggttcgtatggtttagttttgtcgggtttcgttttgttgtcgtcgagtttcgaaggtgtgtagtgttgagtcgtgttttgtttcgtggtttcgaggggtgtgcgcgttttttatattttttcggaacgcgcgagatagt

SEQ ID NO: 27872 - DNA, 588 bp, Artificial Sequence
  chemically treated genomic DNA (Homo sapiens) CpG-island No: 27872
actatctcgcgcgttccgaaaaaatataaaaaacgcgcacacccctcgaaaccacgaaacaaaacacgactcaacactacacaccttcgaaactcgacgacaacaaaacgaaacccgacaaaactaaaccatacgaacccaacgaccaacgccgcgccttaaaaattccctccgcgaaaaaaataatcaaaatacgacgacgccccaaaaacgaataaaaaaaaaactatatcgacctctacgtcactctacgaacgcacaaaaaactaacgaaccgctaataaacacccgacaaaaccgcttctcaactaactcgctcctccaaccccttccccaaaaaccaaaaaaacgtctcctcgactccctaacgttcgccctctttattaacgatatttctaaaattcaaactccttcccaattcgtaaactcaaactaaaatttcgctctaaccctactcacaacgcccccaaacgtaaaacccgcccatcctcgcgaacttaaacctaaaaccgaaacattaaataactttacaaaaaaaacactccgacacctcaacaactcacgcctcacaaacttaactataacacc

SEQ ID NO: 27873 - DNA, 561 bp, Artificial Sequence
  chemically treated genomic DNA (Homo sapiens) CpG-island No: 27873
agttacgtttcgttcggttttttcgaatatttttttcggggttttggggtagtaggaaaggggatgtgggaaggttaaggaggacggtttagggcgtcgaggggtaggaagtgcggggagtaggagtcgcgtagggggcgggtgggagagggggtggattagcgggcgaggggttgttaggagcgaagtttcgggggtggggtcggtcgtttggtagagggcgcggcgggggaggggagaggagtgcgttttggggaggcggcgagggggtttcgttaaagttgttttaaagttttcggttcggggagcggttttttagttagtagtttcgaggtttatttgcgtagtggtcgaagacggtgggtacgtattttttcgggaaggcgtcgttggtatagtttatgagtaggtacgttttgtttatcgtttcgtcgtcgattattacgtatttgagtattagcgcgtcgggttcgtgagttatgttgttgtcggtcggttttcgggtatggttttttcggagttttcgtttcggtttcgggtttagttttagttcgtttgggg

SEQ ID NO: 27874 - DNA, 561 bp, Artificial Sequence
  chemically treated genomic DNA (Homo sapiens) CpG-island No: 27874
ccccaaacgaactaaaactaaacccgaaaccgaaacgaaaactccgaaaaaaccatacccgaaaaccgaccgacaacaacataactcacgaacccgacgcgctaatactcaaatacgtaataatcgacgacgaaacgataaacaaaacgtacctactcataaactataccaacgacgccttcccgaaaaaatacgtacccaccgtcttcgaccactacgcaaataaacctcgaaactactaactaaaaaaccgctccccgaaccgaaaactttaaaacaactttaacgaaaccccctcgccgcctccccaaaacgcactcctctcccctcccccgccgcgccctctaccaaacgaccgaccccacccccgaaacttcgctcctaacaacccctcgcccgctaatccaccccctctcccacccgccccctacgcgactcctactccccgcacttcctacccctcgacgccctaaaccgtcctccttaaccttcccacatcccctttcctactaccccaaaaccccgaaaaaaatattcgaaaaaaccgaacgaaacgtaact

SEQ ID NO: 27875 - DNA, 561 bp, Artificial Sequence
  chemically treated genomic DNA (Homo sapiens) CpG-island No: 27875
ttttaggcgggttggggttgagttcggggtcggggcgggggtttcggggggattatgttcggaggtcggtcggtagtagtatggtttacgggttcggcgcgttgatgtttaagtgcgtggtggtcggcgacggggcggtgggtaagacgtgtttatttatgagttatgttaacgacgttttttcggaggagtacgtgtttatcgttttcgattattacgtaggtaagtttcggaattgttgattaaggggtcgtttttcgggtcgggaattttggagtaattttggcggagttttttcgtcgtttttttagagcgtattttttttttttttttcgtcgcgttttttgttaggcggtcggttttattttcgaagtttcgtttttggtaatttttcgttcgttgatttatttttttttttattcgttttttacgcggtttttgtttttcgtattttttatttttcggcgttttgggtcgttttttttgatttttttatatttttttttttattgttttaaggtttcgggggaaatattcgaggggatcgagcgagacgtggtt

SEQ ID NO: 27876 - DNA, 561 bp, Artificial Sequence
  chemically treated genomic DNA (Homo sapiens) CpG-island No: 27876
aaccacgtctcgctcgatcccctcgaatatttcccccgaaaccttaaaacaataaaaaaaaaaatataaaaaaatcaaaaaaaacgacccaaaacgccgaaaaataaaaaatacgaaaaacaaaaaccgcgtaaaaaacgaataaaaaaaaaaataaatcaacgaacgaaaaattaccaaaaacgaaacttcgaaaataaaaccgaccgcctaacaaaaaacgcgacgaaaaaaaaaaaaaaaatacgctctaaaaaaacgacgaaaaaactccgccaaaattactccaaaattcccgacccgaaaaacgaccccttaatcaacaattccgaaacttacctacgtaataatcgaaaacgataaacacgtactcctccgaaaaaacgtcgttaacataactcataaataaacacgtcttacccaccgccccgtcgccgaccaccacgcacttaaacatcaacgcgccgaacccgtaaaccatactactaccgaccgacctccgaacataatccccccgaaacccccgccccgaccccgaactcaaccccaacccgcctaaaa

SEQ ID NO: 27877 - DNA, 711 bp, Artificial Sequence
  chemically treated genomic DNA (Homo sapiens) CpG-island No: 27877
gttcgtcgtcgtcgtcgtcgtttcgcgtcgtaggtcgttttttcggttttatgtagcggtttttttcgtaggaggggagggggcggcgggttcgggcgttgttcgtcgcggtcgtcgtcggattttcgtttcggtttcggtcgtcgcgttcgttcgttgttttcgttattcggcgttcgcgtttttttttcggttcggtttttttaggaggattcgtcggattataagatcggtcggtttcgggggagacggtaattttggggagggcggcggaggggaggggttaggcggtttttttcgtttcgcgttaattcgggtttttttcgcggcgtttcggaggagggcgggtttaggcgtttttttagacgcggtcgcgttacgcgttattcgtttgttgtcgtcggcggtttgtcggcgtattcgagttttattttttgcgagggtcgcgcggaggggcgcgtaggaggaggaggagtcgaggatcgcggaggggaggaggggagtcgtttgggagtcgagggtttttcgcgtaagtgttcgtagcgttcggaagcgtttaaaggtttcgatgttgggagaagacgtggaggtttttcggggaattacgacgatttttacgatgacgtaatagttatgttaaattatatatgtatattttatttttattcggaaggttagagttattttttcggtttttaagtgtataacgga

SEQ ID NO: 27878 - DNA, 711 bp, Artificial Sequence
  chemically treated genomic DNA (Homo sapiens) CpG-island No: 27878
tccgttatacacttaaaaaccgaaaaaataactctaaccttccgaataaaaataaaatatacatatataatttaacataactattacgtcatcgtaaaaatcgtcgtaattccccgaaaaacctccacgtcttctcccaacatcgaaacctttaaacgcttccgaacgctacgaacacttacgcgaaaaaccctcgactcccaaacgactcccctcctcccctccgcgatcctcgactcctcctcctcctacgcgcccctccgcgcgaccctcgcaaaaaataaaactcgaatacgccgacaaaccgccgacgacaacaaacgaataacgcgtaacgcgaccgcgtctaaaaaaacgcctaaacccgccctcctccgaaacgccgcgaaaaaaacccgaattaacgcgaaacgaaaaaaaccgcctaacccctcccctccgccgccctccccaaaattaccgtctcccccgaaaccgaccgatcttataatccgacgaatcctcctaaaaaaaccgaaccgaaaaaaaaacgcgaacgccgaataacgaaaacaacgaacgaacgcgacgaccgaaaccgaaacgaaaatccgacgacgaccgcgacgaacaacgcccgaacccgccgccccctcccctcctacgaaaaaaaccgctacataaaaccgaaaaaacgacctacgacgcgaaacgacgacgacgacgacgaac

SEQ ID NO: 27879 - DNA, 711 bp, Artificial Sequence
  chemically treated genomic DNA (Homo sapiens) CpG-island No: 27879
ttcgttgtgtatttagaggtcgagaggatggttttggtttttcgggtggaggtgaaatatgtatgtataatttggtatgattattgcgttatcgtggaggtcgtcgtggtttttcgagaggtttttacgtttttttttagtatcggggtttttggacgttttcgggcgttgcgggtatttgcgcgaggagttttcggtttttaggcgattttttttttttttttcgcggttttcggttttttttttttttgcgcgttttttcgcgcggttttcgtagggagtggggttcgggtgcgtcggtaggtcgtcggcggtagtaggcgggtggcgcgtggcgcggtcgcgtttggggaggcgtttgggttcgttttttttcggggcgtcgcgggaggggttcgggttggcgcggggcggggagagtcgtttggtttttttttttcgtcgttttttttaaagttgtcgtttttttcggggtcggtcggttttatgattcggcggatttttttggggaggtcgggtcggggagagggcgcgggcgtcgagtggcgggggtagcgggcgggcgcggcgatcggggtcggggcggggattcggcggcgatcgcggcgggtagcgttcgggttcgtcgttttttttttttttgcgaggggagtcgttgtatggggtcgggggggcggtttgcggcgcggagcggcggcgacggcggcggat

SEQ ID NO: 27880 - DNA, 711 bp, Artificial Sequence
  chemically treated genomic DNA (Homo sapiens) CpG-island No: 27880
atccgccgccgtcgccgccgctccgcgccgcaaaccgcccccccgaccccatacaacgactcccctcgcaaaaaaaaaaaaaacgacgaacccgaacgctacccgccgcgatcgccgccgaatccccgccccgaccccgatcgccgcgcccgcccgctacccccgccactcgacgcccgcgccctctccccgacccgacctccccaaaaaaatccgccgaatcataaaaccgaccgaccccgaaaaaaacgacaactttaaaaaaaacgacgaaaaaaaaaaaccaaacgactctccccgccccgcgccaacccgaacccctcccgcgacgccccgaaaaaaaacgaacccaaacgcctccccaaacgcgaccgcgccacgcgccacccgcctactaccgccgacgacctaccgacgcacccgaaccccactccctacgaaaaccgcgcgaaaaaacgcgcaaaaaaaaaaaaaaccgaaaaccgcgaaaaaaaaaaaaaaaatcgcctaaaaaccgaaaactcctcgcgcaaatacccgcaacgcccgaaaacgtccaaaaaccccgatactaaaaaaaaacgtaaaaacctctcgaaaaaccacgacgacctccacgataacgcaataatcataccaaattatacatacatatttcacctccacccgaaaaaccaaaaccatcctctcgacctctaaatacacaacgaa

SEQ ID NO: 27881 - DNA, 508 bp, Artificial Sequence
  chemically treated genomic DNA (Homo sapiens) CpG-island No: 27881
taattatcgtgtaagatttttgtttttagttgtatgtattgaggcggcgggaagaagcgtcgagggaaggtttagatcgtaatgttttttagtttgtagttattttcgggggttgtagttttcgtattcgcgacgttcggtttttagcgggtgtaggcgtagttttttcgtttttttttcgttcgcggttgcgttcggagagcgtttagttgatttaggggcggggtcggggcggggatttaaagtttcggttattttcgagggggtgagtggttttatcgtcggttttttgtagcgttgtttttcgatttttttatatttcggtggcgcgggattttaagatgcgtttttatttgtttttgttgttcgcgttgtgcgtgtaggtattatcgtcgcggagtttagttatagtttgcgtggtaattggagtatttgtaatgggaacggttcgttggagttgttcggggcggtttttggttgcgtgtatagcgttttgttttagtagggt

SEQ ID NO: 27882 - DNA, 508 bp, Artificial Sequence
  chemically treated genomic DNA (Homo sapiens) CpG-island No: 27882
accctactaaaacaaaacgctatacacgcaaccaaaaaccgccccgaacaactccaacgaaccgttcccattacaaatactccaattaccacgcaaactataactaaactccgcgacgataatacctacacgcacaacgcgaacaacaaaaacaaataaaaacgcatcttaaaatcccgcgccaccgaaatataaaaaaatcgaaaaacaacgctacaaaaaaccgacgataaaaccactcaccccctcgaaaataaccgaaactttaaatccccgccccgaccccgcccctaaatcaactaaacgctctccgaacgcaaccgcgaacgaaaaaaaaacgaaaaaactacgcctacacccgctaaaaaccgaacgtcgcgaatacgaaaactacaacccccgaaaataactacaaactaaaaaacattacgatctaaaccttccctcgacgcttcttcccgccgcctcaatacatacaactaaaaacaaaaatcttacacgataatta

SEQ ID NO: 27883 - DNA, 508 bp, Artificial Sequence
  chemically treated genomic DNA (Homo sapiens) CpG-island No: 27883
gttttgttggaataaggcgttgtgtacgtagttagggatcgtttcgggtagttttagcgagtcgtttttattgtagatgttttagttgttacgtaagttgtaattgagtttcgcggcggtggtgtttgtacgtatagcgcgagtagtaggagtaggtggaggcgtattttgagatttcgcgttatcgagatgtggagagatcgaaaggtagcgttgtaagggatcggcggtgaagttatttattttttcggaagtagtcgaggttttaggttttcgtttcggtttcgtttttaggttagttgagcgtttttcgggcgtagtcgcgggcgggaggggaacgaggaggttgcgtttgtattcgttgaaagtcgggcgtcgcgggtgcgggagttgtagttttcgagaatagttataggttggggggtattgcggtttgagttttttttcggcgttttttttcgtcgttttagtatatataattggaggtaagaattttgtacggtaattg

SEQ ID NO: 27884 - DNA, 508 bp, Artificial Sequence
  chemically treated genomic DNA (Homo sapiens) CpG-island No: 27884
caattaccgtacaaaattcttacctccaattatatatactaaaacgacgaaaaaaaacgccgaaaaaaaactcaaaccgcaataccccccaacctataactattctcgaaaactacaactcccgcacccgcgacgcccgactttcaacgaatacaaacgcaacctcctcgttcccctcccgcccgcgactacgcccgaaaaacgctcaactaacctaaaaacgaaaccgaaacgaaaacctaaaacctcgactacttccgaaaaaataaataacttcaccgccgatcccttacaacgctacctttcgatctctccacatctcgataacgcgaaatctcaaaatacgcctccacctactcctactactcgcgctatacgtacaaacaccaccgccgcgaaactcaattacaacttacgtaacaactaaaacatctacaataaaaacgactcgctaaaactacccgaaacgatccctaactacgtacacaacgccttattccaacaaaac

SEQ ID NO: 27885 - DNA, 617 bp, Artificial Sequence
  chemically treated genomic DNA (Homo sapiens) CpG-island No: 27885
tttcggtttttaaaaggtaaggtgtacgatttatttatttattcggttgtagggatattatttaaaacgggtattatcgttatcgaatcgcgggcgttttttgtggggtcgttcggagatcggttttttaaagttaacgacgatttgggatagttagcgcggtttttagtcgtcgtcgtcggcgatttgagagttcgttcgggtttgagtgttttttacgtttacgattattatcgaattcgggtttcgtttttgtcggtttttaggaaaataaagatagaggagagtcggttcgtttgtgtcgtagggtaaacgtcgttttgaagtatcgataatattggtaatatttatagtcgttttgaggggacgggcgtagaggagagttgtcgtttttcggttgttgggttcgggtgtcgcgcggcgcggtcgaggacgcgagtttaagtggcggtagcggcggttgcggcggtggcggaagtggagtggggaagagggggtggttgttagtgtttggcgtcggcggagggagttatttttgtagttgtattttcggtcggtattttgttttgagagggagagacggaacgagagagagatatatatagggtttttttttt

SEQ ID NO: 27886 - DNA, 617 bp, Artificial Sequence
  chemically treated genomic DNA (Homo sapiens) CpG-island No: 27886
aaaaaaaaaaccctatatatatctctctctcgttccgtctctccctctcaaaacaaaataccgaccgaaaatacaactacaaaaataactccctccgccgacgccaaacactaacaaccaccccctcttccccactccacttccgccaccgccgcaaccgccgctaccgccacttaaactcgcgtcctcgaccgcgccgcgcgacacccgaacccaacaaccgaaaaacgacaactctcctctacgcccgtcccctcaaaacgactataaatattaccaatattatcgatacttcaaaacgacgtttaccctacgacacaaacgaaccgactctcctctatctttattttcctaaaaaccgacaaaaacgaaacccgaattcgataataatcgtaaacgtaaaaaacactcaaacccgaacgaactctcaaatcgccgacgacgacgactaaaaaccgcgctaactatcccaaatcgtcgttaactttaaaaaaccgatctccgaacgaccccacaaaaaacgcccgcgattcgataacgataatacccgttttaaataatatccctacaaccgaataaataaataaatcgtacaccttaccttttaaaaaccgaaa

SEQ ID NO: 27887 - DNA, 617 bp, Artificial Sequence
  chemically treated genomic DNA (Homo sapiens) CpG-island No: 27887
ggggaaggagttttgtgtgtgtttttttttcgtttcgttttttttttttagaataaaatgtcgatcggaagtgtagttgtaggaatgatttttttcgtcggcgttaaatattaataattatttttttttttttattttattttcgttatcgtcgtagtcgtcgttgtcgttatttgggttcgcgttttcggtcgcgtcgcgcggtattcgggtttagtagtcgggaggcggtagtttttttttacgttcgtttttttagggcggttgtggatgttgttagtattgtcgatgttttagagcgacgtttgttttgcgatataggcgggtcggtttttttttgtttttatttttttggaggtcgataggagcggggttcgagttcggtggtggtcgtgagcgtggggggtatttaggttcggacgggtttttaggtcgtcgacggcggcggttggaggtcgcgttggttgttttaggtcgtcgttagttttagggagtcgattttcgggcggttttatagaggacgttcgcgattcgatggcgatgatgttcgttttaaatggtgtttttgtagtcgggtggatggatggatcgtatattttgttttttgagagtcggga

SEQ ID NO: 27888 - DNA, 617 bp, Artificial Sequence
  chemically treated genomic DNA (Homo sapiens) CpG-island No: 27888
tcccgactctcaaaaaacaaaatatacgatccatccatccacccgactacaaaaacaccatttaaaacgaacatcatcgccatcgaatcgcgaacgtcctctataaaaccgcccgaaaatcgactccctaaaactaacgacgacctaaaacaaccaacgcgacctccaaccgccgccgtcgacgacctaaaaacccgtccgaacctaaataccccccacgctcacgaccaccaccgaactcgaaccccgctcctatcgacctccaaaaaaataaaaacaaaaaaaaaccgacccgcctatatcgcaaaacaaacgtcgctctaaaacatcgacaatactaacaacatccacaaccgccctaaaaaaacgaacgtaaaaaaaaactaccgcctcccgactactaaacccgaataccgcgcgacgcgaccgaaaacgcgaacccaaataacgacaacgacgactacgacgataacgaaaataaaataaaaaaaaaaaaataattattaatatttaacgccgacgaaaaaaatcattcctacaactacacttccgatcgacattttattctaaaaaaaaaaaacgaaacgaaaaaaaaacacacacaaaactccttcccc

SEQ ID NO: 27889 - DNA, 573 bp, Artificial Sequence
  chemically treated genomic DNA (Homo sapiens) CpG-island No: 27889
gacggaagaggagtcgtagttattttttttttcggttcggattatagtttttcgttatagcggtttcggtttttttttggatttagacgtcgattcgtttaggtaaatttttgttttttatttcggcggcggcggcggcggcgtcggcgttaggtttttagcgtttttttttttcgttttttttttcgtcgtttttttagcggttttaggttttttttataggcgagtttagagttcgtttttttttggtggtagtcgttttgggtagcggtggttttgtattttttttcggtcggtttcggtggcggggattgggtttttgttgggcggtcggggaggcgtaggttcggcggagagtgtaggtcgcgggttagcggaatttatttgagttcggggattaggagagtttcgggttgagcggagcgattgttggtcggtgataggtttcgttcgggagtggagtcgtagttagtggggaggcggaaataatataattaatagtaaatgtgttttgatcgtttttatatttataattttttcggttcgggagtggggaacgttttagtgaaataa

SEQ ID NO: 27890 - DNA, 573 bp, Artificial Sequence
  chemically treated genomic DNA (Homo sapiens) CpG-island No: 27890
ttatttcactaaaacgttccccactcccgaaccgaaaaaattataaatataaaaacgatcaaaacacatttactattaattatattatttccgcctccccactaactacgactccactcccgaacgaaacctatcaccgaccaacaatcgctccgctcaacccgaaactctcctaatccccgaactcaaataaattccgctaacccgcgacctacactctccgccgaacctacgcctccccgaccgcccaacaaaaacccaatccccgccaccgaaaccgaccgaaaaaaaatacaaaaccaccgctacccaaaacgactaccaccaaaaaaaaacgaactctaaactcgcctataaaaaaaacctaaaaccgctaaaaaaacgacgaaaaaaaaaacgaaaaaaaaaaacgctaaaaacctaacgccgacgccgccgccgccgccgccgaaataaaaaacaaaaatttacctaaacgaatcgacgtctaaatccaaaaaaaaaccgaaaccgctataacgaaaaactataatccgaaccgaaaaaaaaaataactacgactcctcttccgtc

SEQ ID NO: 27891 - DNA, 573 bp, Artificial Sequence
  chemically treated genomic DNA (Homo sapiens) CpG-island No: 27891
ttgttttattgggacgttttttattttcggatcgggaaagttgtaaatatggggacgattagggtatatttgttgttagttgtattgttttcgtttttttattagttacggttttattttcgggcgaggtttgttatcgattagtagtcgtttcgtttagttcggagtttttttaattttcgagtttaagtagatttcgttggttcgcggtttgtatttttcgtcgggtttacgttttttcggtcgtttagtaggagtttagttttcgttatcggagtcggtcgggagagggtataaaattatcgttatttaaggcggttgttattagagaggagcgaattttagattcgtttgtggaagagatttggggtcgttaaggaaacggcggggaggggagcgaggaggagagacgttgaggatttggcgtcggcgtcgtcgtcgtcgtcgtcgaaataaagagtaggaatttatttgggcgaatcggcgtttgaatttaaggggaggtcgaggtcgttgtggcgagagattataattcgggtcgggagggggggtggttacggtttttttttcgtt

SEQ ID NO: 27892 - DNA, 573 bp, Artificial Sequence
  chemically treated genomic DNA (Homo sapiens) CpG-island No: 27892
aacgaaaaaaaaaccgtaaccaccccccctcccgacccgaattataatctctcgccacaacgacctcgacctccccttaaattcaaacgccgattcgcccaaataaattcctactctttatttcgacgacgacgacgacgacgccgacgccaaatcctcaacgtctctcctcctcgctcccctccccgccgtttccttaacgaccccaaatctcttccacaaacgaatctaaaattcgctcctctctaataacaaccgccttaaataacgataattttataccctctcccgaccgactccgataacgaaaactaaactcctactaaacgaccgaaaaaacgtaaacccgacgaaaaatacaaaccgcgaaccaacgaaatctacttaaactcgaaaattaaaaaaactccgaactaaacgaaacgactactaatcgataacaaacctcgcccgaaaataaaaccgtaactaataaaaaaacgaaaacaatacaactaacaacaaatataccctaatcgtccccatatttacaactttcccgatccgaaaataaaaaacgtcccaataaaacaa

SEQ ID NO: 27893 - DNA, 815 bp, Artificial Sequence
  chemically treated genomic DNA (Homo sapiens) CpG-island No: 27893
ttcgatagcgattgcgatatagttgtttcggtttttgtttttagtttagggcgttcgggcgttacgggttttattcgagtggttttgcgttttagttagtttttaaatttagttagttagcgttttcgttttcggatttcggcgaagttggttcgcgttttagtttttgttttgggatttttgtcgagttttcgttttttacgcgtcgtaaatttcgtattcgcgcgtattaaattttttgttcgtgcgtttttaatcgggttttcgcgttttttaatttgggttttttcgtgattttattttcgcgttttgagttttcgtatttcgcgtttttcgaattttgttttcgcgtttttcgaatttagttttcgcgttttagttttagatttttgtgttttttaagtttcgtttttgcgttcggagcgcgaaagttcgcgtcgggttcgaaataaagaggatcgcggcgcgtggtcgcgtttttttttttttcggttttagtatttgggggagtttgaggcgcggttcggtagggcgatggtcgtaacgaggttgggtttcgagtagcgcgcgggcgggttcgttttttttggttggttgtcggcgttcgcggtagggttttttcgaggcggcgcgggtaatcgttacggtcggttttcgcgttcgcgtttcgagtttggcgggttatttggttttattattttaataatgtagcgcgtttttaggcgttttttatcggggtttttcgttttgtcgaggtgcgttttgggattttttttcgttggtcgtagagaggatttggaattattagatttatt

SEQ ID NO: 27894 - DNA, 815 bp, Artificial Sequence
  chemically treated genomic DNA (Homo sapiens) CpG-island No: 27894
aataaatctaataattccaaatcctctctacgaccaacgaaaaaaaatcccaaaacgcacctcgacaaaacgaaaaaccccgataaaaaacgcctaaaaacgcgctacattattaaaataataaaaccaaataacccgccaaactcgaaacgcgaacgcgaaaaccgaccgtaacgattacccgcgccgcctcgaaaaaaccctaccgcgaacgccgacaaccaaccaaaaaaaacgaacccgcccgcgcgctactcgaaacccaacctcgttacgaccatcgccctaccgaaccgcgcctcaaactcccccaaatactaaaaccgaaaaaaaaaaaaacgcgaccacgcgccgcgatcctctttatttcgaacccgacgcgaactttcgcgctccgaacgcaaaaacgaaacttaaaaaacacaaaaatctaaaactaaaacgcgaaaactaaattcgaaaaacgcgaaaacaaaattcgaaaaacgcgaaatacgaaaactcaaaacgcgaaaataaaatcacgaaaaaacccaaattaaaaaacgcgaaaacccgattaaaaacgcacgaacaaaaaatttaatacgcgcgaatacgaaatttacgacgcgtaaaaaacgaaaactcgacaaaaatcccaaaacaaaaactaaaacgcgaaccaacttcgccgaaatccgaaaacgaaaacgctaactaactaaatttaaaaactaactaaaacgcaaaaccactcgaataaaacccgtaacgcccgaacgccctaaactaaaaacaaaaaccgaaacaactatatcgcaatcgctatcgaa

SEQ ID NO: 27895 - DNA, 815 bp, Artificial Sequence
  chemically treated genomic DNA (Homo sapiens) CpG-island No: 27895
aatgggtttgataattttaggttttttttgcggttagcgaagggaggttttagggcgtatttcggtagggcgggggatttcggtgaagggcgtttggaggcgcgttgtattgttagggtgatgaggttaggtgattcgttaggttcggggcgcgggcgcgggggtcggtcgtggcgattgttcgcgtcgtttcgagggggttttgtcgcgggcgtcggtagttagttaggagggacgggttcgttcgcgcgttattcggagtttagtttcgttgcggttatcgttttgtcggatcgcgttttaggtttttttaggtattggggtcggggaaggaggaaacgcggttacgcgtcgcggttttttttgtttcgggttcggcgcgggttttcgcgtttcgggcgtaggaacgaggtttggggagtatagagatttggagttggggcgcggggattgagttcggggagcgcggagatagagttcggggagcgcggggtacgggagtttagggcgcggggatggggttacgggagaatttaggttagggagcgcggggattcggttgggggcgtacgggtaaggggtttggtgcgcgcgggtacggggtttgcggcgcgtggggggcgggggttcggtaggagttttaggataggggttggggcgcgggttagtttcgtcggagttcggggacgggggcgttgattggttgggtttggggattggttggggcgtaggattattcgagtgggattcgtggcgttcgggcgttttggattgagggtagagatcggagtagttatgtcgtagtcgttgtcggg

SEQ ID NO: 27896 - DNA, 815 bp, Artificial Sequence
  chemically treated genomic DNA (Homo sapiens) CpG-island No: 27896
cccgacaacgactacgacataactactccgatctctaccctcaatccaaaacgcccgaacgccacgaatcccactcgaataatcctacgccccaaccaatccccaaacccaaccaatcaacgcccccgtccccgaactccgacgaaactaacccgcgccccaacccctatcctaaaactcctaccgaacccccgccccccacgcgccgcaaaccccgtacccgcgcgcaccaaaccccttacccgtacgcccccaaccgaatccccgcgctccctaacctaaattctcccgtaaccccatccccgcgccctaaactcccgtaccccgcgctccccgaactctatctccgcgctccccgaactcaatccccgcgccccaactccaaatctctatactccccaaacctcgttcctacgcccgaaacgcgaaaacccgcgccgaacccgaaacaaaaaaaaccgcgacgcgtaaccgcgtttcctccttccccgaccccaatacctaaaaaaacctaaaacgcgatccgacaaaacgataaccgcaacgaaactaaactccgaataacgcgcgaacgaacccgtccctcctaactaactaccgacgcccgcgacaaaaccccctcgaaacgacgcgaacaatcgccacgaccgacccccgcgcccgcgccccgaacctaacgaatcacctaacctcatcaccctaacaatacaacgcgcctccaaacgcccttcaccgaaatcccccgccctaccgaaatacgccctaaaacctcccttcgctaaccgcaaaaaaaacctaaaattatcaaacccatt

SEQ ID NO: 27897 - DNA, 1197 bp, Artificial Sequence
  chemically treated genomic DNA (Homo sapiens) CpG-island No: 27897
ggaatttaattaagtgttattgagagggaaaattttattcgagattcgcggatttcgggatttttcggtgtttacgttttttttttttgtcggtttttttcgcgcgcgtgcgcgatcgggttcgtttcgcggtggttatggtaatcggtcgtttcgtttcggttattcgcgagcgcggcgtttcgcgatttatttcgatttttaattttcggtagttcgcgtttttttaaattttggattttcggcgtttttttcgtatttttattggttcgcgcgggtcgcgttagcgagtttacgtttattttcgtcgtcgggattatagagggggttttcgttcgttaagtttcgtttttttttatttgagtcgttttttattggtttcgtagtattcggtcgtttcgtttcgttcgttttttattggtttagatgcgttcggggaatttagggcgcgcgaaatcgggttcgggcgcgataattgaatcgcggggcgttcgttaggcgcggagtttgatatttttttcggcggttcgttaggtttttttttattcggcgcgttcgattttcgtcgggtttcggggacgtagcgttggtttcggttttagtcggatgtgtgtcggggaacgattttcgagggttaggtggaaggggaggttttggatttcgggatagagtgcgggatatgcgtgcgttcgggttggtcgcgcgggaaagttttgtaaagttttcgagtttcgttgcgcggttcggttggtatttcgattcggttcgttcgtttattttttcggtcgtcgcgaatagtttgtttgtttgcgcgcgtggttcggttggggatggcgatgaaatcgcgtgcgtggttcggatttcgcgcggatttgcgtgcgattcggagcgttcgttcggtaaacgttgttcgtcgcgttgttagttgttttgatttttttttcgcgaaaattcggtatttgggagttgcggggtcgtaggaggcgtgtcgggggcgggcgtttgttttttgattggtcgacgtagtggcgggaagcgagaaagagggtggggggcgttttcgtttttgtttacggcgttttcgtttagtgggttacggtttcgtttagttttgcgcgttttgttgggcgcgtttagcgtgtaaaggggttgcgtggtagggtttggttatttttcgtacgtggatattttaggagt

SEQ ID NO: 27898 - DNA, 1197 bp, Artificial Sequence
  chemically treated genomic DNA (Homo sapiens) CpG-island No: 27898
actcctaaaatatccacgtacgaaaaataaccaaaccctaccacgcaacccctttacacgctaaacgcgcccaacaaaacgcgcaaaactaaacgaaaccgtaacccactaaacgaaaacgccgtaaacaaaaacgaaaacgccccccaccctctttctcgcttcccgccactacgtcgaccaatcaaaaaacaaacgcccgcccccgacacgcctcctacgaccccgcaactcccaaataccgaattttcgcgaaaaaaaaatcaaaacaactaacaacgcgacgaacaacgtttaccgaacgaacgctccgaatcgcacgcaaatccgcgcgaaatccgaaccacgcacgcgatttcatcgccatccccaaccgaaccacgcgcgcaaacaaacaaactattcgcgacgaccgaaaaaataaacgaacgaaccgaatcgaaataccaaccgaaccgcgcaacgaaactcgaaaactttacaaaactttcccgcgcgaccaacccgaacgcacgcatatcccgcactctatcccgaaatccaaaacctccccttccacctaaccctcgaaaatcgttccccgacacacatccgactaaaaccgaaaccaacgctacgtccccgaaacccgacgaaaatcgaacgcgccgaataaaaaaaaacctaacgaaccgccgaaaaaaatatcaaactccgcgcctaacgaacgccccgcgattcaattatcgcgcccgaacccgatttcgcgcgccctaaattccccgaacgcatctaaaccaataaaaaacgaacgaaacgaaacgaccgaatactacgaaaccaataaaaaacgactcaaataaaaaaaaacgaaacttaacgaacgaaaaccccctctataatcccgacgacgaaaataaacgtaaactcgctaacgcgacccgcgcgaaccaataaaaatacgaaaaaaacgccgaaaatccaaaatttaaaaaaacgcgaactaccgaaaattaaaaatcgaaataaatcgcgaaacgccgcgctcgcgaataaccgaaacgaaacgaccgattaccataaccaccgcgaaacgaacccgatcgcgcacgcgcgcgaaaaaaaccgacaaaaaaaaaaaacgtaaacaccgaaaaatcccgaaatccgcgaatctcgaataaaattttccctctcaataacacttaattaaattcc

SEQ ID NO: 27899 - DNA, 1197 bp, Artificial Sequence
  chemically treated genomic DNA (Homo sapiens) CpG-island No: 27899
gtttttggggtgtttacgtgcggggggtgattaggttttgttacgtagtttttttgtacgttgggcgcgtttagtagagcgcgtagggttgggcggagtcgtggtttattaggcggaggcgtcgtggatagaggcgggggcgttttttattttttttttcgtttttcgttattgcgtcggttaattaggaggtaggcgttcgttttcggtacgttttttgcggtttcgtaatttttaaatgtcgagttttcgcgggaaaaaaattagagtagttggtagcgcggcgggtagcgtttgtcgagcgggcgtttcgggtcgtacgtaagttcgcgcggggttcgggttacgtacgcggttttatcgttatttttagtcgggttacgcgcgtaggtagataagttgttcgcggcgatcggagaggtgagcgggcgggtcgggtcggggtgttagtcgggtcgcgtaacggggttcgggaattttgtaaaattttttcgcgcggttagttcgggcgtacgtatgtttcgtattttgtttcgggatttagggtttttttttttatttaattttcgggaatcgtttttcggtatatattcggttggagtcgggattagcgttgcgttttcggagttcggcgggggtcgagcgcgtcgggtgggggagggtttggcgagtcgtcggggaggatgttaggtttcgcgtttggcgggcgtttcgcgatttaattgtcgcgttcgagttcgatttcgcgcgttttgagtttttcgggcgtatttgggttaatggggagcgagcggggcggggcggtcgggtgttgcggagttaataagaggcggtttaagtgaaggggggcgggatttgacgagcgggggttttttttgtagtttcggcggcgggggtgggcgtgggttcgttggcgcgattcgcgcgggttagtgggagtgcgggagggacgtcgagggtttagggtttggaggggcgcgagttgtcgggggttggaggtcgaggtgagtcgcggggcgtcgcgttcgcgggtggtcgggacggggcggtcggttattatggttatcgcggggcgggttcggtcgcgtacgcgcgcggggggggtcggtaaggagggggggcgtgggtatcgaggggtttcggggttcgcggatttcgggtggggtttttttttttagtggtatttggttgagtttt

SEQ ID NO: 27900 - DNA, 1197 bp, Artificial Sequence
  chemically treated genomic DNA (Homo sapiens) CpG-island No: 27900
aaaactcaaccaaataccactaaaaaaaaaaaccccacccgaaatccgcgaaccccgaaacccctcgatacccacgccccccctccttaccgaccccccccgcgcgcgtacgcgaccgaacccgccccgcgataaccataataaccgaccgccccgtcccgaccacccgcgaacgcgacgccccgcgactcacctcgacctccaacccccgacaactcgcgcccctccaaaccctaaaccctcgacgtccctcccgcactcccactaacccgcgcgaatcgcgccaacgaacccacgcccacccccgccgccgaaactacaaaaaaaacccccgctcgtcaaatcccgccccccttcacttaaaccgcctcttattaactccgcaacacccgaccgccccgccccgctcgctccccattaacccaaatacgcccgaaaaactcaaaacgcgcgaaatcgaactcgaacgcgacaattaaatcgcgaaacgcccgccaaacgcgaaacctaacatcctccccgacgactcgccaaaccctcccccacccgacgcgctcgacccccgccgaactccgaaaacgcaacgctaatcccgactccaaccgaatatataccgaaaaacgattcccgaaaattaaataaaaaaaaaaaccctaaatcccgaaacaaaatacgaaacatacgtacgcccgaactaaccgcgcgaaaaaattttacaaaattcccgaaccccgttacgcgacccgactaacaccccgacccgacccgcccgctcacctctccgatcgccgcgaacaacttatctacctacgcgcgtaacccgactaaaaataacgataaaaccgcgtacgtaacccgaaccccgcgcgaacttacgtacgacccgaaacgcccgctcgacaaacgctacccgccgcgctaccaactactctaatttttttcccgcgaaaactcgacatttaaaaattacgaaaccgcaaaaaacgtaccgaaaacgaacgcctacctcctaattaaccgacgcaataacgaaaaacgaaaaaaaaaataaaaaacgcccccgcctctatccacgacgcctccgcctaataaaccacgactccgcccaaccctacgcgctctactaaacgcgcccaacgtacaaaaaaactacgtaacaaaacctaatcaccccccgcacgtaaacaccccaaaaac

SEQ ID NO: 27901 - DNA, 529 bp, Artificial Sequence
  chemically treated genomic DNA (Homo sapiens) CpG-island No: 27901
aggcggcgtgcgcggttcggttcgggagtagcggcgcgttttttttcgttttcggttcgtatttttaggtttcgttcgggcgtgtttcgttcggttgttggcgacgatttttcgtaagcgttcgcgtgggggtttataaggtcgcgcgttatttcgtttcgattgttattggttgtcggatttacgttcgagcgtttattggtcggagttgatagttcggtttttttttttcgtcgggtttattaataacgttacgttcgtttatcgcgcgtcgagttgggcgggataaacgtcggtttcgtttttttattggtagatcggcggggatacgtcggcgtttatttacgtgttcgttgatcggttttgtttttattggagggggcgtacgtagttaaggttgtcgcgattaattcgacggtagttgggttttggattgataagggagttttagggttcgttcgacgatcgtatagagaggagttagtattggtttgaggggttagttcgaggcgcggataggttggggtag

SEQ ID NO: 27902 - DNA, 529 bp, Artificial Sequence
  chemically treated genomic DNA (Homo sapiens) CpG-island No: 27902
ctaccccaacctatccgcgcctcgaactaacccctcaaaccaatactaactcctctctatacgatcgtcgaacgaaccctaaaactcccttatcaatccaaaacccaactaccgtcgaattaatcgcgacaaccttaactacgtacgccccctccaataaaaacaaaaccgatcaacgaacacgtaaataaacgccgacgtatccccgccgatctaccaataaaaaaacgaaaccgacgtttatcccgcccaactcgacgcgcgataaacgaacgtaacgttattaataaacccgacgaaaaaaaaaaaccgaactatcaactccgaccaataaacgctcgaacgtaaatccgacaaccaataacaatcgaaacgaaataacgcgcgaccttataaacccccacgcgaacgcttacgaaaaatcgtcgccaacaaccgaacgaaacacgcccgaacgaaacctaaaaatacgaaccgaaaacgaaaaaaaacgcgccgctactcccgaaccgaaccgcgcacgccgcct

SEQ ID NO: 27903 - DNA, 529 bp, Artificial Sequence
  chemically treated genomic DNA (Homo sapiens) CpG-island No: 27903
ttgttttagtttgttcgcgtttcgggttggttttttaagttaatattggtttttttttgtgcggtcgtcgggcgggttttgaggtttttttgttaatttaaggtttagttgtcgtcgggttggtcgcggtagttttggttgcgtgcgttttttttaatgagaatagagtcggttagcgggtacgtgggtgggcgtcggcgtgttttcgtcggtttgttaatgaagaggcgaggtcggcgtttgtttcgtttaattcggcgcgcggtgggcgggcgtagcgttgttgatgggttcggcggaggggaggggtcgagttattagtttcggttaatgggcgttcgggcgtggattcggtagttaatggtagtcggggcggagtggcgcgcggttttataagtttttacgcgagcgtttgcggagggtcgtcgttagtaatcgagcggggtacgttcgagcggggtttgggggtgcgagtcgagggcgggggagagcgcgtcgttgttttcggatcgggtcgcgtacgtcgttt

SEQ ID NO: 27904 - DNA, 529 bp, Artificial Sequence
  chemically treated genomic DNA (Homo sapiens) CpG-island No: 27904
aaacgacgtacgcgacccgatccgaaaacaacgacgcgctctcccccgccctcgactcgcacccccaaaccccgctcgaacgtaccccgctcgattactaacgacgaccctccgcaaacgctcgcgtaaaaacttataaaaccgcgcgccactccgccccgactaccattaactaccgaatccacgcccgaacgcccattaaccgaaactaataactcgacccctcccctccgccgaacccatcaacaacgctacgcccgcccaccgcgcgccgaattaaacgaaacaaacgccgacctcgcctcttcattaacaaaccgacgaaaacacgccgacgcccacccacgtacccgctaaccgactctattctcattaaaaaaaacgcacgcaaccaaaactaccgcgaccaacccgacgacaactaaaccttaaattaacaaaaaaacctcaaaacccgcccgacgaccgcacaaaaaaaaaccaatattaacttaaaaaaccaacccgaaacgcgaacaaactaaaacaa

SEQ ID NO: 27905 - DNA, 595 bp, Artificial Sequence
  chemically treated genomic DNA (Homo sapiens) CpG-island No: 27905
acgcgggataaggtggatattttatttcgataaatattacgcgggataaggtggatatttttatttcgataaatatcgcgtgggataaggtggatattttatttcgataaatattacgcgggataaggtggatattttatttcgataaatattacgcgggataaggtggatatttttatttcgataaatatcgcgtgggataaggtggatattttatttcgataaatatcgcgtgggataaggtggatattttatttcgataaatatcgcgtgggataaggtggatattttatttcgataaatattacgcgggataaggtggatatttttatttcgataaatattacgcgggataaggtggatatttttatttcgataaatatcgcgtgggataaggtggatattttatttcgataaatattacgcgggataaggtggatatttttatttcgataattattacgcgggatatagtggatatttttatttcgataaatattacgcgggataaggtggatatttttatttcgataaatatagtacgggataaggtggatattttatttcgataaatatagagtgggataaggtggat

SEQ ID NO: 27906 - DNA, 595 bp, Artificial Sequence
  chemically treated genomic DNA (Homo sapiens) CpG-island No: 27906
atccaccttatcccactctatatttatcgaaataaaatatccaccttatcccgtactatatttatcgaaataaaaatatccaccttatcccgcgtaatatttatcgaaataaaaatatccactatatcccgcgtaataattatcgaaataaaaatatccaccttatcccgcgtaatatttatcgaaataaaatatccaccttatcccacgcgatatttatcgaaataaaaatatccaccttatcccgcgtaatatttatcgaaataaaaatatccaccttatcccgcgtaatatttatcgaaataaaatatccaccttatcccacgcgatatttatcgaaataaaatatccaccttatcccacgcgatatttatcgaaataaaatatccaccttatcccacgcgatatttatcgaaataaaaatatccaccttatcccgcgtaatatttatcgaaataaaatatccaccttatcccgcgtaatatttatcgaaataaaatatccaccttatcccacgcgatatttatcgaaataaaaatatccaccttatcccgcgtaatatttatcgaaataaaatatccaccttatcccgcgt

SEQ ID NO: 27907 - DNA, 595 bp, Artificial Sequence
  chemically treated genomic DNA (Homo sapiens) CpG-island No: 27907
gtttattttattttattttgtgtttatcggagtggggtgtttattttatttcgtgttgtgtttatcggagtgggggtgtttattttatttcgcgtggtgtttatcggagtgggggtgtttattgtatttcgcgtggtggttatcggagtgggggtgtttattttatttcgcgtggtgtttatcggagtggggtgtttattttattttacgcggtgtttatcggagtgggggtgtttattttatttcgcgtggtgtttatcggagtgggggtgtttattttatttcgcgtggtgtttatcggagtggggtgtttattttattttacgcggtgtttatcggagtggggtgtttattttattttacgcggtgtttatcggagtggggtgtttattttattttacgcggtgtttatcggagtggggatgtttattttatttcgcgtggtgtttatcggagtggggtgtttattttatttcgcgtggtgtttatcggagtggggtgtttattttattttacgcggtgtttatcggagtgggggtgtttattttatttcgcgtggtgtttatcggagtggggtgtttattttatttcgcgt

SEQ ID NO: 27908 - DNA, 595 bp, Artificial Sequence
  chemically treated genomic DNA (Homo sapiens) CpG-island No: 27908
acgcgaaataaaataaacaccccactccgataaacaccacgcgaaataaaataaacacccccactccgataaacaccgcgtaaaataaaataaacaccccactccgataaacaccacgcgaaataaaataaacaccccactccgataaacaccacgcgaaataaaataaacatccccactccgataaacaccgcgtaaaataaaataaacaccccactccgataaacaccgcgtaaaataaaataaacaccccactccgataaacaccgcgtaaaataaaataaacaccccactccgataaacaccacgcgaaataaaataaacacccccactccgataaacaccacgcgaaataaaataaacacccccactccgataaacaccgcgtaaaataaaataaacaccccactccgataaacaccacgcgaaataaaataaacacccccactccgataaccaccacgcgaaatacaataaacacccccactccgataaacaccacgcgaaataaaataaacacccccactccgataaacacaacacgaaataaaataaacaccccactccgataaacacaaaataaaataaaataaac

SEQ ID NO: 27909 - DNA, 898 bp, Artificial Sequence
  chemically treated genomic DNA (Homo sapiens) CpG-island No: 27909
ggtatcgttaggttcgggtagcggtggtttttcgtcgaggtttttcgttttcgtatattttttgttttcgttgttttttcggtcgttttttttggttttatttttcgttcggcgttcgtcgttataattttcgtttgggttggcgcgagattcgcgagcgtcggagtgggcgcgcgggatgcgcgcgggtcggcgttcggagttttgggtatgtttagtcgcgcgggtagggtttcgggcgcgagttgggttttttttgtattatatttagcggttgttaagaggagtcgacgggcgttcgtaggtttagcgcgcgttgttcgcggtaggattcggtcgttttcgtcgtcgtcgtcgtttttaagtttttcgaagttatggtcgggttcggttatttcgtcgttttcggtcgggttatttacgtcgtggtgcgggcgttattcgagtcgttcggttagtacgcgttgagaagcgttaagggcgaggaggtggacgtcgttcgcgcggaacggtagtattagttttacgtgggcgtgttgggtagtaagttggggttgtaggtggtggagttgtcggtcgacgagagtttttcggattgcgttttcgtggaggacgtggtcgtggtgtgcgaggagacggtttttattattcgattcggggcgtcgagtcggaggaaggaggtaattgtcgattcgaggggcgcggtcggggcgcgcgttaggttttttttcgtcgtcggtcgtcgtgttgtttggggagtcgcgttattggttttcgggttagtagtttataatttttcgtcggggggcgagtgtgtgtgtgtgtgtgtgtgttagagagttagagagaagtttattgtttatatttttcggttgtcggtagttttttggaggattcg

SEQ ID NO: 27910 - DNA, 898 bp, Artificial Sequence
  chemically treated genomic DNA (Homo sapiens) CpG-island No: 27910
cgaatcctccaaaaaactaccgacaaccgaaaaatataaacaataaacttctctctaactctctaacacacacacacacacacacactcgccccccgacgaaaaattataaactactaacccgaaaaccaataacgcgactccccaaacaacacgacgaccgacgacgaaaaaaaacctaacgcgcgccccgaccgcgcccctcgaatcgacaattacctccttcctccgactcgacgccccgaatcgaataataaaaaccgtctcctcgcacaccacgaccacgtcctccacgaaaacgcaatccgaaaaactctcgtcgaccgacaactccaccacctacaaccccaacttactacccaacacgcccacgtaaaactaatactaccgttccgcgcgaacgacgtccacctcctcgcccttaacgcttctcaacgcgtactaaccgaacgactcgaataacgcccgcaccacgacgtaaataacccgaccgaaaacgacgaaataaccgaacccgaccataacttcgaaaaacttaaaaacgacgacgacgacgaaaacgaccgaatcctaccgcgaacaacgcgcgctaaacctacgaacgcccgtcgactcctcttaacaaccgctaaatataatacaaaaaaaacccaactcgcgcccgaaaccctacccgcgcgactaaacatacccaaaactccgaacgccgacccgcgcgcatcccgcgcgcccactccgacgctcgcgaatctcgcgccaacccaaacgaaaattataacgacgaacgccgaacgaaaaataaaaccaaaaaaaacgaccgaaaaaacaacgaaaacaaaaaatatacgaaaacgaaaaacctcgacgaaaaaccaccgctacccgaacctaacgatacc

SEQ ID NO: 27911 - DNA, 898 bp, Artificial Sequence
  chemically treated genomic DNA (Homo sapiens) CpG-island No: 27911
cggattttttagaaggttgtcggtagtcgggaggtgtgaataatgaatttttttttgattttttgatatatatatatatatatatattcgtttttcgacgggaagttgtgaattattagttcgagggttaatggcgcgattttttaggtaatacggcggtcggcggcgggggagggtttggcgcgcgtttcggtcgcgtttttcgagtcggtagttatttttttttttcggttcggcgtttcgggtcgggtgatgagggtcgttttttcgtatattacggttacgttttttacgaagacgtagttcggaaggttttcgtcggtcggtagttttattatttgtagttttagtttgttgtttagtacgtttacgtagagttggtgttgtcgtttcgcgcgggcgacgtttattttttcgtttttggcgttttttagcgcgtgttggtcgagcgattcgggtagcgttcgtattacggcgtgggtggttcggtcgaaggcggcggggtggtcgagttcggttatggtttcgggaggtttaggggcggcggcggcggcggaggcggtcgggttttgtcgcgggtagcgcgcgttgagtttgcgagcgttcgtcggttttttttggtagtcgttgaatgtggtgtagaaggagtttagttcgcgttcggagttttgttcgcgcgattgagtatgtttagagtttcgggcgtcggttcgcgcgtatttcgcgcgtttatttcggcgttcgcgggtttcgcgttagtttaggcgggagttgtagcggcgagcgtcgggcgaggagtggggttaggagaggcggtcggggaagtagcgagggtaagaagtatgcggaggcgggggatttcggcgaaaagttatcgttattcggatttggcggtatt

SEQ ID NO: 27912 - DNA, 898 bp, Artificial Sequence
  chemically treated genomic DNA (Homo sapiens) CpG-island No: 27912
aataccgccaaatccgaataacgataacttttcgccgaaatcccccgcctccgcatacttcttaccctcgctacttccccgaccgcctctcctaaccccactcctcgcccgacgctcgccgctacaactcccgcctaaactaacgcgaaacccgcgaacgccgaaataaacgcgcgaaatacgcgcgaaccgacgcccgaaactctaaacatactcaatcgcgcgaacaaaactccgaacgcgaactaaactccttctacaccacattcaacgactaccaaaaaaaaccgacgaacgctcgcaaactcaacgcgcgctacccgcgacaaaacccgaccgcctccgccgccgccgccgcccctaaacctcccgaaaccataaccgaactcgaccaccccgccgccttcgaccgaaccacccacgccgtaatacgaacgctacccgaatcgctcgaccaacacgcgctaaaaaacgccaaaaacgaaaaaataaacgtcgcccgcgcgaaacgacaacaccaactctacgtaaacgtactaaacaacaaactaaaactacaaataataaaactaccgaccgacgaaaaccttccgaactacgtcttcgtaaaaaacgtaaccgtaatatacgaaaaaacgaccctcatcacccgacccgaaacgccgaaccgaaaaaaaaaaataactaccgactcgaaaaacgcgaccgaaacgcgcgccaaaccctcccccgccgccgaccgccgtattacctaaaaaatcgcgccattaaccctcgaactaataattcacaacttcccgtcgaaaaacgaatatatatatatatatatatatcaaaaaatcaaaaaaaaattcattattcacacctcccgactaccgacaaccttctaaaaaatccg

SEQ ID NO: 27913 - DNA, 750 bp, Artificial Sequence
  chemically treated genomic DNA (Homo sapiens) CpG-island No: 27913
ggtttcgggatttttgcggagggagcggagagggttcgtatcgcgagagggtgcgggacgcgaggtattcggacgcgtttgttcggttgttatcgtcgttttttgtcggttatttcgttcgcgcgtttatagttatcgcggttgttaagaatcgaggttttcggcggcgcgcggcgtaggacgtttttagtttcggtttatatttggtgaaagttttttaagatttcgttatttagtttcggggggcggtggcggtggcggtggcggcggcggcggttgttttgcgattcggtttggtaggtttgcggtcgtcgcgtttttgaaaagtgcgtcgcggcggttcgcgtttaggttttttttcgcgcgggatttcggagcgttgcgggcggcggggtagattcgggtagtttggttttagtttttatttttttgagggtcgaagttcgttttgcgttgcgtgggaggttggcgcggagggcgtcgcggtttagttgtgttatttttttcgttcgtttttttgttgattagtttttttagcggggtagcgagttgtcgtgttgtgttagacgtagagggtgcgttcggcgtaagggtgtggggttgtgtgtgtatgtgtgtgtgtgggcggggggatgttcggaggatggcgtttgcgtggatattaagcgtattcgagagcgggacgtgtagttagttttggggaaaagtttcgaagggtttggattttattatttttagaagggatatatg

SEQ ID NO: 27914 - DNA, 750 bp, Artificial Sequence
  chemically treated genomic DNA (Homo sapiens) CpG-island No: 27914
catatatcccttctaaaaataataaaatccaaacccttcgaaacttttccccaaaactaactacacgtcccgctctcgaatacgcttaatatccacgcaaacgccatcctccgaacatccccccgcccacacacacacatacacacacaaccccacacccttacgccgaacgcaccctctacgtctaacacaacacgacaactcgctaccccgctaaaaaaactaatcaacaaaaaaacgaacgaaaaaaataacacaactaaaccgcgacgccctccgcgccaacctcccacgcaacgcaaaacgaacttcgaccctcaaaaaaataaaaactaaaaccaaactacccgaatctaccccgccgcccgcaacgctccgaaatcccgcgcgaaaaaaaacctaaacgcgaaccgccgcgacgcacttttcaaaaacgcgacgaccgcaaacctaccaaaccgaatcgcaaaacaaccgccgccgccgccaccgccaccgccaccgccccccgaaactaaataacgaaatcttaaaaaactttcaccaaatataaaccgaaactaaaaacgtcctacgccgcgcgccgccgaaaacctcgattcttaacaaccgcgataactataaacgcgcgaacgaaataaccgacaaaaaacgacgataacaaccgaacaaacgcgtccgaatacctcgcgtcccgcaccctctcgcgatacgaaccctctccgctccctccgcaaaaatcccgaaacc

SEQ ID NO: 27915 - DNA, 750 bp, Artificial Sequence
  chemically treated genomic DNA (Homo sapiens) CpG-island No: 27915
tatgtgttttttttggggataatggaatttaggtttttcggggtttttttttagagttggttatacgtttcgttttcgggtgcgtttggtgtttacgtaaacgttatttttcgaatattttttcgtttatatatatatatatatatatagttttatatttttgcgtcggacgtattttttacgtttggtatagtacggtaattcgttgtttcgttgggaggattagttaataggggggcggacgggaaaagtgatataattgggtcgcggcgtttttcgcgttagttttttacgtagcgtagggcggatttcggtttttagaggggtgaggattggggttaaattgttcgggtttatttcgtcgttcgtaacgtttcggggtttcgcgcggagggaggtttgggcgcgggtcgtcgcggcgtattttttaggaacgcggcggtcgtaagtttgttaggtcgggtcgtaggatagtcgtcgtcgtcgttatcgttatcgttatcgtttttcgaagttagatgacggagttttgaaagatttttattaaatatgggtcggggttggaaacgttttgcgtcgcgcgtcgtcggaaatttcgatttttggtaatcgcggtgattgtgggcgcgcgggcggggtggtcggtagggggcggcggtagtagtcgggtaggcgcgttcggatgtttcgcgtttcgtattttttcgcggtgcggatttttttcgtttttttcgtaggggtttcggagtt

SEQ ID NO: 27916 - DNA, 750 bp, Artificial Sequence
  chemically treated genomic DNA (Homo sapiens) CpG-island No: 27916
aactccgaaacccctacgaaaaaaacgaaaaaaatccgcaccgcgaaaaaatacgaaacgcgaaacatccgaacgcgcctacccgactactaccgccgccccctaccgaccaccccgcccgcgcgcccacaatcaccgcgattaccaaaaatcgaaatttccgacgacgcgcgacgcaaaacgtttccaaccccgacccatatttaataaaaatctttcaaaactccgtcatctaacttcgaaaaacgataacgataacgataacgacgacgacgactatcctacgacccgacctaacaaacttacgaccgccgcgttcctaaaaaatacgccgcgacgacccgcgcccaaacctccctccgcgcgaaaccccgaaacgttacgaacgacgaaataaacccgaacaatttaaccccaatcctcacccctctaaaaaccgaaatccgccctacgctacgtaaaaaactaacgcgaaaaacgccgcgacccaattatatcacttttcccgtccgcccccctattaactaatcctcccaacgaaacaacgaattaccgtactataccaaacgtaaaaaatacgtccgacgcaaaaatataaaactatatatatatatatatatataaacgaaaaaatattcgaaaaataacgtttacgtaaacaccaaacgcacccgaaaacgaaacgtataaccaactctaaaaaaaaaccccgaaaaacctaaattccattatccccaaaaaaaacacata

SEQ ID NO: 27917 - DNA, 969 bp, Artificial Sequence
  chemically treated genomic DNA (Homo sapiens) CpG-island No: 27917
tcgagcgttaagttgaggagtcgtttttaggggttggcgttagtttgtagcggcgtcgacgtggtcggcgcgattcgttacgtacgtgttcggttttaggtcgggggcgggggcgcgcgggggttttcggttttttttcgatttttggggttcgggcgttagttggtttcgagtttttagttcgcgggtgcgaagaacggagtagatgggtcgggaataagggagttgggttaaggcgaggagggggcggtcgggcgcgcgcgttttggtttcgtgtacgcgttgaaatcggagcgcgtagggcgcgttagggtgagggggacgggggcggggtgggggtagtttttttttaggcggtagcgggggcggcgtcgttgttgtttttttaagtcgcggggtcgtcgttttttgtcgttggagtcggttataaaggaagcgttatttaggtcgttatacgtcgaggttttcgcgtttttcgttattttttagtagcgttcgacgaggcggagtcgcgagagcgcggtttaggtcggtttcgcggggcggtcgcggtcgtgacggcggtttcgggttcggtttttttttcgcgttcggtttttttttcgcgtttttttcgtcggagatgaggggaagatgttcgtgttagggtttaaggtcgagttgaagtttttggcgtttattttcgataagaattacgagcgatttcgtatcgttagttggaagttggacgagttgtattgttagtttttggtgtcgtagtagggtagttcgtattcgttgtcgtcgttatttacgttttattgtaatattacggtgaggcgttcggtcgcggtttcgcggggtagggcgaggacggagagggggcgtttcgagtttcgggataaaggggagtttgtttcggagaggtttcggtttttcgggcggggtaggttcgtttttttttttcgcgatttgtttattttaggtcgg

SEQ ID NO: 27918 - DNA, 969 bp, Artificial Sequence
  chemically treated genomic DNA (Homo sapiens) CpG-island No: 27918
ccgacctaaaataaacaaatcgcgaaaaaaaaaaacgaacctaccccgcccgaaaaaccgaaacctctccgaaacaaactcccctttatcccgaaactcgaaacgccccctctccgtcctcgccctaccccgcgaaaccgcgaccgaacgcctcaccgtaatattacaataaaacgtaaataacgacgacaacgaatacgaactaccctactacgacaccaaaaactaacaatacaactcgtccaacttccaactaacgatacgaaatcgctcgtaattcttatcgaaaataaacgccaaaaacttcaactcgaccttaaaccctaacacgaacatcttcccctcatctccgacgaaaaaaacgcgaaaaaaaaaccgaacgcgaaaaaaaaaccgaacccgaaaccgccgtcacgaccgcgaccgccccgcgaaaccgacctaaaccgcgctctcgcgactccgcctcgtcgaacgctactaaaaaataacgaaaaacgcgaaaacctcgacgtataacgacctaaataacgcttcctttataaccgactccaacgacaaaaaacgacgaccccgcgacttaaaaaaacaacaacgacgccgcccccgctaccgcctaaaaaaaaactacccccaccccgcccccgtccccctcaccctaacgcgccctacgcgctccgatttcaacgcgtacacgaaaccaaaacgcgcgcgcccgaccgccccctcctcgccttaacccaactcccttattcccgacccatctactccgttcttcgcacccgcgaactaaaaactcgaaaccaactaacgcccgaaccccaaaaatcgaaaaaaaaccgaaaacccccgcgcgcccccgcccccgacctaaaaccgaacacgtacgtaacgaatcgcgccgaccacgtcgacgccgctacaaactaacgccaacccctaaaaacgactcctcaacttaacgctcga

SEQ ID NO: 27919 - DNA, 969 bp, Artificial Sequence
  chemically treated genomic DNA (Homo sapiens) CpG-island No: 27919
tcggtttgggatgggtaagtcgcgggggaaaggggcgggtttgtttcgttcggggagtcggagttttttcggggtaggtttttttttgtttcgggattcgaagcgtttttttttcgttttcgttttgtttcgcggggtcgcggtcgggcgttttatcgtgatgttgtagtggagcgtgagtggcggcggtagcgagtgcgggttgttttgttgcggtattaggaattggtagtgtagttcgtttagtttttaattgacgatgcggaatcgttcgtggtttttgtcgaagatggacgttaggaattttagttcggttttgagttttgatacggatattttttttttattttcggcgggaggggcgcggaaggggagtcgggcgcggaaggggagtcgggttcggagtcgtcgttacggtcgcgatcgtttcgcggggtcggtttgggtcgcgttttcgcggtttcgtttcgtcgagcgttgttggaaaatggcgaggggcgcggaagtttcggcgtgtggcggtttgggtggcgttttttttgtaatcgattttagcggtaggaggcggcggtttcgcggtttaaaagggtaatagcgacgtcgttttcgttatcgtttgggaaagggttgtttttatttcgttttcgttttttttattttggcgcgttttgcgcgtttcggttttagcgcgtgtacgaggttagagcgcgcgcgttcggtcgtttttttttcgttttgatttagtttttttgttttcgatttatttgtttcgtttttcgtattcgcggattggaggttcggggttagttggcgttcgggttttagaagtcggggaggagtcggagattttcgcgcgttttcgttttcggtttggagtcggatacgtgcgtggcggatcgcgtcggttacgtcggcgtcgttgtagattagcgttagtttttgggggcggttttttagtttggcgttcgg

SEQ ID NO: 27920 - DNA, 969 bp, Artificial Sequence
  chemically treated genomic DNA (Homo sapiens) CpG-island No: 27920
ccgaacgccaaactaaaaaaccgcccccaaaaactaacgctaatctacaacgacgccgacgtaaccgacgcgatccgccacgcacgtatccgactccaaaccgaaaacgaaaacgcgcgaaaatctccgactcctccccgacttctaaaacccgaacgccaactaaccccgaacctccaatccgcgaatacgaaaaacgaaacaaataaatcgaaaacaaaaaaactaaatcaaaacgaaaaaaaaacgaccgaacgcgcgcgctctaacctcgtacacgcgctaaaaccgaaacgcgcaaaacgcgccaaaataaaaaaaacgaaaacgaaataaaaacaaccctttcccaaacgataacgaaaacgacgtcgctattacccttttaaaccgcgaaaccgccgcctcctaccgctaaaatcgattacaaaaaaaacgccacccaaaccgccacacgccgaaacttccgcgcccctcgccattttccaacaacgctcgacgaaacgaaaccgcgaaaacgcgacccaaaccgaccccgcgaaacgatcgcgaccgtaacgacgactccgaacccgactccccttccgcgcccgactccccttccgcgcccctcccgccgaaaataaaaaaaaaatatccgtatcaaaactcaaaaccgaactaaaattcctaacgtccatcttcgacaaaaaccacgaacgattccgcatcgtcaattaaaaactaaacgaactacactaccaattcctaataccgcaacaaaacaacccgcactcgctaccgccgccactcacgctccactacaacatcacgataaaacgcccgaccgcgaccccgcgaaacaaaacgaaaacgaaaaaaaaacgcttcgaatcccgaaacaaaaaaaaacctaccccgaaaaaactccgactccccgaacgaaacaaacccgcccctttcccccgcgacttacccatcccaaaccga

SEQ ID NO: 27921 - DNA, 731 bp, Artificial Sequence
  chemically treated genomic DNA (Homo sapiens) CpG-island No: 27921
cgtcgcggggtattcgtttggttttttgttttttttttcgtcgcgggttaaggcggtgtaggtttgggcgattcgggcgagacgcggggtttcggggggtttcgggcggtttcgaggcgggttgtaggggttggcgattcgcgcgcggggcgacgatgatagttggcggggaaggagcgaggttgaggggttaggacgaggttgggcgcgagggtcgagggcgtttttcgggaattttcgggggagacgagagggtaaaagggcgtaggggcggggcgggcgtagagcggaaggggtagcggggtcggtacgaggggttcgacggcgttagggacggggttggttaggggggaagggaggggagaagagggagtcgggcgttttagcgcgggagcggttttagggttttcgggttttttttcgcgtttcgtcgttgattataggggcggggtcgtcggatttttacggcggtcgagggaagggcgcgtaggtatttgtcgttttcgtttcggcgtttaggagggttcggtttttatttcgtcggtttatgggtcgtattcgatcgttatttttattttggagtttttattttgtagtcgtcgaagaattcgttcggttttcgtttgtcgcggttatcgcgaattttttcgggttgatcggcggaaggggtcgtcgcgtacgagggtgggtacgggttggtgtcggtcgtttttatttcgggcgttttcgtt

SEQ ID NO: 27922 - DNA, 731 bp, Artificial Sequence
  chemically treated genomic DNA (Homo sapiens) CpG-island No: 27922
aacgaaaacgcccgaaataaaaacgaccgacaccaacccgtacccaccctcgtacgcgacgaccccttccgccgatcaacccgaaaaaattcgcgataaccgcgacaaacgaaaaccgaacgaattcttcgacgactacaaaataaaaactccaaaataaaaataacgatcgaatacgacccataaaccgacgaaataaaaaccgaaccctcctaaacgccgaaacgaaaacgacaaatacctacgcgcccttccctcgaccgccgtaaaaatccgacgaccccgcccctataatcaacgacgaaacgcgaaaaaaaacccgaaaaccctaaaaccgctcccgcgctaaaacgcccgactccctcttctcccctcccttcccccctaaccaaccccgtccctaacgccgtcgaacccctcgtaccgaccccgctaccccttccgctctacgcccgccccgcccctacgcccttttaccctctcgtctcccccgaaaattcccgaaaaacgccctcgaccctcgcgcccaacctcgtcctaacccctcaacctcgctccttccccgccaactatcatcgtcgccccgcgcgcgaatcgccaacccctacaacccgcctcgaaaccgcccgaaaccccccgaaaccccgcgtctcgcccgaatcgcccaaacctacaccgccttaacccgcgacgaaaaaaaaaacaaaaaaccaaacgaataccccgcgacg

SEQ ID NO: 27923 - DNA, 731 bp, Artificial Sequence
  chemically treated genomic DNA (Homo sapiens) CpG-island No: 27923
agcgggagcgttcggagtagggacgatcgatattagttcgtatttattttcgtgcgcgacggtttttttcgtcggttaattcggaagagttcgcggtggtcgcggtagacggaagtcgaacgagtttttcggcggttgtaggatggggattttaaagtgaaagtggcggtcggatacgatttatgaatcggcgaggtgagagtcgagtttttttgggcgtcggggcggaggcggtaggtgtttgcgcgtttttttttcggtcgtcgtgggggttcggcggtttcgtttttatagttagcggcggggcgcgaggaggggttcggggattttgaaatcgttttcgcgttgagacgttcggttttttttttttttttttttttttttttggttagtttcgtttttggcgtcgtcgggtttttcgtgtcggtttcgttgtttttttcgttttgcgttcgtttcgtttttgcgtttttttgttttttcgtttttttcggaggttttcggagggcgttttcggttttcgcgtttagtttcgttttggttttttagtttcgtttttttttcgttagttgttatcgtcgtttcgcgcgcgggtcgttagtttttgtagttcgtttcgggatcgttcgggatttttcgggatttcgcgtttcgttcgggtcgtttaagtttgtatcgttttggttcgcggcgggaagaagggtagggggttaggcgggtgtttcgcggcg

SEQ ID NO: 27924 - DNA, 731 bp, Artificial Sequence
  chemically treated genomic DNA (Homo sapiens) CpG-island No: 27924
cgccgcgaaacacccgcctaaccccctacccttcttcccgccgcgaaccaaaacgatacaaacttaaacgacccgaacgaaacgcgaaatcccgaaaaatcccgaacgatcccgaaacgaactacaaaaactaacgacccgcgcgcgaaacgacgataacaactaacgaaaaaaaaacgaaactaaaaaaccaaaacgaaactaaacgcgaaaaccgaaaacgccctccgaaaacctccgaaaaaaacgaaaaaacaaaaaaacgcaaaaacgaaacgaacgcaaaacgaaaaaaacaacgaaaccgacacgaaaaacccgacgacgccaaaaacgaaactaaccaaaaaaaaaaaaaaaaaaaaaaaaaaaaccgaacgtctcaacgcgaaaacgatttcaaaatccccgaacccctcctcgcgccccgccgctaactataaaaacgaaaccgccgaacccccacgacgaccgaaaaaaaaacgcgcaaacacctaccgcctccgccccgacgcccaaaaaaactcgactctcacctcgccgattcataaatcgtatccgaccgccactttcactttaaaatccccatcctacaaccgccgaaaaactcgttcgacttccgtctaccgcgaccaccgcgaactcttccgaattaaccgacgaaaaaaaccgtcgcgcacgaaaataaatacgaactaatatcgatcgtccctactccgaacgctcccgct

SEQ ID NO: 27925 - DNA, 523 bp, Artificial Sequence
  chemically treated genomic DNA (Homo sapiens) CpG-island No: 27925
gcggaatcggttttttagcgtttgtaaattcgggtagcggagaatgattattttttgtttagttcggattttcgattatttgatggcggcgcgtgtcggattttagcgagttttgcgaaattttcggcggcgagattgttttgttatatttggtagtcggaaattttggaaaaatcgcgtgttgttcgagtttttggagggatttggcgttcgttatatttgtagggtagggtgggttcgcggttttcgggttagggagcgggtagggcgcgtggggttcgggcgttttcgtcgcgttggttttcgtttttcgtcgtcgtatttcgcgtattttttcgcgcgggtagggtttgcgttttcgagttcggtaggtagtttagatttttttatatttattaaagagtcgtttttttttttcgtagcgttttcgtcgtttttttttttttttttttttttcgtttttttttcgatttgtttattcgggaggaagggagttggaaagggggcggaaattttttttttt

SEQ ID NO: 27926 - DNA, 523 bp, Artificial Sequence
  chemically treated genomic DNA (Homo sapiens) CpG-island No: 27926
aaaaaaaaaaatttccgccccctttccaactcccttcctcccgaataaacaaatcgaaaaaaaaacgaaaaaaaaaaaaaaaaaaaaaaacgacgaaaacgctacgaaaaaaaaaaacgactctttaataaatataaaaaaatctaaactacctaccgaactcgaaaacgcaaaccctacccgcgcgaaaaaatacgcgaaatacgacgacgaaaaacgaaaaccaacgcgacgaaaacgcccgaaccccacgcgccctacccgctccctaacccgaaaaccgcgaacccaccctaccctacaaatataacgaacgccaaatccctccaaaaactcgaacaacacgcgatttttccaaaatttccgactaccaaatataacaaaacaatctcgccgccgaaaatttcgcaaaactcgctaaaatccgacacgcgccgccatcaaataatcgaaaatccgaactaaacaaaaaataatcattctccgctacccgaatttacaaacgctaaaaaaccgattccgc

SEQ ID NO: 27927 - DNA, 523 bp, Artificial Sequence
  chemically treated genomic DNA (Homo sapiens) CpG-island No: 27927
gaggggagaggttttcgttttttttttagttttttttttttcgggtggataggtcggaagaggagcggaaaggaaaggaagggagggaggcggcgaaggcgttgcgggggggaggagcggttttttgatgggtgtgggggggtttgaattgtttatcgggttcggaagcgtagattttattcgcgcggaagaatgcgcggaatgcggcggcgggaggcggaggttagcgcggcgggggcgttcggattttacgcgttttgttcgttttttagttcgagggtcgcggatttattttgttttgtaggtgtggcgggcgttaggtttttttagggattcggatagtacgcgatttttttaggattttcgattattaaatgtgataagatagtttcgtcgtcgagagtttcgtagggttcgttaaaattcggtacgcgtcgttattagatagtcgaaaattcgggttgaataaaaggtgattatttttcgttgttcggatttgtaggcgttagaggatcggtttcgt

SEQ ID NO: 27928 - DNA, 523 bp, Artificial Sequence
  chemically treated genomic DNA (Homo sapiens) CpG-island No: 27928
acgaaaccgatcctctaacgcctacaaatccgaacaacgaaaaataatcaccttttattcaacccgaattttcgactatctaataacgacgcgtaccgaattttaacgaaccctacgaaactctcgacgacgaaactatcttatcacatttaataatcgaaaatcctaaaaaaatcgcgtactatccgaatccctaaaaaaacctaacgcccgccacacctacaaaacaaaataaatccgcgaccctcgaactaaaaaacgaacaaaacgcgtaaaatccgaacgcccccgccgcgctaacctccgcctcccgccgccgcattccgcgcattcttccgcgcgaataaaatctacgcttccgaacccgataaacaattcaaacccccccacacccatcaaaaaaccgctcctcccccccgcaacgccttcgccgcctccctcccttcctttcctttccgctcctcttccgacctatccacccgaaaaaaaaaaaactaaaaaaaaaacgaaaacctctcccctc

SEQ ID NO: 27929 - DNA, 536 bp, Artificial Sequence
  chemically treated genomic DNA (Homo sapiens) CpG-island No: 27929
  misc_feature (330)..(332): n is either a, c, g or t
  misc_feature (335)..(335): n is either a, c, g or t
  misc_feature (346)..(346): n is either a, c, g or t
  misc_feature (427)..(427): n is either a, c, g or t
gggagggacggagaggatcgttacgcgggattaaagcgaatcgcggcgcgggcgtcgggcgcgtcgatagtattagacgaggaggggcgttcggcgtcgggcgcgcggggagtcgtcgcggacgggcgagggcgggtatcgcgcgcgcgtcgcgcgcggtcggcgcgatattaatcggggggcgcgggaggaggcggtcgagcgagcgcgggcgtcggttcgcgcggcggcggaggagaggcgcgggcgatcgtcgcggcgggcggcgcgacgcgcgtcgcggcgacggcgggcggcgacgcgatagtatattaatacgattattatatnnnatngggaggggggnggggatcgaaggcgagacgggaggacgagtaacgacgcgtacgatcgtaataggcgcggaggtcgggattacggcgcggangggagcgagcgggagcgatcggcggggcggacgcgaggggcgagacggagcggttcgtaacgcgcgcgacgtcgtagcgcgcgcggtcgtagtagggggggcgcgcggt

SEQ ID NO: 27930 - DNA, 536 bp, Artificial Sequence
  chemically treated genomic DNA (Homo sapiens) CpG-island No: 27930
  misc_feature (110)..(110): n is either a, c, g or t
  misc_feature (191)..(191): n is either a, c, g or t
  misc_feature (202)..(202): n is either a, c, g or t
  misc_feature (205)..(207): n is either a, c, g or t
accgcgcgccccccctactacgaccgcgcgcgctacgacgtcgcgcgcgttacgaaccgctccgtctcgcccctcgcgtccgccccgccgatcgctcccgctcgctcccntccgcgccgtaatcccgacctccgcgcctattacgatcgtacgcgtcgttactcgtcctcccgtctcgccttcgatccccncccccctcccnatnnnatataataatcgtattaatatactatcgcgtcgccgcccgccgtcgccgcgacgcgcgtcgcgccgcccgccgcgacgatcgcccgcgcctctcctccgccgccgcgcgaaccgacgcccgcgctcgctcgaccgcctcctcccgcgccccccgattaatatcgcgccgaccgcgcgcgacgcgcgcgcgatacccgccctcgcccgtccgcgacgactccccgcgcgcccgacgccgaacgcccctcctcgtctaatactatcgacgcgcccgacgcccgcgccgcgattcgctttaatcccgcgtaacgatcctctccgtccctccc

SEQ ID NO: 27931 - DNA, 536 bp, Artificial Sequence
  chemically treated genomic DNA (Homo sapiens) CpG-island No: 27931
  misc_feature (110)..(110): n is either a, c, g or t
  misc_feature (191)..(191): n is either a, c, g or t
  misc_feature (202)..(202): n is either a, c, g or t
  misc_feature (205)..(207): n is either a, c, g or t
gtcgcgcgttttttttgttgcggtcgcgcgcgttgcggcgtcgcgcgcgttgcgggtcgtttcgtttcgtttttcgcgttcgtttcgtcggtcgttttcgttcgtttttnttcgcgtcgtggtttcggttttcgcgtttgttgcggtcgtgcgcgtcgttgttcgttttttcgtttcgttttcggtttttnttttttttttnatnnngtgtggtggtcgtgttggtgtgttgtcgcgtcgtcgttcgtcgtcgtcgcggcgcgcgtcgcgtcgttcgtcgcggcggtcgttcgcgtttttttttcgtcgtcgcgcgggtcggcgttcgcgttcgttcggtcgttttttttcgcgtttttcggttggtgtcgcgtcggtcgcgcgcggcgcgcgcgcggtgttcgttttcgttcgttcgcggcggtttttcgcgcgttcggcgtcgggcgttttttttcgtttggtgttgtcggcgcgttcggcgttcgcgtcgcggttcgttttggtttcgcgtggcggtttttttcgtttttttt

SEQ ID NO: 27932 - DNA, 536 bp, Artificial Sequence
  chemically treated genomic DNA (Homo sapiens) CpG-island No: 27932
  misc_feature (330)..(332): n is either a, c, g or t
  misc_feature (335)..(335): n is either a, c, g or t
  misc_feature (346)..(346): n is either a, c, g or t
  misc_feature (427)..(427): n is either a, c, g or t
aaaaaaaacgaaaaaaaccgccacgcgaaaccaaaacgaaccgcgacgcgaacgccgaacgcgccgacaacaccaaacgaaaaaaaacgcccgacgccgaacgcgcgaaaaaccgccgcgaacgaacgaaaacgaacaccgcgcgcgcgccgcgcgcgaccgacgcgacaccaaccgaaaaacgcgaaaaaaaacgaccgaacgaacgcgaacgccgacccgcgcgacgacgaaaaaaaaacgcgaacgaccgccgcgacgaacgacgcgacgcgcgccgcgacgacgacgaacgacgacgcgacaacacaccaacacgaccaccacacnnnatnaaaaaaaaaanaaaaaccgaaaacgaaacgaaaaaacgaacaacgacgcgcacgaccgcaacaaacgcgaaaaccgaaaccacgacgcgaanaaaaacgaacgaaaacgaccgacgaaacgaacgcgaaaaacgaaacgaaacgacccgcaacgcgcgcgacgccgcaacgcgcgcgaccgcaacaaaaaaaacgcgcgac

SEQ ID NO: 27933 - DNA, 543 bp, Artificial Sequence
  chemically treated genomic DNA (Homo sapiens) CpG-island No: 27933
cggggtcggtcggcgcgtcgggatttcgtattagtcgggcgattggtttttggtggggattgatggcgtagttttttgtatcgtttattttcggcgttgatcgattcgggttacgttgtaaagacgaagagattcggagttacggcgcgtgtagttgttgtgtaaggagttattgttttagttttaaggttatttcgttgcgggtcgtcgtaattttttcgtcgtttcgttttttgtttaatttcggtttcgggcgattcgggtttcgttttttgcgttttcgcgggcgtagttatttttaggaggaagcgcggcggcggcggcggaacgcgcgggtaggttgttttttcggtgggattaaattttgcggcggaaggatatagatttagagttatattttaagaaatttgatgattaatggggacgcggcggggtaacggggttcgttttcggagcgattttttttttagattttcgggcgtcgggttatttgttgtcgttaagttgggttgttagatggggtgtttttttttggttttcggt

SEQ ID NO: 27934 - DNA, 543 bp, Artificial Sequence
  chemically treated genomic DNA (Homo sapiens) CpG-island No: 27934
accgaaaaccaaaaaaaaacaccccatctaacaacccaacttaacgacaacaaataacccgacgcccgaaaatctaaaaaaaaaatcgctccgaaaacgaaccccgttaccccgccgcgtccccattaatcatcaaatttcttaaaatataactctaaatctatatccttccgccgcaaaatttaatcccaccgaaaaaacaacctacccgcgcgttccgccgccgccgccgcgcttcctcctaaaaataactacgcccgcgaaaacgcaaaaaacgaaacccgaatcgcccgaaaccgaaattaaacaaaaaacgaaacgacgaaaaaattacgacgacccgcaacgaaataaccttaaaactaaaacaataactccttacacaacaactacacgcgccgtaactccgaatctcttcgtctttacaacgtaacccgaatcgatcaacgccgaaaataaacgatacaaaaaactacgccatcaatccccaccaaaaaccaatcgcccgactaatacgaaatcccgacgcgccgaccgaccccg

SEQ ID NO: 27935 - DNA, 543 bp, Artificial Sequence
  chemically treated genomic DNA (Homo sapiens) CpG-island No: 27935
gtcgagagttaagaaaagatattttatttggtagtttaatttggcggtaataggtggttcggcgttcgggggtttgggaggaaagtcgtttcgggggcgggtttcgttgtttcgtcgcgtttttattggttattaggttttttaaaatgtgattttgaatttgtgttttttcgtcgtagaatttagttttatcgaaagggtaatttgttcgcgcgtttcgtcgtcgtcgtcgcgtttttttttgaaggtgattgcgttcgcggggacgtagggggcggggttcgggtcgttcggagtcgggattgggtagagggcggggcggcggagggattgcggcggttcgtagcgggataattttgaggttgaggtagtggttttttgtatagtagttgtacgcgtcgtggtttcggattttttcgtttttgtagcgtagttcgagtcggttagcgtcggaggtgagcggtgtaggaggttacgttattagtttttattaagggttagtcgttcggttagtgcggaatttcggcgcgtcggtcggtttcg

SEQ ID NO: 27936 - DNA, 543 bp, Artificial Sequence
  chemically treated genomic DNA (Homo sapiens) CpG-island No: 27936
cgaaaccgaccgacgcgccgaaattccgcactaaccgaacgactaacccttaataaaaactaataacgtaacctcctacaccgctcacctccgacgctaaccgactcgaactacgctacaaaaacgaaaaaatccgaaaccacgacgcgtacaactactatacaaaaaaccactacctcaacctcaaaattatcccgctacgaaccgccgcaatccctccgccgccccgccctctacccaatcccgactccgaacgacccgaaccccgccccctacgtccccgcgaacgcaatcaccttcaaaaaaaaacgcgacgacgacgacgaaacgcgcgaacaaattaccctttcgataaaactaaattctacgacgaaaaaacacaaattcaaaatcacattttaaaaaacctaataaccaataaaaacgcgacgaaacaacgaaacccgcccccgaaacgactttcctcccaaacccccgaacgccgaaccacctattaccgccaaattaaactaccaaataaaatatcttttcttaactctcgac

SEQ ID NO: 27937 - DNA, 521 bp, Artificial Sequence
  chemically treated genomic DNA (Homo sapiens) CpG-island No: 27937
aaagggggcgtgtttgcgtaagcgtacgttgtattttttagtggcgttacgtgcgggggcgggatagggcggggtcgattcgtgttggtagtagggggcgtgggaggtaagtgcgcgcgcgtttgttcgtttgtagtcggggagtcgcgcggggcggggtcgcgtgcgcggggtcgggggcgcgcgatcgaagcggataagggacgcggcggcggttggttgtgtttgttgagagagtataggatagttcggattgcgagaggcggcggcggaggtagtagttgtatcggtagaggcggtcgttggtagcggttgaggcggcggtttaacgcgtgttttttgggcggggtgcggcgggggatgtgtttgtttaggtcgggcggagtttttttgatagggcgggggatgcgtcgcggtcgttcgttcggattttgaggttgttgggtttattttttcggaatcgttcgattttcggtggtttcggttttttttgttattttcggttttattttggggcggag

SEQ ID NO: 27938 - DNA, 521 bp, Artificial Sequence
  chemically treated genomic DNA (Homo sapiens) CpG-island No: 27938
ctccgccccaaaataaaaccgaaaataacaaaaaaaaccgaaaccaccgaaaatcgaacgattccgaaaaaataaacccaacaacctcaaaatccgaacgaacgaccgcgacgcatcccccgccctatcaaaaaaactccgcccgacctaaacaaacacatcccccgccgcaccccgcccaaaaaacacgcgttaaaccgccgcctcaaccgctaccaacgaccgcctctaccgatacaactactacctccgccgccgcctctcgcaatccgaactatcctatactctctcaacaaacacaaccaaccgccgccgcgtcccttatccgcttcgatcgcgcgcccccgaccccgcgcacgcgaccccgccccgcgcgactccccgactacaaacgaacaaacgcgcgcgcacttacctcccacgccccctactaccaacacgaatcgaccccgccctatcccgcccccgcacgtaacgccactaaaaaatacaacgtacgcttacgcaaacacgcccccttt

SEQ ID NO: 27939 - DNA, 521 bp, Artificial Sequence
  chemically treated genomic DNA (Homo sapiens) CpG-island No: 27939
tttcgttttagggtaggatcggagatggtagaagaggtcgaggttatcgagggtcggacggtttcgggagggtgggtttagtagttttagggttcgggcgagcggtcgcggcgtatttttcgttttgttagagagatttcgttcggtttgagtaggtatatttttcgtcgtatttcgtttagagagtacgcgttggatcgtcgttttaatcgttgttagcggtcgtttttgtcggtgtaattattgttttcgtcgtcgtttttcgtagttcgggttgttttgtatttttttaatagatatagttaatcgtcgtcgcgttttttattcgtttcggtcgcgcgttttcgatttcgcgtacgcggtttcgtttcgcgcgatttttcggttgtaggcgagtaggcgcgcgcgtatttattttttacgttttttattgttagtacgggtcggtttcgttttgtttcgttttcgtacgtgacgttattggagagtatagcgtgcgtttgcgtagatacgtttttttt

SEQ ID NO: 27940 - DNA, 521 bp, Artificial Sequence
  chemically treated genomic DNA (Homo sapiens) CpG-island No: 27940
aaaaaaaacgtatctacgcaaacgcacgctatactctccaataacgtcacgtacgaaaacgaaacaaaacgaaaccgacccgtactaacaataaaaaacgtaaaaaataaatacgcgcgcgcctactcgcctacaaccgaaaaatcgcgcgaaacgaaaccgcgtacgcgaaatcgaaaacgcgcgaccgaaacgaataaaaaacgcgacgacgattaactatatctattaaaaaaatacaaaacaacccgaactacgaaaaacgacgacgaaaacaataattacaccgacaaaaacgaccgctaacaacgattaaaacgacgatccaacgcgtactctctaaacgaaatacgacgaaaaatatacctactcaaaccgaacgaaatctctctaacaaaacgaaaaatacgccgcgaccgctcgcccgaaccctaaaactactaaacccaccctcccgaaaccgtccgaccctcgataacctcgacctcttctaccatctccgatcctaccctaaaacgaaa

SEQ ID NO: 27941 - DNA, 732 bp, Artificial Sequence
  chemically treated genomic DNA (Homo sapiens) CpG-island No: 27941
aaaatcggttcgtggcgcgttttcggcgttcgattgttgcgtggtttcgagcgatttgtattttattcgttttcgtttttattttcgttttagttcgtagcggttatagttcgggaggttttaagggaattttcgtacgtttgcgcgcgtaattacgggacggcgggtcggcgtggcgcgcgtaattgttttggaaattacggcgcgcgtacgcgtaaacgcgggtgatggggggaagaaagattgagttgagagttttgtcgcggggggagggttttatttcgttttttcgcggtgggcgcgcgcgttggttcgtttttttgttgtacgttttcggttcgcgcgtttttttcggtgttttttttcgttttataagtatttttgttttttcgtatttgtgcgtcggtgtagtaggtagtgggaatattcgggtattttcgtagttgagcggcgattcgggcggcggcggcggtcgaggagtttttatggtagggacgaggcggagggaaggcgaaaggggggcgaggagttaagttagagttttcgcggggcgggttttcgagggaggtatagagggaaacggttttcgtagttcgaggagggttaggcgcggagtttgtcgtatttttcgcgtattttgtttagttcgggtttcggagatgtatttgtattaggtttttatcggagttgttaattttggagataattgttatttcgtgggtagcgtcgggg

SEQ ID NO: 27942 - DNA, 732 bp, Artificial Sequence
  chemically treated genomic DNA (Homo sapiens) CpG-island No: 27942
ccccgacgctacccacgaaataacaattatctccaaaattaacaactccgataaaaacctaatacaaatacatctccgaaacccgaactaaacaaaatacgcgaaaaatacgacaaactccgcgcctaaccctcctcgaactacgaaaaccgtttccctctatacctccctcgaaaacccgccccgcgaaaactctaacttaactcctcgcccccctttcgccttccctccgcctcgtccctaccataaaaactcctcgaccgccgccgccgcccgaatcgccgctcaactacgaaaatacccgaatattcccactacctactacaccgacgcacaaatacgaaaaaacaaaaatacttataaaacgaaaaaaaacaccgaaaaaaacgcgcgaaccgaaaacgtacaacaaaaaaacgaaccaacgcgcgcgcccaccgcgaaaaaacgaaataaaaccctccccccgcgacaaaactctcaactcaatctttcttccccccatcacccgcgtttacgcgtacgcgcgccgtaatttccaaaacaattacgcgcgccacgccgacccgccgtcccgtaattacgcgcgcaaacgtacgaaaattcccttaaaacctcccgaactataaccgctacgaactaaaacgaaaataaaaacgaaaacgaataaaatacaaatcgctcgaaaccacgcaacaatcgaacgccgaaaacgcgccacgaaccgatttt

SEQ ID NO: 27943 - DNA, 732 bp, Artificial Sequence
  chemically treated genomic DNA (Homo sapiens) CpG-island No: 27943
tttcgacgttgtttacggagtagtagttgtttttagggttgatagtttcggtgaggatttgatgtagatgtattttcggagttcgggttggatagaatgcgcgggaggtgcgataagtttcgcgtttgatttttttcgggttgcgagagtcgtttttttttgtgtttttttcggaaattcgtttcgcggaggttttggtttaatttttcgtttttttttcgtttttttttcgtttcgtttttgttatgggagtttttcgatcgtcgtcgtcgttcgggtcgtcgtttagttgcggaaatgttcggatgtttttattgtttgttgtatcggcgtataaatgcgggagggtaagggtgtttgtgaggcgggggagggtatcggggggaacgcgcgagtcgggagcgtgtagtaagggagcgggttagcgcgcgcgtttatcgcgggggagcgaggtagagtttttttttcgcggtaaagtttttagtttagttttttttttttttattattcgcgtttgcgcgtgcgcgcgtcgtggtttttagggtaattgcgcgcgttacgtcgattcgtcgtttcgtgattgcgcgcgtagacgtgcgggagtttttttggagtttttcgggttgtagtcgttgcggattggggcggaggtgggggcgggggcgagtggggtgtaggtcgttcggggttacgtagtagtcggacgtcggggacgcgttacgagtcggtttt

SEQ ID NO: 27944 - DNA, 732 bp, Artificial Sequence
  chemically treated genomic DNA (Homo sapiens) CpG-island No: 27944
aaaaccgactcgtaacgcgtccccgacgtccgactactacgtaaccccgaacgacctacaccccactcgcccccgcccccacctccgccccaatccgcaacgactacaacccgaaaaactccaaaaaaactcccgcacgtctacgcgcgcaatcacgaaacgacgaatcgacgtaacgcgcgcaattaccctaaaaaccacgacgcgcgcacgcgcaaacgcgaataataaaaaaaaaaaaaactaaactaaaaactttaccgcgaaaaaaaaactctacctcgctcccccgcgataaacgcgcgcgctaacccgctcccttactacacgctcccgactcgcgcgttccccccgataccctcccccgcctcacaaacacccttaccctcccgcatttatacgccgatacaacaaacaataaaaacatccgaacatttccgcaactaaacgacgacccgaacgacgacgacgatcgaaaaactcccataacaaaaacgaaacgaaaaaaaaacgaaaaaaaaacgaaaaattaaaccaaaacctccgcgaaacgaatttccgaaaaaaacacaaaaaaaaacgactctcgcaacccgaaaaaaatcaaacgcgaaacttatcgcacctcccgcgcattctatccaacccgaactccgaaaatacatctacatcaaatcctcaccgaaactatcaaccctaaaaacaactactactccgtaaacaacgtcgaaa

SEQ ID NO: 27945 - DNA, 713 bp, Artificial Sequence
  chemically treated genomic DNA (Homo sapiens) CpG-island No: 27945
gaaaggtatgtaagtatgtttatatacgtgtatatacgggtttttaaaagatttgcgtgtggtcgtaggggtttgtttcgtttttttcgggtttttttaggtttcggcgtttagcgattttattagtatttgggttcggcgcgcggtttttttttttttcgcgtttttcggggttttttgtttcgttcgcgtgttttattttttttagttttgttttatcgttgttttttgtttcgtttacgggttttattttatttttatttcgattcgtttttcgtttttttttgtttcgtttatcgcgtttcgtttttgttcgtttcgtttggtttttagtatttttaagatcggtgcgcgtttcgttttttttttttttttcgcgaggtagtttcgacgtcggaagtgtttggagcgcgcgatagcggcggggcggggcggggcggtttggaggttgtggcgcgcggtcggtagagggaggggagaggttattggggtcgtgttagtttgtcggtggggatttttgtaggtataggcgcggtcggggtttttcgtggagagtcgggggtttttgtcggtttttgattggggtgtcgttgtagggtcgtttttatgttgcgtttttcgatttgttttttattttttcgggtggtgggagagaagtagttttcgtaggagattatttttttggtttggtcgtttaagcgggattttattgt

SEQ ID NO: 27946 - DNA, 713 bp, Artificial Sequence
  chemically treated genomic DNA (Homo sapiens) CpG-island No: 27946
acaataaaatcccgcttaaacgaccaaaccaaaaaaataatctcctacgaaaactacttctctcccaccacccgaaaaaataaaaaacaaatcgaaaaacgcaacataaaaacgaccctacaacgacaccccaatcaaaaaccgacaaaaacccccgactctccacgaaaaaccccgaccgcgcctatacctacaaaaatccccaccgacaaactaacacgaccccaataacctctcccctccctctaccgaccgcgcgccacaacctccaaaccgccccgccccgccccgccgctatcgcgcgctccaaacacttccgacgtcgaaactacctcgcgaaaaaaaaaaaaaaaacgaaacgcgcaccgatcttaaaaatactaaaaaccaaacgaaacgaacaaaaacgaaacgcgataaacgaaacaaaaaaaaacgaaaaacgaatcgaaataaaaataaaataaaacccgtaaacgaaacaaaaaacaacgataaaacaaaactaaaaaaaataaaacacgcgaacgaaacaaaaaaccccgaaaaacgcgaaaaaaaaaaaaaccgcgcgccgaacccaaatactaataaaatcgctaaacgccgaaacctaaaaaaacccgaaaaaaacgaaacaaacccctacgaccacacgcaaatcttttaaaaacccgtatatacacgtatataaacatacttacatacctttc

SEQ ID NO: 27947 - DNA, 713 bp, Artificial Sequence
  chemically treated genomic DNA (Homo sapiens) CpG-island No: 27947
gtaatgagatttcgtttgggcgattagattaggaaaataattttttgcgggagttgttttttttttattattcggaaggatgggaaataggtcggaaaacgtaatatggggacggttttgtaacgatattttagttagaggtcggtaggagttttcggttttttacgaggagtttcgatcgcgtttgtatttgtaagagtttttatcggtagattaatacggttttagtggttttttttttttttttgtcggtcgcgcgttatagtttttaggtcgtttcgtttcgtttcgtcgttgtcgcgcgttttaggtattttcggcgtcgggattgtttcgcgagaggaggaggaggggcggggcgcgtatcggttttgggggtgttgagagttagacggggcggatagggacggggcgcggtgggcggggtagggaggagcgaggggcggatcgaggtgggggtaggatggggttcgtgggcggggtagggagtagcgatggggtagagttaggaagggtggggtacgcgggcggggtagggagtttcgaggggcgcggagagggagggagtcgcgcgtcggatttaggtgttggtgggatcgttgggcgtcgggatttgaaagggttcgagaagggcggggtaggtttttgcggttatacgtaggttttttgggaattcgtgtgtgtacgtgtgtgggtatgtttgtatatttttt

SEQ ID NO: 27948 - DNA, 713 bp, Artificial Sequence
  chemically treated genomic DNA (Homo sapiens) CpG-island No: 27948
aaaaaatatacaaacatacccacacacgtacacacacgaattcccaaaaaacctacgtataaccgcaaaaacctaccccgcccttctcgaaccctttcaaatcccgacgcccaacgatcccaccaacacctaaatccgacgcgcgactccctccctctccgcgcccctcgaaactccctaccccgcccgcgtaccccacccttcctaactctaccccatcgctactccctaccccgcccacgaaccccatcctacccccacctcgatccgcccctcgctcctccctaccccgcccaccgcgccccgtccctatccgccccgtctaactctcaacacccccaaaaccgatacgcgccccgcccctcctcctcctctcgcgaaacaatcccgacgccgaaaatacctaaaacgcgcgacaacgacgaaacgaaacgaaacgacctaaaaactataacgcgcgaccgacaaaaaaaaaaaaaaaaccactaaaaccgtattaatctaccgataaaaactcttacaaatacaaacgcgatcgaaactcctcgtaaaaaaccgaaaactcctaccgacctctaactaaaatatcgttacaaaaccgtccccatattacgttttccgacctatttcccatccttccgaataataaaaaaaaaacaactcccgcaaaaaattattttcctaatctaatcgcccaaacgaaatctcattac

SEQ ID NO: 27949 - DNA, 520 bp, Artificial Sequence
  chemically treated genomic DNA (Homo sapiens) CpG-island No: 27949
ttagagttaggacgtggtttttggtttcgaggttatcgaggtttagtataagtattagataacgcgcgttagaagtaagggcggcgttttcgaggtgtattttaagtttacgtattttatttttcggatcgttcggttcgtatgtgtttaggttacgggttatgtttgtcgtttgcggtggtaataacggatttacgtttatcgtcgcggtgttggttaatttattgcgtttgttttggtttacgcgtaggggtcgtaagggggttaattattacggtttattgttttaggtgggtatcgtgagttcggttttggacgttaagggttaggaggtgttcgcgttttttcgcggttgttgtttatggtggcgtttaacgatttcgtgttcgatggttgggatattttgtcgtcgaatttggtcgaggcgatgcggttcgcgaaggtgttgattgagggttgtaggagtaattgtggtcgtatatggaggttttgtagtttcggtttttggtatatattttat

SEQ ID NO: 27950 - DNA, 520 bp, Artificial Sequence
  chemically treated genomic DNA (Homo sapiens) CpG-island No: 27950
ataaaatatataccaaaaaccgaaactacaaaacctccatatacgaccacaattactcctacaaccctcaatcaacaccttcgcgaaccgcatcgcctcgaccaaattcgacgacaaaatatcccaaccatcgaacacgaaatcgttaaacgccaccataaacaacaaccgcgaaaaaacgcgaacacctcctaacccttaacgtccaaaaccgaactcacgatacccacctaaaacaataaaccgtaataattaacccccttacgacccctacgcgtaaaccaaaacaaacgcaataaattaaccaacaccgcgacgataaacgtaaatccgttattaccaccgcaaacgacaaacataacccgtaacctaaacacatacgaaccgaacgatccgaaaaataaaatacgtaaacttaaaatacacctcgaaaacgccgcccttacttctaacgcgcgttatctaatacttatactaaacctcgataacctcgaaaccaaaaaccacgtcctaactctaa

SEQ ID NO: 27951 - DNA, 520 bp, Artificial Sequence
  chemically treated genomic DNA (Homo sapiens) CpG-island No: 27951
gtgggatgtatattaaaggtcggggttgtagggtttttatgtgcggttatagttgtttttgtagtttttaattagtattttcgcgagtcgtatcgtttcggttaggttcggcgataagatgttttagttatcgaatacgaggtcgttgggcgttattatgggtagtagtcgcggaagggcgcgaatattttttggtttttggcgtttaagatcgggtttacggtgtttatttgagatagtgaatcgtagtagttggtttttttgcgatttttgcgcgtgggttaggatagacgtagtaggttggttagtatcgcggcggtgagcgtggattcgttgttattatcgtaggcgataagtatgattcgtagtttgggtatatgcgggtcgggcggttcggaaggtgaagtgcgtggatttgaggtgtatttcgaggacgtcgtttttgtttttgacgcgcgttgtttggtatttgtattgagtttcgatggtttcgaggttaaagattacgttttggttttgg

SEQ ID NO: 27952 - DNA, 520 bp, Artificial Sequence
  chemically treated genomic DNA (Homo sapiens) CpG-island No: 27952
ccaaaaccaaaacgtaatctttaacctcgaaaccatcgaaactcaatacaaataccaaacaacgcgcgtcaaaaacaaaaacgacgtcctcgaaatacacctcaaatccacgcacttcaccttccgaaccgcccgacccgcatatacccaaactacgaatcatacttatcgcctacgataataacaacgaatccacgctcaccgccgcgatactaaccaacctactacgtctatcctaacccacgcgcaaaaatcgcaaaaaaaccaactactacgattcactatctcaaataaacaccgtaaacccgatcttaaacgccaaaaaccaaaaaatattcgcgcccttccgcgactactacccataataacgcccaacgacctcgtattcgataactaaaacatcttatcgccgaacctaaccgaaacgatacgactcgcgaaaatactaattaaaaactacaaaaacaactataaccgcacataaaaaccctacaaccccgacctttaatatacatcccac

SEQ ID NO: 27953 - DNA, 561 bp, Artificial Sequence
  chemically treated genomic DNA (Homo sapiens) CpG-island No: 27953
tttttaggtgagttcgttttcgcgggattgggttcggggaaggtttttaggattcgtttcgcgtgagcggtttggaggttgcgggagggtagagtagggcgcgcgggagattgttcgttttcgggcgtttagggttcggttttttagcgttatcgtcgtagtaggtgggggtttagtgggcgggggcggggttcggttttgggcggagtcgaggcggcggcggcgtaggttggggtcggggtcggggcgggagtcggagttcgagttggagtagcgagtcgggttgtcggggcgatcgcgggagttcgtcgtgcgtcgtggttgggatcggtttggtcgagcgcgtcggcgtcgcggtcgtagataaagggcggttcgcgttcgggtcgttacgttttcgggttttgtttcggtaagtggttttttttcgttggtttttttttttcgtcgtttgcgtttttcggagttcggcgggtttcggagaagcggggaagagatgagattttttcgttcgtattgtttttttattttattttaataataagttttttaggttaagtt

SEQ ID NO: 27954 - DNA, 561 bp, Artificial Sequence
  chemically treated genomic DNA (Homo sapiens) CpG-island No: 27954
aacttaacctaaaaaacttattattaaaataaaataaaaaaacaatacgaacgaaaaaatctcatctcttccccgcttctccgaaacccgccgaactccgaaaaacgcaaacgacgaaaaaaaaaaaccaacgaaaaaaaaccacttaccgaaacaaaacccgaaaacgtaacgacccgaacgcgaaccgccctttatctacgaccgcgacgccgacgcgctcgaccaaaccgatcccaaccacgacgcacgacgaactcccgcgatcgccccgacaacccgactcgctactccaactcgaactccgactcccgccccgaccccgaccccaacctacgccgccgccgcctcgactccgcccaaaaccgaaccccgcccccgcccactaaacccccacctactacgacgataacgctaaaaaaccgaaccctaaacgcccgaaaacgaacaatctcccgcgcgccctactctaccctcccgcaacctccaaaccgctcacgcgaaacgaatcctaaaaaccttccccgaacccaatcccgcgaaaacgaactcacctaaaaa

SEQ ID NO: 27955 - DNA, 561 bp, Artificial Sequence
  chemically treated genomic DNA (Homo sapiens) CpG-island No: 27955
ggtttggtttggggggtttattgttagggtaaggtggggaggtagtgcgggcggggaagttttatttttttttcgttttttcggagttcgtcgaatttcgagaggcgtaggcggcgggaggagaaagttagcggaggggagttatttatcgaggtagagttcgagagcgtggcggttcgggcgcgagtcgttttttgtttgcggtcgcggcgtcggcgcgttcggttaggtcggttttagttacggcgtacggcgagttttcgcggtcgtttcgatagttcggttcgttgttttagttcgggtttcggttttcgtttcggtttcggttttagtttgcgtcgtcgtcgtttcggtttcgtttagagtcgggtttcgttttcgtttattgggtttttatttgttgcggcggtggcgttggggagtcgggttttgggcgttcggaggcgggtagtttttcgcgcgttttgttttgttttttcgtagtttttaggtcgtttacgcggggcgggttttgggggtttttttcggatttagtttcgcggagacgagtttatttgggga

SEQ ID NO: 27956 - DNA, 561 bp, Artificial Sequence
  chemically treated genomic DNA (Homo sapiens) CpG-island No: 27956
tccccaaataaactcgtctccgcgaaactaaatccgaaaaaaacccccaaaacccgccccgcgtaaacgacctaaaaactacgaaaaaacaaaacaaaacgcgcgaaaaactacccgcctccgaacgcccaaaacccgactccccaacgccaccgccgcaacaaataaaaacccaataaacgaaaacgaaacccgactctaaacgaaaccgaaacgacgacgacgcaaactaaaaccgaaaccgaaacgaaaaccgaaacccgaactaaaacaacgaaccgaactatcgaaacgaccgcgaaaactcgccgtacgccgtaactaaaaccgacctaaccgaacgcgccgacgccgcgaccgcaaacaaaaaacgactcgcgcccgaaccgccacgctctcgaactctacctcgataaataactcccctccgctaactttctcctcccgccgcctacgcctctcgaaattcgacgaactccgaaaaaacgaaaaaaaaataaaacttccccgcccgcactacctccccaccttaccctaacaataaaccccccaaaccaaacc

SEQ ID NO: 27957 - DNA, 629 bp, Artificial Sequence
  chemically treated genomic DNA (Homo sapiens) CpG-island No: 27957
ttatcgcgggtcgagggtagtgggtagagtttttcggttttttgtaggaagcgttgggttttttcgcggttgtcggcgtttagggtttttcgggcgatttcgatatattttttagttttatttttgtttttttttatagtttgttttttttttcgtttttttcggtagcgtagttaagaagggcggaagtcgtcgtcgcggaggaggcgaggcgggatcggttgggggcgtgcggcggtagcggggaggagcgtaggggatcgcggtagcggttgcgacggttcgggcggacgggcgggtttcgtagtttcgtttttttacggcggttttttcgtttttcgcgggtttttagggcgcgattcgtattcgtttcggtttaggattaattttttgggtcggggcgttcgagttgattcggtggttcgcgtacggcgttagtaggttcgaagcggatttgttcgggaggcggacgatagtagtcgggttgtttatcgcggggaggggtttcgttcgggattcgattgtcggtattggtagcgtcgtgttttgtgatttttaggcgaggttttcgtagtttaggttaggaggatagggttcgggaaggggatattcgtttttagtaaaattgt

SEQ ID NO: 27958 - DNA, 629 bp, Artificial Sequence
  chemically treated genomic DNA (Homo sapiens) CpG-island No: 27958
acaattttactaaaaacgaatatccccttcccgaaccctatcctcctaacctaaactacgaaaacctcgcctaaaaatcacaaaacacgacgctaccaataccgacaatcgaatcccgaacgaaacccctccccgcgataaacaacccgactactatcgtccgcctcccgaacaaatccgcttcgaacctactaacgccgtacgcgaaccaccgaatcaactcgaacgccccgacccaaaaaattaatcctaaaccgaaacgaatacgaatcgcgccctaaaaacccgcgaaaaacgaaaaaaccgccgtaaaaaaacgaaactacgaaacccgcccgtccgcccgaaccgtcgcaaccgctaccgcgatcccctacgctcctccccgctaccgccgcacgcccccaaccgatcccgcctcgcctcctccgcgacgacgacttccgcccttcttaactacgctaccgaaaaaaacgaaaaaaaaaacaaactataaaaaaaaacaaaaataaaactaaaaaatatatcgaaatcgcccgaaaaaccctaaacgccgacaaccgcgaaaaaacccaacgcttcctacaaaaaaccgaaaaactctacccactaccctcgacccgcgataa

SEQ ID NO: 27959 - DNA, 629 bp, Artificial Sequence
  chemically treated genomic DNA (Homo sapiens) CpG-island No: 27959
gtaattttattgaaaacgagtgtttttttttcggattttgtttttttggtttgagttgcgagggtttcgtttggaggttatagggtacggcgttattaatgtcggtaatcgggtttcgggcggaattttttttcgcgatgggtagttcggttgttatcgttcgtttttcgggtaggttcgtttcgagtttgttggcgtcgtgcgcggattatcgagttagttcggacgtttcggtttaggaggttggttttgggtcgggacggatgcggatcgcgttttaggggttcgcggggggcggggaggtcgtcgtgaggaggcggagttgcgaggttcgttcgttcgttcgggtcgtcgtagtcgttgtcgcggttttttgcgttttttttcgttgtcgtcgtacgtttttagtcggtttcgtttcgtttttttcgcggcggcggttttcgttttttttagttgcgttgtcggaggaaacggaagaaggagtaagttatggaggggaatagggatgaggttgagaaatgtgtcgagatcgttcgggaggttttgaacgtcggtaatcgcgagaaggtttagcgttttttgtagaaggtcgagaagttttatttattgttttcggttcgcggtga

SEQ ID NO: 27960 - DNA, 629 bp, Artificial Sequence
  chemically treated genomic DNA (Homo sapiens) CpG-island No: 27960
tcaccgcgaaccgaaaacaataaataaaacttctcgaccttctacaaaaaacgctaaaccttctcgcgattaccgacgttcaaaacctcccgaacgatctcgacacatttctcaacctcatccctattcccctccataacttactccttcttccgtttcctccgacaacgcaactaaaaaaaacgaaaaccgccgccgcgaaaaaaacgaaacgaaaccgactaaaaacgtacgacgacaacgaaaaaaaacgcaaaaaaccgcgacaacgactacgacgacccgaacgaacgaacgaacctcgcaactccgcctcctcacgacgacctccccgccccccgcgaacccctaaaacgcgatccgcatccgtcccgacccaaaaccaacctcctaaaccgaaacgtccgaactaactcgataatccgcgcacgacgccaacaaactcgaaacgaacctacccgaaaaacgaacgataacaaccgaactacccatcgcgaaaaaaaattccgcccgaaacccgattaccgacattaataacgccgtaccctataacctccaaacgaaaccctcgcaactcaaaccaaaaaaacaaaatccgaaaaaaaaacactcgttttcaataaaattac

SEQ ID NO: 27961 - DNA, 1234 bp, Artificial Sequence
  chemically treated genomic DNA (Homo sapiens) CpG-island No: 27961
ttttggttttttcggagttttttttagttttatcgttagtttgcggcgcgtatacgttcgcgagcggaggaggaacggagaatatagaattattaaggcggcgcgtttattttttatcgcggcgcgtttcgtcgcgagcgcgttttcgtattttgtcggggttttcggttcgcggcgcgtcgtaggggcgatttcgttcgttcgtttttcgtcgcgcgttcgttacggtcgcgcgttttcgttcgtcggtttttagcggcgttgcgcgcgttatttaatcgtcgtcgttcgtcgcgagattcgaggttgtttcgttagtagtcgataaaatatttttttttatttttttaaattttgttttcgcgcgtttttaatcgtcgttattttatttttatttttttgtgtaacgggtttttttttcgtcggtaaaaattcgcggagttatcgagcgtttttgcgaagtttattatttcgaatttcgttgaagtttaagtaagtaaggtagagaaaaggttaatcggatttacggtgagattttattatttattttttcgtcgtatcgcgatttaaattgcgttgtttttcgttttttttgttttttttatattgtagaatgtttttttattcgggaattcggattgtttattttattaatggttgttattcgttttcgggacgcgtttttgagattttagttaatgagtaagcgaagaaaagggtggaggggcgggcgtttttaattttaagtcgcgattggggcgtggggggagaggcgggggaaggcggagggatgggaacgggggagaagaagggtatcgcggcgggagggaagaaatagagcgagttacgttgtaggagcgtagttattagtcggttgcgattacgtgtttgggaggaggagttgagattttaggggaggggcgcgcggtagcgtttcgggttttttagtagggttttagagattacgtgaagttttttcggtatgtagtacgtcgtttttattatttttagttttatttttagcgtttttcgggcggagatttgcgattcgtagtcgtttttcggggtttcggatattttttttttatttttttaatttttggcggtttttttcgtttgataggtggcgcgaacgcgtttagtgagaggagtttgaggtttgttttgacgttttttatagttttagtagagatttcgtgtttttttcgtttaggcgagtttttagttattaata

SEQ ID NO: 27962 - DNA, 1234 bp, Artificial Sequence
  chemically treated genomic DNA (Homo sapiens) CpG-island No: 27962
tattaataactaaaaactcgcctaaacgaaaaaaacacgaaatctctactaaaactataaaaaacgtcaaaacaaacctcaaactcctctcactaaacgcgttcgcgccacctatcaaacgaaaaaaaccgccaaaaattaaaaaaataaaaaaaaaatatccgaaaccccgaaaaacgactacgaatcgcaaatctccgcccgaaaaacgctaaaaataaaactaaaaataataaaaacgacgtactacataccgaaaaaacttcacgtaatctctaaaaccctactaaaaaacccgaaacgctaccgcgcgcccctcccctaaaatctcaactcctcctcccaaacacgtaatcgcaaccgactaataactacgctcctacaacgtaactcgctctatttcttccctcccgccgcgatacccttcttctcccccgttcccatccctccgccttcccccgcctctccccccacgccccaatcgcgacttaaaattaaaaacgcccgcccctccacccttttcttcgcttactcattaactaaaatctcaaaaacgcgtcccgaaaacgaataacaaccattaataaaataaacaatccgaattcccgaataaaaaaacattctacaatataaaaaaaacaaaaaaaacgaaaaacaacgcaatttaaatcgcgatacgacgaaaaaataaataataaaatctcaccgtaaatccgattaaccttttctctaccttacttacttaaacttcaacgaaattcgaaataataaacttcgcaaaaacgctcgataactccgcgaatttttaccgacgaaaaaaaaacccgttacacaaaaaaataaaaataaaataacgacgattaaaaacgcgcgaaaacaaaatttaaaaaaataaaaaaaaatattttatcgactactaacgaaacaacctcgaatctcgcgacgaacgacgacgattaaataacgcgcgcaacgccgctaaaaaccgacgaacgaaaacgcgcgaccgtaacgaacgcgcgacgaaaaacgaacgaacgaaatcgcccctacgacgcgccgcgaaccgaaaaccccgacaaaatacgaaaacgcgctcgcgacgaaacgcgccgcgataaaaaataaacgcgccgccttaataattctatattctccgttcctcctccgctcgcgaacgtatacgcgccgcaaactaacgataaaactaaaaaaaactccgaaaaaaccaaaa

SEQ ID NO: 27963 - DNA, 1234 bp, Artificial Sequence
  chemically treated genomic DNA (Homo sapiens) CpG-island No: 27963
tgttggtggttggggattcgtttagacggaagaaatacggaatttttattaaggttgtggaaggcgttagggtaaattttagattttttttattggacgcgttcgcgttatttgttagacgggaggagtcgttagggattgagagggtagggaaggggtgttcggggtttcggaaagcggttgcgggtcgtaggttttcgttcgagaggcgttgggaatggggttgggagtggtgggggcggcgtgttatatatcgaggagattttacgtggtttttagagttttgttaggggattcgggacgttatcgcgcgttttttttttgaggttttagtttttttttttaggtacgtgatcgtagtcggttggtaattgcgtttttgtagcgtagttcgttttgttttttttttttcgtcgcggtgttttttttttttttcgtttttattttttcgttttttttcgtttttttttttacgttttaatcgcggtttgagattagaagcgttcgtttttttattttttttttcgtttgtttattggttgaagttttaaggacgcgtttcgagggcgggtggtagttattggtgggatgagtaattcgagttttcggatgagggaatattttgtagtataaagggagtagggaaggcgggagatagcgtagtttgaatcgcggtgcgacgaaggagtaggtggtgggattttatcgtgggttcgattagttttttttttgttttgtttgtttgagttttagcggaattcgaaatggtaaatttcgtagagacgttcgatgatttcgcgggtttttgtcggcgagagaaaaattcgttatatagagggatgggggtgaagtggcgacggttgggaacgcgcggagataggatttagaagagtggggggaggtgttttgtcggttgttagcggagtagtttcggatttcgcggcgggcggcgacggttgggtggcgcgcgtagcgtcgttgggggtcggcgggcggaggcgcgcggtcgtggcgagcgcgcggcggggggcgaacgggcggggtcgtttttgcggcgcgtcgcgggtcggagatttcggtagggtgcggggacgcgttcgcggcgggacgcgtcgcggtgggggatgggcgcgtcgttttggtaattttatatttttcgtttttttttcgttcgcgggcgtgtgcgcgtcgtaggttggcggtaaggttggaaaggatttcggaaaggttaaga

SEQ ID NO: 27964 - DNA, 1234 bp, Artificial Sequence
  chemically treated genomic DNA (Homo sapiens) CpG-island No: 27964
tcttaacctttccgaaatcctttccaaccttaccgccaacctacgacgcgcacacgcccgcgaacgaaaaaaaaacgaaaaatataaaattaccaaaacgacgcgcccatcccccaccgcgacgcgtcccgccgcgaacgcgtccccgcaccctaccgaaatctccgacccgcgacgcgccgcaaaaacgaccccgcccgttcgccccccgccgcgcgctcgccacgaccgcgcgcctccgcccgccgacccccaacgacgctacgcgcgccacccaaccgtcgccgcccgccgcgaaatccgaaactactccgctaacaaccgacaaaacacctccccccactcttctaaatcctatctccgcgcgttcccaaccgtcgccacttcacccccatccctctatataacgaatttttctctcgccgacaaaaacccgcgaaatcatcgaacgtctctacgaaatttaccatttcgaattccgctaaaactcaaacaaacaaaacaaaaaaaaaactaatcgaacccacgataaaatcccaccacctactccttcgtcgcaccgcgattcaaactacgctatctcccgccttccctactccctttatactacaaaatattccctcatccgaaaactcgaattactcatcccaccaataactaccacccgccctcgaaacgcgtccttaaaacttcaaccaataaacaaacgaaaaaaaaaataaaaaaacgaacgcttctaatctcaaaccgcgattaaaacgtaaaaaaaaaaacgaaaaaaaacgaaaaaataaaaacgaaaaaaaaaaaaaacaccgcgacgaaaaaaaaaaaacaaaacgaactacgctacaaaaacgcaattaccaaccgactacgatcacgtacctaaaaaaaaaaactaaaacctcaaaaaaaaaacgcgcgataacgtcccgaatcccctaacaaaactctaaaaaccacgtaaaatctcctcgatatataacacgccgcccccaccactcccaaccccattcccaacgcctctcgaacgaaaacctacgacccgcaaccgctttccgaaaccccgaacaccccttccctaccctctcaatccctaacgactcctcccgtctaacaaataacgcgaacgcgtccaataaaaaaaatctaaaatttaccctaacgccttccacaaccttaataaaaattccgtatttcttccgtctaaacgaatccccaaccaccaaca

SEQ ID NO: 27965 - DNA, 571 bp, Artificial Sequence
  chemically treated genomic DNA (Homo sapiens) CpG-island No: 27965
cgtgataagtacgttttcggttgttaaaataatttaaaaatgtgttttaaaatacgttcgtaaagtttcgggtcggtcggtcgtttgttttttatttagttcgatcgttcgacgttttattgtcgagcgagggcgagtaagttaatgtgtttagtttttttttttcgatttttttcgtttcgttttttcgtttttttcgttttcggatagtttagtagtttttattttttagatttttttcgaattcgtagttttttgggtagtcgttgttcgagtgttgacggaagcggtcgaagttcgggttcggagttggttcgggcgcggagcggaggttcgcgcgtttttcgggtagtcgagcgcgtaggcgtaggttttagtaatcgtcggttggaggcgggcgaatcgtagtagggaaagatttacgttgcgggacgcggtgtatgttgcggcgttgacggtttttgtttttttcgcgggttttcgattttttgttttagattttttgtttagcgatttggggttttttttcgtttgtttattggtaggagtcgtaattttagtagtaatagtt

SEQ ID NO: 27966 - DNA, 571 bp, Artificial Sequence
  chemically treated genomic DNA (Homo sapiens) CpG-island No: 27966
aactattactactaaaattacgactcctaccaataaacaaacgaaaaaaaaccccaaatcgctaaacaaaaaatctaaaacaaaaaatcgaaaacccgcgaaaaaaacaaaaaccgtcaacgccgcaacatacaccgcgtcccgcaacgtaaatctttccctactacgattcgcccgcctccaaccgacgattactaaaacctacgcctacgcgctcgactacccgaaaaacgcgcgaacctccgctccgcgcccgaaccaactccgaacccgaacttcgaccgcttccgtcaacactcgaacaacgactacccaaaaaactacgaattcgaaaaaaatctaaaaaataaaaactactaaactatccgaaaacgaaaaaaacgaaaaaacgaaacgaaaaaaatcgaaaaaaaaaaactaaacacattaacttactcgccctcgctcgacaataaaacgtcgaacgatcgaactaaataaaaaacaaacgaccgaccgacccgaaactttacgaacgtattttaaaacacatttttaaattattttaacaaccgaaaacgtacttatcacg

SEQ ID NO: 27967 - DNA, 571 bp, Artificial Sequence
  chemically treated genomic DNA (Homo sapiens) CpG-island No: 27967
ggttattgttgttgggattgcgatttttattagtaagtaaacgagaggggattttaagtcgttaagtagaaaatttagggtagggagtcggaaattcgcggaaggagtagaggtcgttagcgtcgtagtatgtatcgcgtttcgtagcgtgggtttttttttattgcggttcgttcgtttttaatcggcggttattgggatttgcgtttgcgcgttcggttgttcgggaggcgcgcgagttttcgtttcgcgttcgagttagtttcgggttcggatttcggtcgttttcgttagtattcgggtaacggttgtttaagaagttgcgggttcgagaaagatttggaaaatggaggttgttgagttattcgggggcgggaaaagcgggaaggcggggcggggaggatcggggaaaggaggttaggtatattggtttgttcgttttcgttcggtagtaggacgtcgggcggtcgggttaggtgagaggtaggcgatcggtcggttcggggttttgcgaacgtgttttgaggtatatttttgggttgttttggtaatcggaggcgtgtttgttacg

SEQ ID NO: 27968 - DNA, 571 bp, Artificial Sequence
  chemically treated genomic DNA (Homo sapiens) CpG-island No: 27968
cgtaacaaacacgcctccgattaccaaaacaacccaaaaatatacctcaaaacacgttcgcaaaaccccgaaccgaccgatcgcctacctctcacctaacccgaccgcccgacgtcctactaccgaacgaaaacgaacaaaccaatatacctaacctcctttccccgatcctccccgccccgccttcccgcttttcccgcccccgaataactcaacaacctccattttccaaatctttctcgaacccgcaacttcttaaacaaccgttacccgaatactaacgaaaacgaccgaaatccgaacccgaaactaactcgaacgcgaaacgaaaactcgcgcgcctcccgaacaaccgaacgcgcaaacgcaaatcccaataaccgccgattaaaaacgaacgaaccgcaataaaaaaaaacccacgctacgaaacgcgatacatactacgacgctaacgacctctactccttccgcgaatttccgactccctaccctaaattttctacttaacgacttaaaatcccctctcgtttacttactaataaaaatcgcaatcccaacaacaataacc

SEQ ID NO: 27969 - DNA, 653 bp, Artificial Sequence
  chemically treated genomic DNA (Homo sapiens) CpG-island No: 27969
ttttcgtatcgaagggtttagtattagtagttcgattattacgcggcgggatgtttgtggttggtattgatttcggtttttttaattgttatattgttgtcgcgagaagtggcggtatcgagattatcgttaatgagtatagcgataggtgtatttcgtaagtgtttttgttgagtattatttcgattttaagaaacgtttttttttttcgtttttaacgtttgttttgtttgttcgttttttcggatttttttttaacgtgcgtcgaatttcgagatgataggtgtaattcgttaatcgtagtttttagagatcgtcgggtggtagtcggattttttcgtttcgtaaagtttttttttttttaaggacgagggatcgtattagtttgcgtagtttttttttttgtatttacgtacgttttttgtttcgtgtcgttgttttttaacgttttttttgtttgcgaggaagaggttgttgtgggatagtttttggcgttcggaatattgagaaagattttcggttgtttttaacgaggtttacgtgggattatcggtttcgcgttagttgttttttttttttttttcgtttttttgggtgatagtttttttttagaaaagtaaaaagttagtttcggttgtatacgttagagatga

SEQ ID NO: 27970 - DNA, 653 bp, Artificial Sequence
  chemically treated genomic DNA (Homo sapiens) CpG-island No: 27970
tcatctctaacgtatacaaccgaaactaactttttacttttctaaaaaaaaactatcacccaaaaaaacgaaaaaaaaaaaaaaaacaactaacgcgaaaccgataatcccacgtaaacctcgttaaaaacaaccgaaaatctttctcaatattccgaacgccaaaaactatcccacaacaacctcttcctcgcaaacaaaaaaaacgttaaaaaacaacgacacgaaacaaaaaacgtacgtaaatacaaaaaaaaaaactacgcaaactaatacgatccctcgtccttaaaaaaaaaaaaactttacgaaacgaaaaaatccgactaccacccgacgatctctaaaaactacgattaacgaattacacctatcatctcgaaattcgacgcacgttaaaaaaaaatccgaaaaaacgaacaaacaaaacaaacgttaaaaacgaaaaaaaaaaacgtttcttaaaatcgaaataatactcaacaaaaacacttacgaaatacacctatcgctatactcattaacgataatctcgataccgccacttctcgcgacaacaatataacaattaaaaaaaccgaaatcaataccaaccacaaacatcccgccgcgtaataatcgaactactaatactaaacccttcgatacgaaaa

SEQ ID NO: 27971 - DNA, 653 bp, Artificial Sequence
  chemically treated genomic DNA (Homo sapiens) CpG-island No: 27971
ttatttttgacgtgtgtagtcgaagttgattttttatttttttgagaaaaagttgttatttagagggacggggaaaggaaggagggtagttggcgcggggtcgataattttacgtaaatttcgttagaggtaatcggagattttttttaatatttcggacgttaggggttgttttatagtaatttttttttcgtaagtaaaagaggcgttgggggatagcggtacgaggtaggggacgtgcgtaggtatagaaaagagagttgcgtaaattagtgcggtttttcgtttttgaaggaaaagaagttttgcggggcgaggaagttcgattgttattcggcggtttttagggattgcggttgacgggttgtatttgttatttcggggttcggcgtacgttaggggaaaattcgaggaagcgagtagataggataaacgttaaggacgggagagaaaaacgttttttagggtcgaggtgatgtttagtagaggtatttacggggtatatttgtcgttgtatttattggcgatggtttcgatgtcgttatttttcgcgatagtaatgtagtagttgagaaagtcgaggttaatgttaattatagatatttcgtcgcgtgatggtcgggttgttggtattgaatttttcggtacgggaa

SEQ ID NO: 27972 - DNA, 653 bp, Artificial Sequence
  chemically treated genomic DNA (Homo sapiens) CpG-island No: 27972
ttcccgtaccgaaaaattcaataccaacaacccgaccatcacgcgacgaaatatctataattaacattaacctcgactttctcaactactacattactatcgcgaaaaataacgacatcgaaaccatcgccaataaatacaacgacaaatataccccgtaaatacctctactaaacatcacctcgaccctaaaaaacgtttttctctcccgtccttaacgtttatcctatctactcgcttcctcgaattttcccctaacgtacgccgaaccccgaaataacaaatacaacccgtcaaccgcaatccctaaaaaccgccgaataacaatcgaacttcctcgccccgcaaaacttcttttccttcaaaaacgaaaaaccgcactaatttacgcaactctcttttctatacctacgcacgtcccctacctcgtaccgctatcccccaacgcctcttttacttacgaaaaaaaaattactataaaacaacccctaacgtccgaaatattaaaaaaaatctccgattacctctaacgaaatttacgtaaaattatcgaccccgcgccaactaccctccttcctttccccgtccctctaaataacaactttttctcaaaaaaataaaaaatcaacttcgactacacacgtcaaaaataa

SEQ ID NO: 27973 - DNA, 586 bp, Artificial Sequence
  chemically treated genomic DNA (Homo sapiens) CpG-island No: 27973
ttcggtatcgcggcgaggtttaggttgtggaggcggcggcgagaggagcggttgaagacgagaaggaggaggggaggaggcggagggtcgaggaagagtaggcggcgagcgagggagggggcggtagttgttagttatatttatcgagcgcgggcgatcgtcggaggagagcgatcgggggagtttggggggcgggggagagatttagtcggagcgttaggggttgggaaggaggcggtgcgggcggattggcgggcgagttgtttacggggaagggggcggaggggagggaaggggaggagggttagtaaggagggatggagagggggaagtggtggcggcggttgcgtgcgcggtttcgtcggtcgggcgcgttttcgtggagtgcgcgcgtacgtcggggtagagggcggagcggcgaggacgagggcgcggtcggcggggcgggagggcgtagggttgttcgcgcgagcgtagggcgggaggcgggcgttgtatttgtcggcgtcgtttaggattgggggcggttttttaattggaaggagtcgggaagggtttgattagaggaaggaaaggtataaggggt

SEQ ID NO: 27974 - DNA, 586 bp, Artificial Sequence
  chemically treated genomic DNA (Homo sapiens) CpG-island No: 27974
accccttatacctttccttcctctaatcaaacccttcccgactccttccaattaaaaaaccgcccccaatcctaaacgacgccgacaaatacaacgcccgcctcccgccctacgctcgcgcgaacaaccctacgccctcccgccccgccgaccgcgccctcgtcctcgccgctccgccctctaccccgacgtacgcgcgcactccacgaaaacgcgcccgaccgacgaaaccgcgcacgcaaccgccgccaccacttccccctctccatccctccttactaaccctcctccccttccctcccctccgcccccttccccgtaaacaactcgcccgccaatccgcccgcaccgcctccttcccaacccctaacgctccgactaaatctctcccccgccccccaaactcccccgatcgctctcctccgacgatcgcccgcgctcgataaatataactaacaactaccgccccctccctcgctcgccgcctactcttcctcgaccctccgcctcctcccctcctccttctcgtcttcaaccgctcctctcgccgccgcctccacaacctaaacctcgccgcgataccgaa

SEQ ID NO: 27975 - DNA, 586 bp, Artificial Sequence
  chemically treated genomic DNA (Homo sapiens) CpG-island No: 27975
gttttttatgttttttttttttttgattaagtttttttcggttttttttagttggaaggtcgtttttagttttgagcggcgtcgataggtgtagcgttcgtttttcgttttgcgttcgcgcgggtaattttacgttttttcgtttcgtcggtcgcgttttcgttttcgtcgtttcgttttttgtttcggcgtgcgcgcgtattttacgggggcgcgttcggtcggcggggtcgcgtacgtagtcgtcgttattatttttttttttttatttttttttgttggtttttttttttttttttttttttcgttttttttttcgtaggtagttcgttcgttagttcgttcgtatcgttttttttttagtttttagcgtttcggttgggtttttttttcgttttttaggttttttcggtcgttttttttcggcggtcgttcgcgttcggtggatgtggttggtagttgtcgttttttttttcgttcgtcgtttgttttttttcggtttttcgttttttttttttttttttttcgtttttagtcgtttttttcgtcgtcgtttttatagtttgggtttcgtcgcgatgtcgga

SEQ ID NO: 27976 - DNA, 586 bp, Artificial Sequence
  chemically treated genomic DNA (Homo sapiens) CpG-island No: 27976
tccgacatcgcgacgaaacccaaactataaaaacgacgacgaaaaaaacgactaaaaacgaaaaaaaaaaaaaaaaaaaacgaaaaaccgaaaaaaaacaaacgacgaacgaaaaaaaaaacgacaactaccaaccacatccaccgaacgcgaacgaccgccgaaaaaaaacgaccgaaaaaacctaaaaaacgaaaaaaaaacccaaccgaaacgctaaaaactaaaaaaaaaacgatacgaacgaactaacgaacgaactacctacgaaaaaaaaaacgaaaaaaaaaaaaaaaaaaaaaaaccaacaaaaaaaaataaaaaaaaaaaaataataacgacgactacgtacgcgaccccgccgaccgaacgcgcccccgtaaaatacgcgcgcacgccgaaacaaaaaacgaaacgacgaaaacgaaaacgcgaccgacgaaacgaaaaaacgtaaaattacccgcgcgaacgcaaaacgaaaaacgaacgctacacctatcgacgccgctcaaaactaaaaacgaccttccaactaaaaaaaaccgaaaaaaacttaatcaaaaaaaaaaaaaacataaaaaac

SEQ ID NO: 27977 - DNA, 752 bp, Artificial Sequence
  chemically treated genomic DNA (Homo sapiens) CpG-island No: 27977
gtgggggtcggaaaagcgcgggagggggcgtggtttcgagaaggcggagataagatggtcgtttatagcgtttggaggatttaagaggcggtggtcggggttacgtttcgggtaggagggtcgttttgtgcgcgttcgttttatgatgtttgcgcgcgtttttcgcgcgtcgcgttgcgggcggggcgggttttcgggattttaagggttcggttacggaagaagcgtagcgtcggttggggagggggttggatgcgcgcgtattcggggggaggtcgttgttgttcggagtaggaggagggggagagtgcggcgggcggtagcggcgttggcggcgatttcgttatagagtaggggggttagggtagcgcgttcgtttcgttttcggtgagcggcgtgcgtagggaaggcgttcggggcggcggtcgtggtcgggggcggtggaagtaggcgggtcggggcggcggcgtttgtggtcgtggtcggggtcggggtcgtggtcggggacggggacggggtcggggtcggggtcgcggtcgtttttcgagtggcggtagcggttttggcggcgacggcggcggttgcggcggcggcggtagcggtggcggcggcgtttttcggcgggagtcggtttttttttcgtcggggagcgcggggtcggggtttaggggatttcgggttacggagagcgggaagaggatggattgttcggttttttttttcggatggaagaaggaggaagtgattcgaaa

SEQ ID NO: 27978 - DNA, 752 bp, Artificial Sequence
  chemically treated genomic DNA (Homo sapiens) CpG-island No: 27978
tttcgaatcacttcctccttcttccatccgaaaaaaaaaaccgaacaatccatcctcttcccgctctccgtaacccgaaatcccctaaaccccgaccccgcgctccccgacgaaaaaaaaaccgactcccgccgaaaaacgccgccgccaccgctaccgccgccgccgcaaccgccgccgtcgccgccaaaaccgctaccgccactcgaaaaacgaccgcgaccccgaccccgaccccgtccccgtccccgaccacgaccccgaccccgaccacgaccacaaacgccgccgccccgacccgcctacttccaccgcccccgaccacgaccgccgccccgaacgccttccctacgcacgccgctcaccgaaaacgaaacgaacgcgctaccctaacccccctactctataacgaaatcgccgccaacgccgctaccgcccgccgcactctccccctcctcctactccgaacaacaacgacctccccccgaatacgcgcgcatccaaccccctccccaaccgacgctacgcttcttccgtaaccgaacccttaaaatcccgaaaacccgccccgcccgcaacgcgacgcgcgaaaaacgcgcgcaaacatcataaaacgaacgcgcacaaaacgaccctcctacccgaaacgtaaccccgaccaccgcctcttaaatcctccaaacgctataaacgaccatcttatctccgccttctcgaaaccacgccccctcccgcgcttttccgacccccac

SEQ ID NO: 27979 - DNA, 752 bp, Artificial Sequence
  chemically treated genomic DNA (Homo sapiens) CpG-island No: 27979
tttcggattatttttttttttttttattcgggggggagggtcgggtaatttatttttttttcgtttttcgtggttcggggttttttgggtttcggtttcgcgtttttcgacgggaaagggatcggttttcgtcggggggcgtcgtcgttatcgttgtcgtcgtcgtcgtagtcgtcgtcgtcgtcgttaaggtcgttgtcgttattcgggggacggtcgcggtttcggtttcggtttcgttttcgttttcggttacggtttcggtttcggttacggttatagacgtcgtcgtttcggttcgtttgtttttatcgttttcggttacggtcgtcgtttcgagcgttttttttgcgtacgtcgtttatcggggacggggcgagcgcgttgttttggtttttttgttttatggcggagtcgtcgttagcgtcgttgtcgttcgtcgtattttttttttttttttgtttcgggtagtagcggttttttttcgggtgcgcgcgtatttagttttttttttagtcggcgttgcgtttttttcgtaatcgagtttttggaatttcggagattcgtttcgttcgtagcgcggcgcgcgggggacgcgcgtaagtattatagagcgggcgcgtatagagcggtttttttgttcggggcgtggtttcggttatcgttttttaggttttttaagcgttatgggcggttattttgttttcgttttttcggggttacgttttttttcgcgttttttcggtttttat

SEQ ID NO: 27980 - DNA, 752 bp, Artificial Sequence
  chemically treated genomic DNA (Homo sapiens) CpG-island No: 27980
ataaaaaccgaaaaaacgcgaaaaaaaacgtaaccccgaaaaaacgaaaacaaaataaccgcccataacgcttaaaaaacctaaaaaacgataaccgaaaccacgccccgaacaaaaaaaccgctctatacgcgcccgctctataatacttacgcgcgtcccccgcgcgccgcgctacgaacgaaacgaatctccgaaattccaaaaactcgattacgaaaaaaacgcaacgccgactaaaaaaaaaactaaatacgcgcgcacccgaaaaaaaaccgctactacccgaaacaaaaaaaaaaaaaaaatacgacgaacgacaacgacgctaacgacgactccgccataaaacaaaaaaaccaaaacaacgcgctcgccccgtccccgataaacgacgtacgcaaaaaaaacgctcgaaacgacgaccgtaaccgaaaacgataaaaacaaacgaaccgaaacgacgacgtctataaccgtaaccgaaaccgaaaccgtaaccgaaaacgaaaacgaaaccgaaaccgaaaccgcgaccgtcccccgaataacgacaacgaccttaacgacgacgacgacgactacgacgacgacgacaacgataacgacgacgccccccgacgaaaaccgatccctttcccgtcgaaaaacgcgaaaccgaaacccaaaaaaccccgaaccacgaaaaacgaaaaaaaaataaattacccgaccctcccccccgaataaaaaaaaaaaaaaataatccgaaa

SEQ ID NO: 27981 - DNA, 1032 bp, Artificial Sequence
  chemically treated genomic DNA (Homo sapiens) CpG-island No: 27981
tcgcggcgacggcgaggagggggcgcggaggagtagttttatttttttagttttttaatcgcgttttaggcggagtcgttagagttttttttcgcgcggagaagtgtggttttaatttttaaaattaaagtcgtttattatttatttaggtcgtttttgttcggcgggatcggggtttcggttcgttttatttcgggagtttcgtttttcgtcgttttggtttcgagtttcgtatttattattcggtcgggtttcgcgggatgtgcgcgtcgaggcgggcgtcggtcgtttcgggttcgggtttcgcgcgtagcggttttttttcgggtttggtggagtcgtagttgttattcggagatcgaggggcggaaaattgcgttcgttgttcgtttttttcgcgcggcgttgttatcgtcgggaataaaggagataaagtcgcgtcggtcgggttcgttttcgttttttttttttcgtttgtcgggttgtttttttttcgttcgtcgttcgggttaggtcggaagtagttcggagagtcgggcgcgcggtttcgaatcgttcgggatttcgtattttagtttcgcgggtttcgtatcggtcgagggttggggattcgatttttttcgtacgggggagggcgggggcgggttgtatcgcggcggtcgttatggtaacgcgggtcgttcggaggggtgaggagtgaattcggggagttagagtcgtttcgtttcgtcggttttatttgttcgtttttttggaatcggaattgggaatttttttggttgttaggagtcgaggcggggggtcgcgtttcgtattcgtaggtgttggtggaatagcgtttcggttttttttcgttcgtttagagtcgggtagtattcgagttttttattagttcgattcgtttttttgttagcgttcggtttcgtttcgcgttcggagtttttttttttttttttattcggtttcggtggttattttttttaattttttttatttgaattttaaggcgttttgttttttttttgcgtattt

SEQ ID NO: 27982 - DNA, 1032 bp, Artificial Sequence
  chemically treated genomic DNA (Homo sapiens) CpG-island No: 27982
aaatacgcaaaaaaaaaacaaaacgccttaaaattcaaataaaaaaaattaaaaaaaataaccaccgaaaccgaataaaaaaaaaaaaaaaaactccgaacgcgaaacgaaaccgaacgctaacaaaaaaacgaatcgaactaataaaaaactcgaatactacccgactctaaacgaacgaaaaaaaaccgaaacgctattccaccaacacctacgaatacgaaacgcgaccccccgcctcgactcctaacaaccaaaaaaattcccaattccgattccaaaaaaacgaacaaataaaaccgacgaaacgaaacgactctaactccccgaattcactcctcacccctccgaacgacccgcgttaccataacgaccgccgcgatacaacccgcccccgccctcccccgtacgaaaaaaatcgaatccccaaccctcgaccgatacgaaacccgcgaaactaaaatacgaaatcccgaacgattcgaaaccgcgcgcccgactctccgaactacttccgacctaacccgaacgacgaacgaaaaaaaaacaacccgacaaacgaaaaaaaaaaaacgaaaacgaacccgaccgacgcgactttatctcctttattcccgacgataacaacgccgcgcgaaaaaaacgaacaacgaacgcaattttccgcccctcgatctccgaataacaactacgactccaccaaacccgaaaaaaaaccgctacgcgcgaaacccgaacccgaaacgaccgacgcccgcctcgacgcgcacatcccgcgaaacccgaccgaataataaatacgaaactcgaaaccaaaacgacgaaaaacgaaactcccgaaataaaacgaaccgaaaccccgatcccgccgaacaaaaacgacctaaataaataataaacgactttaattttaaaaattaaaaccacacttctccgcgcgaaaaaaaactctaacgactccgcctaaaacgcgattaaaaaactaaaaaaataaaactactcctccgcgccccctcctcgccgtcgccgcga

SEQ ID NO: 27983 - DNA, 1032 bp, Artificial Sequence
  chemically treated genomic DNA (Homo sapiens) CpG-island No: 27983
aggtgcgtaggggagaaataaggcgttttggagtttaggtaaagaaagttggggaggatgattatcggagtcgggtaaggaagggaaagggagtttcgggcgcggggcgaggtcgggcgttggtagaagaacgggtcgggttggtgagggattcgggtgttattcggttttggacgggcgggaagaggtcgggacgttgttttattagtatttgcgggtgcggagcgcgatttttcgtttcggtttttggtaattaggaaagtttttagtttcggttttaaggaggcgagtaggtgaggtcgacggggcggggcggttttggtttttcgggtttattttttattttttcgggcgattcgcgttgttatggcgatcgtcgcggtgtagttcgttttcgttttttttcgtgcgggaggggtcgggtttttagttttcggtcgatgcggagttcgcggggttggaatgcggggtttcgggcggttcggggtcgcgcgttcggtttttcgggttgttttcggtttggttcgggcggcgggcggggggagggtagttcggtaggcgagggggaaggagcggagacgagttcggtcgacgcggttttgttttttttgttttcggcggtggtagcgtcgcgcgggaggggcgggtagcgggcgtagtttttcgtttttcggttttcgggtaatagttgcggttttattagattcggggagaggtcgttgcgcgcggagttcgagttcggagcggtcgacgttcgtttcggcgcgtatatttcgcggggttcggtcgggtggtgagtgcggggttcggggttagggcggcgaggaacggggttttcgaggtggaacgggtcggggtttcgatttcgtcgggtaggggcggtttgggtgagtggtgggcggttttggttttgagagttgggattatattttttcgcgcgaagggaaattttggcgatttcgtttggaacgcgattgggagattgaggaggtggagttgttttttcgcgtttttttttcgtcgtcgtcgcgg

SEQ ID NO: 27984 - DNA, 1032 bp, Artificial Sequence
  chemically treated genomic DNA (Homo sapiens) CpG-island No: 27984
ccgcgacgacgacgaaaaaaaaacgcgaaaaaacaactccacctcctcaatctcccaatcgcgttccaaacgaaatcgccaaaatttcccttcgcgcgaaaaaatataatcccaactctcaaaaccaaaaccgcccaccactcacccaaaccgcccctacccgacgaaatcgaaaccccgacccgttccacctcgaaaaccccgttcctcgccgccctaaccccgaaccccgcactcaccacccgaccgaaccccgcgaaatatacgcgccgaaacgaacgtcgaccgctccgaactcgaactccgcgcgcaacgacctctccccgaatctaataaaaccgcaactattacccgaaaaccgaaaaacgaaaaactacgcccgctacccgcccctcccgcgcgacgctaccaccgccgaaaacaaaaaaaacaaaaccgcgtcgaccgaactcgtctccgctccttccccctcgcctaccgaactaccctccccccgcccgccgcccgaaccaaaccgaaaacaacccgaaaaaccgaacgcgcgaccccgaaccgcccgaaaccccgcattccaaccccgcgaactccgcatcgaccgaaaactaaaaacccgacccctcccgcacgaaaaaaaacgaaaacgaactacaccgcgacgatcgccataacaacgcgaatcgcccgaaaaaataaaaaataaacccgaaaaaccaaaaccgccccgccccgtcgacctcacctactcgcctccttaaaaccgaaactaaaaactttcctaattaccaaaaaccgaaacgaaaaatcgcgctccgcacccgcaaatactaataaaacaacgtcccgacctcttcccgcccgtccaaaaccgaataacacccgaatccctcaccaacccgacccgttcttctaccaacgcccgacctcgccccgcgcccgaaactccctttcccttccttacccgactccgataatcatcctccccaactttctttacctaaactccaaaacgccttatttctcccctacgcacct

SEQ ID NO: 27985 - DNA, 803 bp, Artificial Sequence
  chemically treated genomic DNA (Homo sapiens) CpG-island No: 27985
acgtaatacgcgtgaatgttagggtaggttgtttttgcgcggtttttttttacggagtgttagggagggagcgtaaagttattagcgcggcggagttggtgcgttttcggttcgttttttcggtaacgggtcgcgtcgtattgagtttttgtagtaaatttgtcgaatttcgttcgtggatttttaaatatcgggcggggtcgggtgtggcggcgcgttcggacgttcgttattttttcgcgtttttcgtttgttagttgattggtttttgggttaggggcggggtattcgcggcggaggtaagcggcggcgcgcggacggttggtttagtttttcggtttggcggtaggtaagtttagttcggcgttgtcggatatttggggtgagcggaaagtatggcggggattttcgcgttaggtagtaagaggcggagcgagttttcggcgtttcgtttcggttcgtcgtcgggtatcgggtatttttcgagtaagcgggttcggggttttttcgtagtcgttgtttcggattttgacgattcgttcggcgcgtatggggattttattgtcgacgatttggaggagtttgatattttcgcgttataggttttgagttaatgttcggtcgcggttcgggacgtgtttagtgagtgtttttcgcggttttttgttcggagggagttgttaatcgcgttagatttttttgatggttgtggtttcggaatttcgcggttagtattgttttttcgtttttttaaaatatgggaatattttgatttaagtagcggttgttttttagaaggtttt

SEQ ID NO: 27986 - DNA, 803 bp, Artificial Sequence
  chemically treated genomic DNA (Homo sapiens) CpG-island No: 27986
aaaaccttctaaaaaacaaccgctacttaaatcaaaatattcccatattttaaaaaaacgaaaaaacaatactaaccgcgaaattccgaaaccacaaccatcaaaaaaatctaacgcgattaacaactccctccgaacaaaaaaccgcgaaaaacactcactaaacacgtcccgaaccgcgaccgaacattaactcaaaacctataacgcgaaaatatcaaactcctccaaatcgtcgacaataaaatccccatacgcgccgaacgaatcgtcaaaatccgaaacaacgactacgaaaaaaccccgaacccgcttactcgaaaaatacccgatacccgacgacgaaccgaaacgaaacgccgaaaactcgctccgcctcttactacctaacgcgaaaatccccgccatactttccgctcaccccaaatatccgacaacgccgaactaaacttacctaccgccaaaccgaaaaactaaaccaaccgtccgcgcgccgccgcttacctccgccgcgaataccccgcccctaacccaaaaaccaatcaactaacaaacgaaaaacgcgaaaaaataacgaacgtccgaacgcgccgccacacccgaccccgcccgatatttaaaaatccacgaacgaaattcgacaaatttactacaaaaactcaatacgacgcgacccgttaccgaaaaaacgaaccgaaaacgcaccaactccgccgcgctaataactttacgctccctccctaacactccgtaaaaaaaaaccgcgcaaaaacaacctaccctaacattcacgcgtattacgt

SEQ ID NO: 27987 - DNA, 803 bp, Artificial Sequence
  chemically treated genomic DNA (Homo sapiens) CpG-island No: 27987
aggattttttggaagataatcgttgtttaaattagggtgtttttatattttaaaaaggcgaaaaggtagtgttggtcgcgaggtttcgaagttatagttattaaggggatttggcgcggttgataatttttttcgagtaaaaggtcgcgaggagtatttattggatacgtttcgagtcgcggtcggatattggtttagggtttgtgacgcgagggtgttaagtttttttaggtcgtcggtagtgaagtttttatgcgcgtcgaacgggtcgttagggttcggggtagcggttgcggagaagtttcgggttcgtttgttcggggggtgttcggtgttcggcggcgggtcggggcgaggcgtcgggggttcgtttcgttttttgttgtttggcgcggaggttttcgttatgtttttcgtttattttaagtattcgatagcgtcgagttagatttgtttgtcgttaggtcggagaattggattaatcgttcgcgcgtcgtcgtttgttttcgtcgcgagtgtttcgtttttggtttaggggttaattagttggtaggcggagggcgcggaggaatgacgaacgttcgagcgcgtcgttatattcggtttcgttcggtgtttagaggtttacgggcgggattcggtaggtttgttgtaaggatttagtgcggcgcgattcgttatcggagaggcgggtcggaggcgtattagtttcgtcgcgttggtggttttgcgttttttttttggtatttcgtggaggagggtcgcgtaggagtagtttgttttagtatttacgcgtgttgcgt

SEQ ID NO: 27988 - DNA, 803 bp, Artificial Sequence
  chemically treated genomic DNA (Homo sapiens) CpG-island No: 27988
acgcaacacgcgtaaatactaaaacaaactactcctacgcgaccctcctccacgaaataccaaaaaaaaaacgcaaaaccaccaacgcgacgaaactaatacgcctccgacccgcctctccgataacgaatcgcgccgcactaaatccttacaacaaacctaccgaatcccgcccgtaaacctctaaacaccgaacgaaaccgaatataacgacgcgctcgaacgttcgtcattcctccgcgccctccgcctaccaactaattaacccctaaaccaaaaacgaaacactcgcgacgaaaacaaacgacgacgcgcgaacgattaatccaattctccgacctaacgacaaacaaatctaactcgacgctatcgaatacttaaaataaacgaaaaacataacgaaaacctccgcgccaaacaacaaaaaacgaaacgaacccccgacgcctcgccccgacccgccgccgaacaccgaacaccccccgaacaaacgaacccgaaacttctccgcaaccgctaccccgaaccctaacgacccgttcgacgcgcataaaaacttcactaccgacgacctaaaaaaacttaacaccctcgcgtcacaaaccctaaaccaatatccgaccgcgactcgaaacgtatccaataaatactcctcgcgaccttttactcgaaaaaaattatcaaccgcgccaaatccccttaataactataacttcgaaacctcgcgaccaacactaccttttcgcctttttaaaatataaaaacaccctaatttaaacaacgattatcttccaaaaaatcct

SEQ ID NO: 27989 - DNA, 594 bp, Artificial Sequence
  chemically treated genomic DNA (Homo sapiens) CpG-island No: 27989
tcggttggattttcgatcggggcgtttgcgaggtgcggtttttgggtaatttgagtcgtaattttttgcgtaacggtatcgaggtggtgtcgtgttattcgtagggttcgacggtcggcgtggtgtatcgcgcgggtcggaataatcgttggtatttggcggtggtcgttatttacgtgttgtttgagtcggagacggcgagtcgttgtaatttcgcggtattcgattacgatacggttatcgcgtttaaggatacggaggggcgtagtttggttacgtaggagttggggcgttttaagttgtgcgagggcgcgggtagtttgtatttcgtggacgtttttttttggaacggtagtatttattttttttattatttttataattatacgagcggcgttgttatcggttggtttagtatggcgcgtatcgcgtagagtatcgaggtgttgttttagggttaggtatttttcgattgcggttacggttatttcgacggtcgtcgtttgttttttttttttagtttagtggaggttttggacgtttgggcgggagtgtttagcgcggtcgttggagagggttaggagcggcgttttt

SEQ ID NO: 27990 - DNA, 594 bp, Artificial Sequence
  chemically treated genomic DNA (Homo sapiens) CpG-island No: 27990
aaaaacgccgctcctaaccctctccaacgaccgcgctaaacactcccgcccaaacgtccaaaacctccactaaactaaaaaaaaaaaacaaacgacgaccgtcgaaataaccgtaaccgcaatcgaaaaatacctaaccctaaaacaacacctcgatactctacgcgatacgcgccatactaaaccaaccgataacaacgccgctcgtataattataaaaataataaaaaaaataaatactaccgttccaaaaaaaaacgtccacgaaatacaaactacccgcgccctcgcacaacttaaaacgccccaactcctacgtaaccaaactacgcccctccgtatccttaaacgcgataaccgtatcgtaatcgaataccgcgaaattacaacgactcgccgtctccgactcaaacaacacgtaaataacgaccaccgccaaataccaacgattattccgacccgcgcgatacaccacgccgaccgtcgaaccctacgaataacacgacaccacctcgataccgttacgcaaaaaattacgactcaaattacccaaaaaccgcacctcgcaaacgccccgatcgaaaatccaaccga

SEQ ID NO: 27991 - DNA, 594 bp, Artificial Sequence
  chemically treated genomic DNA (Homo sapiens) CpG-island No: 27991
gggagcgtcgtttttggttttttttagcggtcgcgttgaatattttcgtttagacgtttagggtttttattaggttggaggagaggagtaggcggcggtcgtcggggtggtcgtggtcgtagtcgagggatgtttggttttggaatagtatttcggtgttttgcgcgatgcgcgttatgttgggttagtcggtggtagcgtcgttcgtgtagttgtaggggtagtaggggaagtagatgttgtcgttttagagaaaggcgtttacgaagtgtaggttgttcgcgttttcgtatagtttgaggcgttttagtttttgcgtggttaggttgcgttttttcgtgtttttgagcgcgatggtcgtgtcgtggtcggatgtcgcggggttgtagcggttcgtcgttttcggtttaggtagtacgtaggtggcggttatcgttaggtattagcggttgtttcggttcgcgcggtatattacgtcggtcgtcgagttttgcgggtggtacgatattatttcggtgtcgttgcgtagggagttgcggtttaggttgtttaggggtcgtatttcgtaggcgtttcggtcgaaggtttagtcgg

SEQ ID NO: 27992 - DNA, 594 bp, Artificial Sequence
  chemically treated genomic DNA (Homo sapiens) CpG-island No: 27992
ccgactaaaccttcgaccgaaacgcctacgaaatacgacccctaaacaacctaaaccgcaactccctacgcaacgacaccgaaataatatcgtaccacccgcaaaactcgacgaccgacgtaatataccgcgcgaaccgaaacaaccgctaatacctaacgataaccgccacctacgtactacctaaaccgaaaacgacgaaccgctacaaccccgcgacatccgaccacgacacgaccatcgcgctcaaaaacacgaaaaaacgcaacctaaccacgcaaaaactaaaacgcctcaaactatacgaaaacgcgaacaacctacacttcgtaaacgcctttctctaaaacgacaacatctacttcccctactacccctacaactacacgaacgacgctaccaccgactaacccaacataacgcgcatcgcgcaaaacaccgaaatactattccaaaaccaaacatccctcgactacgaccacgaccaccccgacgaccgccgcctactcctctcctccaacctaataaaaaccctaaacgtctaaacgaaaatattcaacgcgaccgctaaaaaaaaccaaaaacgacgctccc

SEQ ID NO: 27993 - DNA, 712 bp, Artificial Sequence
  chemically treated genomic DNA (Homo sapiens) CpG-island No: 27993
cgtttttttttttcggtttagcgtgaaaatacggacggcgaagggttgtcgttagtcgtttttttgttatcgcgatcgggaaataaagatatattattttttattttttgcgtttttaagggattcgaggaatttttggttgtaagcggttggtatttcggaacgggcgttttattcgttcgggcgaaggtttttggtttattaggcggttttggcgttcgtagttggcgagttttcgtttcgttttcgtcgtcgttttcgtcgcgggttttcggcgttagtttatagttcgttcgcgtttttcgcgtcgagtttggttcggcgttagtgagtttcgtcgtcggttcgtttttcgttcgcgttcggttcgtcgtatggtgcgtttagcgcgtttcgagttagttttcggcgcgttgttaggtcgggtgttaggcggttatcgcgcgttatcgtcgtcgttatcgttcgtcgttcgattttggataataatgcgcgttttcgtttttttagaaagttagggacgtttttagtcgtcgttagagttggttcggttttttagttttttttcgtggtattcgtaggcgagataaagttcgttttcggtgaggttgcgcgcgtttaaagcgtgcgggatgtttagtacggaggtttttaagcgggggatttttggtttttttataaaatttatttaaagttatcgttcgaggttttt

SEQ ID NO: 27994 - DNA, 712 bp, Artificial Sequence
  chemically treated genomic DNA (Homo sapiens) CpG-island No: 27994
aaaaacctcgaacgataactttaaataaattttataaaaaaaccaaaaatcccccgcttaaaaacctccgtactaaacatcccgcacgctttaaacgcgcgcaacctcaccgaaaacgaactttatctcgcctacgaataccacgaaaaaaaactaaaaaaccgaaccaactctaacgacgactaaaaacgtccctaactttctaaaaaaacgaaaacgcgcattattatccaaaatcgaacgacgaacgataacgacgacgataacgcgcgataaccgcctaacacccgacctaacaacgcgccgaaaactaactcgaaacgcgctaaacgcaccatacgacgaaccgaacgcgaacgaaaaacgaaccgacgacgaaactcactaacgccgaaccaaactcgacgcgaaaaacgcgaacgaactataaactaacgccgaaaacccgcgacgaaaacgacgacgaaaacgaaacgaaaactcgccaactacgaacgccaaaaccgcctaataaaccaaaaaccttcgcccgaacgaataaaacgcccgttccgaaataccaaccgcttacaaccaaaaattcctcgaatcccttaaaaacgcaaaaaataaaaaataatatatctttatttcccgatcgcgataacaaaaaaacgactaacgacaacccttcgccgtccgtattttcacgctaaaccgaaaaaaaaaaacg

SEQ ID NO: 27995 - DNA, 712 bp, Artificial Sequence
  chemically treated genomic DNA (Homo sapiens) CpG-island No: 27995
gagggtttcgagcggtggttttgggtgggttttgtgggggagttaggggtttttcgtttggggattttcgtgttgggtatttcgtacgttttggacgcgcgtagttttatcgggagcgaattttgtttcgtttgcgggtgttacggagaggggttgggaagtcgagttagttttggcggcgattgggggcgtttttggttttttgggggggcgggggcgcgtattgttgtttaggatcgggcggcgggcggtggcggcggcggtggcgcgcggtggtcgtttagtattcgatttagtagcgcgtcggggattggttcggggcgcgttgggcgtattatgcggcgggtcgggcgcgggcgaggggcgggtcggcggcggggtttattggcgtcgggttaggttcggcgcgagaggcgcgagcgggttatgggttgacgtcgagggttcgcggcgggggcggcggcggggacggggcgggggttcgttagttgcgggcgttaaggtcgtttagtaggttaagggttttcgttcgggcgaatgggacgttcgtttcggggtattagtcgtttgtagttagaagtttttcggattttttggaagcgtaaaaaataaaaggtaatgtgtttttgtttttcggtcgcggtggtagggaggcgattgacggtagtttttcgtcgttcgtgtttttacgttgggtcggggaaaagggacg

SEQ ID NO: 27996 - DNA, 712 bp, Artificial Sequence
  chemically treated genomic DNA (Homo sapiens) CpG-island No: 27996
cgtcccttttccccgacccaacgtaaaaacacgaacgacgaaaaactaccgtcaatcgcctccctaccaccgcgaccgaaaaacaaaaacacattaccttttattttttacgcttccaaaaaatccgaaaaacttctaactacaaacgactaataccccgaaacgaacgtcccattcgcccgaacgaaaacccttaacctactaaacgaccttaacgcccgcaactaacgaacccccgccccgtccccgccgccgcccccgccgcgaaccctcgacgtcaacccataacccgctcgcgcctctcgcgccgaacctaacccgacgccaataaaccccgccgccgacccgcccctcgcccgcgcccgacccgccgcataatacgcccaacgcgccccgaaccaatccccgacgcgctactaaatcgaatactaaacgaccaccgcgcgccaccgccgccgccaccgcccgccgcccgatcctaaacaacaatacgcgcccccgcccccccaaaaaaccaaaaacgcccccaatcgccgccaaaactaactcgacttcccaacccctctccgtaacacccgcaaacgaaacaaaattcgctcccgataaaactacgcgcgtccaaaacgtacgaaatacccaacacgaaaatccccaaacgaaaaacccctaactcccccacaaaacccacccaaaaccaccgctcgaaaccctc

SEQ ID NO: 27997 - DNA, 971 bp, Artificial Sequence
  chemically treated genomic DNA (Homo sapiens) CpG-island No: 27997
tcggggttcgcgtcgagggttcgcgtttttgtttcgtgtttgcgttgttcgtatgtaaatgagggcgcgtgacgcgggacgtagatggataagggaagagagagaatggtcgttgtcgtcgtcgttgttgtcgtcgtcgtcgtcgtcgtttagtgtcggagttttcggtgcgcggcggagagaagaggatttcggcgggaattcgatttttggcgttatcgttttatgtattgtgtaggtaagagagacgcgggtcggggtttcgggtttcgcgcggcgatcgttgtcgtagttcgaggagtttgtggttgaggggtttagttgaatttttcgttcgggttagttcggtgggggagcgagatgggagcggcgcggcgcggcggtttcggcgttcgttttttgttttgcgggttgttggttcggcgcggttcgcgttttttcgtttttttagtttttgggtttttcgggaattgttagtttggattcgtttgttgagttttcgcggaagtcgttcgttcgtttttttttcgaaatttttcggcgttcgtcgttgttcgtcgtcgttcgtcgtttattttgataggacggaggaagcggttcggtgggtcggcgttttggcggaggggagtcggcgggtagggcggtcggaggaaggcgggttggttcgcgttttcgtcgagcgtatatatatttttttgtcgtcgtcgggggtcgggtgagtagacgcggttagttttcggggatttggatttggagatttacgggtattcgtagggcgggggtcgttgatgggtcggttgggggcgaggggcggcgggggcgtcgttcgaggggcggggggcgtttaattttgttttttcgcgttcggcggcggcgttgtgtgtatttttttaagaaggagtcgtttgagcgttgacggttgggatttgaagttttttttttttttttggaagtttggacggtgggggggg

SEQ ID NO: 27998 - DNA, 971 bp, Artificial Sequence
  chemically treated genomic DNA (Homo sapiens) CpG-island No: 27998
ccccccccaccgtccaaacttccaaaaaaaaaaaaaaaacttcaaatcccaaccgtcaacgctcaaacgactccttcttaaaaaaatacacacaacgccgccgccgaacgcgaaaaaacaaaattaaacgccccccgcccctcgaacgacgcccccgccgcccctcgcccccaaccgacccatcaacgacccccgccctacgaatacccgtaaatctccaaatccaaatccccgaaaactaaccgcgtctactcacccgacccccgacgacgacaaaaaaatatatatacgctcgacgaaaacgcgaaccaacccgccttcctccgaccgccctacccgccgactcccctccgccaaaacgccgacccaccgaaccgcttcctccgtcctatcaaaataaacgacgaacgacgacgaacaacgacgaacgccgaaaaatttcgaaaaaaaaacgaacgaacgacttccgcgaaaactcaacaaacgaatccaaactaacaattcccgaaaaacccaaaaactaaaaaaacgaaaaaacgcgaaccgcgccgaaccaacaacccgcaaaacaaaaaacgaacgccgaaaccgccgcgccgcgccgctcccatctcgctcccccaccgaactaacccgaacgaaaaattcaactaaacccctcaaccacaaactcctcgaactacgacaacgatcgccgcgcgaaacccgaaaccccgacccgcgtctctcttacctacacaatacataaaacgataacgccaaaaatcgaattcccgccgaaatcctcttctctccgccgcgcaccgaaaactccgacactaaacgacgacgacgacgacgacaacaacgacgacgacaacgaccattctctctcttcccttatccatctacgtcccgcgtcacgcgccctcatttacatacgaacaacgcaaacacgaaacaaaaacgcgaaccctcgacgcgaaccccga

SEQ ID NO: 27999 - DNA, 971 bp, Artificial Sequence
  chemically treated genomic DNA (Homo sapiens) CpG-island No: 27999
ttttttttatcgtttagatttttaaagagggaggaagaattttaaattttaatcgttagcgtttaagcggtttttttttaaaggggtatatatagcgtcgtcgtcgagcgcgagagggtagagttgggcgtttttcgtttttcggacgacgttttcgtcgtttttcgtttttagtcggtttattagcggttttcgttttgcgagtgttcgtgggtttttaggtttaggttttcgggaattggtcgcgtttgtttattcggttttcggcggcgataagggggtgtgtgtgcgttcggcgggggcgcggattagttcgttttttttcggtcgttttgttcgtcggttttttttcgttagggcgtcgatttatcgggtcgtttttttcgttttgttagggtggacggcgggcgacggcgggtagcgacgggcgtcgaggagtttcggggagagagcgagcgggcggttttcgcgggggtttagtaagcgggtttaaattaatagttttcggggagtttaagagttgggaaggcgaaggagcgcggatcgcgtcgggttagtagttcgtaagataaaaggcgagcgtcggggtcgtcgcgtcgcgtcgtttttatttcgtttttttatcgaattaattcgaacgggagatttaattaaattttttagttataaatttttcgggttgcgatagcggtcgtcgcgcggagttcggggtttcggttcgcgttttttttatttatatagtgtatgaggcggtggcgttaagagtcgagttttcgtcggaattttttttttttcgtcgcgtatcgagggtttcggtattgagcggcggcggcggcggcggtagtagcggcggcggtagcggttattttttttttttttttgtttatttgcgtttcgcgttacgcgtttttatttatatacgagtagcgtaggtacgaggtaggggcgcgagttttcggcgcgagtttcgg

SEQ ID NO: 28000 - DNA, 971 bp, Artificial Sequence
  chemically treated genomic DNA (Homo sapiens) CpG-island No: 28000
ccgaaactcgcgccgaaaactcgcgcccctacctcgtacctacgctactcgtatataaataaaaacgcgtaacgcgaaacgcaaataaacaaaaaaaaaaaaaaaataaccgctaccgccgccgctactaccgccgccgccgccgccgctcaataccgaaaccctcgatacgcgacgaaaaaaaaaaaattccgacgaaaactcgactcttaacgccaccgcctcatacactatataaataaaaaaaacgcgaaccgaaaccccgaactccgcgcgacgaccgctatcgcaacccgaaaaatttataactaaaaaatttaattaaatctcccgttcgaattaattcgataaaaaaacgaaataaaaacgacgcgacgcgacgaccccgacgctcgccttttatcttacgaactactaacccgacgcgatccgcgctccttcgccttcccaactcttaaactccccgaaaactattaatttaaacccgcttactaaacccccgcgaaaaccgcccgctcgctctctccccgaaactcctcgacgcccgtcgctacccgccgtcgcccgccgtccaccctaacaaaacgaaaaaaacgacccgataaatcgacgccctaacgaaaaaaaaccgacgaacaaaacgaccgaaaaaaaacgaactaatccgcgcccccgccgaacgcacacacacccccttatcgccgccgaaaaccgaataaacaaacgcgaccaattcccgaaaacctaaacctaaaaacccacgaacactcgcaaaacgaaaaccgctaataaaccgactaaaaacgaaaaacgacgaaaacgtcgtccgaaaaacgaaaaacgcccaactctaccctctcgcgctcgacgacgacgctatatatacccctttaaaaaaaaaccgcttaaacgctaacgattaaaatttaaaattcttcctccctctttaaaaatctaaacgataaaaaaaa

SEQ ID NO: 28001 - DNA, 561 bp, Artificial Sequence
  chemically treated genomic DNA (Homo sapiens) CpG-island No: 28001
tattatcgtggtagtcgttttcgcgttttgttttcgtttcgttttttttttttttattcgcgaatttagttagcggttcgcgtcgtcgagcgtttattggttagcggaacgcgtcgcgttataatggagtcggtcggaggcggcgagtcggatagcgtcggggtttttcgttgagttcgtagttttcggtagtcgggaaagtgcgggcgcggggtcgtagtttgttcgttcggagcggtttaggagtacgtcgcggggagcgcgggcgttcggggttggagtcgcgtaggtaggtcggagcgtgatatttcggttttaggagggcgagtcgcgtcgatcgaggtggtggaggaggaggatcggatacggggacgtagtaggtggggttggtcgaataggtgcggttatttgtttacgttttatttgcgagttaggttgcgggtcggtagcgcggttgtagagacgagtggtcgtttcgttgtgttttttgttttcgggagagacggagttttacgttgagaggattttttttgtgtgttggggttatttggagtaagaggt

SEQ ID NO: 28002 - DNA, 561 bp, Artificial Sequence
  chemically treated genomic DNA (Homo sapiens) CpG-island No: 28002
acctcttactccaaataaccccaacacacaaaaaaaatcctctcaacgtaaaactccgtctctcccgaaaacaaaaaacacaacgaaacgaccactcgtctctacaaccgcgctaccgacccgcaacctaactcgcaaataaaacgtaaacaaataaccgcacctattcgaccaaccccacctactacgtccccgtatccgatcctcctcctccaccacctcgatcgacgcgactcgccctcctaaaaccgaaatatcacgctccgacctacctacgcgactccaaccccgaacgcccgcgctccccgcgacgtactcctaaaccgctccgaacgaacaaactacgaccccgcgcccgcactttcccgactaccgaaaactacgaactcaacgaaaaaccccgacgctatccgactcgccgcctccgaccgactccattataacgcgacgcgttccgctaaccaataaacgctcgacgacgcgaaccgctaactaaattcgcgaataaaaaaaaaaaaaacgaaacgaaaacaaaacgcgaaaacgactaccacgataata

SEQ ID NO: 28003 - DNA, 561 bp, Artificial Sequence
  chemically treated genomic DNA (Homo sapiens) CpG-island No: 28003
attttttgttttaaatgattttagtatataggagaggtttttttagcgtgggatttcgtttttttcgaaggtagggagtataacgaagcggttattcgtttttgtagtcgcgttatcggttcgtagtttggttcgtaggtgaggcgtgaataggtaatcgtatttgttcggttagttttatttgttgcgttttcgtattcggttttttttttttattatttcggtcggcgcggttcgtttttttggaatcggggtgttacgtttcgatttatttgcgcgattttagtttcggacgttcgcgtttttcgcggcgtgtttttgggtcgtttcgggcgggtaggttgcggtttcgcgttcgtattttttcggttgtcggaggttgcgggtttagcgggaagtttcggcgttgttcggttcgtcgttttcgatcggttttattgtgacgcgacgcgtttcgttggttaatgggcgttcggcggcgcgaatcgttgattaagttcgcgggtggaggaggaggggacggggcggaggtagggcgcggaggcggttattacggtggtg

SEQ ID NO: 28004 - DNA, 561 bp, Artificial Sequence
  chemically treated genomic DNA (Homo sapiens) CpG-island No: 28004
caccaccgtaataaccgcctccgcgccctacctccgccccgtcccctcctcctccacccgcgaacttaatcaacgattcgcgccgccgaacgcccattaaccaacgaaacgcgtcgcgtcacaataaaaccgatcgaaaacgacgaaccgaacaacgccgaaacttcccgctaaacccgcaacctccgacaaccgaaaaaatacgaacgcgaaaccgcaacctacccgcccgaaacgacccaaaaacacgccgcgaaaaacgcgaacgtccgaaactaaaatcgcgcaaataaatcgaaacgtaacaccccgattccaaaaaaacgaaccgcgccgaccgaaataataaaaaaaaaaaaccgaatacgaaaacgcaacaaataaaactaaccgaacaaatacgattacctattcacgcctcacctacgaaccaaactacgaaccgataacgcgactacaaaaacgaataaccgcttcgttatactccctaccttcgaaaaaaacgaaatcccacgctaaaaaaacctctcctatatactaaaatcatttaaaacaaaaaat

SEQ ID NO: 28005 - DNA, 683 bp, Artificial Sequence
  chemically treated genomic DNA (Homo sapiens) CpG-island No: 28005
gacggacggatggacggtcggacgcgtggatatttgtgggacggtatcggttgggaggcggtcggacgcggagatagcggtacggatacgggttttaagtgataggagtcgacgagggagaggggcgtcgggatagaagaaggggatgggggtagcgggaggatgggggtagggaagggttgagtaggcgaagagagcgaggagagcgaagataggaattcgggagcggggtttgtaaggaggggaaagatgggtatcgcggagcgaggttaggcgcgggaatggttggggttgggatcgtagttaggacggaggggttcgcgggatggggatagcgtcgagaggcggtttcgagtacggaggggacgcgggggtcggagggaaggacggttttcggtagcgagtagttttcgttttatagtttcgatagttttttttttcgttattattatttttttttacgttttttttttattttcgtcgcgttgggttcggcggcggcgcggggtttggaatttttatcgcgttttgttttcgtagtttttattttcggcggggaggtggcgcgtttcggggcgtagagagaggtcggattcgacgggcgtcgtcgaggggtcgtgagggagcgcggggtcgtttttagttggtcgcggggtcgggcgtcgaagcggttgttatttttt

SEQ ID NO: 28006 - DNA, 683 bp, Artificial Sequence
  chemically treated genomic DNA (Homo sapiens) CpG-island No: 28006
aaaaaataacaaccgcttcgacgcccgaccccgcgaccaactaaaaacgaccccgcgctccctcacgacccctcgacgacgcccgtcgaatccgacctctctctacgccccgaaacgcgccacctccccgccgaaaataaaaactacgaaaacaaaacgcgataaaaattccaaaccccgcgccgccgccgaacccaacgcgacgaaaataaaaaaaaaacgtaaaaaaaaataataataacgaaaaaaaaaactatcgaaactataaaacgaaaactactcgctaccgaaaaccgtccttccctccgacccccgcgtcccctccgtactcgaaaccgcctctcgacgctatccccatcccgcgaacccctccgtcctaactacgatcccaaccccaaccattcccgcgcctaacctcgctccgcgatacccatctttcccctccttacaaaccccgctcccgaattcctatcttcgctctcctcgctctcttcgcctactcaacccttccctacccccatcctcccgctacccccatccccttcttctatcccgacgcccctctccctcgtcgactcctatcacttaaaacccgtatccgtaccgctatctccgcgtccgaccgcctcccaaccgataccgtcccacaaatatccacgcgtccgaccgtccatccgtccgtc

SEQ ID NO: 28007 - DNA, 683 bp, Artificial Sequence
  chemically treated genomic DNA (Homo sapiens) CpG-island No: 28007
gggggatggtagtcgtttcggcgttcggtttcgcggttagttaggggcggtttcgcgtttttttacggtttttcggcggcgttcgtcggattcggtttttttttgcgtttcggggcgcgttattttttcgtcggaggtgaggattgcggggatagggcgcggtggggattttaggtttcgcgtcgtcgtcgaatttagcgcggcggagatagaaaggggacgtgggagagagtggtggtggcgggggggggggttgtcggagttgtggggcggagattgttcgttgtcgggaatcgttttttttttcggttttcgcgtttttttcgtgttcgaggtcgtttttcggcgttgtttttatttcgcggattttttcgttttgattacgattttaattttagttattttcgcgtttggtttcgtttcgcgatgtttattttttttttttttgtagatttcgttttcgggtttttgttttcgtttttttcgtttttttcgtttgtttaatttttttttgtttttattttttcgttatttttattttttttttttgtttcggcgtttttttttttcgtcggtttttgttatttggaattcgtattcgtgtcgttattttcgcgttcggtcgttttttaatcggtgtcgttttataggtgtttacgcgttcggtcgtttattcgttcgtt

SEQ ID NO: 28008 - DNA, 683 bp, Artificial Sequence
  chemically treated genomic DNA (Homo sapiens) CpG-island No: 28008
aacgaacgaataaacgaccgaacgcgtaaacacctataaaacgacaccgattaaaaaacgaccgaacgcgaaaataacgacacgaatacgaattccaaataacaaaaaccgacgaaaaaaaaaaacgccgaaacaaaaaaaaaaaataaaaataacgaaaaaataaaaacaaaaaaaaattaaacaaacgaaaaaaacgaaaaaaacgaaaacaaaaacccgaaaacgaaatctacaaaaaaaaaaaaaataaacatcgcgaaacgaaaccaaacgcgaaaataactaaaattaaaatcgtaatcaaaacgaaaaaatccgcgaaataaaaacaacgccgaaaaacgacctcgaacacgaaaaaaacgcgaaaaccgaaaaaaaaaacgattcccgacaacgaacaatctccgccccacaactccgacaacccccccccccgccaccaccactctctcccacgtcccctttctatctccgccgcgctaaattcgacgacgacgcgaaacctaaaatccccaccgcgccctatccccgcaatcctcacctccgacgaaaaaataacgcgccccgaaacgcaaaaaaaaaccgaatccgacgaacgccgccgaaaaaccgtaaaaaaacgcgaaaccgcccctaactaaccgcgaaaccgaacgccgaaacgactaccatccccc

SEQ ID NO: 28009 - DNA, 746 bp, Artificial Sequence
  chemically treated genomic DNA (Homo sapiens) CpG-island No: 28009
aaggaacggagcgcgtattttcgacgagacgttcgtgcgttttcgagttcgttattgtgttaacgttttcgggtttgatagaagtttttaggttcggtattttcgagggagttggtcggaggtttcgcgtttaggattttggtttggaggtttcgggcgtttttggaaacgggaatttcgggggaggggattgggggatggagggagttttggacgaggggtgggattattcggttgtcgttgtcgtttggatggttttcgcggtcgtttcgggtatagtcggcgcgggatttttttcggttgttgtttttgaagtcggtcgggttcggcgggaagagtcgtcggtttcgcggtggcgacggggagtcgcgacgggttcgaggcggggacggggagacgcgacgatttcgtggcggggacggcgaggttcggcggtcgcggtgttttgagggcgagcggggtcggcgagtcggggttcgcgacgaggagtcggagggcggaggcggttttgagttgcggcgagtcgggtttgaggaggagttagagttgcggtcgttgcgcgggtcgttttcgtcgtcgtttttaggtcggtgggaagagacggaggagcgagcgttgttgcggtatatggtttttgtagcggcggttacggcgatagttttgattcgggggcgttttagacgtaggttcggagcgcgtcgtcgtagttgtagtcgtcgttatttcggtcgttgcgcgtcgtttta

SEQ ID NO: 28010 - DNA, 746 bp, Artificial Sequence
  chemically treated genomic DNA (Homo sapiens) CpG-island No: 28010
taaaacgacgcgcaacgaccgaaataacgacgactacaactacgacgacgcgctccgaacctacgtctaaaacgcccccgaatcaaaactatcgccgtaaccgccgctacaaaaaccatataccgcaacaacgctcgctcctccgtctcttcccaccgacctaaaaacgacgacgaaaacgacccgcgcaacgaccgcaactctaactcctcctcaaacccgactcgccgcaactcaaaaccgcctccgccctccgactcctcgtcgcgaaccccgactcgccgaccccgctcgccctcaaaacaccgcgaccgccgaacctcgccgtccccgccacgaaatcgtcgcgtctccccgtccccgcctcgaacccgtcgcgactccccgtcgccaccgcgaaaccgacgactcttcccgccgaacccgaccgacttcaaaaacaacaaccgaaaaaaatcccgcgccgactatacccgaaacgaccgcgaaaaccatccaaacgacaacgacaaccgaataatcccacccctcgtccaaaactccctccatcccccaatcccctcccccgaaattcccgtttccaaaaacgcccgaaacctccaaaccaaaatcctaaacgcgaaacctccgaccaactccctcgaaaataccgaacctaaaaacttctatcaaacccgaaaacgttaacacaataacgaactcgaaaacgcacgaacgtctcgtcgaaaatacgcgctccgttcctt

SEQ ID NO: 28011 - DNA, 746 bp, Artificial Sequence
  chemically treated genomic DNA (Homo sapiens) CpG-island No: 28011
tgaggcggcgcgtagcggtcgaggtggcggcggttgtagttgcggcggcgcgtttcgagtttgcgtttagggcgttttcgggttagagttgtcgtcgtggtcgtcgttgtaagaattatgtatcgtagtagcgttcgttttttcgtttttttttatcggtttaaagacgacggcgggggcggttcgcgtagcggtcgtagttttggtttttttttaggttcggttcgtcgtagtttaaagtcgttttcgtttttcggtttttcgtcgcggatttcggttcgtcgatttcgttcgtttttagggtatcgcggtcgtcgggtttcgtcgttttcgttacggggtcgtcgcgttttttcgttttcgtttcgggttcgtcgcggtttttcgtcgttatcgcggggtcgacgatttttttcgtcgggttcggtcggttttagaggtagtagtcggggggagtttcgcgtcgattatgttcgggacggtcgcggagattatttaggcgatagcggtagtcgggtaattttatttttcgtttaggattttttttattttttagttttttttttcggaattttcgtttttagaaacgttcggggtttttagattagggttttaagcgcgaagttttcggttaattttttcggggatgtcgagtttggaggtttttgttagattcgggagcgttgatataataacggattcgggagcgtacgggcgtttcgtcgggagtgcgcgtttcgtttttt

SEQ ID NO: 28012 - DNA, 746 bp, Artificial Sequence
  chemically treated genomic DNA (Homo sapiens) CpG-island No: 28012
aaaaaacgaaacgcgcactcccgacgaaacgcccgtacgctcccgaatccgttattatatcaacgctcccgaatctaacaaaaacctccaaactcgacatccccgaaaaaattaaccgaaaacttcgcgcttaaaaccctaatctaaaaaccccgaacgtttctaaaaacgaaaattccgaaaaaaaaaactaaaaaataaaaaaaatcctaaacgaaaaataaaattacccgactaccgctatcgcctaaataatctccgcgaccgtcccgaacataatcgacgcgaaactccccccgactactacctctaaaaccgaccgaacccgacgaaaaaaatcgtcgaccccgcgataacgacgaaaaaccgcgacgaacccgaaacgaaaacgaaaaaacgcgacgaccccgtaacgaaaacgacgaaacccgacgaccgcgataccctaaaaacgaacgaaatcgacgaaccgaaatccgcgacgaaaaaccgaaaaacgaaaacgactttaaactacgacgaaccgaacctaaaaaaaaaccaaaactacgaccgctacgcgaaccgcccccgccgtcgtctttaaaccgataaaaaaaaacgaaaaaacgaacgctactacgatacataattcttacaacgacgaccacgacgacaactctaacccgaaaacgccctaaacgcaaactcgaaacgcgccgccgcaactacaaccgccgccacctcgaccgctacgcgccgcctca

SEQ ID NO: 28013 - DNA, 511 bp, Artificial Sequence
  chemically treated genomic DNA (Homo sapiens) CpG-island No: 28013
ttcggagttgggcgtaggggggcgttcgggaggcggcgtagttcgcgttacgttgttgtcgttttttttcggtttcgtcgggtgtaggtgcgtggcgagtttttgtagtacggtcgcgcgttcgatttggtcgttgcgtcgtttttttatgattaggttttttagattttggaattcgagcgtgtggttgcgttgcgtcgatagttgaatttgtagtcggtagggttgtttgtcgatgcgtagttcgtcgtcgattttgaattcgcgtttgtcgtagcggtattaggcggcgaaatttttcgagttgcgttagtttagttcgcgttttttggtatttacgtgcgttagcgcgttgcgtattacggcgttggagtttagcggtttgtagcggtatagatcgttgattacgcggtcgcgacggttttggttggcgttagttaggaagttgttaattatttttagtcggtgtaggtgtattatttggaagttatttatatatacggtttagtgt

SEQ ID NO: 28014 - DNA, 511 bp, Artificial Sequence
  chemically treated genomic DNA (Homo sapiens) CpG-island No: 28014
acactaaaccgtatatataaataacttccaaataatacacctacaccgactaaaaataattaacaacttcctaactaacgccaaccaaaaccgtcgcgaccgcgtaatcaacgatctataccgctacaaaccgctaaactccaacgccgtaatacgcaacgcgctaacgcacgtaaataccaaaaaacgcgaactaaactaacgcaactcgaaaaatttcgccgcctaataccgctacgacaaacgcgaattcaaaatcgacgacgaactacgcatcgacaaacaaccctaccgactacaaattcaactatcgacgcaacgcaaccacacgctcgaattccaaaatctaaaaaacctaatcataaaaaaacgacgcaacgaccaaatcgaacgcgcgaccgtactacaaaaactcgccacgcacctacacccgacgaaaccgaaaaaaaacgacaacaacgtaacgcgaactacgccgcctcccgaacgcccccctacgcccaactccgaa

SEQ ID NO: 28015 - DNA, 511 bp, Artificial Sequence
  chemically treated genomic DNA (Homo sapiens) CpG-island No: 28015
gtattgggtcgtatatgtgggtaatttttaggtggtgtatttgtatcggttggaggtgattaatagttttttgattgacgttagttagggtcgtcgcggtcgcgtggttaacgatttgtatcgttataagtcgttaagttttagcgtcgtggtgcgtaacgcgttggcgtacgtgggtgttaaggagcgcgagttgagttggcgtaattcggagagtttcgtcgtttggtgtcgttacggtaagcgcgagtttaagatcggcggcgagttgcgtatcggtaagtagttttatcggttgtagatttagttgtcggcgtagcgtagttatacgttcgagttttagagtttagaggatttgattatggagaagcgacgtaacgattagatcgggcgcgcggtcgtgttgtaggagttcgttacgtatttgtattcggcggagtcggaggagggcgatagtaacgtggcgcggattacgtcgtttttcgggcgtttttttgcgtttagtttcgag

SEQ ID NO: 28016 - DNA, 511 bp, Artificial Sequence
  chemically treated genomic DNA (Homo sapiens) CpG-island No: 28016
ctcgaaactaaacgcaaaaaaacgcccgaaaaacgacgtaatccgcgccacgttactatcgccctcctccgactccgccgaatacaaatacgtaacgaactcctacaacacgaccgcgcgcccgatctaatcgttacgtcgcttctccataatcaaatcctctaaactctaaaactcgaacgtataactacgctacgccgacaactaaatctacaaccgataaaactacttaccgatacgcaactcgccgccgatcttaaactcgcgcttaccgtaacgacaccaaacgacgaaactctccgaattacgccaactcaactcgcgctccttaacacccacgtacgccaacgcgttacgcaccacgacgctaaaacttaacgacttataacgatacaaatcgttaaccacgcgaccgcgacgaccctaactaacgtcaatcaaaaaactattaatcacctccaaccgatacaaatacaccacctaaaaattacccacatatacgacccaatac

SEQ ID NO: 28017 - DNA, 639 bp, Artificial Sequence
  chemically treated genomic DNA (Homo sapiens) CpG-island No: 28017
agttattgcgcgtattgtttttacggttttatgttcgacggtttcgggacgcggttgggtcggggcgggcggtaaggatgcggtcgtcgtcgtcgtcgtcgcggttttttcgcgtttcgtcgacgttaatagtcgtcggtttttttttcgcgcgggatcgagggagtaggagtcgcggttgacgggtcgcgggcgtcgcgttaggttcggtttcggtttcggttcgggtgcgtcgcgattcggtcgtcgttgtagcgagtttcgcgcgtttttcgtgcgtttcggtcggttcggcggcggttgtcgcgtataggttttcgattttagcgttcggttcgttattgagtatgtttagtacgtcggtcggtttcgttgcggttcgtaagtttttagacgcgcgggtgggagcgcgtcggcggtcggggttggggtttgtggtcgagggcggggcgcgggggaggggtcggcggaggggggcggcggttagaaaggggatttcgcgttttcgtttgtagttttgcggggtttacgtagttttcggcgttttggggttttttttcggggcggtttttcggttttgcggggagtgtggttgaatattgtaatacgatggggttttttaggattttttaaataata

SEQ ID NO: 28018 - DNA, 639 bp, Artificial Sequence
  chemically treated genomic DNA (Homo sapiens) CpG-island No: 28018
tattatttaaaaaatcctaaaaaaccccatcgtattacaatattcaaccacactccccgcaaaaccgaaaaaccgccccgaaaaaaaaccccaaaacgccgaaaactacgtaaaccccgcaaaactacaaacgaaaacgcgaaatcccctttctaaccgccgcccccctccgccgacccctcccccgcgccccgccctcgaccacaaaccccaaccccgaccgccgacgcgctcccacccgcgcgtctaaaaacttacgaaccgcaacgaaaccgaccgacgtactaaacatactcaataacgaaccgaacgctaaaatcgaaaacctatacgcgacaaccgccgccgaaccgaccgaaacgcacgaaaaacgcgcgaaactcgctacaacgacgaccgaatcgcgacgcacccgaaccgaaaccgaaaccgaacctaacgcgacgcccgcgacccgtcaaccgcgactcctactccctcgatcccgcgcgaaaaaaaaaccgacgactattaacgtcgacgaaacgcgaaaaaaccgcgacgacgacgacgacgaccgcatccttaccgcccgccccgacccaaccgcgtcccgaaaccgtcgaacataaaaccgtaaaaacaatacgcgcaataact

SEQ ID NO: 28019 - DNA, 639 bp, Artificial Sequence
  chemically treated genomic DNA (Homo sapiens) CpG-island No: 28019
tgttgtttagggggttttgggggattttatcgtattatagtatttagttatatttttcgtaaagtcgggaagtcgtttcgagagaagattttaggacgtcgggggttgcgtgagtttcgtaaggttgtaggcgggggcgcgggattttttttttggtcgtcgttttttttcgtcggtttttttttcgcgtttcgttttcggttatagattttagtttcggtcgtcggcgcgtttttattcgcgcgtttggggatttgcggatcgtagcgagatcggtcggcgtgttgggtatgtttagtggcgggtcgggcgttggagtcggaagtttgtgcgcggtagtcgtcgtcgagtcggtcggggcgtacggagagcgcgcgggattcgttgtagcggcggtcgggtcgcggcgtattcgggtcgggatcggagtcgagtttagcgcggcgttcgcgattcgttagtcgcggtttttgttttttcgatttcgcgcggggaaagggtcggcggttgttggcgtcggcggggcgcggaggaatcgcggcggcggcggcggcggtcgtatttttgtcgttcgtttcggtttagtcgcgtttcggagtcgtcgggtatggagtcgtggaagtagtgcgcgtagtggtt

SEQ ID NO: 28020 - DNA, 639 bp, Artificial Sequence
  chemically treated genomic DNA (Homo sapiens) CpG-island No: 28020
aaccactacgcgcactacttccacgactccatacccgacgactccgaaacgcgactaaaccgaaacgaacgacaaaaatacgaccgccgccgccgccgccgcgattcctccgcgccccgccgacgccaacaaccgccgaccctttccccgcgcgaaatcgaaaaaacaaaaaccgcgactaacgaatcgcgaacgccgcgctaaactcgactccgatcccgacccgaatacgccgcgacccgaccgccgctacaacgaatcccgcgcgctctccgtacgccccgaccgactcgacgacgactaccgcgcacaaacttccgactccaacgcccgacccgccactaaacatacccaacacgccgaccgatctcgctacgatccgcaaatccccaaacgcgcgaataaaaacgcgccgacgaccgaaactaaaatctataaccgaaaacgaaacgcgaaaaaaaaaccgacgaaaaaaaacgacgaccaaaaaaaaaatcccgcgcccccgcctacaaccttacgaaactcacgcaacccccgacgtcctaaaatcttctctcgaaacgacttcccgactttacgaaaaatataactaaatactataatacgataaaatcccccaaaaccccctaaacaaca

SEQ ID NO: 28021 - DNA, 694 bp, Artificial Sequence
  chemically treated genomic DNA (Homo sapiens) CpG-island No: 28021
gacgcggcgcggattcgtattattgcgcgtagtagtcgttgtagtagtcgtcggggatcgcggagtcgggacgttttcgttcggttcgcgtttcgtttttcgttttattttcgttcgtcgggtttagtaacgtagggtgtttaggagtcgcgggttgcgtagggaggcgggtagcggttttcgcgcgtttttgtcgttttcggagtcggcgcgcggcgagcgtagggcgagcgcgcgtcgggcggcggtcgcgttggggggcgtgaggcgagcggcgcggagagcggtaggggcgaaatttcgcgggttagatgttcgagggcgcggcggcgttgttaggttgtcgttgttgtttttgcgggtttcgggcgcgttttcgtaggcggtattgttcgcggcgcggcgtgtgtatcgagcgagtgaaggtatgtgtggcgggcgcggttggagttgtcgtcgtcgtcgtcgtcgcgttagtaggttttaatgtttgttattttttaggacgttggtagtagtagtagttcggagttttcgagttttcggtaggtttgcgtgttttttttcgcgatttgattggataaagtgggggttcgacggtggtcgacgtgggatagtttggttgtggtaggggtttcggaaattatgggttattgtagtggtaggtgtacgtttatttttatttgtggtatgt

SEQ ID NO: 28022 - DNA, 694 bp, Artificial Sequence
  chemically treated genomic DNA (Homo sapiens) CpG-island No: 28022
acataccacaaataaaaataaacgtacacctaccactacaataacccataatttccgaaacccctaccacaaccaaactatcccacgtcgaccaccgtcgaacccccactttatccaatcaaatcgcgaaaaaaaacacgcaaacctaccgaaaactcgaaaactccgaactactactactaccaacgtcctaaaaaataacaaacattaaaacctactaacgcgacgacgacgacgacgacaactccaaccgcgcccgccacacataccttcactcgctcgatacacacgccgcgccgcgaacaataccgcctacgaaaacgcgcccgaaacccgcaaaaacaacaacgacaacctaacaacgccgccgcgccctcgaacatctaacccgcgaaatttcgcccctaccgctctccgcgccgctcgcctcacgccccccaacgcgaccgccgcccgacgcgcgctcgccctacgctcgccgcgcgccgactccgaaaacgacaaaaacgcgcgaaaaccgctacccgcctccctacgcaacccgcgactcctaaacaccctacgttactaaacccgacgaacgaaaataaaacgaaaaacgaaacgcgaaccgaacgaaaacgtcccgactccgcgatccccgacgactactacaacgactactacgcgcaataatacgaatccgcgccgcgtc

SEQ ID NO: 28023 - DNA, 694 bp, Artificial Sequence
  chemically treated genomic DNA (Homo sapiens) CpG-island No: 28023
gtatgttatagataaagataagcgtgtatttgttattgtaataatttatggttttcgagatttttgttatagttagattgttttacgtcggttatcgtcgagtttttattttatttaattagatcgcggggaaggatacgtaaatttgtcgagggttcgagggtttcgggttgttgttgttgttagcgttttgggaagtgataggtattaggatttgttggcgcggcggcggcggcggcggtagttttagtcgcgttcgttatatatatttttattcgttcggtgtatacgtcgcgtcgcgggtagtgtcgtttgcggaggcgcgttcggggttcgtaggggtagtagcggtagtttggtagcgtcgtcgcgttttcgggtatttggttcgcgaagtttcgtttttgtcgtttttcgcgtcgttcgttttacgttttttagcgcggtcgtcgttcgacgcgcgttcgttttgcgttcgtcgcgcgtcggtttcgggggcggtagaagcgcgcgagggtcgttgttcgtttttttgcgtagttcgcggtttttaggtattttgcgttgttgggttcggcgggcgggggtggggcggggagcggggcgcgggtcgagcgggggcgtttcggtttcgcggttttcggcggttgttgtagcggttgttgcgcgtaatgatgcgggttcgcgtcgcgtt

SEQ ID NO: 28024 - DNA, 694 bp, Artificial Sequence
  chemically treated genomic DNA (Homo sapiens) CpG-island No: 28024
aacgcgacgcgaacccgcatcattacgcgcaacaaccgctacaacaaccgccgaaaaccgcgaaaccgaaacgcccccgctcgacccgcgccccgctccccgccccacccccgcccgccgaacccaacaacgcaaaatacctaaaaaccgcgaactacgcaaaaaaacgaacaacgaccctcgcgcgcttctaccgcccccgaaaccgacgcgcgacgaacgcaaaacgaacgcgcgtcgaacgacgaccgcgctaaaaaacgtaaaacgaacgacgcgaaaaacgacaaaaacgaaacttcgcgaaccaaatacccgaaaacgcgacgacgctaccaaactaccgctactacccctacgaaccccgaacgcgcctccgcaaacgacactacccgcgacgcgacgtatacaccgaacgaataaaaatatatataacgaacgcgactaaaactaccgccgccgccgccgccgcgccaacaaatcctaatacctatcacttcccaaaacgctaacaacaacaacaacccgaaaccctcgaaccctcgacaaatttacgtatccttccccgcgatctaattaaataaaataaaaactcgacgataaccgacgtaaaacaatctaactataacaaaaatctcgaaaaccataaattattacaataacaaatacacgcttatctttatctataacatac

SEQ ID NO: 28025 - DNA, 650 bp, Artificial Sequence
  chemically treated genomic DNA (Homo sapiens) CpG-island No: 28025
tgttcggattatttgcgttagttattgtagtacgtcgggttattttggtcgggggtaggtttagggacggtgtggaatttcgattattttttcgattgtacgtttcgtagggttgtaaaatagtagttttttcgttttacgttcgttttttttagattatttcgtcgagagtgggttgtcggttgttcgttaagtaattgcgggggtattggttttggggagaaaaagtatggcgatcgattgcgttagtgtagtagcgtgtggggagaatttcggggtttgagttttgtattgttcgttgcgggattatagtcgatttcgagatcggattttttttagtcggtaggttttggaatttggattgggtgcgcggcgttttagtttaagtgcgttgcggcgcgggtagggttaatcgtttcggtatttcggtcgggggtgggtgggggcggggtcggaggaggggattttcgtagtttgtcgatagagtcggtcgggtttttcgggttttttttggcgggggcggagggtttttttcgttatcgttagtttatatttgcgttttttttagaatatgaggggatggcgttttcggtcgtcgggttttgggttttggcgtttaggttttttggtagttcgaattcggaggtttt

SEQ ID NO: 28026 - DNA, 650 bp, Artificial Sequence
  chemically treated genomic DNA (Homo sapiens) CpG-island No: 28026
aaaacctccgaattcgaactaccaaaaaacctaaacgccaaaacccaaaacccgacgaccgaaaacgccatcccctcatattctaaaaaaaacgcaaatataaactaacgataacgaaaaaaaccctccgcccccgccaaaaaaaacccgaaaaacccgaccgactctatcgacaaactacgaaaatcccctcctccgaccccgcccccacccacccccgaccgaaataccgaaacgattaaccctacccgcgccgcaacgcacttaaactaaaacgccgcgcacccaatccaaattccaaaacctaccgactaaaaaaaatccgatctcgaaatcgactataatcccgcaacgaacaatacaaaactcaaaccccgaaattctccccacacgctactacactaacgcaatcgatcgccatactttttctccccaaaaccaatacccccgcaattacttaacgaacaaccgacaacccactctcgacgaaataatctaaaaaaaacgaacgtaaaacgaaaaaactactattttacaaccctacgaaacgtacaatcgaaaaaataatcgaaattccacaccgtccctaaacctacccccgaccaaaataacccgacgtactacaataactaacgcaaataatccgaaca

SEQ ID NO: 28027 - DNA, 650 bp, Artificial Sequence
  chemically treated genomic DNA (Homo sapiens) CpG-island No: 28027
gggattttcggattcgggttgttagagggtttgagcgttagagtttaggattcggcggtcgggggcgttatttttttatgttttggagaaggcgtaaatgtgagttggcggtagcggggaaagtttttcgttttcgttaggggggattcgggaagttcggtcggttttgtcggtagattgcggggattttttttttcggtttcgtttttatttattttcggtcggggtgtcgaggcggttaattttattcgcgtcgtagcgtatttgggttagagcgtcgcgtatttaatttagattttagagtttgtcggttgggaaagattcggtttcggggtcggttatgatttcgtagcgggtaatgtagggtttaggtttcgggattttttttatacgttgttgtattggcgtagtcggtcgttatattttttttttttaaagttagtgttttcgtagttatttggcgggtagtcggtagtttattttcggcgggatgatttgggagaagcgggcgtgggacgagggggttgttgttttgtagttttgcgaggcgtgtagtcggagaagtggtcggggttttatatcgtttttgagtttgttttcggttaaggtggttcgacgtgttgtagtggttggcgtaggtgattcgggta

SEQ ID NO: 28028 - DNA, 650 bp, Artificial Sequence
  chemically treated genomic DNA (Homo sapiens) CpG-island No: 28028
tacccgaatcacctacgccaaccactacaacacgtcgaaccaccttaaccgaaaacaaactcaaaaacgatataaaaccccgaccacttctccgactacacgcctcgcaaaactacaaaacaacaaccccctcgtcccacgcccgcttctcccaaatcatcccgccgaaaataaactaccgactacccgccaaataactacgaaaacactaactttaaaaaaaaaaaatataacgaccgactacgccaatacaacaacgtataaaaaaaatcccgaaacctaaaccctacattacccgctacgaaatcataaccgaccccgaaaccgaatctttcccaaccgacaaactctaaaatctaaattaaatacgcgacgctctaacccaaatacgctacgacgcgaataaaattaaccgcctcgacaccccgaccgaaaataaataaaaacgaaaccgaaaaaaaaaatccccgcaatctaccgacaaaaccgaccgaacttcccgaatcccccctaacgaaaacgaaaaactttccccgctaccgccaactcacatttacgccttctccaaaacataaaaaaataacgcccccgaccgccgaatcctaaactctaacgctcaaaccctctaacaacccgaatccgaaaatccc

SEQ ID NO: 28029 - DNA, 1389 bp, Artificial Sequence
  chemically treated genomic DNA (Homo sapiens) CpG-island No: 28029
gtttcgtagcggcgaacgtttcgcgcggttttcgtcgttcgtcggggaatgcgtagggtcgcggtttcgcgcggcgtcgattttttttttttttttaatttttttttttttttttttttcgaggcgatagaaataatagcgcgggaggaggggaaagtaattttcggtattttcgtcggaattagtttcggtgtagtgatgatattttttcgtggcgtaattaagtttcgtttttttcgtagcggcgttttcgtcgtcgtcgttttttttatttgaaagtggttatttttcgtcgcggtagtttttttcgtttcgtcgtcgttagttgtattaattcgttcggttttagttgtaaattaaacgttttttcgcgtttagaagttatttgcgtcgttggaaacggtcgcgtcgttttttttttcgagttttttcggggcggtattttcgggttggggcgggcgcgtcggcgagaaacggttttaagatgggagcggtagcggcggcgaggagtttcgagcgggttcggttttcgttttcgttttcgtttttagatagttttggaaattgtgtattatttttgttataggaagttattcggcgaggaaggcggcgcggaattaataaataaacgtttgcggtcgttcgtcggaatcggcgcggggatcgcgtcgggtttcgggtcgttttcggggcgggggcgtagcggttattttcgcgtcgcgggttttgtgcggggcgggcgcggcgggtcgggcgttttcgttttcgtaattttttatttcggttcgggcggcgtagttgggatcgttaggtgacgtttcggtcgtagcggagaagtagcgtttcggtcgtcgttcgtttttatttttatattgggtcgtttttttttaaatattagaggcgggttataaaagttggtttcggggttatttagtatttgtttacgtgtcgcggaggttcgttttcgagtttttttcggttttttttttcgtcgttttcggtcgttaggttatttattatcggtgggaggggagagaggttgttatttaaacgttcgcggaagttgaggtatttttattggcgggtgtcgtgtatttgtttttcgtcgtcgcgtttcgttattttgagtagtagtcgcgtttttagtttcgttttttgttcgaaggcgggcgggggggagcgggaaggaggtggaagggatcgaatttttttagtaaatgggatcgtttcgataggattcggtttttcggttaatattttatattttatttttttttcgtatttgtaagttaatgtcgagtaattcggaaagtttgttggttatcgaataatagtttttaattcgtaaatatagatttataggtataagatacgtgtattgaagggttt

SEQ ID NO: 28030 - DNA, 1389 bp, Artificial Sequence
  chemically treated genomic DNA (Homo sapiens) CpG-island No: 28030
aaacccttcaatacacgtatcttatacctataaatctatatttacgaattaaaaactattattcgataaccaacaaactttccgaattactcgacattaacttacaaatacgaaaaaaaaataaaatataaaatattaaccgaaaaaccgaatcctatcgaaacgatcccatttactaaaaaaattcgatcccttccacctccttcccgctcccccccgcccgccttcgaacaaaaaacgaaactaaaaacgcgactactactcaaaataacgaaacgcgacgacgaaaaacaaatacacgacacccgccaataaaaatacctcaacttccgcgaacgtttaaataacaacctctctcccctcccaccgataataaataacctaacgaccgaaaacgacgaaaaaaaaaaccgaaaaaaactcgaaaacgaacctccgcgacacgtaaacaaatactaaataaccccgaaaccaacttttataacccgcctctaatatttaaaaaaaaacgacccaatataaaaataaaaacgaacgacgaccgaaacgctacttctccgctacgaccgaaacgtcacctaacgatcccaactacgccgcccgaaccgaaataaaaaattacgaaaacgaaaacgcccgacccgccgcgcccgccccgcacaaaacccgcgacgcgaaaataaccgctacgcccccgccccgaaaacgacccgaaacccgacgcgatccccgcgccgattccgacgaacgaccgcaaacgtttatttattaattccgcgccgccttcctcgccgaataacttcctataacaaaaataatacacaatttccaaaactatctaaaaacgaaaacgaaaacgaaaaccgaacccgctcgaaactcctcgccgccgctaccgctcccatcttaaaaccgtttctcgccgacgcgcccgccccaacccgaaaataccgccccgaaaaaactcgaaaaaaaaaacgacgcgaccgtttccaacgacgcaaataacttctaaacgcgaaaaaacgtttaatttacaactaaaaccgaacgaattaatacaactaacgacgacgaaacgaaaaaaactaccgcgacgaaaaataaccactttcaaataaaaaaaacgacgacgacgaaaacgccgctacgaaaaaaacgaaacttaattacgccacgaaaaaatatcatcactacaccgaaactaattccgacgaaaataccgaaaattactttcccctcctcccgcgctattatttctatcgcctcgaaaaaaaaaaaaaaaaaaaaattaaaaaaaaaaaaaaaatcgacgccgcgcgaaaccgcgaccctacgcattccccgacgaacgacgaaaaccgcgcgaaacgttcgccgctacgaaac

SEQ ID NO: 28031 - DNA, 1389 bp, Artificial Sequence
  chemically treated genomic DNA (Homo sapiens) CpG-island No: 28031
gagttttttagtgtacgtgttttgtgtttgtgagtttgtgtttgcgagttgggggttgttgttcggtagttagtaggtttttcgggttgttcggtattggtttgtaaatgcgggagagggatggaatgtggaatgttgatcggggaatcgaattttgtcggaacggttttatttgttggagaaattcgattttttttatttttttttcgttttttttcgttcgttttcgggtaggaggcggggttgaggacgcggttgttgtttaaagtggcggagcgcggcggcgggaggtaggtgtacggtattcgttagtgggggtgttttaattttcgcgggcgtttaaatagtagtttttttttttttttatcggtaataggtgatttggcggtcgagggcggcgggggagggaatcgggggagattcgggagcgagttttcgcggtacgtgggtaggtgttgggtggtttcggggttaatttttgtagttcgtttttggtgtttgaggagaggcggtttagtgtggaaatgggggcgggcggcggtcgaggcgttgttttttcgttgcggtcggagcgttatttaacggttttagttgcgtcgttcgggtcggggtggggggttgcgggggcggggacgttcggttcgtcgcgttcgtttcgtataaagttcgcggcgcgggggtggtcgttgcgttttcgtttcgggaacggttcgaagttcgacgcggttttcgcgtcggtttcggcgggcggtcgtaggcgtttgtttgttggtttcgcgtcgtttttttcgtcggatggttttttgtgatagaggtgatatatagtttttagaattgtttgggggcgggagcgggagcgggagtcgagttcgttcggagtttttcgtcgtcgttgtcgtttttattttaaaatcgtttttcgtcggcgcgttcgttttagttcgaaggtgtcgtttcggagggattcggggagggggacggcgcggtcgtttttagcggcgtaagtggtttttggacgcgagggagcgtttgatttgtaattggggtcgagcggattggtgtagttggcggcggcggggcgggaggagttgtcgcggcggggggtggttatttttaaatggagagggcggcggcggcggggacgtcgttgcggagggagcggggtttggttgcgttacgagaaggtgttattattgtatcggggttaatttcggcggaggtgtcgggagttattttttttttttttcgcgttgttgtttttgtcgtttcgggaggaggaggaggaggaggattgggagagagggaggggtcggcgtcgcgcggaatcgcggttttgcgtatttttcggcgggcggcgggagtcgcgcggagcgttcgtcgttgcggggt

SEQ ID NO: 28032 - DNA, 1389 bp, Artificial Sequence
  chemically treated genomic DNA (Homo sapiens) CpG-island No: 28032
accccgcaacgacgaacgctccgcgcgactcccgccgcccgccgaaaaatacgcaaaaccgcgattccgcgcgacgccgacccctccctctctcccaatcctcctcctcctcctcctcccgaaacgacaaaaacaacaacgcgaaaaaaaaaaaaaataactcccgacacctccgccgaaattaaccccgatacaataataacaccttctcgtaacgcaaccaaaccccgctccctccgcaacgacgtccccgccgccgccgccctctccatttaaaaataaccaccccccgccgcgacaactcctcccgccccgccgccgccaactacaccaatccgctcgaccccaattacaaatcaaacgctccctcgcgtccaaaaaccacttacgccgctaaaaacgaccgcgccgtccccctccccgaatccctccgaaacgacaccttcgaactaaaacgaacgcgccgacgaaaaacgattttaaaataaaaacgacaacgacgacgaaaaactccgaacgaactcgactcccgctcccgctcccgcccccaaacaattctaaaaactatatatcacctctatcacaaaaaaccatccgacgaaaaaaacgacgcgaaaccaacaaacaaacgcctacgaccgcccgccgaaaccgacgcgaaaaccgcgtcgaacttcgaaccgttcccgaaacgaaaacgcaacgaccacccccgcgccgcgaactttatacgaaacgaacgcgacgaaccgaacgtccccgcccccgcaaccccccaccccgacccgaacgacgcaactaaaaccgttaaataacgctccgaccgcaacgaaaaaacaacgcctcgaccgccgcccgcccccatttccacactaaaccgcctctcctcaaacaccaaaaacgaactacaaaaattaaccccgaaaccacccaacacctacccacgtaccgcgaaaactcgctcccgaatctcccccgattccctcccccgccgccctcgaccgccaaatcacctattaccgataaaaaaaaaaaaaaactactatttaaacgcccgcgaaaattaaaacacccccactaacgaataccgtacacctacctcccgccgccgcgctccgccactttaaacaacaaccgcgtcctcaaccccgcctcctacccgaaaacgaacgaaaaaaaacgaaaaaaaaataaaaaaaatcgaatttctccaacaaataaaaccgttccgacaaaattcgattccccgatcaacattccacattccatccctctcccgcatttacaaaccaataccgaacaacccgaaaaacctactaactaccgaacaacaacccccaactcgcaaacacaaactcacaaacacaaaacacgtacactaaaaaactc

SEQ ID NO: 28033 - DNA, 589 bp, Artificial Sequence
  chemically treated genomic DNA (Homo sapiens) CpG-island No: 28033
gtagcgttcgtttttagttttgcgttcgcgcgagtaattcgacgttttttcgtttcgtcggtcgcgttttcgttttcgtcgtttcgttttttgtttaggcgtgcgcgcgtattttacgggggcgcgttcggtcggcggggtcgcgtacgtagtcgtcgttattatttttttttttttttttttttttgcgggtttttttttttttttttttttttcgttttttttttcgtaggtagttcgttcgttagttcgttcgtatcgttttttttttagtttttagcgtttcggttgggtttttttttcgttttttaggttttttcggtcgttttttttcggcggtcgttcgcgttcggtggatgtggttggtagttgtcgttttttttttcgttcgtcgtttgttttttttcggtttttcgttttttttttttttttttttcgtttttagtcgtttttttcgtcgtcgtttttatagtttgggtttcgtcgcgatgtcggagaagaggtttttcgagcggttgtttgtcgatgttttttttattaattatagtttttgttttaagttcgatttgttggattttattttcgaggg

SEQ ID NO: 28034 - DNA, 589 bp, Artificial Sequence
  chemically treated genomic DNA (Homo sapiens) CpG-island No: 28034
ccctcgaaaataaaatccaacaaatcgaacttaaaacaaaaactataattaataaaaaaaacatcgacaaacaaccgctcgaaaaacctcttctccgacatcgcgacgaaacccaaactataaaaacgacgacgaaaaaaacgactaaaaacgaaaaaaaaaaaaaaaaaaaacgaaaaaccgaaaaaaaacaaacgacgaacgaaaaaaaaaacgacaactaccaaccacatccaccgaacgcgaacgaccgccgaaaaaaaacgaccgaaaaaacctaaaaaacgaaaaaaaaacccaaccgaaacgctaaaaactaaaaaaaaaacgatacgaacgaactaacgaacgaactacctacgaaaaaaaaaacgaaaaaaaaaaaaaaaaaaaaaaacccgcaaaaaaaaaaaaaaaaaaaaaaataataacgacgactacgtacgcgaccccgccgaccgaacgcgcccccgtaaaatacgcgcgcacgcctaaacaaaaaacgaaacgacgaaaacgaaaacgcgaccgacgaaacgaaaaaacgtcgaattactcgcgcgaacgcaaaactaaaaacgaacgctac

SEQ ID NO: 28035 - DNA, 589 bp, Artificial Sequence
  chemically treated genomic DNA (Homo sapiens) CpG-island No: 28035
ttttcgaaggtgaagtttagtaagtcgggtttgaggtaaaggttgtagttgatgggggagatatcggtaggtagtcgttcgaagggtttttttttcggtatcgcggcgaggtttaggttgtggaggcggcggcgagaggagcggttgaagacgagaaggaggaggggaggaggcggagggtcgaggaagagtaggcggcgagcgagggagggggcggtagttgttagttatatttatcgagcgcgggcgatcgtcggaggagagcgatcgggggagtttggggggcgggggagagatttagtcggagcgttaggggttgggaaggaggcggtgcgggcggattggcgggcgggttgtttacggggaagggggcggaggggagggaaggggaggagggttcgtaaggagggagggagagggggaagtggtggcggcggttgcgtgcgcggtttcgtcggtcgggcgcgttttcgtggagtgcgcgcgtacgtttgggtagagggcggagcggcgaggacgagggcgcggtcggcggggcgggagggcgtcgggttgttcgcgcgagcgtagggttggaggcgggcgttgt

SEQ ID NO: 28036 - DNA, 589 bp, Artificial Sequence
  chemically treated genomic DNA (Homo sapiens) CpG-island No: 28036
acaacgcccgcctccaaccctacgctcgcgcgaacaacccgacgccctcccgccccgccgaccgcgccctcgtcctcgccgctccgccctctacccaaacgtacgcgcgcactccacgaaaacgcgcccgaccgacgaaaccgcgcacgcaaccgccgccaccacttccccctctccctccctccttacgaaccctcctccccttccctcccctccgcccccttccccgtaaacaacccgcccgccaatccgcccgcaccgcctccttcccaacccctaacgctccgactaaatctctcccccgccccccaaactcccccgatcgctctcctccgacgatcgcccgcgctcgataaatataactaacaactaccgccccctccctcgctcgccgcctactcttcctcgaccctccgcctcctcccctcctccttctcgtcttcaaccgctcctctcgccgccgcctccacaacctaaacctcgccgcgataccgaaaaaaaaacccttcgaacgactacctaccgatatctcccccatcaactacaacctttacctcaaacccgacttactaaacttcaccttcgaaaa

SEQ ID NO: 28037 - DNA, 513 bp, Artificial Sequence
  chemically treated genomic DNA (Homo sapiens) CpG-island No: 28037
tgataaatcgttatttgggttttggacggttacggttacggttagggttgcggttatatatcgtgggtttcgttttcgtttttatttacgtgtacgtaaagcgtcgcgcgtcggttcgtaggtttaggattcggggatttttttgcgttttttacgcggcggcgtttttgggtcgttttggttgttgtcgtttagtcgcgagttcgggtttcggggagcgttatggcgtttagcgtagcgcggcgtattgattcgagtaggagacgcgcgtagggattattgtgagtgcgtagtcggcggaaggaagaggggttgcgtgatcgcgcgataagagggttcgggttcggggttgcggcgttatttgtcgggcgttcgggcgtttattgcggttttttgtcggttttttttttaggtcgcgaggcgggttgtttgttttttggtattttgtgttcgggcgagttttcggatttatttaggagtttttagtttgtttagttaattttttgatatttg

SEQ ID NO: 28038 - DNA, 513 bp, Artificial Sequence
  chemically treated genomic DNA (Homo sapiens) CpG-island No: 28038
caaatatcaaaaaattaactaaacaaactaaaaactcctaaataaatccgaaaactcgcccgaacacaaaataccaaaaaacaaacaacccgcctcgcgacctaaaaaaaaaaccgacaaaaaaccgcaataaacgcccgaacgcccgacaaataacgccgcaaccccgaacccgaaccctcttatcgcgcgatcacgcaacccctcttccttccgccgactacgcactcacaataatccctacgcgcgtctcctactcgaatcaatacgccgcgctacgctaaacgccataacgctccccgaaacccgaactcgcgactaaacgacaacaaccaaaacgacccaaaaacgccgccgcgtaaaaaacgcaaaaaaatccccgaatcctaaacctacgaaccgacgcgcgacgctttacgtacacgtaaataaaaacgaaaacgaaacccacgatatataaccgcaaccctaaccgtaaccgtaaccgtccaaaacccaaataacgatttatca

SEQ ID NO: 28039 - DNA, 513 bp, Artificial Sequence
  chemically treated genomic DNA (Homo sapiens) CpG-island No: 28039
taaatgttaaggaattgattgaataaattaagagtttttggatgggttcgggaattcgttcgggtataaggtgttaaaaggtaagtagttcgtttcgcggtttggggaaagaatcgataggaggtcgtagtgagcgttcgggcgttcggtaggtggcgtcgtagtttcgggttcgggtttttttgtcgcgcggttacgtagtttttttttttttcgtcggttgcgtatttatagtgatttttgcgcgcgttttttgttcgggttagtgcgtcgcgttgcgttgggcgttatggcgtttttcggagttcgggttcgcggttgggcggtagtagttagagcggtttagaggcgtcgtcgcgtggagaacgtaggagggttttcgagttttgagtttgcgggtcggcgcgcggcgttttacgtatacgtgagtaggggcgggggcggagtttacggtgtgtggtcgtagttttggtcgtgatcgtggtcgtttaaaatttaggtggcggtttgtta

SEQ ID NO: 28040 - DNA, 513 bp, Artificial Sequence
  chemically treated genomic DNA (Homo sapiens) CpG-island No: 28040
taacaaaccgccacctaaattttaaacgaccacgatcacgaccaaaactacgaccacacaccgtaaactccgcccccgcccctactcacgtatacgtaaaacgccgcgcgccgacccgcaaactcaaaactcgaaaaccctcctacgttctccacgcgacgacgcctctaaaccgctctaactactaccgcccaaccgcgaacccgaactccgaaaaacgccataacgcccaacgcaacgcgacgcactaacccgaacaaaaaacgcgcgcaaaaatcactataaatacgcaaccgacgaaaaaaaaaaaaactacgtaaccgcgcgacaaaaaaacccgaacccgaaactacgacgccacctaccgaacgcccgaacgctcactacgacctcctatcgattctttccccaaaccgcgaaacgaactacttaccttttaacaccttatacccgaacgaattcccgaacccatccaaaaactcttaatttattcaatcaattccttaacattta

SEQ ID NO: 28041 - DNA, 534 bp, Artificial Sequence
  chemically treated genomic DNA (Homo sapiens) CpG-island No: 28041
cgcggtagggggtttcgggatttcgcgttgtttcgtagagttcggtattttcgtaggtcgcgtttatcgcgcgtcggtttttttggtttttaggttttttcgggacgcggtttcgtaggtaattagggaaacgcgtcgttatggtaacgtgcgcgttacgtcgggagttttttttaattcgcggttttttttgtcggagtttttggtagtttcggtcgttattattcgcgttattttcgcgtttcgtttttgtcgaaatggagtgggatttcgaattttagtttcgggcgagggttcgtagtgatttagttttttacgtcgcgtcgcgttgcgggttttgtgcgtcgcgggttttcgggcggtgttgtaggcgttggacgcgggttcggcgggcgtgttagtcgcgcggagttaaaacggttagatttgtaaagggatcgttttattttttcgtttgtcggaatttttaattttttacgtgtatgtatggtacggttggtgagtttcgagtaatagatatagaatttgaacgtt

SEQ ID NO: 28042 - DNA, 534 bp, Artificial Sequence
  chemically treated genomic DNA (Homo sapiens) CpG-island No: 28042
aacgttcaaattctatatctattactcgaaactcaccaaccgtaccatacatacacgtaaaaaattaaaaattccgacaaacgaaaaaataaaacgatccctttacaaatctaaccgttttaactccgcgcgactaacacgcccgccgaacccgcgtccaacgcctacaacaccgcccgaaaacccgcgacgcacaaaacccgcaacgcgacgcgacgtaaaaaactaaatcactacgaaccctcgcccgaaactaaaattcgaaatcccactccatttcgacaaaaacgaaacgcgaaaataacgcgaataataacgaccgaaactaccaaaaactccgacaaaaaaaaccgcgaattaaaaaaaactcccgacgtaacgcgcacgttaccataacgacgcgtttccctaattacctacgaaaccgcgtcccgaaaaaacctaaaaaccaaaaaaaccgacgcgcgataaacgcgacctacgaaaataccgaactctacgaaacaacgcgaaatcccgaaaccccctaccgcg

SEQ ID NO: 28043 - DNA, 534 bp, Artificial Sequence
  chemically treated genomic DNA (Homo sapiens) CpG-island No: 28043
aacgtttagattttatatttattattcgaagtttattagtcgtgttatgtatgtacgtaggaaattagagatttcgatagacgggagggtgggacggtttttttgtaaatttggtcgttttggtttcgcgcggttggtacgttcgtcgggttcgcgtttagcgtttgtagtatcgttcgggagttcgcggcgtatagagttcgtagcgcggcgcggcgtggggggttaagttattgcgaattttcgttcggagttggggttcggggttttattttatttcggtaggagcggggcgcgagggtggcgcgggtagtggcgatcgggattgttaggggtttcggtaaaggaggtcgcgggttgggaggggttttcgacgtggcgcgtacgttattatggcgacgcgtttttttggttatttgcggggtcgcgtttcggaggagtttgagggttaagagggtcggcgcgcggtgggcgcggtttgcggggatgtcgggttttacggagtagcgcggggtttcgaagttttttatcgcg

SEQ ID NO: 28044 - DNA, 534 bp, Artificial Sequence
  chemically treated genomic DNA (Homo sapiens) CpG-island No: 28044
cgcgataaaaaacttcgaaaccccgcgctactccgtaaaacccgacatccccgcaaaccgcgcccaccgcgcgccgaccctcttaaccctcaaactcctccgaaacgcgaccccgcaaataaccaaaaaaacgcgtcgccataataacgtacgcgccacgtcgaaaacccctcccaacccgcgacctcctttaccgaaacccctaacaatcccgatcgccactacccgcgccaccctcgcgccccgctcctaccgaaataaaataaaaccccgaaccccaactccgaacgaaaattcgcaataacttaaccccccacgccgcgccgcgctacgaactctatacgccgcgaactcccgaacgatactacaaacgctaaacgcgaacccgacgaacgtaccaaccgcgcgaaaccaaaacgaccaaatttacaaaaaaaccgtcccaccctcccgtctatcgaaatctctaatttcctacgtacatacataacacgactaataaacttcgaataataaatataaaatctaaacgtt

SEQ ID NO: 28045 - DNA, 1332 bp, Artificial Sequence
  chemically treated genomic DNA (Homo sapiens) CpG-island No: 28045
gtagaatagcgtcgcgggtattacgtgaaattttcggggtcggttgggggcgggggacgaggggcgtttattcgggggtcggtagtttgtaggtgcgatgggcggtttttttatttacgtttattcggattggagttcgtcgttttcggtcgggttttcgggtggttcgcgttttttttgaattggtagcgaggtcgcggtaggttcgaggtaaatcggacgaagaggggaaaaagttttaggggtttgggggttttcgcgttttaggggaggtaagggtcgggttagaggcgcgagggtgggtgagggattttcgtcgcggggtcgggatcggggttcgggtagtgggttttgtttcgcgcgtttacgcgggtcgttttatcgtggttttgtaggatttcgtgtttgagatcgtcggtgtagtcgatgagtttttttaggtcgcgttcgtatagttgttcgtagttcgagaatttgtgtagtattttttttagttcgcgttttatcgttacgtattgatttatgtcggaggcggcggcgttcggtttttcggcgtttaggtgttcgtagtcgttcggttcgggtttcgtcgaggtcgcgttttgtttttcgttttttaagcgggcggcgcgggaggttgaggcggtcgaggcggcgggcgtattagtcgcggcgtcgggggagtttcgcgtagtcggagttcgtttgttttatggcgttttagttttttggcgagtcgtcgttgttttcgttcgttcgttgtattcggtttcgcgtttttaggtttcgttcgcgacgttcgggtgtttgcgacggcgcggtcgattgtttttgtttttacgggaatcgatcgatgatttggttttttcgggcggtattaagtgtcgtcgattggggggagggggatggttattcgggcgaggaaaggaggcggagcgggtcgtattaagtatattttcggggtggggggtgcgattcggcgagaacgggcggaggaacgcgacgggcgtttatacgcgtcgttattttaatggtgtgcgtcgtattatacggaaggcgtgcgagggagagggcgagggtggagcgaggttttaattggtttgaggagttaaatagggaattttggagatagttttagcgttcggagagcgtaataattacgcgttttataaataaggaggcggaaatcggtttttattatttcgtttagaagcggggaattttaattaatgggcgcggggagtggtaagaagttaatttttggtcgaggcgtaagtttttagttaattcgggttgaggggttaaattaacgggttcgttgttggagggggt

SEQ ID NO: 28046 - DNA, 1332 bp, Artificial Sequence
  chemically treated genomic DNA (Homo sapiens) CpG-island No: 28046
accccctccaacaacgaacccgttaatttaacccctcaacccgaattaactaaaaacttacgcctcgaccaaaaattaacttcttaccactccccgcgcccattaattaaaattccccgcttctaaacgaaataataaaaaccgatttccgcctccttatttataaaacgcgtaattattacgctctccgaacgctaaaactatctccaaaattccctatttaactcctcaaaccaattaaaacctcgctccaccctcgccctctccctcgcacgccttccgtataatacgacgcacaccattaaaataacgacgcgtataaacgcccgtcgcgttcctccgcccgttctcgccgaatcgcaccccccaccccgaaaatatacttaatacgacccgctccgcctcctttcctcgcccgaataaccatccccctccccccaatcgacgacacttaataccgcccgaaaaaaccaaatcatcgatcgattcccgtaaaaacaaaaacaatcgaccgcgccgtcgcaaacacccgaacgtcgcgaacgaaacctaaaaacgcgaaaccgaatacaacgaacgaacgaaaacaacgacgactcgccaaaaaactaaaacgccataaaacaaacgaactccgactacgcgaaactcccccgacgccgcgactaatacgcccgccgcctcgaccgcctcaacctcccgcgccgcccgcttaaaaaacgaaaaacaaaacgcgacctcgacgaaacccgaaccgaacgactacgaacacctaaacgccgaaaaaccgaacgccgccgcctccgacataaatcaatacgtaacgataaaacgcgaactaaaaaaaatactacacaaattctcgaactacgaacaactatacgaacgcgacctaaaaaaactcatcgactacaccgacgatctcaaacacgaaatcctacaaaaccacgataaaacgacccgcgtaaacgcgcgaaacaaaacccactacccgaaccccgatcccgaccccgcgacgaaaatccctcacccaccctcgcgcctctaacccgacccttacctcccctaaaacgcgaaaacccccaaacccctaaaactttttcccctcttcgtccgatttacctcgaacctaccgcgacctcgctaccaattcaaaaaaaacgcgaaccacccgaaaacccgaccgaaaacgacgaactccaatccgaataaacgtaaataaaaaaaccgcccatcgcacctacaaactaccgacccccgaataaacgcccctcgtcccccgcccccaaccgaccccgaaaatttcacgtaatacccgcgacgctattctac

SEQ ID NO: 28047 - DNA, 1332 bp, Artificial Sequence
  chemically treated genomic DNA (Homo sapiens) CpG-island No: 28047
attttttttaatagcgagttcgttggtttggttttttagttcggattggttgaaggtttacgtttcggttagggattggttttttattatttttcgcgtttattggttgggatttttcgtttttgggcggagtggtgagggtcggttttcgtttttttgtttatggagcgcgtagttgttgcgtttttcgagcgttggggttgtttttaaagttttttatttagttttttaggttaattggggtttcgttttattttcgttttttttttcgtacgtttttcgtgtggtacggcgtatattattagagtggcggcgcgtgtgggcgttcgtcgcgttttttcgttcgttttcgtcgggtcgtattttttatttcgagggtgtatttggtacggttcgtttcgtttttttttttcgttcgggtggttatttttttttttttagtcggcggtatttggtgtcgttcgggagaattaggttatcggtcggttttcgtgaaaataaaaataatcggtcgcgtcgtcgtaggtattcgaacgtcgcgagcggggtttggggacgcggggtcgagtgtagcgagcgaacgggagtagcggcgattcgttagggggttagggcgttatggggtaggcgggtttcggttgcgcggggttttttcggcgtcgcggttagtgcgttcgtcgtttcggtcgttttagtttttcgcgtcgttcgtttggggaacgaggagtaggacgcggtttcggcggggttcgggtcgaacggttgcggatatttgggcgtcgaggagtcgagcgtcgtcgttttcggtatggattagtgcgtgacggtggagcgcgagttggagaaggtgttgtataagttttcgggttacgggtagttgtgcgagcgcggtttggaggagtttatcgattatatcggcggttttaagtacgagattttgtagagttacggtagggcggttcgcgtgggcgcgcggggtagggtttattgttcgagtttcggtttcggtttcgcggcgggaattttttatttattttcgcgtttttggttcggtttttgttttttttgaggcgcggaggtttttagatttttgagattttttttttttttcgttcgatttatttcgaatttgtcgcgatttcgttgttaatttagaaggagcgcgaattattcggaaattcggtcgggagcggcgggttttagttcggataaacgtgggtgagggggtcgtttatcgtatttgtaaattgtcgattttcgagtgggcgtttttcgtttttcgtttttagtcggtttcgggagttttacgtggtgttcgcggcgttgttttgt

SEQ ID NO: 28048 - DNA, 1332 bp, Artificial Sequence
  chemically treated genomic DNA (Homo sapiens) CpG-island No: 28048
acaaaacaacgccgcgaacaccacgtaaaactcccgaaaccgactaaaaacgaaaaacgaaaaacgcccactcgaaaatcgacaatttacaaatacgataaacgaccccctcacccacgtttatccgaactaaaacccgccgctcccgaccgaatttccgaataattcgcgctccttctaaattaacaacgaaatcgcgacaaattcgaaataaatcgaacgaaaaaaaaaaaaaatctcaaaaatctaaaaacctccgcgcctcaaaaaaaacaaaaaccgaaccaaaaacgcgaaaataaataaaaaattcccgccgcgaaaccgaaaccgaaactcgaacaataaaccctaccccgcgcgcccacgcgaaccgccctaccgtaactctacaaaatctcgtacttaaaaccgccgatataatcgataaactcctccaaaccgcgctcgcacaactacccgtaacccgaaaacttatacaacaccttctccaactcgcgctccaccgtcacgcactaatccataccgaaaacgacgacgctcgactcctcgacgcccaaatatccgcaaccgttcgacccgaaccccgccgaaaccgcgtcctactcctcgttccccaaacgaacgacgcgaaaaactaaaacgaccgaaacgacgaacgcactaaccgcgacgccgaaaaaaccccgcgcaaccgaaacccgcctaccccataacgccctaaccccctaacgaatcgccgctactcccgttcgctcgctacactcgaccccgcgtccccaaaccccgctcgcgacgttcgaatacctacgacgacgcgaccgattatttttattttcacgaaaaccgaccgataacctaattctcccgaacgacaccaaataccgccgactaaaaaaaaaaaaataaccacccgaacgaaaaaaaaaaacgaaacgaaccgtaccaaatacaccctcgaaataaaaaatacgacccgacgaaaacgaacgaaaaaacgcgacgaacgcccacacgcgccgccactctaataatatacgccgtaccacacgaaaaacgtacgaaaaaaaaaacgaaaataaaacgaaaccccaattaacctaaaaaactaaataaaaaactttaaaaacaaccccaacgctcgaaaaacgcaacaactacgcgctccataaacaaaaaaacgaaaaccgaccctcaccactccgcccaaaaacgaaaaatcccaaccaataaacgcgaaaaataataaaaaaccaatccctaaccgaaacgtaaaccttcaaccaatccgaactaaaaaaccaaaccaacgaactcgctattaaaaaaaat

SEQ ID NO: 28049 - DNA, 984 bp, Artificial Sequence
  chemically treated genomic DNA (Homo sapiens) CpG-island No: 28049
ttttagacgtttgcgcggggtttgttttatcgcgtttattttaggagttacgtttggagagggatattttggagggacgtcgttcgacgttttgtttttttgcgtagtttttttgcgtttggcgaagaagtttgcgggcgataacgcgcgtcggttagggcggggtcggtttagagattcgcgaggagattcgcggagtgcgtacggcgcggggtcggggtgggggcgttattttcgttcgcgtcgaggttcgcggcgggttagttttgtttacgtcgtcgcgtaatgtgttgtgtaagtatttttttttgtttcgcggttaagtttttcggggttgtcgtcgtatttaattttttttatgtcgtatatacggcgtttttaaggggttttcgcggttcgagttaaagatcgcgattcgagtgggtcgcggttaggttcgtttttttattgtacgttcgggagttttagttgtatttttattagtaggaaaggggtgcgggcgtaatcgcgttttaagcgtcgcgggttttttaatgttacgggaggaggcggggatcgggcgaggttttcgagggcgagggagagttcggtcggtcggataaagcgaggtcgggtcggggcggggtcgtgcggggtttatcggagatgagaggtttcgatagttttttgatcgtatcgttcgtattggtcgtagtagtttcgggtgtaggacgttttggaattttcgagagaggttggttttttagtttttggtcgcgttgtttttgattttcgttttgtttttcgatcggttttttattttgtttttcgatcggtttcgtattttgtttttcgatcggtttcgcgttttgtttttttttcggtttttcgttttttttttcgatcggttttgcgttttgtttttcgttttgtttagagatcggtttagtttttagtttattattcggtttagtattcgatttttcgttttgtttagagatttgt

SEQ ID NO: 28050 - DNA, 984 bp, Artificial Sequence
  chemically treated genomic DNA (Homo sapiens) CpG-island No: 28050
acaaatctctaaacaaaacgaaaaatcgaatactaaaccgaataataaactaaaaactaaaccgatctctaaacaaaacgaaaaacaaaacgcaaaaccgatcgaaaaaaaaaacgaaaaaccgaaaaaaaaacaaaacgcgaaaccgatcgaaaaacaaaatacgaaaccgatcgaaaaacaaaataaaaaaccgatcgaaaaacaaaacgaaaatcaaaaacaacgcgaccaaaaactaaaaaaccaacctctctcgaaaattccaaaacgtcctacacccgaaactactacgaccaatacgaacgatacgatcaaaaaactatcgaaacctctcatctccgataaaccccgcacgaccccgccccgacccgacctcgctttatccgaccgaccgaactctccctcgccctcgaaaacctcgcccgatccccgcctcctcccgtaacattaaaaaacccgcgacgcttaaaacgcgattacgcccgcacccctttcctactaataaaaatacaactaaaactcccgaacgtacaataaaaaaacgaacctaaccgcgacccactcgaatcgcgatctttaactcgaaccgcgaaaaccccttaaaaacgccgtatatacgacataaaaaaaattaaatacgacgacaaccccgaaaaacttaaccgcgaaacaaaaaaaaatacttacacaacacattacgcgacgacgtaaacaaaactaacccgccgcgaacctcgacgcgaacgaaaataacgcccccaccccgaccccgcgccgtacgcactccgcgaatctcctcgcgaatctctaaaccgaccccgccctaaccgacgcgcgttatcgcccgcaaacttcttcgccaaacgcaaaaaaactacgcaaaaaaacaaaacgtcgaacgacgtccctccaaaatatccctctccaaacgtaactcctaaaataaacgcgataaaacaaaccccgcgcaaacgtctaaaa

SEQ ID NO: 28051 - DNA, 984 bp, Artificial Sequence
  chemically treated genomic DNA (Homo sapiens) CpG-island No: 28051
gtaggtttttgagtagggcgaggagtcgggtgttgagtcgggtgatgagttgggaattgagtcggtttttgagtagggcgaggagtagggcgtagagtcggtcgaggagaaggacgaggagtcggaggaggagtagggcgcggagtcggtcgaggagtagggtgcggagtcggtcgaggagtagaatggggagtcggtcgaggagtaggacgagaattaagagtagcgcggttaggagttgaaggattagtttttttcggggattttaggacgttttgtattcgggattgttgcggttaatgcgaacggtgcgattaagaagttgtcggggttttttattttcggtgagtttcgtacggtttcgtttcggttcggtttcgttttgttcggtcggtcgggttttttttcgttttcgggggtttcgttcggttttcgttttttttcgtggtattaaagggttcgcggcgtttagggcgcggttgcgttcgtattttttttttattggtaggggtgtagttaaggttttcgagcgtgtagtgggagggcgagtttggtcgcgatttattcggatcgcggtttttggttcgggtcgcgggagttttttagggacgtcgtgtgtgcggtatggagggggttaagtgcggcggtagtttcggggggtttggtcgcgggataaggggaaatgtttatatagtatattgcgcggcgacgtaaataaagttgattcgtcgcggatttcggcgcgggcggggatggcgtttttatttcggtttcgcgtcgtgcgtatttcgcgggttttttcgcgggtttttgggtcggtttcgttttgatcgacgcgcgttgtcgttcgtagattttttcgttaagcgtaagagaattgcgtaggagaataaggcgtcgaacgacgtttttttagggtgtttttttttaaacgtggtttttggggtgggcgcggtggagtagatttcgcgtaaacgtttgaga

SEQ ID NO: 28052 - DNA, 984 bp, Artificial Sequence
  chemically treated genomic DNA (Homo sapiens) CpG-island No: 28052
tctcaaacgtttacgcgaaatctactccaccgcgcccaccccaaaaaccacgtttaaaaaaaaacaccctaaaaaaacgtcgttcgacgccttattctcctacgcaattctcttacgcttaacgaaaaaatctacgaacgacaacgcgcgtcgatcaaaacgaaaccgacccaaaaacccgcgaaaaaacccgcgaaatacgcacgacgcgaaaccgaaataaaaacgccatccccgcccgcgccgaaatccgcgacgaatcaactttatttacgtcgccgcgcaatatactatataaacatttccccttatcccgcgaccaaaccccccgaaactaccgccgcacttaaccccctccataccgcacacacgacgtccctaaaaaactcccgcgacccgaaccaaaaaccgcgatccgaataaatcgcgaccaaactcgccctcccactacacgctcgaaaaccttaactacacccctaccaataaaaaaaaaatacgaacgcaaccgcgccctaaacgccgcgaaccctttaataccacgaaaaaaaacgaaaaccgaacgaaacccccgaaaacgaaaaaaaacccgaccgaccgaacaaaacgaaaccgaaccgaaacgaaaccgtacgaaactcaccgaaaataaaaaaccccgacaacttcttaatcgcaccgttcgcattaaccgcaacaatcccgaatacaaaacgtcctaaaatccccgaaaaaaactaatccttcaactcctaaccgcgctactcttaattctcgtcctactcctcgaccgactccccattctactcctcgaccgactccgcaccctactcctcgaccgactccgcgccctactcctcctccgactcctcgtccttctcctcgaccgactctacgccctactcctcgccctactcaaaaaccgactcaattcccaactcatcacccgactcaacacccgactcctcgccctactcaaaaacctac

SEQ ID NO: 28053 - DNA, 1002 bp, Artificial Sequence
  chemically treated genomic DNA (Homo sapiens) CpG-island No: 28053
cggcgtttagttcggttaggcgtattcgtagttcgcggtttagtttttcgtggtttataggttcgaagaggttgcggtaggcgttgttacgcgttattattgggaaggtatcgttggaggttaagcgttttatcgttgttttgttgcggaggtatacgtcggatatgtttatggtcgaaggttgtgtaaacgcgggtagcgagaaagaagggaacgggaggagaaggaagaggggagaggaggagggcggaggttgggcgtgggtgagattttttgtatagttcgcgttcgtttttgtttaaggacgtagcggttatttggttgattggtgatggacggtttttgcgtttggatcgtttgttttgtttagtttgggtcgcgttttttcggagtttgtttgtttgttcgtttgtttttagtcgggtatagtcggtatttttcgagtatagcgtattcggtttgtggaacgtttagttcgttgcgtttttttatacgcgttggttttattttcgcgcgcgcgggtttttttacgattagtataatgtagtatttttagttttaataatatcgcggcgattggagggtgtagttcgtttcgtttatagaggttttgttttcgcgttacgtttattggttgcgcgtatatattttcggggtcgggcggggcgggtgacgggcgggcgttgattggcggtcgtacggcgagcgggttgcgcgggataaggggcggggttcgagttaaagagttttgcgggcggtaacgtgatatcgcgacgtttttttttttcgttttattttttttttcgtttttcgcgggtttttttgtttgtaggcgggggttcgcgtagtcgcgacgcgcgcgttttttttgattatggagttgggtatagtttttttgcgatgtcgacgtcggtgaaagtgtttttgttttcgtagttcgcgttatttttatgattgtattaattgattagggttttaatttattattattagttgggtttt

SEQ ID NO: 28054 - DNA, 1002 bp, Artificial Sequence
  chemically treated genomic DNA (Homo sapiens) CpG-island No: 28054
aaaacccaactaataataataaattaaaaccctaatcaattaatacaatcataaaaataacgcgaactacgaaaacaaaaacactttcaccgacgtcgacatcgcaaaaaaactatacccaactccataatcaaaaaaaacgcgcgcgtcgcgactacgcgaacccccgcctacaaacaaaaaaacccgcgaaaaacgaaaaaaaaaataaaacgaaaaaaaaaaacgtcgcgatatcacgttaccgcccgcaaaactctttaactcgaaccccgccccttatcccgcgcaacccgctcgccgtacgaccgccaatcaacgcccgcccgtcacccgccccgcccgaccccgaaaatatatacgcgcaaccaataaacgtaacgcgaaaacaaaacctctataaacgaaacgaactacaccctccaatcgccgcgatattattaaaactaaaaatactacattatactaatcgtaaaaaaacccgcgcgcgcgaaaataaaaccaacgcgtataaaaaaacgcaacgaactaaacgttccacaaaccgaatacgctatactcgaaaaataccgactatacccgactaaaaacaaacgaacaaacaaacaaactccgaaaaaacgcgacccaaactaaacaaaacaaacgatccaaacgcaaaaaccgtccatcaccaatcaaccaaataaccgctacgtccttaaacaaaaacgaacgcgaactatacaaaaaatctcacccacgcccaacctccgccctcctcctctcccctcttccttctcctcccgttcccttctttctcgctacccgcgtttacacaaccttcgaccataaacatatccgacgtatacctccgcaacaaaacaacgataaaacgcttaacctccaacgataccttcccaataataacgcgtaacaacgcctaccgcaacctcttcgaacctataaaccacgaaaaactaaaccgcgaactacgaatacgcctaaccgaactaaacgccg

SEQ ID NO: 28055 - DNA, 1002 bp, Artificial Sequence
  chemically treated genomic DNA (Homo sapiens) CpG-island No: 28055
aggatttagttggtagtagtaggttaaagttttaattagttggtgtagttatagggatagcgcgggttgcggggatagaggtatttttatcgacgtcggtatcgtagaggggttgtgtttagttttatggttagagggggcgcgcgcgtcgcggttgcgcgagttttcgtttgtagataaaggagttcgcggggggcggggggggggatggggcgagggggaggggcgtcgcggtgttacgttatcgttcgtagagttttttaattcgagtttcgttttttgtttcgcgtagttcgttcgtcgtgcggtcgttaattagcgttcgttcgttattcgtttcgttcggtttcgggggtgtgtgcgcgtagttaatgagcgtggcgcgggggtagggtttttgtgggcggggcgggttgtattttttaatcgtcgcggtgttgttgaaattgaaaatattatattatgttaatcgtgaggaggttcgcgcgcgcgggggtggggttagcgcgtataaaggggcgtagcgggttgggcgttttataggtcgagtgcgttgtgttcgaggggtgtcggttatgttcgattgagagtaagcgaataggtaggtaagtttcgagggggcgcggtttaagttggataggataagcgatttagacgtaggagtcgtttattattaattagttaggtagtcgttgcgtttttaggtagaggcggacgcgggttgtgtaaggggttttatttacgtttagttttcgtttttttttttttttttttttttttttttttcgtttttttttttttcgttgttcgcgtttgtatagttttcgattatgggtatgttcgacgtgtattttcgtagtagaatagcgatggaacgtttggtttttagcgatatttttttagtgatagcgcgtagtagcgtttgtcgtagttttttcgggtttgtagattacgaggagttgggtcgcgagttgcggatgcgtttggtcgagttgaacgtcg

SEQ ID NO: 28056 - DNA, 1002 bp, Artificial Sequence
  chemically treated genomic DNA (Homo sapiens) CpG-island No: 28056
cgacgttcaactcgaccaaacgcatccgcaactcgcgacccaactcctcgtaatctacaaacccgaaaaaactacgacaaacgctactacgcgctatcactaaaaaaatatcgctaaaaaccaaacgttccatcgctattctactacgaaaatacacgtcgaacatacccataatcgaaaactatacaaacgcgaacaacgaaaaaaaaaaaaacgaaaaaaaaaaaaaaaaaaaaaaaaaaaaaaacgaaaactaaacgtaaataaaaccccttacacaacccgcgtccgcctctacctaaaaacgcaacgactacctaactaattaataataaacgactcctacgtctaaatcgcttatcctatccaacttaaaccgcgccccctcgaaacttacctacctattcgcttactctcaatcgaacataaccgacacccctcgaacacaacgcactcgacctataaaacgcccaacccgctacgcccctttatacgcgctaaccccacccccgcgcgcgcgaacctcctcacgattaacataatataatattttcaatttcaacaacaccgcgacgattaaaaaatacaacccgccccgcccacaaaaaccctacccccgcgccacgctcattaactacgcgcacacacccccgaaaccgaacgaaacgaataacgaacgaacgctaattaacgaccgcacgacgaacgaactacgcgaaacaaaaaacgaaactcgaattaaaaaactctacgaacgataacgtaacaccgcgacgcccctccccctcgccccatccccccccccgccccccgcgaactcctttatctacaaacgaaaactcgcgcaaccgcgacgcgcgcgccccctctaaccataaaactaaacacaacccctctacgataccgacgtcgataaaaatacctctatccccgcaacccgcgctatccctataactacaccaactaattaaaactttaacctactactaccaactaaatcct

SEQ ID NO: 28057 - DNA, 528 bp, Artificial Sequence
  chemically treated genomic DNA (Homo sapiens) CpG-island No: 28057
gtggagttcggcgatacggttaatggtaggtggttttgttggcgattacggcggtgtagtttcggagcgagtttaggataggcgttattgtcgtaggaggcgcgaggtgcggtgttggcgggtaacggcgcggcgggcggttggcgagggattggggcggaggaggcggagacggggaggagtgggcggcgcgggtaggtcgacgcgttatggcggcgagtagaggcgggcggcgatcgggttagaggttcgggtggcgggtggcggcggatggcgggtcggtttttttttcgtgtagtttcgttttcggttgaaggttagcgcgttttgttttcgtcgttcgagaatttacgcgaagcggcgtaggcggttttttgagaggataaggtttttttagcgaggtgggtttgggtacgtttcgttttagatcgcgtttgggaaggaaggggtttattgggtcgtcgtttcgttttttcgggttttgtatgtttttcgtatagtgtttcggtttttgagttagattttatt

SEQ ID NO: 28058 - DNA, 528 bp, Artificial Sequence
  chemically treated genomic DNA (Homo sapiens) CpG-island No: 28058
aataaaatctaactcaaaaaccgaaacactatacgaaaaacatacaaaacccgaaaaaacgaaacgacgacccaataaaccccttccttcccaaacgcgatctaaaacgaaacgtacccaaacccacctcgctaaaaaaaccttatcctctcaaaaaaccgcctacgccgcttcgcgtaaattctcgaacgacgaaaacaaaacgcgctaaccttcaaccgaaaacgaaactacacgaaaaaaaaaccgacccgccatccgccgccacccgccacccgaacctctaacccgatcgccgcccgcctctactcgccgccataacgcgtcgacctacccgcgccgcccactcctccccgtctccgcctcctccgccccaatccctcgccaaccgcccgccgcgccgttacccgccaacaccgcacctcgcgcctcctacgacaataacgcctatcctaaactcgctccgaaactacaccgccgtaatcgccaacaaaaccacctaccattaaccgtatcgccgaactccac

SEQ ID NO: 28059 - DNA, 528 bp, Artificial Sequence
  chemically treated genomic DNA (Homo sapiens) CpG-island No: 28059
agtgaggtttggtttagagatcggggtattgtgcggagagtatgtaaagttcggaagggcgaggcggcggtttagtagatttttttttttttaggcgcggtttgagacgaggcgtatttaggtttatttcgttggggaggttttgtttttttaaggaatcgtttgcgtcgtttcgcgtgggttttcgggcggcgggaataaagcgcgttgatttttagtcgggggcggggttgtacggaggagggatcggttcgttattcgtcgttattcgttattcggatttttgattcggtcgtcgttcgtttttgttcgtcgttatggcgcgtcggtttgttcgcgtcgtttattttttttcgttttcgtttttttcgttttagtttttcgttagtcgttcgtcgcgtcgttattcgttagtatcgtatttcgcgttttttgcggtagtggcgtttgttttaagttcgtttcggggttgtatcgtcgtggtcgttaataaaattatttgttattggtcgtatcgtcgggttttat

SEQ ID NO: 28060 - DNA, 528 bp, Artificial Sequence
  chemically treated genomic DNA (Homo sapiens) CpG-island No: 28060
ataaaacccgacgatacgaccaataacaaataattttattaacgaccacgacgatacaaccccgaaacgaacttaaaacaaacgccactaccgcaaaaaacgcgaaatacgatactaacgaataacgacgcgacgaacgactaacgaaaaactaaaacgaaaaaaacgaaaacgaaaaaaaataaacgacgcgaacaaaccgacgcgccataacgacgaacaaaaacgaacgacgaccgaatcaaaaatccgaataacgaataacgacgaataacgaaccgatccctcctccgtacaaccccgcccccgactaaaaatcaacgcgctttattcccgccgcccgaaaacccacgcgaaacgacgcaaacgattccttaaaaaaacaaaacctccccaacgaaataaacctaaatacgcctcgtctcaaaccgcgcctaaaaaaaaaaaaatctactaaaccgccgcctcgcccttccgaactttacatactctccgcacaataccccgatctctaaaccaaacctcact

SEQ ID NO: 28061 - DNA, 640 bp, Artificial Sequence
  chemically treated genomic DNA (Homo sapiens) CpG-island No: 28061
aagaggatttttcgaagttttaggtcggatttcgtcgtagtttgttcggttttttttttttttcgggtagtaggaaggagcgtcgggtaggtaacgcgtataagggcggcgggtaagtttggtcgcgaggtttagatttcgtttatcgacgtttttttcggcggtggtttttttgtttcgtttgcggtatttattaggagaagtagtagggcgtacgcgcgtttcgggtttcgcgttatcgtattttcgttttcgtttttcgtcgtcgtatcgtttcgcgtcgtcgtttgtttcgagcgcgtattcggtttttttttggtttcggttttttttcggttcggttatttttttttttttcgtttcgagggttgttttttcgtggcggttggcgcggtttagtttagtttaatttaaaggcgcggttttaggtgtggtcgtcgcgagaaaatggagtcgggggtcggttcgggtcgtttttatagaggtggggagtttagtagaggagggaggcgcggggtggattttcgttcgttcgtattcgtatttgggatcgtgacgtttttgggttggggattgtgggtggtaggtttcgtttcgtcgttttttttttttcgattttttattttttggagaatggcgg

SEQ ID NO: 28062 - DNA, 640 bp, Artificial Sequence
  chemically treated genomic DNA (Homo sapiens) CpG-island No: 28062
ccgccattctccaaaaaataaaaaatcgaaaaaaaaaaaacgacgaaacgaaacctaccacccacaatccccaacccaaaaacgtcacgatcccaaatacgaatacgaacgaacgaaaatccaccccgcgcctccctcctctactaaactccccacctctataaaaacgacccgaaccgacccccgactccattttctcgcgacgaccacacctaaaaccgcgcctttaaattaaactaaactaaaccgcgccaaccgccacgaaaaaacaaccctcgaaacgaaaaaaaaaaaaataaccgaaccgaaaaaaaaccgaaaccaaaaaaaaaccgaatacgcgctcgaaacaaacgacgacgcgaaacgatacgacgacgaaaaacgaaaacgaaaatacgataacgcgaaacccgaaacgcgcgtacgccctactacttctcctaataaataccgcaaacgaaacaaaaaaaccaccgccgaaaaaaacgtcgataaacgaaatctaaacctcgcgaccaaacttacccgccgcccttatacgcgttacctacccgacgctccttcctactacccgaaaaaaaaaaaaaaccgaacaaactacgacgaaatccgacctaaaacttcgaaaaatcctctt

SEQ ID NO: 28063 - DNA, 640 bp, Artificial Sequence
  chemically treated genomic DNA (Homo sapiens) CpG-island No: 28063
tcgttattttttagagagtagggggtcgggaaggagagaacggcggggcggggtttgttatttatagtttttaatttaaggacgttacggttttaggtgcgagtgcgagcgggcgggagtttatttcgcgttttttttttttgttgaattttttatttttgtaaaagcggttcgggtcggttttcggttttattttttcgcggcggttatatttggagtcgcgtttttgggttgggttgggttgggtcgcgttaatcgttacgggaagatagttttcggggcggggagggagagggtggtcgggtcggggggaggtcggggttagggaggagtcgagtgcgcgttcggggtaggcggcggcgcggagcggtgcggcggcgggaggcggaggcgagggtgcgatggcgcggagttcgggacgcgcgtacgttttgttgttttttttggtaagtgtcgtaagcgggataggggagttatcgtcggggagggcgtcggtaggcgaggtttagatttcgcgattagatttgttcgtcgtttttgtgcgcgttatttgttcggcgtttttttttgttgttcgaggggggaaaagggtcgggtaggttgcggcgagattcgatttggggtttcggaaaattttttt

SEQ ID NO: 28064 - DNA, 640 bp, Artificial Sequence
  chemically treated genomic DNA (Homo sapiens) CpG-island No: 28064
aaaaaaattttccgaaaccccaaatcgaatctcgccgcaacctacccgacccttttcccccctcgaacaacaaaaaaaaacgccgaacaaataacgcgcacaaaaacgacgaacaaatctaatcgcgaaatctaaacctcgcctaccgacgccctccccgacgataactcccctatcccgcttacgacacttaccaaaaaaaacaacaaaacgtacgcgcgtcccgaactccgcgccatcgcaccctcgcctccgcctcccgccgccgcaccgctccgcgccgccgcctaccccgaacgcgcactcgactcctccctaaccccgacctccccccgacccgaccaccctctccctccccgccccgaaaactatcttcccgtaacgattaacgcgacccaacccaacccaacccaaaaacgcgactccaaatataaccgccgcgaaaaaataaaaccgaaaaccgacccgaaccgcttttacaaaaataaaaaattcaacaaaaaaaaaaaacgcgaaataaactcccgcccgctcgcactcgcacctaaaaccgtaacgtccttaaattaaaaactataaataacaaaccccgccccgccgttctctccttcccgaccccctactctctaaaaaataacga

SEQ ID NO: 28065 - DNA, 804 bp, Artificial Sequence
  chemically treated genomic DNA (Homo sapiens) CpG-island No: 28065
gcgtgtgttcgtcggtcggtttaggcggagatattttatttagcgtttttttcgttttcgtttttttttttcggttttgtttgcgaaagttcgttttttttttcgtttaagtttcggcgtcgtttttgcgggagcgtttcgtatcgtttcgggggtttttacgcgaggattttcggggtcgttggtagcgtttggtatttttgagttcggcggacgagagtttgtaggttttttttagttagggacggcgaagggcggaaagcgtaggaggaggtagtgttaggttttaggtcgggtgggtcgggttaggagagacgcgtttatttttcgttattcggggtgcgcgaggttttttcgggattcggtcggcgattcgtagttcgggtacgcgtttgtcgtatttcgtaggaaggaggggttcggtttgaggttcggggcggcgttcgttatggagattttttcggtttagggtcggcgtttgggatttggcgggcggttttgatcgtttttttttttgcgcgggttgggtcgcggacgtgtttttcgcggtattcggttttttttgcgttttcgttttttttgggtcgtattgttgtttgggcgcggcggcggcgacggcgttttgttgaatgggttgtgagggtttaggtttaaagcgttggcgaacgcggttttcgggggcgtacggtagttgtagcggtggcgattaaacgggtgttggagttggcggcggttatggagggtttggttggttatgtatataaggcggttagcgagggtaaggtgttgattttggtcgttttg

SEQ ID NO: 28066 - DNA, 804 bp, Artificial Sequence
  chemically treated genomic DNA (Homo sapiens) CpG-island No: 28066
caaaacgaccaaaatcaacaccttaccctcgctaaccgccttatatacataaccaaccaaaccctccataaccgccgccaactccaacacccgtttaatcgccaccgctacaactaccgtacgcccccgaaaaccgcgttcgccaacgctttaaacctaaaccctcacaacccattcaacaaaacgccgtcgccgccgccgcgcccaaacaacaatacgacccaaaaaaaacgaaaacgcaaaaaaaaccgaataccgcgaaaaacacgtccgcgacccaacccgcgcaaaaaaaaaaacgatcaaaaccgcccgccaaatcccaaacgccgaccctaaaccgaaaaaatctccataacgaacgccgccccgaacctcaaaccgaacccctccttcctacgaaatacgacaaacgcgtacccgaactacgaatcgccgaccgaatcccgaaaaaacctcgcgcaccccgaataacgaaaaataaacgcgtctctcctaacccgacccacccgacctaaaacctaacactacctcctcctacgctttccgcccttcgccgtccctaactaaaaaaaacctacaaactctcgtccgccgaactcaaaaataccaaacgctaccaacgaccccgaaaatcctcgcgtaaaaacccccgaaacgatacgaaacgctcccgcaaaaacgacgccgaaacttaaacgaaaaaaaaaacgaactttcgcaaacaaaaccgaaaaaaaaaaacgaaaacgaaaaaaacgctaaataaaatatctccgcctaaaccgaccgacgaacacacgc

SEQ ID NO: 28067 - DNA, 804 bp, Artificial Sequence
  chemically treated genomic DNA (Homo sapiens) CpG-island No: 28067
taaggcggttagagttagtattttgttttcgttggtcgttttgtatatatagttagttaggttttttatggtcgtcgttaattttaatattcgtttggtcgttatcgttgtagttgtcgtgcgttttcggaggtcgcgttcgttagcgttttaaatttgggtttttatagtttatttaatagggcgtcgtcgtcgtcgtcgcgtttaggtagtagtgcggtttagggaaggcggagacgtagaggaggtcgagtgtcgcgaagggtacgttcgcgatttagttcgcgtagggaggaaggcggttagggtcgttcgttaggttttaggcgtcggttttggatcgaggggatttttatggcggacgtcgtttcgggttttaggtcggattttttttttttgcgggatgcgataggcgcgtgttcgagttacgggtcgtcggtcgggtttcgagaggatttcgcgtatttcggatggcgaaagatgggcgcgttttttttgattcggtttattcggtttaaggtttaatattgtttttttttgcgtttttcgtttttcgtcgtttttgattggaggaaatttgtaggttttcgttcgtcgagtttagaagtgttaggcgttgttaacggtttcggagattttcgcgtaggggttttcggggcgatgcggaacgttttcgtaagagcggcgtcggaatttgggcggggaggaagacgagttttcgtagatagggtcgggaggagagggcgggagcgggagggacgttaagtggggtgttttcgtttaagtcgatcggcgggtatacgt

SEQ ID NO: 28068 - DNA, 804 bp, Artificial Sequence
  chemically treated genomic DNA (Homo sapiens) CpG-island No: 28068
acgtatacccgccgatcgacttaaacgaaaacaccccacttaacgtccctcccgctcccgccctctcctcccgaccctatctacgaaaactcgtcttcctccccgcccaaattccgacgccgctcttacgaaaacgttccgcatcgccccgaaaacccctacgcgaaaatctccgaaaccgttaacaacgcctaacacttctaaactcgacgaacgaaaacctacaaatttcctccaatcaaaaacgacgaaaaacgaaaaacgcaaaaaaaaacaatattaaaccttaaaccgaataaaccgaatcaaaaaaaacgcgcccatctttcgccatccgaaatacgcgaaatcctctcgaaacccgaccgacgacccgtaactcgaacacgcgcctatcgcatcccgcaaaaaaaaaaaatccgacctaaaacccgaaacgacgtccgccataaaaatcccctcgatccaaaaccgacgcctaaaacctaacgaacgaccctaaccgccttcctccctacgcgaactaaatcgcgaacgtacccttcgcgacactcgacctcctctacgtctccgccttccctaaaccgcactactacctaaacgcgacgacgacgacgacgccctattaaataaactataaaaacccaaatttaaaacgctaacgaacgcgacctccgaaaacgcacgacaactacaacgataacgaccaaacgaatattaaaattaacgacgaccataaaaaacctaactaactatatatacaaaacgaccaacgaaaacaaaatactaactctaaccgcctta

SEQ ID NO: 28069 - DNA, 815 bp, Artificial Sequence
  chemically treated genomic DNA (Homo sapiens) CpG-island No: 28069
aaagaacgaacgcgtgagttgaaagaacgaacgcgtgaatgaatgaatgggatacgtcgtaggttaggtttttgttacgtcgtttatcggcgcgggcgtggttacggttaagagagacgcgcgcgtagtcgcgcgcgggtcgtgtcgtattatcgtcgcgggtaggttcggttacgagcgttagagtttcgcgttttttttcgcggtttgttttaagtttttgtttcgtaatagagcgttattttcgttattttcggtagcggttggggcggggcgtacgggggagggggttaggtcggagggaagttcgttcgtgttcgagttcgcgttcgagtagggattatatttttcgaggggtttcggcggcggttgcggcgacgggcgcggtaacgtttttcggaagtggagttcgggatttttattcgtgcgtgaggcgagaggagtcggagacgagattagaggtcgaattcgggttttgataagatggtcgggttgtttcgtaggattattaaggtaatcgtttaggtcggtttttagtttttcgttttgttttcgtcggtttagttgggtaggtagcgcggtttttcgtttttttcggttcgcggttcgttttgggaggttcgaggcggcgcggagaggggttggtcgcggcggcgagggaagtcgggtgttgaggagggggcgtcggggagattttcggtcgcggcggggtagtcggatagcggggattcggggtttttaggcggttgttcggcgggttagggagtgttgttttacgtttcggcggagggtggggcggtaaggttgggggtttt

SEQ ID NO: 28070 - DNA, 815 bp, Artificial Sequence
  chemically treated genomic DNA (Homo sapiens) CpG-island No: 28070
aaaacccccaaccttaccgccccaccctccgccgaaacgtaaaacaacactccctaacccgccgaacaaccgcctaaaaaccccgaatccccgctatccgactaccccgccgcgaccgaaaatctccccgacgccccctcctcaacacccgacttccctcgccgccgcgaccaacccctctccgcgccgcctcgaacctcccaaaacgaaccgcgaaccgaaaaaaacgaaaaaccgcgctacctacccaactaaaccgacgaaaacaaaacgaaaaactaaaaaccgacctaaacgattaccttaataatcctacgaaacaacccgaccatcttatcaaaacccgaattcgacctctaatctcgtctccgactcctctcgcctcacgcacgaataaaaatcccgaactccacttccgaaaaacgttaccgcgcccgtcgccgcaaccgccgccgaaacccctcgaaaaatataatccctactcgaacgcgaactcgaacacgaacgaacttccctccgacctaaccccctcccccgtacgccccgccccaaccgctaccgaaaataacgaaaataacgctctattacgaaacaaaaacttaaaacaaaccgcgaaaaaaaacgcgaaactctaacgctcgtaaccgaacctacccgcgacgataatacgacacgacccgcgcgcgactacgcgcgcgtctctcttaaccgtaaccacgcccgcgccgataaacgacgtaacaaaaacctaacctacgacgtatcccattcattcattcacgcgttcgttctttcaactcacgcgttcgttcttt

SEQ ID NO: 28071 - DNA, 815 bp, Artificial Sequence
  chemically treated genomic DNA (Homo sapiens) CpG-island No: 28071
gagatttttagttttgtcgttttatttttcgtcggggcgtgggatagtattttttggttcgtcgggtagtcgtttggaagtttcgggttttcgttgttcggttgtttcgtcgcggtcggaagttttttcggcgttttttttttagtattcgatttttttcgtcgtcgcggttaattttttttcgcgtcgtttcgggttttttagagcgggtcgcgggtcgaaggaggcgagaggtcgcgttgtttgtttagttgagtcgacgagagtagagcgaagagttggaggtcggtttgggcggttattttgatgattttgcggggtagttcggttattttgttagaattcgagttcggtttttggtttcgttttcggtttttttcgttttacgtacgagtggaagtttcgggttttattttcgggggacgttgtcgcgttcgtcgtcgtagtcgtcgtcgaggtttttcgggaaatgtagtttttgttcgggcgcgggttcgggtacgggcgggttttttttcgatttggttttttttttcgtgcgtttcgttttaatcgttgtcggggatggcggaagtgacgttttgttgcggggtagggatttgggataggtcgcgaggggaggcgcggggttttggcgttcgtggtcgagtttgttcgcgacggtggtacggtacgattcgcgcgcgattgcgcgcgcgttttttttaatcgtggttacgttcgcgtcggtggacgacgtaatagaggtttggtttacgacgtattttatttatttatttacgcgttcgtttttttagtttacgcgttcgtttttt

SEQ ID NO: 28072 - DNA, 815 bp, Artificial Sequence
  chemically treated genomic DNA (Homo sapiens) CpG-island No: 28072
aaaaaacgaacgcgtaaactaaaaaaacgaacgcgtaaataaataaataaaatacgtcgtaaaccaaacctctattacgtcgtccaccgacgcgaacgtaaccacgattaaaaaaaacgcgcgcgcaatcgcgcgcgaatcgtaccgtaccaccgtcgcgaacaaactcgaccacgaacgccaaaaccccgcgcctcccctcgcgacctatcccaaatccctaccccgcaacaaaacgtcacttccgccatccccgacaacgattaaaacgaaacgcacgaaaaaaaaaaccaaatcgaaaaaaaacccgcccgtacccgaacccgcgcccgaacaaaaactacatttcccgaaaaacctcgacgacgactacgacgacgaacgcgacaacgtcccccgaaaataaaacccgaaacttccactcgtacgtaaaacgaaaaaaaccgaaaacgaaaccaaaaaccgaactcgaattctaacaaaataaccgaactaccccgcaaaatcatcaaaataaccgcccaaaccgacctccaactcttcgctctactctcgtcgactcaactaaacaaacaacgcgacctctcgcctccttcgacccgcgacccgctctaaaaaacccgaaacgacgcgaaaaaaaattaaccgcgacgacgaaaaaaatcgaatactaaaaaaaaaacgccgaaaaaacttccgaccgcgacgaaacaaccgaacaacgaaaacccgaaacttccaaacgactacccgacgaaccaaaaaatactatcccacgccccgacgaaaaataaaacgacaaaactaaaaatctc

SEQ ID NO: 28073 - DNA, 533 bp, Artificial Sequence
  chemically treated genomic DNA (Homo sapiens) CpG-island No: 28073
tagtgttcgaacgcgtgggtagatcgtaaattgttgcgtttttcgtagttttcgcgcgtattaagtgggaattataattttcggcggtttcggcggattgcgggtcgtcgggttagatagtcgatttcggttataagcgtttgcgtagtcgcggggtcgtcggtcgtgttgttttcgttaatttttgtggtaatttttatcgtggcgagtttcgcgtttaatggagacgtttgattttatcgagttgttcgagttgtttaaattttattatcggaggttttttttttatttttagtattatcgttggtttaattacggtggaggtgatggaggcgaggaatgggttcgggagcggagtgtgaggaggttggaggcggggtgtttttagaatgataatatgaagcgttttttgtgtattaggttttgtgtcgcgcgtttttatttgttttttcgagttcgttttattattttataggtgtaaatgggtcgagagaggatataataagttagtttgcggttacgttgtaaaaaaa

SEQ ID NO: 28074 - DNA, 533 bp, Artificial Sequence
  chemically treated genomic DNA (Homo sapiens) CpG-island No: 28074
tttttttacaacgtaaccgcaaactaacttattatatcctctctcgacccatttacacctataaaataataaaacgaactcgaaaaaacaaataaaaacgcgcgacacaaaacctaatacacaaaaaacgcttcatattatcattctaaaaacaccccgcctccaacctcctcacactccgctcccgaacccattcctcgcctccatcacctccaccgtaattaaaccaacgataatactaaaaataaaaaaaaaacctccgataataaaatttaaacaactcgaacaactcgataaaatcaaacgtctccattaaacgcgaaactcgccacgataaaaattaccacaaaaattaacgaaaacaacacgaccgacgaccccgcgactacgcaaacgcttataaccgaaatcgactatctaacccgacgacccgcaatccgccgaaaccgccgaaaattataattcccacttaatacgcgcgaaaactacgaaaaacgcaacaatttacgatctacccacgcgttcgaacacta

SEQ ID NO: 28075 - DNA, 533 bp, Artificial Sequence
  chemically treated genomic DNA (Homo sapiens) CpG-island No: 28075
tttttttatagcgtggtcgtaggttggtttattatattttttttcggtttatttatatttatgaagtggtggggcgggttcgagagagtaaatgaaggcgcgcggtataaagtttggtgtatagaaggcgttttatattgttattttaaggatatttcgtttttaatttttttatatttcgttttcgaatttatttttcgtttttattatttttatcgtagttgagttagcgatagtattgagagtagggaaagagttttcggtaataaagtttaagtagttcgggtagttcggtggggttaaacgtttttattgagcgcggaattcgttacggtaaggattattataggaattggcgggaatagtacggtcggcggtttcgcgattgcgtaggcgtttatggtcgaggtcggttgtttgattcggcggttcgtagttcgtcggggtcgtcgggaattgtagtttttatttggtgcgcgcgggggttgcgggagacgtagtagtttgcgatttgtttacgcgttcgggtatta

SEQ ID NO: 28076 - DNA, 533 bp, Artificial Sequence
  chemically treated genomic DNA (Homo sapiens) CpG-island No: 28076
taatacccgaacgcgtaaacaaatcgcaaactactacgtctcccgcaacccccgcgcgcaccaaataaaaactacaattcccgacgaccccgacgaactacgaaccgccgaatcaaacaaccgacctcgaccataaacgcctacgcaatcgcgaaaccgccgaccgtactattcccgccaattcctataataatccttaccgtaacgaattccgcgctcaataaaaacgtttaaccccaccgaactacccgaactacttaaactttattaccgaaaactctttccctactctcaatactatcgctaactcaactacgataaaaataataaaaacgaaaaataaattcgaaaacgaaatataaaaaaattaaaaacgaaatatccttaaaataacaatataaaacgccttctatacaccaaactttataccgcgcgccttcatttactctctcgaacccgccccaccacttcataaatataaataaaccgaaaaaaaatataataaaccaacctacgaccacgctataaaaaaa

SEQ ID NO: 28077 - DNA, 819 bp, Artificial Sequence
  chemically treated genomic DNA (Homo sapiens) CpG-island No: 28077
ttatcgatgcgagaaaggttagggggtcgtttttagggagtttttaacgcggtttcggttttattcggcgattttttttcggcggggtgtcgtatttatattgtgaacggggtagggggacgggcgaattggtgggcgggtttttttggcggcggttgttgttagggagtcgattttttttcggtggcgatttcgtttttttttttcggtcgcggttttttttcgttttttttaggcgacggcggtagcggcgggttcgatttcgggttttagaatgtatcgcgcggaaagagcggttttttcggtcggggagaagaggaaagtgtaggaaaaggggcgcgaggacggagaatgaacgtgcgtgcgtgtaaacgaggggtggtgaggtcgggcggcggttggtgacgtagtaaaatgttcgggttttgtcgtcgcgcgtgcgtagtttttgtttttgggtttcggcgcggttttttagagatatttacggaaagggcggggttttttagttttttcgcgattttttttggcgtcggtttcgtttttcgttcgttattttatttttatttcgttttttgttagtttttacgcgttttcgttttttttttcgttttgttttttcgcgttagaaaatcgttagtggtttaattgttttgttatgcgttttcggcgatttttttgagaaacggttgcgttgatagtgggaggtaaggttgaggcggagggatacggagtcgggattttggagaattgaaatggcgcgttggttatttttgagggagtaaattagtttattgagttattattttattataaaaa

SEQ ID NO: 28078 - DNA, 819 bp, Artificial Sequence
  chemically treated genomic DNA (Homo sapiens) CpG-island No: 28078
tttttataataaaataataactcaataaactaatttactccctcaaaaataaccaacgcgccatttcaattctccaaaatcccgactccgtatccctccgcctcaaccttacctcccactatcaacgcaaccgtttctcaaaaaaatcgccgaaaacgcataacaaaacaattaaaccactaacgattttctaacgcgaaaaaacaaaacgaaaaaaaaaacgaaaacgcgtaaaaactaacaaaaaacgaaataaaaataaaataacgaacgaaaaacgaaaccgacgccaaaaaaaatcgcgaaaaaactaaaaaaccccgccctttccgtaaatatctctaaaaaaccgcgccgaaacccaaaaacaaaaactacgcacgcgcgacgacaaaacccgaacattttactacgtcaccaaccgccgcccgacctcaccacccctcgtttacacgcacgcacgttcattctccgtcctcgcgccccttttcctacactttcctcttctccccgaccgaaaaaaccgctctttccgcgcgatacattctaaaacccgaaatcgaacccgccgctaccgccgtcgcctaaaaaaaacgaaaaaaaaccgcgaccgaaaaaaaaaaacgaaatcgccaccgaaaaaaaatcgactccctaacaacaaccgccgccaaaaaaacccgcccaccaattcgcccgtccccctaccccgttcacaatataaatacgacaccccgccgaaaaaaaatcgccgaataaaaccgaaaccgcgttaaaaactccctaaaaacgaccccctaacctttctcgcatcgataa

SEQ ID NO: 28079 - DNA, 819 bp, Artificial Sequence
  chemically treated genomic DNA (Homo sapiens) CpG-island No: 28079
tttttgtggtggaatgatgatttagtgagttgatttatttttttaagagtaattaacgcgttattttagttttttaggatttcgatttcgtgttttttcgttttagttttgttttttattgttaacgtaatcgttttttagagaaatcgtcgaaggcgtatggtagggtagttgggttattaacggttttttaacgcgagaagatagagcgggaggagaggcgggaacgcgtagggattagtagggggcggagtgggggtggggtggcggacgaagggcggggtcggcgttaggaaggatcgcgaaggagttgggaggtttcgtttttttcgtagatatttttagaaagtcgcgtcggagtttaaaaataaggattgcgtacgcgcggcggtaaggttcgggtattttgttgcgttattagtcgtcgttcggttttattatttttcgtttgtacgtacgtacgtttatttttcgttttcgcgtttttttttttatatttttttttttttttcgatcggaggagtcgtttttttcgcgcggtgtattttggggttcgaggtcgagttcgtcgttgtcgtcgtcgtttgagggaagcgagaagaggtcgcgatcggagagaaaaagcggagtcgttatcggagagaagtcgattttttagtagtagtcgtcgttagagaggttcgtttattagttcgttcgtttttttgtttcgtttataatgtgagtgcgatatttcgtcgagggaaggtcgtcgagtgaggtcgaggtcgcgttgggggttttttggaagcggttttttagtttttttcgtatcggtgg

SEQ ID NO: 28080 - DNA, 819 bp, Artificial Sequence
  chemically treated genomic DNA (Homo sapiens) CpG-island No: 28080
ccaccgatacgaaaaaaactaaaaaaccgcttccaaaaaacccccaacgcgacctcgacctcactcgacgaccttccctcgacgaaatatcgcactcacattataaacgaaacaaaaaaacgaacgaactaataaacgaacctctctaacgacgactactactaaaaaatcgacttctctccgataacgactccgctttttctctccgatcgcgacctcttctcgcttccctcaaacgacgacgacaacgacgaactcgacctcgaaccccaaaatacaccgcgcgaaaaaaacgactcctccgatcgaaaaaaaaaaaaaaatataaaaaaaaaaacgcgaaaacgaaaaataaacgtacgtacgtacaaacgaaaaataataaaaccgaacgacgactaataacgcaacaaaatacccgaaccttaccgccgcgcgtacgcaatccttatttttaaactccgacgcgactttctaaaaatatctacgaaaaaaacgaaacctcccaactccttcgcgatccttcctaacgccgaccccgcccttcgtccgccaccccacccccactccgccccctactaatccctacgcgttcccgcctctcctcccgctctatcttctcgcgttaaaaaaccgttaataacccaactaccctaccatacgccttcgacgatttctctaaaaaacgattacgttaacaataaaaaacaaaactaaaacgaaaaaacacgaaatcgaaatcctaaaaaactaaaataacgcgttaattactcttaaaaaaataaatcaactcactaaatcatcattccaccacaaaaa

SEQ ID NO: 28081 - DNA, 522 bp, Artificial Sequence
  chemically treated genomic DNA (Homo sapiens) CpG-island No: 28081
cgcgttaacgcgttcggtatacgggtagttatatatcgggttttagtcgagtgttcggtgtttttagggaaggtatcgggcgtgtagagtcgtttttgggtaaatttttaagattgttttttacgtagggagcgcgcggaggttcgtagggtgttcgtttggtcgtagaggtcgcgacgtttttttcgttattttcgggtcgtcgaaagaacgggtagtcgggaaatttcgtgtttttattcgtggtagaggacgttgtggggcgggcgggttgcgggttttcggcgttttttcgtagaggcggcgatagcggtcgtttttttcgcggggtcgggtcggggaatttttttcgtttggagtcgggttaaaaagattcgtagtagagtcgagggggcggagggttgcgaacggtcggagggaaatacgagaggcgtgtagtttggggataggggagaaaggtagagcgcgttgggggaaggggtaggggagattagataagtttggggatgttttggggatcgg

SEQ ID NO: 28082 - DNA, 522 bp, Artificial Sequence
  chemically treated genomic DNA (Homo sapiens) CpG-island No: 28082
ccgatccccaaaacatccccaaacttatctaatctcccctaccccttcccccaacgcgctctacctttctcccctatccccaaactacacgcctctcgtatttccctccgaccgttcgcaaccctccgccccctcgactctactacgaatctttttaacccgactccaaacgaaaaaaattccccgacccgaccccgcgaaaaaaacgaccgctatcgccgcctctacgaaaaaacgccgaaaacccgcaacccgcccgccccacaacgtcctctaccacgaataaaaacacgaaatttcccgactacccgttctttcgacgacccgaaaataacgaaaaaaacgtcgcgacctctacgaccaaacgaacaccctacgaacctccgcgcgctccctacgtaaaaaacaatcttaaaaatttacccaaaaacgactctacacgcccgataccttccctaaaaacaccgaacactcgactaaaacccgatatataactacccgtataccgaacgcgttaacgcg

SEQ ID NO: 28083 - DNA, 522 bp, Artificial Sequence
  chemically treated genomic DNA (Homo sapiens) CpG-island No: 28083
tcggtttttaggatatttttagatttgtttgattttttttgtttttttttttaacgcgttttgttttttttttttgtttttaaattgtacgtttttcgtgttttttttcggtcgttcgtagtttttcgttttttcggttttgttgcgggtttttttggttcggttttaggcggggaaagtttttcggttcggtttcgcggggggggcggtcgttgtcgtcgtttttgcgggaaggcgtcgggagttcgtagttcgttcgttttatagcgttttttgttacgagtggggatacgggatttttcggttgttcgttttttcggcggttcgagggtggcggagggggcgtcgcggtttttgcggttaggcgggtattttgcgggttttcgcgcgttttttgcgtgaagagtagttttgggaatttgtttaggggcggttttgtacgttcggtgttttttttgaagatatcgagtattcggttggagttcgatgtgtggttgttcgtgtgtcgggcgcgttggcgcg

SEQ ID NO: 28084 - DNA, 522 bp, Artificial Sequence
  chemically treated genomic DNA (Homo sapiens) CpG-island No: 28084
cgcgccaacgcgcccgacacacgaacaaccacacatcgaactccaaccgaatactcgatatcttcaaaaaaaacaccgaacgtacaaaaccgcccctaaacaaattcccaaaactactcttcacgcaaaaaacgcgcgaaaacccgcaaaatacccgcctaaccgcaaaaaccgcgacgccccctccgccaccctcgaaccgccgaaaaaacgaacaaccgaaaaatcccgtatccccactcgtaacaaaaaacgctataaaacgaacgaactacgaactcccgacgccttcccgcaaaaacgacgacaacgaccgccccccccgcgaaaccgaaccgaaaaactttccccgcctaaaaccgaaccaaaaaaacccgcaacaaaaccgaaaaaacgaaaaactacgaacgaccgaaaaaaaacacgaaaaacgtacaatttaaaaacaaaaaaaaaaaacaaaacgcgttaaaaaaaaaaacaaaaaaaatcaaacaaatctaaaaatatcctaaaaaccga

SEQ ID NO: 28085 - DNA, 504 bp, Artificial Sequence
  chemically treated genomic DNA (Homo sapiens) CpG-island No: 28085
atagtagaagtcggagtcggagttcgggaggcgtcgtcgtcgtcgttgtcgtcgtatattgggattcgttcggtagtattatattcgttatgtcgggtatttgttttagattggcggcgttggttgttttcggagttcgagcggatagttaatgagatgttaatgatatgcgttggaggcggagttcgggtagattaattatagcgtcgcgagtttaattcggttttcggagggtttcgtttttttttttatttcgttttttggcgttggcgttcggcggcgcgttcgcgttatttaggggcggggttaaggggaggggcgtatgtaaatatgtttatgttaaaattcgggttttgtttttttcggattaaggaaaaagtgttttttcgggcgtttggcgtgtaaggattcgggttttagggggcgggtttagttttttgtatatttttattaggaatgtttatagtaatcgttgtattagatcgacgattggagaattttttt

SEQ ID NO: 28086 - DNA, 504 bp, Artificial Sequence
  chemically treated genomic DNA (Homo sapiens) CpG-island No: 28086
aaaaaaattctccaatcgtcgatctaatacaacgattactataaacattcctaataaaaatatacaaaaaactaaacccgccccctaaaacccgaatccttacacgccaaacgcccgaaaaaacactttttccttaatccgaaaaaaacaaaacccgaattttaacataaacatatttacatacgcccctccccttaaccccgcccctaaataacgcgaacgcgccgccgaacgccaacgccaaaaaacgaaataaaaaaaaaaacgaaaccctccgaaaaccgaattaaactcgcgacgctataattaatctacccgaactccgcctccaacgcatatcattaacatctcattaactatccgctcgaactccgaaaacaaccaacgccgccaatctaaaacaaatacccgacataacgaatataatactaccgaacgaatcccaatatacgacgacaacgacgacgacgacgcctcccgaactccgactccgacttctactat

SEQ ID NO: 28087 - DNA, 504 bp, Artificial Sequence
  chemically treated genomic DNA (Homo sapiens) CpG-island No: 28087
agggagattttttagtcgtcggtttgatatagcgattgttataaatatttttaataaaggtgtataagaagttagattcgttttttggagttcgagtttttgtacgttaggcgttcgggagaatattttttttttgattcggggaaagtaaaattcgaattttaatataaatatatttgtatacgtttttttttttggtttcgtttttaggtggcgcgggcgcgtcgtcgaacgttagcgttagggggcggggtgggggagggagcgaggtttttcgagagtcgggttgggttcgcggcgttgtgattggtttgttcggatttcgtttttagcgtatgttattagtattttattagttgttcgttcgggtttcggaggtagttaacgtcgttagtttgaggtaggtgttcgatatggcgagtgtagtgttgtcgagcggattttagtgtgcggcggtagcggcggcggcggcgtttttcgggtttcggtttcggtttttgttgt

SEQ ID NO: 28088 - DNA, 504 bp, Artificial Sequence
  chemically treated genomic DNA (Homo sapiens) CpG-island No: 28088
acaacaaaaaccgaaaccgaaacccgaaaaacgccgccgccgccgctaccgccgcacactaaaatccgctcgacaacactacactcgccatatcgaacacctacctcaaactaacgacgttaactacctccgaaacccgaacgaacaactaataaaatactaataacatacgctaaaaacgaaatccgaacaaaccaatcacaacgccgcgaacccaacccgactctcgaaaaacctcgctccctcccccaccccgccccctaacgctaacgttcgacgacgcgcccgcgccacctaaaaacgaaaccaaaaaaaaaaacgtatacaaatatatttatattaaaattcgaattttactttccccgaatcaaaaaaaaaatattctcccgaacgcctaacgtacaaaaactcgaactccaaaaaacgaatctaacttcttatacacctttattaaaaatatttataacaatcgctatatcaaaccgacgactaaaaaatctccct

SEQ ID NO: 28089 - DNA, 811 bp, Artificial Sequence
  chemically treated genomic DNA (Homo sapiens) CpG-island No: 28089
gtcgcgtcgttttcggttttttcgggtagcgtcggggttttgttaggcgcgcgttgttgtttgtttggattgcgtttattttgattttgaagttagcggttttattgatacgttttgaaaagtgggagttatacgcgggattcggagatcgcgttaaagttttacgtacgacggcgttcgtcggcgagtttacgttcgtacgtcggcgtatgcgcgcggttaagtcggtgttcgcgtttattagcgcgtatgcgcgtttcgtttttttttttttttcgtgttttgtttcgatggttcggttcgcgtcgggggcggggttagggcgttcgcgggaaatttggcgggaatcgcgttcgttttttttttttttttttttttttttgttttcgtcgcgtatttcgtcgttatggagtagcgtcgcgttatcgattttttcgcgcgtcgtcgtttcgggttttttcgtatcgcgtcgtttaagttggtttgtcgtatttttagtttcgttaggttcgtatttcgcgtttcggttttcgttattagtggtagtcgtaagcgcgttcgttcgttcgtcgttttcggacgcgattaggttaggttatcggttcgtaggagattgcggttgtcggtggacgaggtgaggggcgtggggagattgaggtcggggagttgggggcggggagattgaggttcggggggtagggttcggggaaattgaggcggagggacgggggcggggaaataggcgggggggacggggcgtagggaattttgggataggtcgggggattttgggggcgttttgttattattg

SEQ ID NO: 28090 - DNA, 811 bp, Artificial Sequence
  chemically treated genomic DNA (Homo sapiens) CpG-island No: 28090
caataataacaaaacgcccccaaaatcccccgacctatcccaaaattccctacgccccgtcccccccgcctatttccccgcccccgtccctccgcctcaatttccccgaaccctaccccccgaacctcaatctccccgcccccaactccccgacctcaatctccccacgcccctcacctcgtccaccgacaaccgcaatctcctacgaaccgataacctaacctaatcgcgtccgaaaacgacgaacgaacgaacgcgcttacgactaccactaataacgaaaaccgaaacgcgaaatacgaacctaacgaaactaaaaatacgacaaaccaacttaaacgacgcgatacgaaaaaacccgaaacgacgacgcgcgaaaaaatcgataacgcgacgctactccataacgacgaaatacgcgacgaaaacaaaaaaaaaaaaaaaaaaaaaaaaaacgaacgcgattcccgccaaatttcccgcgaacgccctaaccccgcccccgacgcgaaccgaaccatcgaaacaaaacacgaaaaaaaaaaaaaaacgaaacgcgcatacgcgctaataaacgcgaacaccgacttaaccgcgcgcatacgccgacgtacgaacgtaaactcgccgacgaacgccgtcgtacgtaaaactttaacgcgatctccgaatcccgcgtataactcccacttttcaaaacgtatcaataaaaccgctaacttcaaaatcaaaataaacgcaatccaaacaaacaacaacgcgcgcctaacaaaaccccgacgctacccgaaaaaaccgaaaacgacgcgac

SEQ ID NO: 28091 - DNA, 811 bp, Artificial Sequence
  chemically treated genomic DNA (Homo sapiens) CpG-island No: 28091
tagtggtggtagggcgtttttaggatttttcggtttgttttagagttttttgcgtttcgtttttttcgtttgttttttcgttttcgttttttcgttttagttttttcgagttttgtttttcgggttttagttttttcgtttttaatttttcggttttagtttttttacgttttttatttcgtttatcgatagtcgtagttttttgcgggtcggtggtttggtttggtcgcgttcgggggcggcgggcgggcgggcgcgtttgcggttgttattggtagcggaggtcggggcgcggagtgcgggtttggcggggttgggggtgcggtaggttagtttgggcggcgcgatgcgggggggttcggggcggcggcgcgcgaagaagtcggtgacgcggcgttgttttatggcggcggagtgcgcggcgaaagtaaggaaagaaggaagggaggaagaggcgggcgcggttttcgttaaatttttcgcgggcgttttggtttcgttttcggcgcggatcgaattatcggggtagagtacggggggagggaggggacggggcgcgtatgcgcgttggtgggcgcgggtatcggtttggtcgcgcgtatgcgtcgacgtgcgggcgtggattcgtcggcgggcgtcgtcgtgcgtgggattttagcgcggttttcggatttcgcgtgtggtttttattttttagggcgtgttagtggggtcgttggttttagggttagaatgagcgtaatttaggtaaatagtagcgcgcgtttgataaaatttcggcgttgttcgggggagtcgaggacggcgcggt

SEQ ID NO: 28092 - DNA, 811 bp, Artificial Sequence
  chemically treated genomic DNA (Homo sapiens) CpG-island No: 28092
accgcgccgtcctcgactcccccgaacaacgccgaaattttatcaaacgcgcgctactatttacctaaattacgctcattctaaccctaaaaccaacgaccccactaacacgccctaaaaaataaaaaccacacgcgaaatccgaaaaccgcgctaaaatcccacgcacgacgacgcccgccgacgaatccacgcccgcacgtcgacgcatacgcgcgaccaaaccgatacccgcgcccaccaacgcgcatacgcgccccgtcccctccctccccccgtactctaccccgataattcgatccgcgccgaaaacgaaaccaaaacgcccgcgaaaaatttaacgaaaaccgcgcccgcctcttcctcccttccttctttccttactttcgccgcgcactccgccgccataaaacaacgccgcgtcaccgacttcttcgcgcgccgccgccccgaacccccccgcatcgcgccgcccaaactaacctaccgcacccccaaccccgccaaacccgcactccgcgccccgacctccgctaccaataacaaccgcaaacgcgcccgcccgcccgccgcccccgaacgcgaccaaaccaaaccaccgacccgcaaaaaactacgactatcgataaacgaaataaaaaacgtaaaaaaactaaaaccgaaaaattaaaaacgaaaaaactaaaacccgaaaaacaaaactcgaaaaaactaaaacgaaaaaacgaaaacgaaaaaacaaacgaaaaaaacgaaacgcaaaaaactctaaaacaaaccgaaaaatcctaaaaacgccctaccaccacta

SEQ ID NO: 28093 - DNA, 852 bp, Artificial Sequence
  chemically treated genomic DNA (Homo sapiens) CpG-island No: 28093
tagcgcggcggtttcgggggtttaattttataatttttttcgggcgatttaagtacggcgttcgtttcggcgttttttgaagtattttaaaggtttttttttaagtagacgcgtagagtttacgtgttgttttcggcgcgcgtagaggcggaagcgttttagatgcggttattgggtattcgtttgcgatgtagtcgatgcggttttcgtgggtcgtttttaggtgtcgcgttaggaggtcgatggcggcgcggaaggaggcggggttttttaggacgggcgagatgtttttggatttaaggataggtttggtgacgtcggggtcgaaggagggtagggtttcgggggcgaaagacgagggttttcgtttcgttcgttcggaggtcgcgggttacgcgtttttattcgtaggttcgtaggtcggggcgttacgagggcggtttgtgcgtgtatttgaatattacgtttggggtggggaagtcggggaagttgcggattcgttgtttaattagttgtagttcggagtcggttatggtcgcgtgcgaagagtttgcggtagttcgagcgcgtttgcgcggggacgggcgggatcgttacgaggggtggggtattttcggagggcggagcgtgggtgaggggcggggtattcgtcgtcggaagtttgtatcgtattttatggatttttaggcgttatcgattttaagacgcgttcgtattttacgtattattgagtagaacgttcgaatcggataaaagtgcgagttaaggcgtttttttttgtttcgggttacgtttttgattgtagttaggtagttgtgggtcggggttttggcggttggaggaggggcgtga

SEQ ID NO: 28094 - DNA, 852 bp, Artificial Sequence
  chemically treated genomic DNA (Homo sapiens) CpG-island No: 28094
tcacgcccctcctccaaccgccaaaaccccgacccacaactacctaactacaatcaaaaacgtaacccgaaacaaaaaaaaacgccttaactcgcacttttatccgattcgaacgttctactcaataatacgtaaaatacgaacgcgtcttaaaatcgataacgcctaaaaatccataaaatacgatacaaacttccgacgacgaataccccgcccctcacccacgctccgccctccgaaaataccccacccctcgtaacgatcccgcccgtccccgcgcaaacgcgctcgaactaccgcaaactcttcgcacgcgaccataaccgactccgaactacaactaattaaacaacgaatccgcaacttccccgacttccccaccccaaacgtaatattcaaatacacgcacaaaccgccctcgtaacgccccgacctacgaacctacgaataaaaacgcgtaacccgcgacctccgaacgaacgaaacgaaaaccctcgtctttcgcccccgaaaccctaccctccttcgaccccgacgtcaccaaacctatccttaaatccaaaaacatctcgcccgtcctaaaaaaccccgcctccttccgcgccgccatcgacctcctaacgcgacacctaaaaacgacccacgaaaaccgcatcgactacatcgcaaacgaatacccaataaccgcatctaaaacgcttccgcctctacgcgcgccgaaaacaacacgtaaactctacgcgtctacttaaaaaaaaacctttaaaatacttcaaaaaacgccgaaacgaacgccgtacttaaatcgcccgaaaaaaattataaaattaaacccccgaaaccgccgcgcta

SEQ ID NO: 28095 - DNA, 852 bp, Artificial Sequence
  chemically treated genomic DNA (Homo sapiens) CpG-island No: 28095
ttacgttttttttttagtcgttaaggtttcggtttatagttgtttggttgtagttagaagcgtagttcgagataaggaagggcgttttgattcgtatttttgttcggttcgaacgttttgtttagtggtgcgtggaatgcgagcgcgttttaaaatcgatggcgtttaggagtttatgaaatacggtataggttttcggcgacggatgtttcgttttttatttacgtttcgtttttcggggatgttttatttttcgtggcggtttcgttcgttttcgcgtaggcgcgttcgggttgtcgtaggtttttcgtacgcggttatggtcgatttcgagttgtagttggttgagtagcggattcgtagttttttcgatttttttattttaggcgtggtatttaggtgtacgtataggtcgttttcgtggcgtttcgatttgcgggtttacggatgggagcgcgtggttcgcgattttcgggcgggcggggcgggaattttcgtttttcgttttcggggttttgttttttttcggtttcggcgttattaggtttgtttttgggtttagggatatttcgttcgttttgaaggatttcgttttttttcgcgtcgttatcggttttttggcgcgatatttgaaggcgatttacgggggtcgtatcgattatatcgtaggcgagtgtttagtggtcgtatttagggcgttttcgtttttgcgcgcgtcgagggtagtacgtgggttttgcgcgtttgtttgggggagggtttttggggtgttttagggggcgtcgggacgggcgtcgtgtttgggtcgttcgggaagggttgtgagattgagttttcgaggtcgtcgcgttg

SEQ ID NO: 28096 - DNA, 852 bp, Artificial Sequence
  chemically treated genomic DNA (Homo sapiens) CpG-island No: 28096
caacgcgacgacctcgaaaactcaatctcacaacccttcccgaacgacccaaacacgacgcccgtcccgacgccccctaaaacaccccaaaaaccctcccccaaacaaacgcgcaaaacccacgtactaccctcgacgcgcgcaaaaacgaaaacgccctaaatacgaccactaaacactcgcctacgatataatcgatacgacccccgtaaatcgccttcaaatatcgcgccaaaaaaccgataacgacgcgaaaaaaaacgaaatccttcaaaacgaacgaaatatccctaaacccaaaaacaaacctaataacgccgaaaccgaaaaaaaacaaaaccccgaaaacgaaaaacgaaaattcccgccccgcccgcccgaaaatcgcgaaccacgcgctcccatccgtaaacccgcaaatcgaaacgccacgaaaacgacctatacgtacacctaaataccacgcctaaaataaaaaaatcgaaaaaactacgaatccgctactcaaccaactacaactcgaaatcgaccataaccgcgtacgaaaaacctacgacaacccgaacgcgcctacgcgaaaacgaacgaaaccgccacgaaaaataaaacatccccgaaaaacgaaacgtaaataaaaaacgaaacatccgtcgccgaaaacctataccgtatttcataaactcctaaacgccatcgattttaaaacgcgctcgcattccacgcaccactaaacaaaacgttcgaaccgaacaaaaatacgaatcaaaacgcccttccttatctcgaactacgcttctaactacaaccaaacaactataaaccgaaaccttaacgactaaaaaaaaaacgtaa

SEQ ID NO: 28097 - DNA, 1017 bp, Artificial Sequence
  chemically treated genomic DNA (Homo sapiens) CpG-island No: 28097
tcgcggttttttttattcgggtaaatatcgtttcgttcggcggtttttttttcgtagcgtttcggcggagacgttagtcgcgttatgttcggcgttcgttcgatcgttttcgtgggtacgcggtgtcgttttttttagtcgtcgtcgtttttttagttcggttttgggataggagtttcgtcgtcgtttggcgcgtttatgttttaggaatgcgggcgttcgggtcgcgcgtttttgggaattttcgcgttcgttcgttcgtagttttcgtttcggtcggcgtcgttcggtgtttaggtcgtggggagtcgagacgtagttttttttcgtcgtttttaggcgttcgttttttatttattcgttagtagcgcgtagggtagtagtagttagtataggatcgcgtcgagtacgtgcggttttatggttggagggtttagggttcggtttagatcgagcggacgtcgcggcgttatggggcggtgcgggggtttcggggtcggcgcgttatggttgattcgcggggattcgcgcgtcgtttttttttttttttttttttttttcggtcgtttcgtcggtgtcgacgtttcgggttcgcgttcgtttaggcgatcgttttgtttttcggcggagcgtagcgttcgggtttattggggtcgagttgggtcggacgggggtttttttcgttttttttcgttcgcgggtttttataagttcggttttcgttcgtttttttcggcgtgttcgttttcgcgttttttcgacggttcggcgcgtttaggtatttttttcgttgtttcgcgcggttcgtttcgttttcggttcgttttggtgcgttggggtttggagattttcgattggcgttggttcggagcggattttttttttttcgtagttttggtttcgcggtttcgagcgtgcgcggcggtgggtaggggcgtttttcgttgggtgggttgcggttggggttcgggcgttatataaggggtttcggggtttttggtttttttaggtagcgtt

SEQ ID NO: 28098 - DNA, 1017 bp, Artificial Sequence
  chemically treated genomic DNA (Homo sapiens) CpG-island No: 28098
aacgctacctaaaaaaaccaaaaaccccgaaaccccttatataacgcccgaaccccaaccgcaacccacccaacgaaaaacgcccctacccaccgccgcgcacgctcgaaaccgcgaaaccaaaactacgaaaaaaaaaaaatccgctccgaaccaacgccaatcgaaaatctccaaaccccaacgcaccaaaacgaaccgaaaacgaaacgaaccgcgcgaaacaacgaaaaaaatacctaaacgcgccgaaccgtcgaaaaaacgcgaaaacgaacacgccgaaaaaaacgaacgaaaaccgaacttataaaaacccgcgaacgaaaaaaaacgaaaaaaacccccgtccgacccaactcgaccccaataaacccgaacgctacgctccgccgaaaaacaaaacgatcgcctaaacgaacgcgaacccgaaacgtcgacaccgacgaaacgaccgaaaaaaaaaaaaaaaaaaaaaaaaacgacgcgcgaatccccgcgaatcaaccataacgcgccgaccccgaaacccccgcaccgccccataacgccgcgacgtccgctcgatctaaaccgaaccctaaaccctccaaccataaaaccgcacgtactcgacgcgatcctatactaactactactaccctacgcgctactaacgaataaataaaaaacgaacgcctaaaaacgacgaaaaaaaactacgtctcgactccccacgacctaaacaccgaacgacgccgaccgaaacgaaaactacgaacgaacgaacgcgaaaattcccaaaaacgcgcgacccgaacgcccgcattcctaaaacataaacgcgccaaacgacgacgaaactcctatcccaaaaccgaactaaaaaaacgacgacgactaaaaaaaacgacaccgcgtacccacgaaaacgatcgaacgaacgccgaacataacgcgactaacgtctccgccgaaacgctacgaaaaaaaaaccgccgaacgaaacgatatttacccgaataaaaaaaaccgcga

SEQ ID NO: 28099 - DNA, 1017 bp, Artificial Sequence
  chemically treated genomic DNA (Homo sapiens) CpG-island No: 28099
ggcgttgtttgggggagttagaggtttcgggattttttatgtagcgttcgggttttagtcgtagtttatttagcgagaagcgtttttgtttatcgtcgcgtacgttcggagtcgcggggttaagattgcgggaggggaggggttcgtttcgggttagcgttagtcgggggtttttaggttttaacgtattagggcgggtcggaggcgggacgggtcgcgcgggatagcggagggggtgtttgggcgcgtcgggtcgtcggggaagcgcggaggcgggtacgtcggggagggcgggcgggggtcgagtttataaaggttcgcgggcggaggagggcggggaggattttcgttcggtttagttcggttttagtgagttcgagcgttgcgtttcgtcggggggtagggcggtcgtttgagcgagcgcgggttcgggacgtcggtatcggcggggcggtcgaaggagaaggaggaagaggagaaggcggcgcgcgggttttcgcgggttagttatggcgcgtcggtttcggggttttcgtatcgttttatagcgtcgcggcgttcgttcggtttgggtcgggttttgggttttttagttatggagtcgtacgtgttcggcgcggttttgtattggttgttgttgttttgcgcgttgttggcgggtgagtggggggcgggcgtttgggggcgacgggagggggttgcgtttcggttttttacggtttggatatcggacgacgtcggtcggggcgagggttgcgggcgagcgggcgcggaaatttttagggacgcgcgattcgggcgttcgtatttttgaagtatgagcgcgttaggcggcggcggggtttttgttttagggtcgggttggaagggcggcggcggttgggggagacggtatcgcgtgtttacgggggcggtcgagcgagcgtcgggtatagcgcggttggcgttttcgtcggggcgttgcggagaggaggtcgtcgggcgaggcggtgtttgttcgggtgggaagggtcgcgg

SEQ ID NO: 28100 - DNA, 1017 bp, Artificial Sequence
  chemically treated genomic DNA (Homo sapiens) CpG-island No: 28100
ccgcgacccttcccacccgaacaaacaccgcctcgcccgacgacctcctctccgcaacgccccgacgaaaacgccaaccgcgctatacccgacgctcgctcgaccgcccccgtaaacacgcgataccgtctcccccaaccgccgccgcccttccaacccgaccctaaaacaaaaaccccgccgccgcctaacgcgctcatacttcaaaaatacgaacgcccgaatcgcgcgtccctaaaaatttccgcgcccgctcgcccgcaaccctcgccccgaccgacgtcgtccgatatccaaaccgtaaaaaaccgaaacgcaaccccctcccgtcgcccccaaacgcccgccccccactcacccgccaacaacgcgcaaaacaacaacaaccaatacaaaaccgcgccgaacacgtacgactccataactaaaaaacccaaaacccgacccaaaccgaacgaacgccgcgacgctataaaacgatacgaaaaccccgaaaccgacgcgccataactaacccgcgaaaacccgcgcgccgccttctcctcttcctccttctccttcgaccgccccgccgataccgacgtcccgaacccgcgctcgctcaaacgaccgccctaccccccgacgaaacgcaacgctcgaactcactaaaaccgaactaaaccgaacgaaaatcctccccgccctcctccgcccgcgaacctttataaactcgacccccgcccgccctccccgacgtacccgcctccgcgcttccccgacgacccgacgcgcccaaacaccccctccgctatcccgcgcgacccgtcccgcctccgacccgccctaatacgttaaaacctaaaaacccccgactaacgctaacccgaaacgaacccctcccctcccgcaatcttaaccccgcgactccgaacgtacgcgacgataaacaaaaacgcttctcgctaaataaactacgactaaaacccgaacgctacataaaaaatcccgaaacctctaactcccccaaacaacgcc

SEQ ID NO: 28101 - DNA, 945 bp, Artificial Sequence
  chemically treated genomic DNA (Homo sapiens) CpG-island No: 28101
agcgaggtttcgttttttacgcggggtttttcggagtaagttcggtcgggatttttcggggtaggagtgcggcgggaaggcgaggggcggtttggcgggttcggtcgttagtttttatttgggtcgcggcgtcgggggcggttttttaggcgtcggtttttcgtagttttcgtttatttgatatatgggtacgtcgggtttcgtcgtagattgtggcggcgatagcgcgagggcgcgtttcgatgacgtcggagtggcgtcgtgacggtcgcgaagttcggttgggggcggcgttttacgatgacgttagcgcggcgtagtagcggttgtgattagcgggtcggttcgggttaggatagcgggcggcgggcggcgcgggtttggtttcgggatggttatgtttcgtagtttggtggtttcggtttagtagcggtagtcgtcggtcgggtcggcgggcggcgatagcggtttggaggcgtagtatatttgttttatttgtttggaggtttattatcggttcgtggttatcggtagttgcggttatacgtgagcgcgttcgtttaggggtcgcggggagggggtcgtgtttcgtcgcgggaggggtcgcgaggtcggcggtcgtttcggtgtagtttcggattgggcgcgcggggattcggggcgtcggggtttcggggcgcgtggggttcgggtttttttgtgtcgcgtcgtttttgttttttgggcgcgtttatttttcgtttagtttttttcgcgttagtcgtaggcgttcggttcgattgttgtttcggtttatcgggcgatttgcggttttgtttaagttcggggttttcggcggttgcggcgggcgtttcggtatttagagggtagtaggtgttatcgtttcgttagtggtggtggatttgggtttgtgcggttggaatgggtagttgtaaataaataatt

SEQ ID NO: 28102 - DNA, 945 bp, Artificial Sequence
  chemically treated genomic DNA (Homo sapiens) CpG-island No: 28102
aattatttatttacaactacccattccaaccgcacaaacccaaatccaccaccactaacgaaacgataacacctactaccctctaaataccgaaacgcccgccgcaaccgccgaaaaccccgaacttaaacaaaaccgcaaatcgcccgataaaccgaaacaacaatcgaaccgaacgcctacgactaacgcgaaaaaaactaaacgaaaaataaacgcgcccaaaaaacaaaaacgacgcgacacaaaaaaacccgaaccccacgcgccccgaaaccccgacgccccgaatccccgcgcgcccaatccgaaactacaccgaaacgaccgccgacctcgcgacccctcccgcgacgaaacacgaccccctccccgcgacccctaaacgaacgcgctcacgtataaccgcaactaccgataaccacgaaccgataataaacctccaaacaaataaaacaaatatactacgcctccaaaccgctatcgccgcccgccgacccgaccgacgactaccgctactaaaccgaaaccaccaaactacgaaacataaccatcccgaaaccaaacccgcgccgcccgccgcccgctatcctaacccgaaccgacccgctaatcacaaccgctactacgccgcgctaacgtcatcgtaaaacgccgcccccaaccgaacttcgcgaccgtcacgacgccactccgacgtcatcgaaacgcgccctcgcgctatcgccgccacaatctacgacgaaacccgacgtacccatatatcaaataaacgaaaactacgaaaaaccgacgcctaaaaaaccgcccccgacgccgcgacccaaataaaaactaacgaccgaacccgccaaaccgcccctcgccttcccgccgcactcctaccccgaaaaatcccgaccgaacttactccgaaaaaccccgcgtaaaaaacgaaacctcgct

SEQ ID NO: 28103 - DNA, 945 bp, Artificial Sequence
  chemically treated genomic DNA (Homo sapiens) CpG-island No: 28103
agttatttatttataattgtttattttagtcgtataagtttaaatttattattattggcggagcggtggtatttgttgttttttgagtatcggagcgttcgtcgtagtcgtcggggatttcgagtttgggtagggtcgtaggtcgttcggtgaatcgaagtagtagtcggatcgggcgtttgcggttggcgcgaaggaggttgggcgggggatgaacgcgtttagagggtagaggcggcgcggtatagggaaattcggattttacgcgtttcgaggtttcggcgtttcgagttttcgcgcgtttagttcggggttgtatcggggcggtcgtcggtttcgcgatttttttcgcggcggggtacggtttttttttcgcggtttttgggcgggcgcgtttacgtgtggtcgtagttgtcgatggttacgggtcggtgatagatttttaggtagatggggtaggtgtattgcgtttttaggtcgttgtcgtcgttcgtcggttcggtcggcggttgtcgttgttgagtcgaggttattaggttgcggaatatagttatttcggggttaggttcgcgtcgttcgtcgttcgttgttttggttcgggtcggttcgttagttatagtcgttattgcgtcgcgttgacgttatcgtagggcgtcgtttttagtcgggtttcgcggtcgttacggcgttatttcgacgttatcggggcgcgttttcgcgttgtcgtcgttatagtttgcgacgggattcggcgtgtttatgtgttaggtgggcgaggattacggggagtcggcgtttgaggagtcgttttcggcgtcgcggtttaggtaagagttggcggtcggattcgttaggtcgtttttcgttttttcgtcgtatttttgtttcgaagggtttcggtcgggtttgtttcgggaagtttcgcgtggagagcgggatttcgtt

SEQ ID NO: 28104 - DNA, 945 bp, Artificial Sequence
  chemically treated genomic DNA (Homo sapiens) CpG-island No: 28104
aacgaaatcccgctctccacgcgaaacttcccgaaacaaacccgaccgaaacccttcgaaacaaaaatacgacgaaaaaacgaaaaacgacctaacgaatccgaccgccaactcttacctaaaccgcgacgccgaaaacgactcctcaaacgccgactccccgtaatcctcgcccacctaacacataaacacgccgaatcccgtcgcaaactataacgacgacaacgcgaaaacgcgccccgataacgtcgaaataacgccgtaacgaccgcgaaacccgactaaaaacgacgccctacgataacgtcaacgcgacgcaataacgactataactaacgaaccgacccgaaccaaaacaacgaacgacgaacgacgcgaacctaaccccgaaataactatattccgcaacctaataacctcgactcaacaacgacaaccgccgaccgaaccgacgaacgacgacaacgacctaaaaacgcaatacacctaccccatctacctaaaaatctatcaccgacccgtaaccatcgacaactacgaccacacgtaaacgcgcccgcccaaaaaccgcgaaaaaaaaaccgtaccccgccgcgaaaaaaatcgcgaaaccgacgaccgccccgatacaaccccgaactaaacgcgcgaaaactcgaaacgccgaaacctcgaaacgcgtaaaatccgaatttccctataccgcgccgcctctaccctctaaacgcgttcatcccccgcccaacctccttcgcgccaaccgcaaacgcccgatccgactactacttcgattcaccgaacgacctacgaccctacccaaactcgaaatccccgacgactacgacgaacgctccgatactcaaaaaacaacaaataccaccgctccgccaataataataaatttaaacttatacgactaaaataaacaattataaataaataact

SEQ ID NO: 28105 - DNA, 651 bp, Artificial Sequence
  chemically treated genomic DNA (Homo sapiens) CpG-island No: 28105
cggggtgcgtggggaggagagcggtgaggtcgagtacggggtgcgtggggaggagagcggtgaggtcgagtacggggtgcgtggggaggagagcggtgaggtcgagtacggggagcgtggggaggagagcggtgaggtcgagtacggggtgcgtggggaggagagcggtgaggtcgagtacggggtgcgtggggaggagagcggtgaggtcgagtacggggtgcgtggggaggagagcggtgaggtcgagtacggggtgcgtggggaggagagcggtgaggtcgagtacggggtgcgtggggaggagagcggtgaggtcgagtacggggtgcgtggggaggagagcggtgaggtcgagtacggggtgcgtggggaggagagcggtgaggtcgagtacggggagcgtggggaggagagcggtgaggtcgagtacggggtgcgtggggaggagagcggtgaggtcgagtacggggtgcgtggggaggagagcggtgaggtcgagtacggggtgcgtggggaggagagcggtgaggtcgagtacggggagcgtggggaggagggtggtgaggttgagtatggggtgcgtggaggttgagtatagggtgcgtggggaggagagcggtgaggatgagtacggggtgtatgggggag

SEQ ID NO: 28106 - DNA, 651 bp, Artificial Sequence
  chemically treated genomic DNA (Homo sapiens) CpG-island No: 28106
ctcccccatacaccccgtactcatcctcaccgctctcctccccacgcaccctatactcaacctccacgcaccccatactcaacctcaccaccctcctccccacgctccccgtactcgacctcaccgctctcctccccacgcaccccgtactcgacctcaccgctctcctccccacgcaccccgtactcgacctcaccgctctcctccccacgcaccccgtactcgacctcaccgctctcctccccacgctccccgtactcgacctcaccgctctcctccccacgcaccccgtactcgacctcaccgctctcctccccacgcaccccgtactcgacctcaccgctctcctccccacgcaccccgtactcgacctcaccgctctcctccccacgcaccccgtactcgacctcaccgctctcctccccacgcaccccgtactcgacctcaccgctctcctccccacgcaccccgtactcgacctcaccgctctcctccccacgcaccccgtactcgacctcaccgctctcctccccacgctccccgtactcgacctcaccgctctcctccccacgcaccccgtactcgacctcaccgctctcctccccacgcaccccgtactcgacctcaccgctctcctccccacgcaccccg

SEQ ID NO: 28107 - DNA, 651 bp, Artificial Sequence
  chemically treated genomic DNA (Homo sapiens) CpG-island No: 28107
tttttttatgtatttcgtgtttatttttatcgtttttttttttacgtattttgtgtttagtttttacgtattttatgtttagttttattatttttttttttacgtttttcgtgttcggttttatcgtttttttttttacgtatttcgtgttcggttttatcgtttttttttttacgtatttcgtgttcggttttatcgtttttttttttacgtatttcgtgttcggttttatcgtttttttttttacgtttttcgtgttcggttttatcgtttttttttttacgtatttcgtgttcggttttatcgtttttttttttacgtatttcgtgttcggttttatcgtttttttttttacgtatttcgtgttcggttttatcgtttttttttttacgtatttcgtgttcggttttatcgtttttttttttacgtatttcgtgttcggttttatcgtttttttttttacgtatttcgtgttcggttttatcgtttttttttttacgtatttcgtgttcggttttatcgtttttttttttacgtttttcgtgttcggttttatcgtttttttttttacgtatttcgtgttcggttttatcgtttttttttttacgtatttcgtgttcggttttatcgtttttttttttacgtatttcg

SEQ ID NO: 28108 - DNA, 651 bp, Artificial Sequence
  chemically treated genomic DNA (Homo sapiens) CpG-island No: 28108
cgaaatacgtaaaaaaaaaaacgataaaaccgaacacgaaatacgtaaaaaaaaaaacgataaaaccgaacacgaaatacgtaaaaaaaaaaacgataaaaccgaacacgaaaaacgtaaaaaaaaaaacgataaaaccgaacacgaaatacgtaaaaaaaaaaacgataaaaccgaacacgaaatacgtaaaaaaaaaaacgataaaaccgaacacgaaatacgtaaaaaaaaaaacgataaaaccgaacacgaaatacgtaaaaaaaaaaacgataaaaccgaacacgaaatacgtaaaaaaaaaaacgataaaaccgaacacgaaatacgtaaaaaaaaaaacgataaaaccgaacacgaaatacgtaaaaaaaaaaacgataaaaccgaacacgaaaaacgtaaaaaaaaaaacgataaaaccgaacacgaaatacgtaaaaaaaaaaacgataaaaccgaacacgaaatacgtaaaaaaaaaaacgataaaaccgaacacgaaatacgtaaaaaaaaaaacgataaaaccgaacacgaaaaacgtaaaaaaaaaaataataaaactaaacataaaatacgtaaaaactaaacacaaaatacgtaaaaaaaaaaacgataaaaataaacacgaaatacataaaaaaa

SEQ ID NO: 28109 - DNA, 637 bp, Artificial Sequence
  chemically treated genomic DNA (Homo sapiens) CpG-island No: 28109
ttttatttcgtttttttttttattcgtttttttttttttcgttttatttcggttttgtttcgttttatcgttcgtatttacgtcgtttatgagtaggagtaggatgttggggggttgcggggcgttcgaggtttttattttcgcggcgttgagtattagtaatagttgttattatttcgtcgtcgcgataatcgtcgttatggtaattacgggagtcgcggagtttcggttagcgagtcgatttagcgagcgttcgtcggttttttcggttgggttgcggggcggggtttggacggttacgtgattcgcggggcggggttagagttcgcggagggacgggaggcggggtttggattgtttcgtgattagtggggcggggtttgagttagttgtgtgcggatggggcggggttttggaggtcgcgtgattagcggcgggttacgtgacgcggtgtttggcgtcgagttttttaagatggcggtgtgtatcgcggtgattgttaaggaggtgcgtacgcgcggcgtggggcgttcgggttcgtattattttcggtttttcgttttttttttattttttttttgggtttagaaggtattttaggaaatgggatttggaggaggttttcgtcgagttttag

SEQ ID NO: 28110 - DNA, 637 bp, Artificial Sequence
  chemically treated genomic DNA (Homo sapiens) CpG-island No: 28110
ctaaaactcgacgaaaacctcctccaaatcccatttcctaaaataccttctaaacccaaaaaaaaaataaaaaaaaaacgaaaaaccgaaaataatacgaacccgaacgccccacgccgcgcgtacgcacctccttaacaatcaccgcgatacacaccgccatcttaaaaaactcgacgccaaacaccgcgtcacgtaacccgccgctaatcacgcgacctccaaaaccccgccccatccgcacacaactaactcaaaccccgccccactaatcacgaaacaatccaaaccccgcctcccgtccctccgcgaactctaaccccgccccgcgaatcacgtaaccgtccaaaccccgccccgcaacccaaccgaaaaaaccgacgaacgctcgctaaatcgactcgctaaccgaaactccgcgactcccgtaattaccataacgacgattatcgcgacgacgaaataataacaactattactaatactcaacgccgcgaaaataaaaacctcgaacgccccgcaaccccccaacatcctactcctactcataaacgacgtaaatacgaacgataaaacgaaacaaaaccgaaataaaacgaaaaaaaaaaaaacgaataaaaaaaaaaacgaaataaaa

SEQ ID NO: 28111 - DNA, 637 bp, Artificial Sequence
  chemically treated genomic DNA (Homo sapiens) CpG-island No: 28111
ttggagttcggcgaaggttttttttaggttttattttttaaggtgttttttaagtttagggaagaagtagaaagaaagcggagagtcgaggatggtgcgagttcggacgttttacgtcgcgcgtacgtatttttttggtaattatcgcgatgtatatcgttattttgggaggttcggcgttaggtatcgcgttacgtgattcgtcgttggttacgcggtttttaaagtttcgttttattcgtatatagttggtttaggtttcgttttattggttacgaggtagtttaggtttcgtttttcgttttttcgcggattttggtttcgtttcgcgagttacgtggtcgtttaggtttcgtttcgtagtttagtcggaagggtcggcggacgttcgttaggtcggttcgttggtcggggtttcgcggttttcgtggttgttatggcggcggttgtcgcggcgacgaggtggtggtagttgttgttggtgtttagcgtcgcggggatgggggtttcgggcgtttcgtagttttttaatattttgtttttgtttatggacgacgtgagtgcgggcggtgggacggggtagggtcggggtggggcggggaggggaggggcggatggagggaggagcgaggtgggg

SEQ ID NO: 28112 - DNA, 637 bp, Artificial Sequence
  chemically treated genomic DNA (Homo sapiens) CpG-island No: 28112
ccccacctcgctcctccctccatccgcccctcccctccccgccccaccccgaccctaccccgtcccaccgcccgcactcacgtcgtccataaacaaaaacaaaatattaaaaaactacgaaacgcccgaaacccccatccccgcgacgctaaacaccaacaacaactaccaccacctcgtcgccgcgacaaccgccgccataacaaccacgaaaaccgcgaaaccccgaccaacgaaccgacctaacgaacgtccgccgacccttccgactaaactacgaaacgaaacctaaacgaccacgtaactcgcgaaacgaaaccaaaatccgcgaaaaaacgaaaaacgaaacctaaactacctcgtaaccaataaaacgaaacctaaaccaactatatacgaataaaacgaaactttaaaaaccgcgtaaccaacgacgaatcacgtaacgcgatacctaacgccgaacctcccaaaataacgatatacatcgcgataattaccaaaaaaatacgtacgcgcgacgtaaaacgtccgaactcgcaccatcctcgactctccgctttctttctacttcttccctaaacttaaaaaacaccttaaaaaataaaacctaaaaaaaaccttcgccgaactccaa

SEQ ID NO: 28113 - DNA, 851 bp, Artificial Sequence
  chemically treated genomic DNA (Homo sapiens) CpG-island No: 28113
gtgttgcggtcggcgtggttcggagattagttttttaatttcgaggtggggtggattcgggtgtttcgcggttatagttttttttcgtttttagaagcgtagtttcgcggttcgttcgtcgttcgcgagggtcgtattttgttttcggtttttagcggcgtttggttacgttttcggcgggtggagtcgggcggggcgtcgggtaggtttttttgcgtttcgcggcggcggtagcggcggcgacggcgatatggagagcggggtttacggcgcggttaaggcgggcggttttttcgatttgcggcgttttttgacgtagtcgtaggtggtggcgcgcgtcgtgtgtttggtgagttcggggagggcgggtcgagggtattttggggatttttttttcgtcgttaggttcggcggggtttttagtttacgagcgcgataggtggcggcggtcgcgttcggggtttggcggcgagcggggtcggcgtttagcgtttcgggtttcgttttttcgttttttatagtttgtttcgttgttttttttcggtttcgggtttcgttatttattttatttttagtttcgcgtttcgacgcggggtgttcggattttcgtagggagcgggtttttgtttcgttggtagtgggaggagtttgggggcggttttcggataggtggttcgtacgtcgcgatttttagattggggagtttatcgggacggggtttttcgaagttacgtggggtaagggagggggcggggggcgatttaacgttcggaaatagggtgttttttttattcggggtaggttacgggttcgtttttttattcgaagttgagggattttaagatgtattt

SEQ ID NO: 28114 - DNA, 851 bp, Artificial Sequence
  chemically treated genomic DNA (Homo sapiens) CpG-island No: 28114
aaatacatcttaaaatccctcaacttcgaataaaaaaacgaacccgtaacctaccccgaataaaaaaaacaccctatttccgaacgttaaatcgccccccgccccctcccttaccccacgtaacttcgaaaaaccccgtcccgataaactccccaatctaaaaatcgcgacgtacgaaccacctatccgaaaaccgcccccaaactcctcccactaccaacgaaacaaaaacccgctccctacgaaaatccgaacaccccgcgtcgaaacgcgaaactaaaaataaaataaataacgaaacccgaaaccgaaaaaaaacaacgaaacaaactataaaaaacgaaaaaacgaaacccgaaacgctaaacgccgaccccgctcgccgccaaaccccgaacgcgaccgccgccacctatcgcgctcgtaaactaaaaaccccgccgaacctaacgacgaaaaaaaaatccccaaaataccctcgacccgccctccccgaactcaccaaacacacgacgcgcgccaccacctacgactacgtcaaaaaacgccgcaaatcgaaaaaaccgcccgccttaaccgcgccgtaaaccccgctctccatatcgccgtcgccgccgctaccgccgccgcgaaacgcaaaaaaacctacccgacgccccgcccgactccacccgccgaaaacgtaaccaaacgccgctaaaaaccgaaaacaaaatacgaccctcgcgaacgacgaacgaaccgcgaaactacgcttctaaaaacgaaaaaaaactataaccgcgaaacacccgaatccaccccacctcgaaattaaaaaactaatctccgaaccacgccgaccgcaacac

SEQ ID NO: 28115 - DNA, 851 bp, Artificial Sequence
  chemically treated genomic DNA (Homo sapiens) CpG-island No: 28115
gggtatattttggggttttttaatttcgggtgggaaggcggattcgtggtttgtttcgagtgggaaggatattttgttttcgggcgttgggtcgtttttcgtttttttttttattttacgtggtttcggaaaatttcgtttcggtgaattttttaatttgggagtcgcggcgtgcgggttatttgttcgggagtcgtttttaaattttttttattgttagcgaggtaggggttcgttttttgcggagattcggatatttcgcgtcggggcgcgaggttgggggtggggtgggtggcgggattcgggatcgggaggggatagcgggatagattgtggagggcgggaaggcggggttcgggacgttggacgtcggtttcgttcgtcgttaggtttcggacgcggtcgtcgttatttgtcgcgttcgtgggttaggggtttcgtcgggtttggcgacggagagggggtttttagggtgttttcggttcgtttttttcgggtttattaagtatacggcgcgcgttattatttgcggttgcgttaggaagcgtcgtaggtcgaaggagtcgttcgttttggtcgcgtcgtaggtttcgttttttatgtcgtcgtcgtcgtcgttgtcgtcgtcgcggaacgtagaggaatttgttcggcgtttcgttcgattttattcgtcgggggcgtggttaggcgtcgttagggatcgagggtaaagtgcggttttcgcgagcggcgggcgagtcgcgggattgcgtttttagaggcggggaggggttgtggtcgcggagtattcgggtttattttatttcggggttgaggggttagttttcgggttacgtcggtcgtagtat

SEQ ID NO: 28116 - DNA, 851 bp, Artificial Sequence
  chemically treated genomic DNA (Homo sapiens) CpG-island No: 28116
atactacgaccgacgtaacccgaaaactaacccctcaaccccgaaataaaataaacccgaatactccgcgaccacaacccctccccgcctctaaaaacgcaatcccgcgactcgcccgccgctcgcgaaaaccgcactttaccctcgatccctaacgacgcctaaccacgcccccgacgaataaaatcgaacgaaacgccgaacaaattcctctacgttccgcgacgacgacaacgacgacgacgacgacataaaaaacgaaacctacgacgcgaccaaaacgaacgactccttcgacctacgacgcttcctaacgcaaccgcaaataataacgcgcgccgtatacttaataaacccgaaaaaaacgaaccgaaaacaccctaaaaaccccctctccgtcgccaaacccgacgaaacccctaacccacgaacgcgacaaataacgacgaccgcgtccgaaacctaacgacgaacgaaaccgacgtccaacgtcccgaaccccgccttcccgccctccacaatctatcccgctatcccctcccgatcccgaatcccgccacccaccccacccccaacctcgcgccccgacgcgaaatatccgaatctccgcaaaaaacgaacccctacctcgctaacaataaaaaaaatttaaaaacgactcccgaacaaataacccgcacgccgcgactcccaaattaaaaaattcaccgaaacgaaattttccgaaaccacgtaaaataaaaaaaaaaacgaaaaacgacccaacgcccgaaaacaaaatatccttcccactcgaaacaaaccacgaatccgccttcccacccgaaattaaaaaaccccaaaatataccc

SEQ ID NO: 28117 - DNA, 1452 bp, Artificial Sequence
  chemically treated genomic DNA (Homo sapiens) CpG-island No: 28117
tagtaagttatttgcggttgttgtttattagggttcgtttggggttattgagattacgcgtcggtgttcgttttttcgttgcggttcgattttttgaattaattaggcgttttcgggcgttttgttttagacgggtttatcgtttgcgcgggtcgagggcggcgtatttgtttttgcgttttcgtatcgaaggtgaggtcggaggaagagaagatcgtaatttttaagttttcgcggcgtggggttcggggggggatacgaggcggggttattaggacgtcgatagttttacgtttttgggttcgcggcgcgtaaggtatgtcgggattcgtagtttcgcgacgttgcgatttatagtgcgcgatgggagtggaggagagcggttcgcggtgtatgtcggaattcgtagtttcgggatgttgggttttagcgcgtgatggggtaatggtacgtaggtttgcgttgaacgttgggattcgtagtttcgttatgttttgttcgcggtgtacgtcgggatacgtagtttcgagcgcgttaagatcgttattgggattgggcgatagcggttcgcgttgtatgtcgttgttttacggtgtcggcgtttcgaggaaaagtaggtagggtttaggaacgtagttttttacggtcggtacgtagggttggttttaggacggagtcggtttcggtttcgcgcggcgttcgtatttatacgcgtacgtacgtacgtacgcggcgtttttgcgtgacgttacgcgttttttaggaagtcggcgcgggttaggcgacgggtggaagtcggtatcgagaggaattatagcgtcgtcgtttgggttgtgtcgtcgcggtagggcgttgcgttttgagcgtagcgtaggtttcgtatcgatcgttcgttcgttttttgttcgcgatggaggtgtcggtcgcgggtcgcgtttttgtcgagggcgtttcgacggcggttgtggtcgaggtgcgttgttcggggttcgcgttcgttgcgtttgttggagtggagggtggcggcgggcgcggtcgtgcgtatcggttcggtgttggtcgtgttcgaggtcgtcgttttcgcgtagtttttcggggttttttagtttcgtgtagttttcgggggttgcgtgcgtttcgcgcggtcggaacgtaggttgaggtcggagcgcgcgggcgtggtgcgggagttgtgcgcgtagtcgggttaggtggtcgttttagggtgagtgtgttgagtcgggcggggtcgagggcgggcggtttcggggagggattttggaggattttcgggttgttgcgttcgcggtgggtaggggcgtttttggtgagggagcgataaagcgggacgtaggtattgcgttttttttttaaaattggatagttattatttgtggttttattaacggggagtattttgagataaaaggaaagggttttgcgtagcgatat

SEQ ID NO: 28118 - DNA, 1452 bp, Artificial Sequence
  chemically treated genomic DNA (Homo sapiens) CpG-island No: 28118
atatcgctacgcaaaaccctttccttttatctcaaaatactccccgttaataaaaccacaaataataactatccaattttaaaaaaaaaacgcaatacctacgtcccgctttatcgctccctcaccaaaaacgcccctacccaccgcgaacgcaacaacccgaaaatcctccaaaatccctccccgaaaccgcccgccctcgaccccgcccgactcaacacactcaccctaaaacgaccacctaacccgactacgcgcacaactcccgcaccacgcccgcgcgctccgacctcaacctacgttccgaccgcgcgaaacgcacgcaacccccgaaaactacacgaaactaaaaaaccccgaaaaactacgcgaaaacgacgacctcgaacacgaccaacaccgaaccgatacgcacgaccgcgcccgccgccaccctccactccaacaaacgcaacgaacgcgaaccccgaacaacgcacctcgaccacaaccgccgtcgaaacgccctcgacaaaaacgcgacccgcgaccgacacctccatcgcgaacaaaaaacgaacgaacgatcgatacgaaacctacgctacgctcaaaacgcaacgccctaccgcgacgacacaacccaaacgacgacgctataattcctctcgataccgacttccacccgtcgcctaacccgcgccgacttcctaaaaaacgcgtaacgtcacgcaaaaacgccgcgtacgtacgtacgtacgcgtataaatacgaacgccgcgcgaaaccgaaaccgactccgtcctaaaaccaaccctacgtaccgaccgtaaaaaactacgttcctaaaccctacctacttttcctcgaaacgccgacaccgtaaaacaacgacatacaacgcgaaccgctatcgcccaatcccaataacgatcttaacgcgctcgaaactacgtatcccgacgtacaccgcgaacaaaacataacgaaactacgaatcccaacgttcaacgcaaacctacgtaccattaccccatcacgcgctaaaacccaacatcccgaaactacgaattccgacatacaccgcgaaccgctctcctccactcccatcgcgcactataaatcgcaacgtcgcgaaactacgaatcccgacataccttacgcgccgcgaacccaaaaacgtaaaactatcgacgtcctaataaccccgcctcgtatccccccccgaaccccacgccgcgaaaacttaaaaattacgatcttctcttcctccgacctcaccttcgatacgaaaacgcaaaaacaaatacgccgccctcgacccgcgcaaacgataaacccgtctaaaacaaaacgcccgaaaacgcctaattaattcaaaaaatcgaaccgcaacgaaaaaacgaacaccgacgcgtaatctcaataaccccaaacgaaccctaataaacaacaaccgcaaataacttacta

SEQ ID NO: 28119 - DNA, 1452 bp, Artificial Sequence
  chemically treated genomic DNA (Homo sapiens) CpG-island No: 28119
gtgtcgttacgtaggattttttttttttattttaaaatgtttttcgttggtaaaattataggtggtgattatttagttttaggggagaagcgtagtgtttgcgtttcgttttatcgtttttttattaggggcgtttttgtttatcgcggacgtagtagttcgggggttttttaggattttttttcggagtcgttcgttttcggtttcgttcggtttagtatatttattttggggcgattatttggttcggttgcgcgtatagttttcgtattacgttcgcgcgtttcgattttagtttgcgtttcggtcgcgcggggcgtacgtagttttcggaggttatacgggattgagaggtttcggaggattgcgcggaggcggcggtttcgaatacggttagtatcgagtcgatgcgtacggtcgcgttcgtcgttattttttattttagtaggcgtagcgggcgcgggtttcgggtagcgtatttcggttatagtcgtcgtcggggcgttttcggtaggaacgcgattcgcggtcggtatttttatcgcggatagagggcgggcgggcggtcggtacggggtttgcgttgcgtttagagcgtagcgttttatcgcggcgatataatttaggcggcgacgttgtagtttttttcggtatcggtttttattcgtcgtttagttcgcgtcgattttttggagggcgcgtgacgttacgtaagggcgtcgcgtacgtgcgtacgtgcgcgtgtaaatacgagcgtcgcgcggggtcggagtcggtttcgttttgggattaattttgcgtgtcggtcgtgaagaattgcgtttttgagttttatttattttttttcggagcgtcggtatcgtggagtagcggtatgtaacgcgggtcgttgtcgtttagttttagtgacggttttggcgcgttcggaattacgtatttcggcgtgtatcgcggatagagtatggcgggattacgagttttagcgtttaacgtaggtttgcgtgttattattttattacgcgttgagatttagtatttcgagattacgagtttcggtatgtatcgcgagtcgtttttttttatttttatcgcgtattgtgagtcgtaacgtcgcgggattacgggtttcggtatgttttgcgcgtcgcgggtttagagacgtgaggttgtcggcgttttggtggtttcgtttcgtgttttttttcggattttacgtcgcgggagtttgggggttgcggtttttttttttttcgattttattttcgatgcggaagcgtaggggtaggtgcgtcgttttcggttcgcgtaggcggtgggttcgtttggggtaaggcgttcggaagcgtttggttggtttagaaaatcggatcgtagcgggagggcgggtatcggcgcgtggttttagtggttttaggcgaattttgatgagtagtagtcgtaagtggtttatta

SEQ ID NO: 28120 - DNA, 1452 bp, Artificial Sequence
  chemically treated genomic DNA (Homo sapiens) CpG-island No: 28120
taataaaccacttacgactactactcatcaaaattcgcctaaaaccactaaaaccacgcgccgatacccgccctcccgctacgatccgattttctaaaccaaccaaacgcttccgaacgccttaccccaaacgaacccaccgcctacgcgaaccgaaaacgacgcacctacccctacgcttccgcatcgaaaataaaatcgaaaaaaaaaaaaaccgcaacccccaaactcccgcgacgtaaaatccgaaaaaaaacacgaaacgaaaccaccaaaacgccgacaacctcacgtctctaaacccgcgacgcgcaaaacataccgaaacccgtaatcccgcgacgttacgactcacaatacgcgataaaaataaaaaaaaacgactcgcgatacataccgaaactcgtaatctcgaaatactaaatctcaacgcgtaataaaataataacacgcaaacctacgttaaacgctaaaactcgtaatcccgccatactctatccgcgatacacgccgaaatacgtaattccgaacgcgccaaaaccgtcactaaaactaaacgacaacgacccgcgttacataccgctactccacgataccgacgctccgaaaaaaaataaataaaactcaaaaacgcaattcttcacgaccgacacgcaaaattaatcccaaaacgaaaccgactccgaccccgcgcgacgctcgtatttacacgcgcacgtacgcacgtacgcgacgcccttacgtaacgtcacgcgccctccaaaaaatcgacgcgaactaaacgacgaataaaaaccgataccgaaaaaaactacaacgtcgccgcctaaattatatcgccgcgataaaacgctacgctctaaacgcaacgcaaaccccgtaccgaccgcccgcccgccctctatccgcgataaaaataccgaccgcgaatcgcgttcctaccgaaaacgccccgacgacgactataaccgaaatacgctacccgaaacccgcgcccgctacgcctactaaaataaaaaataacgacgaacgcgaccgtacgcatcgactcgatactaaccgtattcgaaaccgccgcctccgcgcaatcctccgaaacctctcaatcccgtataacctccgaaaactacgtacgccccgcgcgaccgaaacgcaaactaaaatcgaaacgcgcgaacgtaatacgaaaactatacgcgcaaccgaaccaaataatcgccccaaaataaatatactaaaccgaacgaaaccgaaaacgaacgactccgaaaaaaaatcctaaaaaacccccgaactactacgtccgcgataaacaaaaacgcccctaataaaaaaacgataaaacgaaacgcaaacactacgcttctcccctaaaactaaataatcaccacctataattttaccaacgaaaaacattttaaaataaaaaaaaaaaatcctacgtaacgacac

SEQ ID NO: 28121 - DNA, 1259 bp, Artificial Sequence
  chemically treated genomic DNA (Homo sapiens) CpG-island No: 28121
tttgaagagatcgtagagttagaatacgtatgggagggacgtacggatagaacgcgtatgggagggacgtagggttagaacgcgtacgggagggacgcggggatagaacgcgtacgggagggacgtagggatagaacgcgtacgggagggacgcgggtatagaacgcgtacgggagggacgcggggttagaacgcgtacgggagggacgcggggatagaattcgtacgggagggacgcggggatagaacgcgtacgggagggacgcggggatagaacgcgtacgggagggacgcggggatagaacgcgtacgggagggacgcggggatagaacgcgtacgggagggacgcgggtatagaacgcgtacgggagggacgcgggtatagaacgcgtacgggagggacgcgggtatagaacgcgtacgggagggacgcgggtatagaacgcgtacgggagggacgcgggtatagaacgcgtacgggagggacgcgggtatagaacgcgtacgggagggacgcggggttagaacgcgtacgggagggacgcggggatagaattcgtacgggagggacgcggggatagaacgcgtacgggagggacgcggggatagaacgcgtacgggagggacgcggggatagaacgcgtattgtatggacgcggggatagaacgcgtacgggagggacgcgggtatagaacgcgtacgggagggacgcgggtatagaacgcgtacgggagggacgcgggtatagaacgcgtacgggagggacgcgggtatagaacgcgtacgggagggacgcgggtatagaacgtttacgggagggacgcgggtatagaacgcgtacgggagggacgcggggatagaacgcgtacggtagggacgcggggatagaattcgtacgggagggattcgggtatagaacgcgtacgggagggacgcggggatagaacgtttacgtgagggacgcgggtttagaacgcgtacggtagggacgcgggtatagaacgcgtacggtagggacgcgggtatagaacgtttattggagggacgcgggtatataacgtttacgggagggacgcgggtatagaacgcgtacgggagggacgtagggatagaacgcgtacgggagggacgtagggatagaacgcgtacgggagggacgtagggatagaacgcgtatgggagggacgtataatttagttaaatacgtatgtgtgttgattatttattttttttataaaaattatttatgttatagtt

SEQ ID NO: 28122 - DNA, 1259 bp, Artificial Sequence
  chemically treated genomic DNA (Homo sapiens) CpG-island No: 28122
aactataacataaataatttttataaaaaaaataaataatcaacacacatacgtatttaactaaattatacgtccctcccatacgcgttctatccctacgtccctcccgtacgcgttctatccctacgtccctcccgtacgcgttctatccctacgtccctcccgtacgcgttctatacccgcgtccctcccgtaaacgttatatacccgcgtccctccaataaacgttctatacccgcgtccctaccgtacgcgttctatacccgcgtccctaccgtacgcgttctaaacccgcgtccctcacgtaaacgttctatccccgcgtccctcccgtacgcgttctatacccgaatccctcccgtacgaattctatccccgcgtccctaccgtacgcgttctatccccgcgtccctcccgtacgcgttctatacccgcgtccctcccgtaaacgttctatacccgcgtccctcccgtacgcgttctatacccgcgtccctcccgtacgcgttctatacccgcgtccctcccgtacgcgttctatacccgcgtccctcccgtacgcgttctatacccgcgtccctcccgtacgcgttctatccccgcgtccatacaatacgcgttctatccccgcgtccctcccgtacgcgttctatccccgcgtccctcccgtacgcgttctatccccgcgtccctcccgtacgaattctatccccgcgtccctcccgtacgcgttctaaccccgcgtccctcccgtacgcgttctatacccgcgtccctcccgtacgcgttctatacccgcgtccctcccgtacgcgttctatacccgcgtccctcccgtacgcgttctatacccgcgtccctcccgtacgcgttctatacccgcgtccctcccgtacgcgttctatacccgcgtccctcccgtacgcgttctatccccgcgtccctcccgtacgcgttctatccccgcgtccctcccgtacgcgttctatccccgcgtccctcccgtacgcgttctatccccgcgtccctcccgtacgaattctatccccgcgtccctcccgtacgcgttctaaccccgcgtccctcccgtacgcgttctatacccgcgtccctcccgtacgcgttctatccctacgtccctcccgtacgcgttctatccccgcgtccctcccgtacgcgttctaaccctacgtccctcccatacgcgttctatccgtacgtccctcccatacgtattctaactctacgatctcttcaaa

SEQ ID NO: 28123 - DNA, 1259 bp, Artificial Sequence
  chemically treated genomic DNA (Homo sapiens) CpG-island No: 28123
gattgtggtatggataatttttgtggggaagatgagtggttagtatatatacgtgtttgattggattgtgcgttttttttatgcgcgttttgtttttgcgtttttttcgtgcgcgttttgtttttgcgtttttttcgtgcgcgttttgtttttgcgtttttttcgtgcgcgttttgtgttcgcgtttttttcgtgagcgttatgtgttcgcgtttttttagtgagcgttttgtgttcgcgtttttatcgtgcgcgttttgtgttcgcgtttttatcgtgcgcgttttgagttcgcgttttttacgtgagcgttttgttttcgcgtttttttcgtgcgcgttttgtgttcgagtttttttcgtgcgggttttgttttcgcgtttttatcgtgcgcgttttgttttcgcgtttttttcgtgcgcgttttgtgttcgcgtttttttcgtgagcgttttgtgttcgcgtttttttcgtgcgcgttttgtgttcgcgtttttttcgtgcgcgttttgtgttcgcgtttttttcgtgcgcgttttgtgttcgcgtttttttcgtgcgcgttttgtgttcgcgtttttttcgtgcgcgttttgttttcgcgtttatatagtgcgcgttttgttttcgcgtttttttcgtgcgcgttttgttttcgcgtttttttcgtgcgcgttttgttttcgcgtttttttcgtgcgggttttgttttcgcgtttttttcgtgcgcgttttgatttcgcgtttttttcgtgcgcgttttgtgttcgcgtttttttcgtgcgcgttttgtgttcgcgtttttttcgtgcgcgttttgtgttcgcgtttttttcgtgcgcgttttgtgttcgcgtttttttcgtgcgcgttttgtgttcgcgtttttttcgtgcgcgttttgtgttcgcgtttttttcgtgcgcgttttgttttcgcgtttttttcgtgcgcgttttgttttcgcgtttttttcgtgcgcgttttgttttcgcgtttttttcgtgcgcgttttgttttcgcgtttttttcgtgcgggttttgttttcgcgtttttttcgtgcgcgttttgatttcgcgtttttttcgtgcgcgttttgtgttcgcgtttttttcgtgcgcgttttgtttttgcgtttttttcgtgcgcgttttgttttcgcgtttttttcgtgcgcgttttgattttgcgttttttttatgcgcgttttgttcgtgcgttttttttatgcgtgttttgattttgcggtttttttagg

SEQ ID NO: 28124 - DNA, 1259 bp, Artificial Sequence
  chemically treated genomic DNA (Homo sapiens) CpG-island No: 28124
cctaaaaaaaccgcaaaatcaaaacacgcataaaaaaaacgcacgaacaaaacgcgcataaaaaaaacgcaaaatcaaaacgcgcacgaaaaaaacgcgaaaacaaaacgcgcacgaaaaaaacgcaaaaacaaaacgcgcacgaaaaaaacgcgaacacaaaacgcgcacgaaaaaaacgcgaaatcaaaacgcgcacgaaaaaaacgcgaaaacaaaacccgcacgaaaaaaacgcgaaaacaaaacgcgcacgaaaaaaacgcgaaaacaaaacgcgcacgaaaaaaacgcgaaaacaaaacgcgcacgaaaaaaacgcgaaaacaaaacgcgcacgaaaaaaacgcgaacacaaaacgcgcacgaaaaaaacgcgaacacaaaacgcgcacgaaaaaaacgcgaacacaaaacgcgcacgaaaaaaacgcgaacacaaaacgcgcacgaaaaaaacgcgaacacaaaacgcgcacgaaaaaaacgcgaacacaaaacgcgcacgaaaaaaacgcgaaatcaaaacgcgcacgaaaaaaacgcgaaaacaaaacccgcacgaaaaaaacgcgaaaacaaaacgcgcacgaaaaaaacgcgaaaacaaaacgcgcacgaaaaaaacgcgaaaacaaaacgcgcactatataaacgcgaaaacaaaacgcgcacgaaaaaaacgcgaacacaaaacgcgcacgaaaaaaacgcgaacacaaaacgcgcacgaaaaaaacgcgaacacaaaacgcgcacgaaaaaaacgcgaacacaaaacgcgcacgaaaaaaacgcgaacacaaaacgctcacgaaaaaaacgcgaacacaaaacgcgcacgaaaaaaacgcgaaaacaaaacgcgcacgataaaaacgcgaaaacaaaacccgcacgaaaaaaactcgaacacaaaacgcgcacgaaaaaaacgcgaaaacaaaacgctcacgtaaaaaacgcgaactcaaaacgcgcacgataaaaacgcgaacacaaaacgcgcacgataaaaacgcgaacacaaaacgctcactaaaaaaacgcgaacacataacgctcacgaaaaaaacgcgaacacaaaacgcgcacgaaaaaaacgcaaaaacaaaacgcgcacgaaaaaaacgcaaaaacaaaacgcgcacgaaaaaaacgcaaaaacaaaacgcgcataaaaaaaacgcacaatccaatcaaacacgtatatatactaaccactcatcttccccacaaaaattatccataccacaatc

SEQ ID NO: 28125 - DNA, 548 bp, Artificial Sequence
  chemically treated genomic DNA (Homo sapiens) CpG-island No: 28125
gcgattcgtaaacggtaggcgtggtgtaggtagggagtaagcgtcgagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgtttcggtcgtgggtatgagagttttattcgttttggcggcgggtatgaaggttgcgtagtagaatttgaatagatttttaggatattttatttttttgatt

SEQ ID NO: 28126 - DNA, 548 bp, Artificial Sequence
  chemically treated genomic DNA (Homo sapiens) CpG-island No: 28126
aatcaaaaaaataaaatatcctaaaaatctattcaaattctactacgcaaccttcatacccgccgccaaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactctcatacccacgaccgaaacgaataaaactcgacgcttactccctacctacaccacgcctaccgtttacgaatcgc

SEQ ID NO: 28127 - DNA, 548 bp, Artificial Sequence
  chemically treated genomic DNA (Homo sapiens) CpG-island No: 28127
gattaggagaataaagtgttttgggagtttgtttaggttttgttgcgtagtttttatattcgtcgttaggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggatttttatatttacggtcgggacgggtgggattcggcgtttgttttttgtttgtattacgtttgtcgtttgcggatcgt

SEQ ID NO: 28128 - DNA, 548 bp, Artificial Sequence
  chemically treated genomic DNA (Homo sapiens) CpG-island No: 28128
acgatccgcaaacgacaaacgtaatacaaacaaaaaacaaacgccgaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcccgaccgtaaatataaaaatcccacccgtcctaacgacgaatataaaaactacgcaacaaaacctaaacaaactcccaaaacactttattctcctaatc

SEQ ID NO: 28129 - DNA, 722 bp, Artificial Sequence
  chemically treated genomic DNA (Homo sapiens) CpG-island No: 28129
gggaggagacgtcggggttcgcgtcgcggggcgggcgttttttcggattcgggggaggcgggacgtaggcgaaggtcgtttcgggagagcggggtttcgggagagcggggtttcggttgtgggggacgcgggtcgaggttgtcgcgaagtcgttgacggtcgaggcgttttcggttttcgcggcgtataagggttgttcgagcgtttagagtaggggtcgttacgcgggcgttcggtttaattcgcggtttttcgggttttttttagcggggtcgtagacgttcgcgagtcgcgttttcggagcgtagaagattttcgcgtatagcgtaggtttcgtcggttcggtggattcgtttgaggacgcggagggggcgcgttttttttgcggcgttcgtacggtttttgttcgtttgtttcgcgttttcgttcggtaggtttagttcggacgaggtttagttgtcgttttcgttgtttttgtgggtttttttgcggaagtttttttttttcgggtggatgggattttgcgcgtggaatttcgtatagttttcgtttcgtcgcgggtcgtaggatttattttttttttacggtggcgttggggaggggttgtttttatttaggagattcgcgagggagagaaaatatgcggtttatattcggacggtagtttcgtttcgtttagaaataatatggttagtttgttaatgaaaggtgaaattaattta

SEQ ID NO: 28130 - DNA, 722 bp, Artificial Sequence
  chemically treated genomic DNA (Homo sapiens) CpG-island No: 28130
taaattaatttcacctttcattaacaaactaaccatattatttctaaacgaaacgaaactaccgtccgaatataaaccgcatattttctctccctcgcgaatctcctaaataaaaacaacccctccccaacgccaccgtaaaaaaaaaataaatcctacgacccgcgacgaaacgaaaactatacgaaattccacgcgcaaaatcccatccacccgaaaaaaaaaaacttccgcaaaaaaacccacaaaaacaacgaaaacgacaactaaacctcgtccgaactaaacctaccgaacgaaaacgcgaaacaaacgaacaaaaaccgtacgaacgccgcaaaaaaaacgcgccccctccgcgtcctcaaacgaatccaccgaaccgacgaaacctacgctatacgcgaaaatcttctacgctccgaaaacgcgactcgcgaacgtctacgaccccgctaaaaaaaacccgaaaaaccgcgaattaaaccgaacgcccgcgtaacgacccctactctaaacgctcgaacaacccttatacgccgcgaaaaccgaaaacgcctcgaccgtcaacgacttcgcgacaacctcgacccgcgtcccccacaaccgaaaccccgctctcccgaaaccccgctctcccgaaacgaccttcgcctacgtcccgcctcccccgaatccgaaaaaacgcccgccccgcgacgcgaaccccgacgtctcctccc

SEQ ID NO: 28131 - DNA, 722 bp, Artificial Sequence
  chemically treated genomic DNA (Homo sapiens) CpG-island No: 28131
tggattaattttattttttattagtaaattggttatattgtttttaagcggggcggggttgtcgttcggatgtgagtcgtatgttttttttttttcgcgaattttttgggtggaagtagtttttttttagcgttatcgtggagaaggaatgggttttgcggttcgcggcggagcgggggttgtgcggggttttacgcgtagggttttatttattcgaggaaaaggggttttcgtagaaaaatttataaaggtaacgggggcggtagttgagtttcgttcgagttgggtttgtcgggcgggagcgcgggataggcgggtagaggtcgtgcgggcgtcgtagaggaaacgcgtttttttcgcgtttttaagcgggtttatcgggtcggcggggtttgcgttgtgcgcggggattttttgcgtttcggggacgcggttcgcgggcgtttgcggtttcgttaggagggattcgggaggtcgcgggttggatcgggcgttcgcgtggcggtttttgttttgagcgttcgggtaatttttgtgcgtcgcgaaaatcgggagcgtttcggtcgttagcggtttcgcgatagtttcggttcgcgttttttatagtcgggatttcgttttttcgggatttcgttttttcggggcggttttcgtttgcgtttcgtttttttcgggttcggggaagcgttcgtttcgcggcgcggatttcggcgttttttttt

SEQ ID NO: 28132 - DNA, 722 bp, Artificial Sequence
  chemically treated genomic DNA (Homo sapiens) CpG-island No: 28132
aaaaaaaaacgccgaaatccgcgccgcgaaacgaacgcttccccgaacccgaaaaaaacgaaacgcaaacgaaaaccgccccgaaaaaacgaaatcccgaaaaaacgaaatcccgactataaaaaacgcgaaccgaaactatcgcgaaaccgctaacgaccgaaacgctcccgattttcgcgacgcacaaaaattacccgaacgctcaaaacaaaaaccgccacgcgaacgcccgatccaacccgcgacctcccgaatccctcctaacgaaaccgcaaacgcccgcgaaccgcgtccccgaaacgcaaaaaatccccgcgcacaacgcaaaccccgccgacccgataaacccgcttaaaaacgcgaaaaaaacgcgtttcctctacgacgcccgcacgacctctacccgcctatcccgcgctcccgcccgacaaacccaactcgaacgaaactcaactaccgcccccgttacctttataaatttttctacgaaaaccccttttcctcgaataaataaaaccctacgcgtaaaaccccgcacaacccccgctccgccgcgaaccgcaaaacccattccttctccacgataacgctaaaaaaaaactacttccacccaaaaaattcgcgaaaaaaaaaaaacatacgactcacatccgaacgacaaccccgccccgcttaaaaacaatataaccaatttactaataaaaaataaaattaatcca

SEQ ID NO: 28133 - DNA, 729 bp, Artificial Sequence
  chemically treated genomic DNA (Homo sapiens) CpG-island No: 28133
gggagtcgaggggggtcgttgggtcgggagcgtttttcggtttggtcgcgtcgcgcgcgtggatggaggtttcgttcgcggatcgtttcgtttattcgcgttggttttgcgggagttcgggtgagcgaaaggcgaggaaggggcgcgggtttcgggaaaaatcgattttttcggcgttcgttttcggttcggttgggggcgtattcggttcgcgcggagagcgggcggggtgtgggcgaatgttcggcgcgttgcgtttttttcggtttttttttttttcggagatgaacgttttattttcgttcggatatacggtcgtatttttattttgtttttttcgattagtcggggcgcggttcgaattgggggagagaagatttagttttcgtagtcgcgaattttgtaaattcggagtttatgcgtttcgtttttcggttcggggagtttttagttttgttcgtcgagcgtagttcgggttcggattgtggttattggggacgagaagggttttttttgcggggttttcgggttcggatggacggagggggcgttcggtaggtgaattgggttcgtttcgcgtttcgaacgtttttttaaatttataagtttcggagattttggggtattttgcgatttcggagtgatcggtggagttttcgttcgcgcgtttggttttcggggtttttttatatagtaggggttgcggggattttttttgttatttttttt

SEQ ID NO: 28134 - DNA, 729 bp, Artificial Sequence
  chemically treated genomic DNA (Homo sapiens) CpG-island No: 28134
aaaaaaaataacaaaaaaaatccccgcaacccctactatataaaaaaaccccgaaaaccaaacgcgcgaacgaaaactccaccgatcactccgaaatcgcaaaataccccaaaatctccgaaacttataaatttaaaaaaacgttcgaaacgcgaaacgaacccaattcacctaccgaacgccccctccgtccatccgaacccgaaaaccccgcaaaaaaaacccttctcgtccccaataaccacaatccgaacccgaactacgctcgacgaacaaaactaaaaactccccgaaccgaaaaacgaaacgcataaactccgaatttacaaaattcgcgactacgaaaactaaatcttctctcccccaattcgaaccgcgccccgactaatcgaaaaaaacaaaataaaaatacgaccgtatatccgaacgaaaataaaacgttcatctccgaaaaaaaaaaaaaccgaaaaaaacgcaacgcgccgaacattcgcccacaccccgcccgctctccgcgcgaaccgaatacgcccccaaccgaaccgaaaacgaacgccgaaaaaatcgatttttcccgaaacccgcgccccttcctcgcctttcgctcacccgaactcccgcaaaaccaacgcgaataaacgaaacgatccgcgaacgaaacctccatccacgcgcgcgacgcgaccaaaccgaaaaacgctcccgacccaacgacccccctcgactccc

SEQ ID NO: 28135 - DNA, 729 bp, Artificial Sequence
  chemically treated genomic DNA (Homo sapiens) CpG-island No: 28135
ggaggaggtgatagagggggttttcgtagtttttgttgtgtggggagatttcgggagttaggcgcgcgggcgggggttttatcggttatttcgaaatcgtagaatgttttagggttttcgggatttgtgggtttaggggaacgttcgggacgcggagcgggtttagtttatttgtcggacgtttttttcgtttattcgaattcgggagtttcgtaggagggatttttttcgtttttagtgattatagttcggattcgggttgcgttcggcgggtaaggttgggagtttttcgggtcggaggacggggcgtatgggtttcgggtttgtagaattcgcggttgcgggagttgggtttttttttttttaattcgggtcgcgtttcggttggtcggaggaggtagagtaggggtgcggtcgtgtgttcgagcgggagtggggcgtttattttcggggagaagggggatcgggaaaggcgtagcgcgtcgagtattcgtttatatttcgttcgtttttcgcgcgagtcgggtgcgtttttaatcgaatcgggggcgggcgtcgggagagtcggtttttttcgagattcgcgtttttttttcgtttttcgtttattcgggttttcgtaggattagcgcgaatagacggggcgattcgcgggcgagatttttatttacgcgcgcggcgcggttagatcggggagcgttttcggtttaacggtttttttcgattttt

SEQ ID NO: 28136 - DNA, 729 bp, Artificial Sequence
  chemically treated genomic DNA (Homo sapiens) CpG-island No: 28136
aaaaatcgaaaaaaaccgttaaaccgaaaacgctccccgatctaaccgcgccgcgcgcgtaaataaaaatctcgcccgcgaatcgccccgtctattcgcgctaatcctacgaaaacccgaataaacgaaaaacgaaaaaaaaacgcgaatctcgaaaaaaaccgactctcccgacgcccgcccccgattcgattaaaaacgcacccgactcgcgcgaaaaacgaacgaaatataaacgaatactcgacgcgctacgcctttcccgatcccccttctccccgaaaataaacgccccactcccgctcgaacacacgaccgcacccctactctacctcctccgaccaaccgaaacgcgacccgaattaaaaaaaaaaaaacccaactcccgcaaccgcgaattctacaaacccgaaacccatacgccccgtcctccgacccgaaaaactcccaaccttacccgccgaacgcaacccgaatccgaactataatcactaaaaacgaaaaaaatccctcctacgaaactcccgaattcgaataaacgaaaaaaacgtccgacaaataaactaaacccgctccgcgtcccgaacgttcccctaaacccacaaatcccgaaaaccctaaaacattctacgatttcgaaataaccgataaaacccccgcccgcgcgcctaactcccgaaatctccccacacaacaaaaactacgaaaaccccctctatcacctcctcc

SEQ ID NO: 28137 - DNA, 846 bp, Artificial Sequence
  chemically treated genomic DNA (Homo sapiens) CpG-island No: 28137
ttagtttcgagagttagggcgcgcggcggaggcgaggtcggggcggttttcgttttttcggtcgttttttttcgcgtcgtttcggttttttttttcggttttcggcgggtatttggcggcggcgggtagggggcggcgttgcgcgcgttacgcggttgggtgggatagcgggtaggtgatattcggcggtttttttttttttttaatttagtcggcggtcgggatagtaggggtcgttgtgaggagtttcgcgttcgcgttgttagtcgtcgttttttttttcgcgcgcgttcggcgtttcggtttcgttttttgtgcggtgagtgcggggttttaggtcggcgggtaggggttaaattttttcggcgcgcggaggagaagagattggggagggaggtagagtcgaggggaacggcgtcgggagtggtcggatggaggaatttgggcgcggcgcgcgagaagtgggattcgggtgcgggggtttcgggagcggggttaggttttttttgggttcgggaggcgtttgggaagttttgttttcgttgtttgcgcgtggggaggatcgaggtttttttcgtcggagcgcggggtcgcggcgtttatttgcgttttttcgggagtttttattcggtagtatttcgaagggaaggtcgggttcggtgggcgcgttgcggagcggagtttggattggggtttcgcgcggcgttggttttgcggagcggagcgggaggggtagaggtgttcgtcggcgggattgggagggagaaggatttgttcgattttggacgcggaggttatttttttagtttcggggtttggtttcgttagttatttttttaaatttcg

SEQ ID NO: 28138 - DNA, 846 bp, Artificial Sequence
  chemically treated genomic DNA (Homo sapiens) CpG-island No: 28138
cgaaatttaaaaaaataactaacgaaaccaaaccccgaaactaaaaaaataacctccgcgtccaaaatcgaacaaatccttctccctcccaatcccgccgacgaacacctctacccctcccgctccgctccgcaaaaccaacgccgcgcgaaaccccaatccaaactccgctccgcaacgcgcccaccgaacccgaccttcccttcgaaatactaccgaataaaaactcccgaaaaaacgcaaataaacgccgcgaccccgcgctccgacgaaaaaaacctcgatcctccccacgcgcaaacaacgaaaacaaaacttcccaaacgcctcccgaacccaaaaaaaacctaaccccgctcccgaaacccccgcacccgaatcccacttctcgcgcgccgcgcccaaattcctccatccgaccactcccgacgccgttcccctcgactctacctccctccccaatctcttctcctccgcgcgccgaaaaaatttaacccctacccgccgacctaaaaccccgcactcaccgcacaaaaaacgaaaccgaaacgccgaacgcgcgcgaaaaaaaaaacgacgactaacaacgcgaacgcgaaactcctcacaacgacccctactatcccgaccgccgactaaattaaaaaaaaaaaaaaaccgccgaatatcacctacccgctatcccacccaaccgcgtaacgcgcgcaacgccgccccctacccgccgccgccaaatacccgccgaaaaccgaaaaaaaaaaccgaaacgacgcgaaaaaaaacgaccgaaaaaacgaaaaccgccccgacctcgcctccgccgcgcgccctaactctcgaaactaa

SEQ ID NO: 28139 - DNA, 846 bp, Artificial Sequence
  chemically treated genomic DNA (Homo sapiens) CpG-island No: 28139
cggaatttgggggggtggttagcgaggttagatttcggagttgggaaaatgattttcgcgtttaaggtcgagtaggttttttttttttttagtttcgtcggcgagtatttttgtttttttcgtttcgtttcgtagggttagcgtcgcgcgggattttagtttaggtttcgtttcgtagcgcgtttatcgggttcgatttttttttcgggatgttgtcgggtgggggttttcgagaaggcgtaggtgagcgtcgcggtttcgcgtttcggcgaaaagggtttcggttttttttacgcgtaggtagcggggatagaattttttaagcgtttttcgagtttagggagggtttggtttcgttttcggggttttcgtattcgggttttatttttcgcgcgtcgcgtttaagtttttttattcggttattttcgacgtcgtttttttcggttttgtttttttttttagttttttttttttcgcgcgtcgggaaagtttggtttttgttcgtcggtttggaatttcgtatttatcgtatagggagcggagtcgaagcgtcgggcgcgcgcgggagagagggcggcgattggtagcgcgagcgcggagttttttatagcggtttttgttgtttcggtcgtcgattgggttggaaaggggaggaggtcgtcgggtgttatttgttcgttattttatttagtcgcgtgacgcgcgtagcgtcgttttttgttcgtcgtcgttaggtgttcgtcgagggtcggagggaggagtcggggcggcgcgagggggagcggtcgggagggcggaggtcgtttcggtttcgttttcgtcgcgcgttttgattttcgggattgg

SEQ ID NO: 28140 - DNA, 846 bp, Artificial Sequence
  chemically treated genomic DNA (Homo sapiens) CpG-island No: 28140
ccaatcccgaaaatcaaaacgcgcgacgaaaacgaaaccgaaacgacctccgccctcccgaccgctccccctcgcgccgccccgactcctccctccgaccctcgacgaacacctaacgacgacgaacaaaaaacgacgctacgcgcgtcacgcgactaaataaaataacgaacaaataacacccgacgacctcctcccctttccaacccaatcgacgaccgaaacaacaaaaaccgctataaaaaactccgcgctcgcgctaccaatcgccgccctctctcccgcgcgcgcccgacgcttcgactccgctccctatacgataaatacgaaattccaaaccgacgaacaaaaaccaaactttcccgacgcgcgaaaaaaaaaaaactaaaaaaaaaaacaaaaccgaaaaaaacgacgtcgaaaataaccgaataaaaaaacttaaacgcgacgcgcgaaaaataaaacccgaatacgaaaaccccgaaaacgaaaccaaaccctccctaaactcgaaaaacgcttaaaaaattctatccccgctacctacgcgtaaaaaaaaccgaaacccttttcgccgaaacgcgaaaccgcgacgctcacctacgccttctcgaaaacccccacccgacaacatcccgaaaaaaaaatcgaacccgataaacgcgctacgaaacgaaacctaaactaaaatcccgcgcgacgctaaccctacgaaacgaaacgaaaaaaacaaaaatactcgccgacgaaactaaaaaaaaaaaaaacctactcgaccttaaacgcgaaaatcattttcccaactccgaaatctaacctcgctaaccacccccccaaattccg

SEQ ID NO: 28141 - DNA, 1248 bp, Artificial Sequence
  chemically treated genomic DNA (Homo sapiens) CpG-island No: 28141
cggcgggggtaaaaagttcgagtagtaaaaagtttcggtagcgggggtagaaaatcgcggcggcggggagtaaaaagtcgcggcggtgggcgcgaaaagtcgcgggggcgggggcgaaaagtcgcgggggcgggggcgaaaagtcgaaaaaagtagcggcggcggtggtaaaaagtagcggcggcggtggtaaaaagtttcggcggcgggggtagaaacgcgcggcggcgggggtaaaaagtagcggcggcggggagtaaaaagtcgcggcggcggtggttaaaagtcgttggggtaaaaagtagcgggagcgggggtaaaaaaaaaatataaaaagtcgcgacggcgggggttaaaagtcgcggcggtaaaaagttgtggtaacgggggtagaaagtcgcggcggcgggggaaaaagtaggggcgataaaaagtcgcgggggcggggcgtaaaaagtcgtagcggcggagataaaaagcggaggcggcgagaagtaaaaagtcgcgttggtaaaattcgcggcggcgggcgtaaaaagtatcggcggttaaaattcgcggcggggggagtaaaaatcgcggtggcgggggttaaaagtcgtaagaagtcgcggcggcgggggttaaaattcgcggcggaaaaagtcgcggggtgggggtggtaaaaagtcgcggcggcgggggtaaaaagttgtaaaaatttgcggcggtaacggtaaaaaatcgtggtttcgggggtaaaaagttatagcggtaaaaagcggcggaggcgggggtagaaagtcgcggcggcggggtaaaaagtaggggcggtaaaaagtttcggcggcggggattaaaagtcgcggcggtgggttaaaaagttatagcggtaaaaagttgtggcgacgggggtagatagttgcggcggtgggggtaaaaagttgtagtcgtaggggaaaaagtcgcggcggtaggggtaaaaagtaggggtagcgggggtaataagtcgcggcggtaaaaagttgcggcggtgggggtaaaaagtagcggcgatgggggtaaaagttagagcgacgggggtaataagttttggtagtaggggtaaatagcggcggcggtaaaaattcgtagcggtgggggtaaatagtcgcggcgggggtgataaaaagtcgcggtggcgggggtagaaagtagcggtggcgggggtaaaaagttataaaaatttgttgtggtcgggataaaatagtggaaatggggtgaaggtta

SEQ ID NO: 28142 - DNA, 1248 bp, Artificial Sequence
  chemically treated genomic DNA (Homo sapiens) CpG-island No: 28142
taaccttcaccccatttccactattttatcccgaccacaacaaatttttataactttttacccccgccaccgctactttctacccccgccaccgcgactttttatcacccccgccgcgactatttacccccaccgctacgaatttttaccgccgccgctatttacccctactaccaaaacttattacccccgtcgctctaacttttacccccatcgccgctactttttacccccaccgccgcaactttttaccgccgcgacttattacccccgctacccctactttttacccctaccgccgcgactttttcccctacgactacaactttttacccccaccgccgcaactatctacccccgtcgccacaactttttaccgctataactttttaacccaccgccgcgacttttaatccccgccgccgaaactttttaccgcccctactttttaccccgccgccgcgactttctacccccgcctccgccgctttttaccgctataactttttacccccgaaaccacgattttttaccgttaccgccgcaaatttttacaactttttacccccgccgccgcgactttttaccacccccaccccgcgactttttccgccgcgaattttaacccccgccgccgcgacttcttacgacttttaacccccgccaccgcgatttttactccccccgccgcgaattttaaccgccgatactttttacgcccgccgccgcgaattttaccaacgcgactttttacttctcgccgcctccgctttttatctccgccgctacgactttttacgccccgcccccgcgactttttatcgcccctactttttcccccgccgccgcgactttctacccccgttaccacaactttttaccgccgcgacttttaacccccgccgtcgcgactttttatattttttttttacccccgctcccgctactttttaccccaacgacttttaaccaccgccgccgcgactttttactccccgccgccgctactttttacccccgccgccgcgcgtttctacccccgccgccgaaactttttaccaccgccgccgctactttttaccaccgccgccgctacttttttcgacttttcgcccccgcccccgcgacttttcgcccccgcccccgcgacttttcgcgcccaccgccgcgactttttactccccgccgccgcgattttctacccccgctaccgaaactttttactactcgaactttttacccccgccg

SEQ ID NO: 28143 - DNA, 1248 bp, Artificial Sequence
  chemically treated genomic DNA (Homo sapiens) CpG-island No: 28143
tggtttttattttatttttattgttttgtttcggttatagtaggtttttgtggttttttgttttcgttatcgttgttttttgttttcgttatcgcggttttttgttattttcgtcgcggttgtttgtttttatcgttgcggatttttgtcgtcgtcgttgtttgtttttgttgttagggtttgttgttttcgtcgttttggtttttatttttatcgtcgttgttttttgtttttatcgtcgtagttttttgtcgtcgcggtttgttgttttcgttgtttttgttttttgtttttgtcgtcgcggtttttttttttgcggttgtagttttttgtttttatcgtcgtagttatttgttttcgtcgttatagttttttgtcgttgtggttttttgatttatcgtcgcggtttttggttttcgtcgtcgaggttttttgtcgtttttgttttttgtttcgtcgtcgcggttttttgttttcgttttcgtcgttttttgtcgttatggttttttattttcgaagttacggttttttgtcgttgtcgtcgtagatttttgtaattttttgttttcgtcgtcgcggttttttgttatttttatttcgcgatttttttcgtcgcggattttggttttcgtcgtcgcggttttttgcggtttttggttttcgttatcgcggtttttgtttttttcgtcgcgggttttggtcgtcggtgttttttgcgttcgtcgtcgcgggttttgttaacgcggttttttgtttttcgtcgttttcgttttttgttttcgtcgttgcgattttttgcgtttcgttttcgcggttttttgtcgtttttgttttttttttcgtcgtcgcggttttttgttttcgttgttatagttttttgtcgtcgcggtttttggttttcgtcgtcgcggttttttgtgttttttttttgttttcgttttcgttgttttttgttttagcgatttttggttatcgtcgtcgcggttttttgtttttcgtcgtcgttgttttttgttttcgtcgtcgcgcgtttttgttttcgtcgtcgaggttttttgttatcgtcgtcgttgttttttgttatcgtcgtcgttgtttttttcggtttttcgttttcgttttcgcggtttttcgttttcgttttcgcggtttttcgcgtttatcgtcgcggttttttgtttttcgtcgtcgcggttttttgttttcgttgtcgaggttttttgttgttcgggttttttgttttcgtcg

SEQ ID NO: 28144 - DNA, 1248 bp, Artificial Sequence
  chemically treated genomic DNA (Homo sapiens) CpG-island No: 28144
cgacgaaaacaaaaaacccgaacaacaaaaaacctcgacaacgaaaacaaaaaaccgcgacgacgaaaaacaaaaaaccgcgacgataaacgcgaaaaaccgcgaaaacgaaaacgaaaaaccgcgaaaacgaaaacgaaaaaccgaaaaaaacaacgacgacgataacaaaaaacaacgacgacgataacaaaaaacctcgacgacgaaaacaaaaacgcgcgacgacgaaaacaaaaaacaacgacgacgaaaaacaaaaaaccgcgacgacgataaccaaaaatcgctaaaacaaaaaacaacgaaaacgaaaacaaaaaaaaaacacaaaaaaccgcgacgacgaaaaccaaaaaccgcgacgacaaaaaactataacaacgaaaacaaaaaaccgcgacgacgaaaaaaaaaacaaaaacgacaaaaaaccgcgaaaacgaaacgcaaaaaatcgcaacgacgaaaacaaaaaacgaaaacgacgaaaaacaaaaaaccgcgttaacaaaacccgcgacgacgaacgcaaaaaacaccgacgaccaaaacccgcgacgaaaaaaacaaaaaccgcgataacgaaaaccaaaaaccgcaaaaaaccgcgacgacgaaaaccaaaatccgcgacgaaaaaaatcgcgaaataaaaataacaaaaaaccgcgacgacgaaaacaaaaaattacaaaaatctacgacgacaacgacaaaaaaccgtaacttcgaaaataaaaaaccataacgacaaaaaacgacgaaaacgaaaacaaaaaaccgcgacgacgaaacaaaaaacaaaaacgacaaaaaacctcgacgacgaaaaccaaaaaccgcgacgataaatcaaaaaaccacaacgacaaaaaactataacgacgaaaacaaataactacgacgataaaaacaaaaaactacaaccgcaaaaaaaaaaaccgcgacgacaaaaacaaaaaacaaaaacaacgaaaacaacaaaccgcgacgacaaaaaactacgacgataaaaacaaaaaacaacgacgataaaaataaaaaccaaaacgacgaaaacaacaaaccctaacaacaaaaacaaacaacgacgacgacaaaaatccgcaacgataaaaacaaacaaccgcgacgaaaataacaaaaaaccgcgataacgaaaacaaaaaacaacgataacgaaaacaaaaaaccacaaaaacctactataaccgaaacaaaacaataaaaataaaataaaaacca

SEQ ID NO: 28145 - DNA, 866 bp, Artificial Sequence
  chemically treated genomic DNA (Homo sapiens) CpG-island No: 28145
ttgtattttcggatttatgcggttttttaggtttatcgttgttcggtttggttcggtgttttagttgggtttttggtttatcgttttatcgttttatcgtttttttttttcgtcgggtttagtcgtttaggtttgtcggagtgtgtgtagaaaagcgtcgggcgcgggagagttggggaaattttttatttattttgttcgttttcggggtagcggcggggtttgggttagtttgggggtgtcgtcgttggaagcgttggtttcgggtttcgggaaggcggcggcggggtcgggtagtagtaggacgaggtcgggttcgggtttcgcgcgcgggcgtagtttagggttagtcgttttaggcgtcgtttgcgtatcgttgtttgggtcgtggcgtgtaggggtcgtagtagcgttgggggcgaagtttcggggtcgcgtagtaggaagtcgaagtttgcgcggtcgcgggggtcgtagaagagcggttcgtaggcggggtcggatttcggcggttaggcgaacgggaagggtagcgtgaagttttcggtgagtacgcggatggcgaagtcgttttgtttgtttagcgcgcggtaggcgcgttcgatgtcgcggaaatgcgttttttagagttgcgcgttttcgtcgtagatgttcgggaaggcgggtttcgggggcgtcgcgggatttgcgggcggaggggatagtgaacgttcggtagggcggggagggtcgggagcggttcgcgtaggcgggagattaggaggtcgggcgcgaagagaggtggttagtttggaaggagtcgtcgaatgagttcgaaaggtagagttggggatggttagggttatttggtgatgaggcgaggtcgg

SEQ ID NO: 28146 - DNA, 866 bp, Artificial Sequence
  chemically treated genomic DNA (Homo sapiens) CpG-island No: 28146
ccgacctcgcctcatcaccaaataaccctaaccatccccaactctacctttcgaactcattcgacgactccttccaaactaaccacctctcttcgcgcccgacctcctaatctcccgcctacgcgaaccgctcccgaccctccccgccctaccgaacgttcactatcccctccgcccgcaaatcccgcgacgcccccgaaacccgccttcccgaacatctacgacgaaaacgcgcaactctaaaaaacgcatttccgcgacatcgaacgcgcctaccgcgcgctaaacaaacaaaacgacttcgccatccgcgtactcaccgaaaacttcacgctacccttcccgttcgcctaaccgccgaaatccgaccccgcctacgaaccgctcttctacgacccccgcgaccgcgcaaacttcgacttcctactacgcgaccccgaaacttcgcccccaacgctactacgacccctacacgccacgacccaaacaacgatacgcaaacgacgcctaaaacgactaaccctaaactacgcccgcgcgcgaaacccgaacccgacctcgtcctactactacccgaccccgccgccgccttcccgaaacccgaaaccaacgcttccaacgacgacacccccaaactaacccaaaccccgccgctaccccgaaaacgaacaaaataaataaaaaatttccccaactctcccgcgcccgacgcttttctacacacactccgacaaacctaaacgactaaacccgacgaaaaaaaaaaacgataaaacgataaaacgataaaccaaaaacccaactaaaacaccgaaccaaaccgaacaacgataaacctaaaaaaccgcataaatccgaaaatacaa

SEQ ID NO: 28147 - DNA, 866 bp, Artificial Sequence
  chemically treated genomic DNA (Homo sapiens) CpG-island No: 28147
tcggtttcgttttattattaggtggttttggttatttttagttttgtttttcgagtttattcggcggttttttttagattggttattttttttcgcgttcggttttttggtttttcgtttgcgcgggtcgttttcggtttttttcgttttgtcgggcgtttattgtttttttcgttcgtaggtttcgcggcgttttcggagttcgttttttcggatatttacggcggggacgcgtagttttgggaggcgtattttcgcggtatcgggcgcgtttatcgcgcgttgggtaagtaggacgatttcgttattcgcgtgtttatcgagaattttacgttgtttttttcgttcgtttggtcgtcggggttcgatttcgtttgcgggtcgtttttttacgattttcgcgatcgcgtagatttcgattttttgttgcgcggtttcggagtttcgtttttagcgttgttgcggtttttgtacgttacggtttaggtagcgatgcgtaagcggcgtttggagcggttggttttgagttgcgttcgcgcgcggggttcgggttcggtttcgttttgttgttgttcggtttcgtcgtcgttttttcggagttcgaggttagcgtttttagcgacggtatttttaggttggtttaggtttcgtcgttgtttcgagagcgaatagaataaataaagagtttttttagttttttcgcgttcggcgtttttttgtatatatttcgataggtttgggcggttgggttcggcggggaaggggggcggtgggacggtgggacggtggattaggaatttaattgggatatcgggttaggtcgggtagcggtgggtttgggaagtcgtatgggttcgaaggtgtag

SEQ ID NO: 28148 - DNA, 866 bp, Artificial Sequence
  chemically treated genomic DNA (Homo sapiens) CpG-island No: 28148
ctacaccttcgaacccatacgacttcccaaacccaccgctacccgacctaacccgatatcccaattaaattcctaatccaccgtcccaccgtcccaccgccccccttccccgccgaacccaaccgcccaaacctatcgaaatatatacaaaaaaacgccgaacgcgaaaaaactaaaaaaactctttatttattctattcgctctcgaaacaacgacgaaacctaaaccaacctaaaaataccgtcgctaaaaacgctaacctcgaactccgaaaaaacgacgacgaaaccgaacaacaacaaaacgaaaccgaacccgaaccccgcgcgcgaacgcaactcaaaaccaaccgctccaaacgccgcttacgcatcgctacctaaaccgtaacgtacaaaaaccgcaacaacgctaaaaacgaaactccgaaaccgcgcaacaaaaaatcgaaatctacgcgatcgcgaaaatcgtaaaaaaacgacccgcaaacgaaatcgaaccccgacgaccaaacgaacgaaaaaaacaacgtaaaattctcgataaacacgcgaataacgaaatcgtcctacttacccaacgcgcgataaacgcgcccgataccgcgaaaatacgcctcccaaaactacgcgtccccgccgtaaatatccgaaaaaacgaactccgaaaacgccgcgaaacctacgaacgaaaaaaacaataaacgcccgacaaaacgaaaaaaaccgaaaacgacccgcgcaaacgaaaaaccaaaaaaccgaacgcgaaaaaaaataaccaatctaaaaaaaaccgccgaataaactcgaaaaacaaaactaaaaataaccaaaaccacctaataataaaacgaaaccga

SEQ ID NO: 28149 - DNA, 1221 bp, Artificial Sequence
  chemically treated genomic DNA (Homo sapiens) CpG-island No: 28149
cgagcgttcggtttttttagcgttatgtgcgcggttcgtttaggtttttggtcgtcgtcgtcgcgggggtaggtcgcgagttagtcgcgagttatagaggtttggtgcgcgtttcgtttttgagtttgtagtcggggcggttttagttagtgagtcgggagtcgtttttttcgttttttttcgtattcggagggtagttggggcggggtagattttcgggtcgggcggtattcgggcgggcgaattcgttagttttcgcgggaggttcggcgagagaaggattcggtgagtagttacgttacgttttttagggaggtttcgtttcgtgttttcgggtcgttttttttcgtcgtttttacgttttcgcgggtagttattagttttggttgttcgcgtttttttaattcgggtaaagtttttcggtttcggcgtgttgcgttttcgcggttgttttgcgttaggtgagggttcgcggttttcggttgcggttttcggcgcgtggtggcgggttcggggcgtgcgtcgcggagaggacggggtcggcgggcggttggcgtttcgttcggtgcggggaggggcgttacgtcgggcgttgcgcggtttcggcgggcggcggtagcggcggttacggtcgtcgggttttcgggttgtttgtttttagttggagtcggtcggtgtttcggcggagagacgggtagtcgggttttttggtttcggggttatttcggttggggcggttggggtagagggacgatgtttattcgcgtttcgatgttcgtcgtttattttcgggaggattcgttcgcggtgattgttgagagggagtcgttgttggtcgcggcgaatcggtcggtcgagtagtcgttttcgttcgaatgtgagggtaaagaggcggcgagggaggagagggtcgcggtcgttattagcgttggggcgcggggagagtcgtcgtcggcgttggtgttgggacgtagcgtgttttaggcggttgttttcgtgaggtttttggcgttgtatttggcgtataaggcgcgtgggttcgggggttttttcggcggggagtcgttatcgttatcgtcgtcgtcgtcgtcgttgtcgtcgttgttgcgggattcgtcggtcgaggacgttcgggaagaggtggtagttggttttgcggaaaagcggtagtcgtcgttgttgtcgtttaagggaaatttttggattaaaaagtttttttag

SEQ ID NO: 28150 - DNA, 1221 bp, Artificial Sequence
  chemically treated genomic DNA (Homo sapiens) CpG-island No: 28150
ctaaaaaaactttttaatccaaaaatttcccttaaacgacaacaacgacgactaccgcttttccgcaaaaccaactaccacctcttcccgaacgtcctcgaccgacgaatcccgcaacaacgacgacaacgacgacgacgacgacgataacgataacgactccccgccgaaaaaacccccgaacccacgcgccttatacgccaaatacaacgccaaaaacctcacgaaaacaaccgcctaaaacacgctacgtcccaacaccaacgccgacgacgactctccccgcgccccaacgctaataacgaccgcgaccctctcctccctcgccgcctctttaccctcacattcgaacgaaaacgactactcgaccgaccgattcgccgcgaccaacaacgactccctctcaacaatcaccgcgaacgaatcctcccgaaaataaacgacgaacatcgaaacgcgaataaacatcgtccctctaccccaaccgccccaaccgaaataaccccgaaaccaaaaaacccgactacccgtctctccgccgaaacaccgaccgactccaactaaaaacaaacaacccgaaaacccgacgaccgtaaccgccgctaccgccgcccgccgaaaccgcgcaacgcccgacgtaacgcccctccccgcaccgaacgaaacgccaaccgcccgccgaccccgtcctctccgcgacgcacgccccgaacccgccaccacgcgccgaaaaccgcaaccgaaaaccgcgaaccctcacctaacgcaaaacaaccgcgaaaacgcaacacgccgaaaccgaaaaactttacccgaattaaaaaaacgcgaacaaccaaaactaataactacccgcgaaaacgtaaaaacgacgaaaaaaaacgacccgaaaacacgaaacgaaacctccctaaaaaacgtaacgtaactactcaccgaatccttctctcgccgaacctcccgcgaaaactaacgaattcgcccgcccgaataccgcccgacccgaaaatctaccccgccccaactaccctccgaatacgaaaaaaaacgaaaaaaacgactcccgactcactaactaaaaccgccccgactacaaactcaaaaacgaaacgcgcaccaaacctctataactcgcgactaactcgcgacctacccccgcgacgacgacgaccaaaaacctaaacgaaccgcgcacataacgctaaaaaaaccgaacgctcg

SEQ ID NO: 28151 - DNA, 1221 bp, Artificial Sequence
  chemically treated genomic DNA (Homo sapiens) CpG-island No: 28151
ttggggaggttttttggtttagggattttttttaggcggtagtagcggcggttgtcgttttttcgtagggttagttgttattttttttcgggcgttttcggtcggcggatttcgtagtaacggcggtaacggcgacggcggcggcggtggcggtggcggtttttcgtcgaaagggttttcgggtttacgcgttttgtgcgttaggtgtagcgttaggggttttacggggatagtcgtttggggtacgttgcgttttagtattagcgtcggcgacggtttttttcgcgttttagcgttagtggcggtcgcggtttttttttttttcgtcgtttttttgtttttatattcgggcgggggcggttgttcggtcggtcggttcgtcgcggttaatagcgatttttttttagtagttatcgcgggcggattttttcgagaatgggcggcgggtatcggggcgcgagtagatatcgtttttttgttttagtcgttttagtcggggtggtttcgaggttagggaattcgattgttcgttttttcgtcgggatatcggtcggttttaattggggatagataattcgagagttcggcggtcgtggtcgtcgttgtcgtcgttcgtcgaggtcgcgtagcgttcggcgtgacgttttttttcgtatcgaacggagcgttaatcgttcgtcggtttcgtttttttcgcgacgtacgtttcgagttcgttattacgcgtcgggagtcgtagtcgggagtcgcgagtttttatttggcgtagggtagtcgcggaggcgtagtacgtcgaggtcgaggagttttattcgagttggggaggcgcgagtagttaaagttggtaattgttcgcggaggcgtggagacggcgaagaggggcggttcgagagtacggggcggggtttttttgaggagcgtgacgtggttatttatcgggtttttttttcgtcgggtttttcgcgggagttgacggattcgttcgttcgggtgtcgttcggttcgagggtttgtttcgttttagttgtttttcgagtgcgagggaggacgaaggggacgattttcggtttattggttgaggtcgtttcgattgtaggtttaggggcggggcgcgtattaggtttttgtggttcgcggttggttcgcggtttgttttcgcggcgacggcggttaagggtttgggcgggtcgcgtatatggcgttgggaggatcgagcgttcg

SEQ ID NO: 28152 - DNA, 1221 bp, Artificial Sequence
  chemically treated genomic DNA (Homo sapiens) CpG-island No: 28152
cgaacgctcgatcctcccaacgccatatacgcgacccgcccaaacccttaaccgccgtcgccgcgaaaacaaaccgcgaaccaaccgcgaaccacaaaaacctaatacgcgccccgcccctaaacctacaatcgaaacgacctcaaccaataaaccgaaaatcgtccccttcgtcctccctcgcactcgaaaaacaactaaaacgaaacaaaccctcgaaccgaacgacacccgaacgaacgaatccgtcaactcccgcgaaaaacccgacgaaaaaaaaacccgataaataaccacgtcacgctcctcaaaaaaaccccgccccgtactctcgaaccgcccctcttcgccgtctccacgcctccgcgaacaattaccaactttaactactcgcgcctccccaactcgaataaaactcctcgacctcgacgtactacgcctccgcgactaccctacgccaaataaaaactcgcgactcccgactacgactcccgacgcgtaataacgaactcgaaacgtacgtcgcgaaaaaaacgaaaccgacgaacgattaacgctccgttcgatacgaaaaaaaacgtcacgccgaacgctacgcgacctcgacgaacgacgacaacgacgaccacgaccgccgaactctcgaattatctatccccaattaaaaccgaccgatatcccgacgaaaaaacgaacaatcgaattccctaacctcgaaaccaccccgactaaaacgactaaaacaaaaaaacgatatctactcgcgccccgatacccgccgcccattctcgaaaaaatccgcccgcgataactactaaaaaaaaatcgctattaaccgcgacgaaccgaccgaccgaacaaccgcccccgcccgaatataaaaacaaaaaaacgacgaaaaaaaaaaaaaccgcgaccgccactaacgctaaaacgcgaaaaaaaccgtcgccgacgctaatactaaaacgcaacgtaccccaaacgactatccccgtaaaacccctaacgctacacctaacgcacaaaacgcgtaaacccgaaaaccctttcgacgaaaaaccgccaccgccaccgccgccgccgtcgccgttaccgccgttactacgaaatccgccgaccgaaaacgcccgaaaaaaaataacaactaaccctacgaaaaaacgacaaccgccgctactaccgcctaaaaaaaatccctaaaccaaaaaacctccccaa

SEQ ID NO: 28153 - DNA, 625 bp, Artificial Sequence
  chemically treated genomic DNA (Homo sapiens) CpG-island No: 28153
ttttcgttgattgagtgacgagagcggttatattgtattttttttttagggtcgtgttttttcgttgatcgagtgacgagagcggttatattgtattttttttttagggtcgtgttttttcgttgattgagtgacgagagcggttatattgcgttttttttttagggtcgtgttttttcgttgattgagtgacgagagcggttatattgtattttttttttagggtcgtgttttttcgttgatcgagtgacgagagcggttatattgcgttttttttttagggtcgtgttttttcgttgatcgagtgataagagcggttatattgtattttttttttagggtcgtgttttttcgttgaatgagtgacgagagcggttatattgcgttttttttttagggttgtgttttttcgttgatcgagtgacgagagcggttatattgtattttttttttagggtcgtgttttttcgttgaatgagtgatgagagcggttatattgcgttttttttttagggtcgtgttttttcgttgattgagtgacgagagcggttatattgtattttttttttagggtcgtgttttttcgttgattgagtgatgagagcggttattttgtgtttttttt

SEQ ID NO: 28154 - DNA, 625 bp, Artificial Sequence
  chemically treated genomic DNA (Homo sapiens) CpG-island No: 28154
aaaaaaaacacaaaataaccgctctcatcactcaatcaacgaaaaaacacgaccctaaaaaaaaaatacaatataaccgctctcgtcactcaatcaacgaaaaaacacgaccctaaaaaaaaaacgcaatataaccgctctcatcactcattcaacgaaaaaacacgaccctaaaaaaaaaatacaatataaccgctctcgtcactcgatcaacgaaaaaacacaaccctaaaaaaaaaacgcaatataaccgctctcgtcactcattcaacgaaaaaacacgaccctaaaaaaaaaatacaatataaccgctcttatcactcgatcaacgaaaaaacacgaccctaaaaaaaaaacgcaatataaccgctctcgtcactcgatcaacgaaaaaacacgaccctaaaaaaaaaatacaatataaccgctctcgtcactcaatcaacgaaaaaacacgaccctaaaaaaaaaacgcaatataaccgctctcgtcactcaatcaacgaaaaaacacgaccctaaaaaaaaaatacaatataaccgctctcgtcactcgatcaacgaaaaaacacgaccctaaaaaaaaaatacaatataaccgctctcgtcactcaatcaacgaaaa

SEQ ID NO: 28155 - DNA, 625 bp, Artificial Sequence
  chemically treated genomic DNA (Homo sapiens) CpG-island No: 28155
ggaaaggatatagggtggtcgtttttattatttagttaacgagagagtacgattttggggaaaggatgtagtgtggtcgttttcgttatttagttaacgagagagtacgattttggggaaaggacgtagtgtggtcgtttttattatttatttaacgagagagtacgattttggggaaaggatgtagtgtggtcgttttcgttattcggttaacgagagagtataattttggggaaaggacgtagtgtggtcgttttcgttatttatttaacgagagagtacgattttggggaaaggatgtagtgtggtcgtttttgttattcggttaacgagagagtacgattttggggaaaggacgtagtgtggtcgttttcgttattcggttaacgagagagtacgattttggggaaaggatgtagtgtggtcgttttcgttatttagttaacgagagagtacgattttggggaaaggacgtagtgtggtcgttttcgttatttagttaacgagagagtacgattttggggaaaggatgtagtgtggtcgttttcgttattcggttaacgagagagtacgattttggggaaaggatgtagtgtggtcgttttcgttatttagttaacgagag

SEQ ID NO: 28156 - DNA, 625 bp, Artificial Sequence
  chemically treated genomic DNA (Homo sapiens) CpG-island No: 28156
ctctcgttaactaaataacgaaaacgaccacactacatcctttccccaaaatcgtactctctcgttaaccgaataacgaaaacgaccacactacatcctttccccaaaatcgtactctctcgttaactaaataacgaaaacgaccacactacgtcctttccccaaaatcgtactctctcgttaactaaataacgaaaacgaccacactacatcctttccccaaaatcgtactctctcgttaaccgaataacgaaaacgaccacactacgtcctttccccaaaatcgtactctctcgttaaccgaataacaaaaacgaccacactacatcctttccccaaaatcgtactctctcgttaaataaataacgaaaacgaccacactacgtcctttccccaaaattatactctctcgttaaccgaataacgaaaacgaccacactacatcctttccccaaaatcgtactctctcgttaaataaataataaaaacgaccacactacgtcctttccccaaaatcgtactctctcgttaactaaataacgaaaacgaccacactacatcctttccccaaaatcgtactctctcgttaactaaataataaaaacgaccaccctatatcctttcc

SEQ ID NO: 28157 - DNA, 642 bp, Artificial Sequence
  chemically treated genomic DNA (Homo sapiens) CpG-island No: 28157
tcgttgatcgagtgacgagagcggttatattgcgttttttttttagggtcgtgttttttcgttgattgagtgacgagagcggttatattgcgttttttttttagggtcgtgttttttcgttgattgagtgacgagagcggttatattgtattttttttttagggtcgtgttttttcgttgatcgagtgacgagagcggttatattgcgttttttttttagggtcgtgttttttcgttgattgagtgacgagagcggttatattgtattttttttttagggtcgtgttttttcgttgatcgagtgacgagagcggttatattgcgttttttttttagggtcgtgttttttcgttgaatgagtgatgagagcggttatattgcgttttttttttagggttgtgttttttcgttgatcgagtgacgagggcggttattttgtgttttttttttagggtcgtgttgttttgttgatcgagtgacgagagcggttacgttgcgttttttttttagggttatgttgtttcgttgatcgagtgacgagagcggttatatcgtgttttttttttaggatcgtgtttttttattgatcgagcgattgtgtgggttgtggtttggtggattttgtttggggaggtcggagga

SEQ ID NO: 28158 - DNA, 642 bp, Artificial Sequence
  chemically treated genomic DNA (Homo sapiens) CpG-island No: 28158
tcctccgacctccccaaacaaaatccaccaaaccacaacccacacaatcgctcgatcaataaaaaaacacgatcctaaaaaaaaaacacgatataaccgctctcgtcactcgatcaacgaaacaacataaccctaaaaaaaaaacgcaacgtaaccgctctcgtcactcgatcaacaaaacaacacgaccctaaaaaaaaaacacaaaataaccgccctcgtcactcgatcaacgaaaaaacacaaccctaaaaaaaaaacgcaatataaccgctctcatcactcattcaacgaaaaaacacgaccctaaaaaaaaaacgcaatataaccgctctcgtcactcgatcaacgaaaaaacacgaccctaaaaaaaaaatacaatataaccgctctcgtcactcaatcaacgaaaaaacacgaccctaaaaaaaaaacgcaatataaccgctctcgtcactcgatcaacgaaaaaacacgaccctaaaaaaaaaatacaatataaccgctctcgtcactcaatcaacgaaaaaacacgaccctaaaaaaaaaacgcaatataaccgctctcgtcactcaatcaacgaaaaaacacgaccctaaaaaaaaaacgcaatataaccgctctcgtcactcgatcaacga

SEQ ID NO: 28159 - DNA, 642 bp, Artificial Sequence
  chemically treated genomic DNA (Homo sapiens) CpG-island No: 28159
tttttcgatttttttagataaaatttattagattatagtttatatagtcgttcggttaatgagagagtacgattttggggagaggatacggtgtggtcgttttcgttattcggttaacgagataatatgattttggggaaaggacgtagcgtggtcgttttcgttattcggttaataagataatacgattttggggaaaggatatagggtggtcgttttcgttattcggttaacgagagagtataattttggggaaaggacgtagtgtggtcgtttttattatttatttaacgagagagtacgattttggggaaaggacgtagtgtggtcgttttcgttattcggttaacgagagagtacgattttggggaaaggatgtagtgtggtcgttttcgttatttagttaacgagagagtacgattttggggaaaggacgtagtgtggtcgttttcgttattcggttaacgagagagtacgattttggggaaaggatgtagtgtggtcgttttcgttatttagttaacgagagagtacgattttggggaaaggacgtagtgtggtcgttttcgttatttagttaacgagagagtacgattttggggaaaggacgtagtgtggtcgttttcgttattcggttaacga

SEQ ID NO: 28160 - DNA, 642 bp, Artificial Sequence
  chemically treated genomic DNA (Homo sapiens) CpG-island No: 28160
tcgttaaccgaataacgaaaacgaccacactacgtcctttccccaaaatcgtactctctcgttaactaaataacgaaaacgaccacactacgtcctttccccaaaatcgtactctctcgttaactaaataacgaaaacgaccacactacatcctttccccaaaatcgtactctctcgttaaccgaataacgaaaacgaccacactacgtcctttccccaaaatcgtactctctcgttaactaaataacgaaaacgaccacactacatcctttccccaaaatcgtactctctcgttaaccgaataacgaaaacgaccacactacgtcctttccccaaaatcgtactctctcgttaaataaataataaaaacgaccacactacgtcctttccccaaaattatactctctcgttaaccgaataacgaaaacgaccaccctatatcctttccccaaaatcgtattatcttattaaccgaataacgaaaacgaccacgctacgtcctttccccaaaatcatattatctcgttaaccgaataacgaaaacgaccacaccgtatcctctccccaaaatcgtactctctcattaaccgaacgactatataaactataatctaataaattttatctaaaaaaatcgaaaaa

SEQ ID NO: 28161 - DNA, 596 bp, Artificial Sequence
  chemically treated genomic DNA (Homo sapiens) CpG-island No: 28161
gcgtggtgtttatcggagtgggggtgtttattgtatttcgcgtggtggttatcggagtgggggtgtttattttatttcgcgtggtgtttatcggagtggggtgtttattttattttacgcggtgtttatcggagtgggggtgtttattttatttcgcgtggtgtttatcggagtgggggtgtttattttatttcgcgtggtgtttatcggagtggggtgtttattttattttacgcggtgtttatcggagtggggtgtttattttattttacgcggtgtttatcggagtggggtgtttattttattttacgcggtgtttatcggagtggggatgtttattttatttcgcgtggtgtttatcggagtggggtgtttattttatttcgcgtggtgtttatcggagtggggtgtttattttattttacgcggtgtttatcggagtgggggtgtttattttatttcgcgtggtgtttatcggagtggggtgtttattttatttcgcgtggtgtttatcggagtggggtgtttattttattttacgcggtgtttatcggagtgggggtgtttattttatttcgcgtagtgttgattagttt

SEQ ID NO: 28162 - DNA, 596 bp, Artificial Sequence
  chemically treated genomic DNA (Homo sapiens) CpG-island No: 28162
aaactaatcaacactacgcgaaataaaataaacacccccactccgataaacaccgcgtaaaataaaataaacaccccactccgataaacaccacgcgaaataaaataaacaccccactccgataaacaccacgcgaaataaaataaacacccccactccgataaacaccgcgtaaaataaaataaacaccccactccgataaacaccacgcgaaataaaataaacaccccactccgataaacaccacgcgaaataaaataaacatccccactccgataaacaccgcgtaaaataaaataaacaccccactccgataaacaccgcgtaaaataaaataaacaccccactccgataaacaccgcgtaaaataaaataaacaccccactccgataaacaccacgcgaaataaaataaacacccccactccgataaacaccacgcgaaataaaataaacacccccactccgataaacaccgcgtaaaataaaataaacaccccactccgataaacaccacgcgaaataaaataaacacccccactccgataaccaccacgcgaaatacaataaacacccccactccgataaacaccacgc

SEQ ID NO: 28163 - DNA, 596 bp, Artificial Sequence
  chemically treated genomic DNA (Homo sapiens) CpG-island No: 28163
gaattgattaatattgcgcgggataaggtggatatttttatttcgataaatatcgcgtgggataaggtggatattttatttcgataaatattacgcgggataaggtggatattttatttcgataaatattacgcgggataaggtggatatttttatttcgataaatatcgcgtgggataaggtggatattttatttcgataaatattacgcgggataaggtggatattttatttcgataaatattacgcgggataaggtggatatttttatttcgataaatatcgcgtgggataaggtggatattttatttcgataaatatcgcgtgggataaggtggatattttatttcgataaatatcgcgtgggataaggtggatattttatttcgataaatattacgcgggataaggtggatatttttatttcgataaatattacgcgggataaggtggatatttttatttcgataaatatcgcgtgggataaggtggatattttatttcgataaatattacgcgggataaggtggatatttttatttcgataattattacgcgggatatagtggatatttttatttcgataaatattacgt

SEQ ID NO: 28164 - DNA, 596 bp, Artificial Sequence
  chemically treated genomic DNA (Homo sapiens) CpG-island No: 28164
acgtaatatttatcgaaataaaaatatccactatatcccgcgtaataattatcgaaataaaaatatccaccttatcccgcgtaatatttatcgaaataaaatatccaccttatcccacgcgatatttatcgaaataaaaatatccaccttatcccgcgtaatatttatcgaaataaaaatatccaccttatcccgcgtaatatttatcgaaataaaatatccaccttatcccacgcgatatttatcgaaataaaatatccaccttatcccacgcgatatttatcgaaataaaatatccaccttatcccacgcgatatttatcgaaataaaaatatccaccttatcccgcgtaatatttatcgaaataaaatatccaccttatcccgcgtaatatttatcgaaataaaatatccaccttatcccacgcgatatttatcgaaataaaaatatccaccttatcccgcgtaatatttatcgaaataaaatatccaccttatcccgcgtaatatttatcgaaataaaatatccaccttatcccacgcgatatttatcgaaataaaaatatccaccttatcccgcgcaatattaatcaattc

SEQ ID NO: 28165 - DNA, 1494 bp, Artificial Sequence
  chemically treated genomic DNA (Homo sapiens) CpG-island No: 28165
tagcggacgtcggataagggggagtttagttcgtacgatatttatttaggacgtggggaagttcggttcgtacgatatttatttgcgtcgcgggagttcgcgcggggtttcgtttttttttttggcggcgcgggtattgaatgggtagtttcggatttagttattttcgttatcgtcgttatttttttttcggttttgggtttttagcgtcgttgtcgttattgggcggggagttgcggggttgcgaagtaaataagtcgggagcgtcggtcgggtttttcgggtagaggggcgttgtttttttttattcgagaaaggggaaggaggcgtagttcgtttaggattcgtttcgttcggtttaggttcggttcgggtgttcgcgtcggggggtgggcgcggatttttttgttttttgggtcgcgcgggttagggcgcgagtttttcggggtttttgattcgattttatttttttttttacgttttatagtagtttttttttgattgcgttttttgcgttgtttatggtgtggtaggaggcggcgtcgagcggtttttagagttttcgcgttttcgtcgttttcgcgtttttcggtttagcgttttacgcgtaaggcggagttttcgttcgtcgcgttttcggttcgtcgtcgtcgtcgtcgtcgtagttattgttcggtgttcggtttcgtagttatttttcgagtttcgtatagacgttaggcggtaggttcggtttttttttatagtcggaggggggttgcgtatagcgacgggggatcggggcggggagaggtcgtgcgcgtttaggggcggtagattcgggcgcgcgttacgggggtcgttgttatggtaacgtattcgttttcgtatggagggcgcgaagtcgtattgtgagcgttggttttggagttcgcggtttcgcggttgagagcgagtttcggtttcgttgaagtttttttgatttttgtttgttttttttttcgacgggacggaaagggtcggggttcgggtatggggttttttgcggttcgagtttgtttacggcgaagtcggtgtagtttggtttcgtgatttttttgaattttcgttcggtcgtcgtcgtgtagttgttaagtttttgggaagattagtgggagcgtagtcgttcgagttcgacggtcggagggtcgcggttagttttttttgtcgggtcgttacgttttataaggtttttttcggtcgtttcgtgggaggcggggcgtaggttggagtaatagggacgggtttgagttggtacggaatcgggtaaggtgagagaagtgttttttacgcgatttttaagtttcgttagggaatcgagggagaagaaaggttgtttagagtgataaagaatatgtcgttgtaaacggaagagtaacgtgttcgaatttaggtgataggaagggtttaggttttttcggtacgaatggagttttttagttaatatgtttttacgtgatgtagttttatagcgta

SEQ ID NO: 28166 - DNA, 1494 bp, Artificial Sequence
  chemically treated genomic DNA (Homo sapiens) CpG-island No: 28166
tacgctataaaactacatcacgtaaaaacatattaactaaaaaactccattcgtaccgaaaaaacctaaacccttcctatcacctaaattcgaacacgttactcttccgtttacaacgacatattctttatcactctaaacaacctttcttctccctcgattccctaacgaaacttaaaaatcgcgtaaaaaacacttctctcaccttacccgattccgtaccaactcaaacccgtccctattactccaacctacgccccgcctcccacgaaacgaccgaaaaaaaccttataaaacgtaacgacccgacaaaaaaaactaaccgcgaccctccgaccgtcgaactcgaacgactacgctcccactaatcttcccaaaaacttaacaactacacgacgacgaccgaacgaaaattcaaaaaaatcacgaaaccaaactacaccgacttcgccgtaaacaaactcgaaccgcaaaaaaccccatacccgaaccccgaccctttccgtcccgtcgaaaaaaaaaacaaacaaaaatcaaaaaaacttcaacgaaaccgaaactcgctctcaaccgcgaaaccgcgaactccaaaaccaacgctcacaatacgacttcgcgccctccatacgaaaacgaatacgttaccataacaacgacccccgtaacgcgcgcccgaatctaccgcccctaaacgcgcacgacctctccccgccccgatcccccgtcgctatacgcaacccccctccgactataaaaaaaaaccgaacctaccgcctaacgtctatacgaaactcgaaaaataactacgaaaccgaacaccgaacaataactacgacgacgacgacgacgacgaaccgaaaacgcgacgaacgaaaactccgccttacgcgtaaaacgctaaaccgaaaaacgcgaaaacgacgaaaacgcgaaaactctaaaaaccgctcgacgccgcctcctaccacaccataaacaacgcaaaaaacgcaatcaaaaaaaaactactataaaacgtaaaaaaaaaaataaaatcgaatcaaaaaccccgaaaaactcgcgccctaacccgcgcgacccaaaaaacaaaaaaatccgcgcccaccccccgacgcgaacacccgaaccgaacctaaaccgaacgaaacgaatcctaaacgaactacgcctccttcccctttctcgaataaaaaaaaacaacgcccctctacccgaaaaacccgaccgacgctcccgacttatttacttcgcaaccccgcaactccccgcccaataacgacaacgacgctaaaaacccaaaaccgaaaaaaaaataacgacgataacgaaaataactaaatccgaaactacccattcaatacccgcgccgccaaaaaaaaaaacgaaaccccgcgcgaactcccgcgacgcaaataaatatcgtacgaaccgaacttccccacgtcctaaataaatatcgtacgaactaaactcccccttatccgacgtccgcta

SEQ ID NO: 28167 - DNA, 1494 bp, Artificial Sequence
  chemically treated genomic DNA (Homo sapiens) CpG-island No: 28167
tgcgttataaagttgtattacgtagaagtatgttgattggaaggttttattcgtgtcgaaaaggtttaagttttttttgttatttagattcgggtacgttgttttttcgtttgtaacggtatgttttttattattttgagtaattttttttttttttcgattttttagcgaggtttgggaatcgcgtggaagatattttttttattttgttcggtttcgtattagtttaagttcgtttttgttattttaatttgcgtttcgttttttacggagcggtcgggaaggattttgtgggacgtggcgattcggtaagggggattggtcgcgatttttcggtcgtcgggttcgggcggttgcgtttttattaatttttttagaaatttgataattgtacggcgacggtcggacggggatttagaggggttacggggttaggttgtatcggtttcgtcgtgggtaggttcggatcgtaggggattttatgttcgagtttcggtttttttcgtttcgtcgggagagggagtaggtagaagttaggggagttttagcgggatcgaggttcgtttttagtcgcggggtcgcgggttttagggttagcgtttataatgcggtttcgcgttttttatgcgggagcgggtgcgttgttatgatagcgattttcgtggcgcgcgttcgggtttgtcgtttttaggcgcgtacggttttttttcgtttcgatttttcgtcgttgtgcgtaattttttttcggttgtgggaaggggtcgggtttgtcgtttgacgtttgtgcggggttcggaagatggttgcggagtcgagtatcgggtagtggttgcggcggcggcggcggcggcgggtcgggagcgcggcgggcgggggtttcgttttgcgcgtggggcgttgagtcgagaggcgcggaggcggcgagggcgcgggggttttgaggatcgttcggcgtcgttttttgttatattatgggtagcgtagaggacgtagttaaagagaaattgttgtggaacgtgaagaaggaggtaaagtcgagttaagaatttcggggggttcgcgttttggttcgcgcggtttagggggtagaaaggttcgcgtttatttttcggcgcgggtattcgggtcgaatttgggtcgggcggggcgggttttggacgggttgcgttttttttttttttttcggatgggggagggtagcgtttttttgttcgggggattcggtcggcgttttcggtttgtttgtttcgtagtttcgtagtttttcgtttagtgacggtagcggcgttgggagtttaaggtcgggggaggggtggcggcgatggcggggatggttggattcggagttgtttatttagtgttcgcgtcgttaggggagggggcggggtttcgcgcgagttttcgcggcgtaggtgggtgtcgtgcgggtcgagtttttttacgttttaagtgggtgtcgtgcgggttgagtttttttttgttcgacgttcgttg

SEQ ID NO: 28168 - DNA, 1494 bp, Artificial Sequence
  chemically treated genomic DNA (Homo sapiens) CpG-island No: 28168
caacgaacgtcgaacaaaaaaaaactcaacccgcacgacacccacttaaaacgtaaaaaaactcgacccgcacgacacccacctacgccgcgaaaactcgcgcgaaaccccgccccctcccctaacgacgcgaacactaaataaacaactccgaatccaaccatccccgccatcgccgccacccctcccccgaccttaaactcccaacgccgctaccgtcactaaacgaaaaactacgaaactacgaaacaaacaaaccgaaaacgccgaccgaatcccccgaacaaaaaaacgctaccctcccccatccgaaaaaaaaaaaaaaaacgcaacccgtccaaaacccgccccgcccgacccaaattcgacccgaatacccgcgccgaaaaataaacgcgaacctttctaccccctaaaccgcgcgaaccaaaacgcgaaccccccgaaattcttaactcgactttacctccttcttcacgttccacaacaatttctctttaactacgtcctctacgctacccataatataacaaaaaacgacgccgaacgatcctcaaaacccccgcgccctcgccgcctccgcgcctctcgactcaacgccccacgcgcaaaacgaaacccccgcccgccgcgctcccgacccgccgccgccgccgccgccgcaaccactacccgatactcgactccgcaaccatcttccgaaccccgcacaaacgtcaaacgacaaacccgaccccttcccacaaccgaaaaaaaattacgcacaacgacgaaaaatcgaaacgaaaaaaaaccgtacgcgcctaaaaacgacaaacccgaacgcgcgccacgaaaatcgctatcataacaacgcacccgctcccgcataaaaaacgcgaaaccgcattataaacgctaaccctaaaacccgcgaccccgcgactaaaaacgaacctcgatcccgctaaaactcccctaacttctacctactccctctcccgacgaaacgaaaaaaaccgaaactcgaacataaaatcccctacgatccgaacctacccacgacgaaaccgatacaacctaaccccgtaacccctctaaatccccgtccgaccgtcgccgtacaattatcaaatttctaaaaaaattaataaaaacgcaaccgcccgaacccgacgaccgaaaaatcgcgaccaatcccccttaccgaatcgccacgtcccacaaaatccttcccgaccgctccgtaaaaaacgaaacgcaaattaaaataacaaaaacgaacttaaactaatacgaaaccgaacaaaataaaaaaaatatcttccacgcgattcccaaacctcgctaaaaaatcgaaaaaaaaaaaaaattactcaaaataataaaaaacataccgttacaaacgaaaaaacaacgtacccgaatctaaataacaaaaaaaacttaaaccttttcgacacgaataaaaccttccaatcaacatacttctacgtaatacaactttataacgca

SEQ ID NO: 28169 - DNA, 1711 bp, Artificial Sequence
  chemically treated genomic DNA (Homo sapiens) CpG-island No: 28169
ttcgtacggtgcggttgttgaattttttaggcggcggtttaggagggaattcggaggcgggagagtcggggagagcgggaacgcgggagcgggaaggttggcggttggtttatacggaaatttcggtttttgttaagaggtttttattttggcgatttagttttttatattataggtttgcgtgcgcgtgtgtgcgtgtgattttaaagttttggttttagaagtttcgggggtagtcggatttatttagtagtttcgtcgcggttcgttttattttttttgttttcgggcgtttagtttttgggggttcgttgttatgatcggtttcgttacggaatttaggttgtcgggggcgagggaaaataggggtttttatttcgatttttcgattcggggaatttattttatttttatttcgggatcgggagttcgggttttttagtatacgcgcggcggggcgacgttagggcggttcgcgatacgtcgcgattttttcgtttttttttgggtttttagttttacgtcggggtttcggcgttttcgatttcgtttttaagtaaatttttttaggttttcgaaggttcgaagaatcggcgttatcgacgtatttgaggtcgagtggtttacgggtttagttcggtcgtcgggtcggggtttgttttcgtggttttcgtttcgggggtcgagacgcgggtttttagtttcgttagttcgtttttttttttcggaagtcgggtcgggcgagcggcgttaggaattcggcgtcggcgaaaggagaagtggaagttgagcgcggcgttcggtcggttttcgcggtcgtcggggtcgtcgtttttcgttttttttttcgttcgtttttttttttcgttcgtttgttttcgttatttcgcgttcgtgatttatttcggcgtcggggtaggttggttcgggcgggcgaggcgtagggtttttttatatttcgcgtcgttaatggtaagttggagggagagatgtaaatattaggtgagacggcggcgtttttgataaaacggggcggggggcggggtggagcgcgcggggagcggggcggacgtcggggagggtcgggttaagatacggggcggtaggggcgttcggggagggggcgcgaatcggcgtagatttgtatcgaaacgagcgagcgaaaggggaaattgtattagagatatatacgttttcgtaggcggcggttggggcgggcgcgaaggaggtagggcgggagggagggaagagtcggagggagggatcgacgggagggattgcgggcgggcggggtgggggagggaacgagggagggacgaggtatttcggtggaaatagcgttttttcgtttcggttcgttcgtcgcggtcgttagtacggtatggggagtcgtgttaggggttcgcgcggttttttttttttttcgcggttcgttcgcgttcgggggattacgaggtagggcgttcgtagagttcgcgtcgtgcgtcgcggttcgggcgggcgttttttattttgtttttagttagcgagatttcgagttttttgttcgtttcgcgtttttttcggtgcgaagtttttatataacgtttcgtagagaaatttttttttcgcggattcgggaaggtttcgtttagttttttcggttcgtgtaagtggagatttgtttgacgtttttgggttaagttttgcgttttatattattgagtttttg

SEQ ID NO: 28170 - DNA, 1711 bp, Artificial Sequence
  chemically treated genomic DNA (Homo sapiens) CpG-island No: 28170
caaaaactcaataatataaaacgcaaaacttaacccaaaaacgtcaaacaaatctccacttacacgaaccgaaaaaactaaacgaaaccttcccgaatccgcgaaaaaaaaatttctctacgaaacgttatataaaaacttcgcaccgaaaaaaacgcgaaacgaacaaaaaactcgaaatctcgctaactaaaaacaaaataaaaaacgcccgcccgaaccgcgacgcacgacgcgaactctacgaacgccctacctcgtaatcccccgaacgcgaacgaaccgcgaaaaaaaaaaaaaaccgcgcgaacccctaacacgactccccataccgtactaacgaccgcgacgaacgaaccgaaacgaaaaaacgctatttccaccgaaatacctcgtccctccctcgttccctcccccaccccgcccgcccgcaatccctcccgtcgatccctccctccgactcttccctccctcccgccctacctccttcgcgcccgccccaaccgccgcctacgaaaacgtatatatctctaatacaatttcccctttcgctcgctcgtttcgatacaaatctacgccgattcgcgccccctccccgaacgcccctaccgccccgtatcttaacccgaccctccccgacgtccgccccgctccccgcgcgctccaccccgccccccgccccgttttatcaaaaacgccgccgtctcacctaatatttacatctctccctccaacttaccattaacgacgcgaaatataaaaaaaccctacgcctcgcccgcccgaaccaacctaccccgacgccgaaataaatcacgaacgcgaaataacgaaaacaaacgaacgaaaaaaaaaaacgaacgaaaaaaaaaacgaaaaacgacgaccccgacgaccgcgaaaaccgaccgaacgccgcgctcaacttccacttctcctttcgccgacgccgaattcctaacgccgctcgcccgacccgacttccgaaaaaaaaaaacgaactaacgaaactaaaaacccgcgtctcgacccccgaaacgaaaaccacgaaaacaaaccccgacccgacgaccgaactaaacccgtaaaccactcgacctcaaatacgtcgataacgccgattcttcgaaccttcgaaaacctaaaaaaatttacttaaaaacgaaatcgaaaacgccgaaaccccgacgtaaaactaaaaacccaaaaaaaaacgaaaaaatcgcgacgtatcgcgaaccgccctaacgtcgccccgccgcgcgtatactaaaaaacccgaactcccgatcccgaaataaaaataaaataaattccccgaatcgaaaaatcgaaataaaaacccctattttccctcgcccccgacaacctaaattccgtaacgaaaccgatcataacaacgaacccccaaaaactaaacgcccgaaaacaaaaaaaataaaacgaaccgcgacgaaactactaaataaatccgactacccccgaaacttctaaaaccaaaactttaaaatcacacgcacacacgcgcacgcaaacctataatataaaaaactaaatcgccaaaataaaaacctcttaacaaaaaccgaaatttccgtataaaccaaccgccaaccttcccgctcccgcgttcccgctctccccgactctcccgcctccgaattccctcctaaaccgccgcctaaaaaattcaacaaccgcaccgtacgaa

SEQ ID NO: 28171 - DNA, 1711 bp, Artificial Sequence
  chemically treated genomic DNA (Homo sapiens) CpG-island No: 28171
taggagtttaataatgtggagcgtagggtttggtttaaaggcgttaagtaagtttttatttgtacgggtcgagggggttggacgaaattttttcgagttcgcggggaagggatttttttgcggggcgttgtatgggggtttcgtatcgggaagggcgcggaacgagtagagagttcggagtttcgttggttagaagtagagtggggagcgttcgttcgggtcgcggcgtacgacgcgggttttgcgggcgttttgtttcgtggtttttcgggcgcgagcgagtcgcgaggggaaggagaggtcgcgcgggtttttggtacggttttttatgtcgtgttggcgatcgcggcgggcgggtcggggcggaggggcgttgtttttatcgagatgtttcgtttttttttcgtttttttttttatttcgttcgttcgtagtttttttcgtcggttttttttttcggtttttttttttttttcgttttgtttttttcgcgttcgttttagtcgtcgtttgcggggacgtgtgtgtttttagtgtaattttttttttcgttcgttcgtttcggtgtaggtttgcgtcggttcgcgtttttttttcgggcgtttttgtcgtttcgtgttttggttcggtttttttcggcgttcgtttcgtttttcgcgcgttttatttcgtttttcgtttcgttttattaggggcgtcgtcgttttatttggtatttgtatttttttttttaatttgttattggcggcgcgaagtgtgggagagttttgcgtttcgttcgttcggattagtttgtttcggcgtcgaggtgagttacgggcgcggggtggcgggggtaggcgggcggggaggaagggcgggcggggaggagggcgggggacggcggtttcggcggtcgcggggatcgatcgggcgtcgcgtttaatttttattttttttttcgtcggcgtcgagtttttggcgtcgttcgttcggttcggttttcgaggggagaggacgggttggcggggttggggattcgcgtttcggttttcggagcggggattacggagatagatttcggttcggcgatcgagttgggttcgtgagttattcggttttaggtacgtcgatggcgtcggtttttcgagttttcggggatttggaaaagtttgtttgagggcggaatcgagagcgtcggggtttcggcgtggggttgggggtttagggaagggcgggagagtcgcggcgtgtcgcgagtcgttttggcgtcgtttcgtcgcgcgtgtgttggagaattcgggttttcgatttcgggatggaagtggaatggatttttcgagtcggggagtcggggtaggggtttttgttttttttcgttttcggtagtttgggtttcgtgacggggtcgattatgatagcgggtttttagaagttgggcgttcgagggtagaggaggtggggcggatcgcggcggagttgttagatggattcgattgttttcggggtttttggggttagggttttagggttatacgtatatacgcgtacgtagatttatgatgtggagaattggatcgttaaaatagagattttttggtaggggtcggagttttcgtgtgagttagtcgttagttttttcgttttcgcgttttcgtttttttcgattttttcgttttcgggtttttttttgggtcgtcgtttaggggatttagtagtcgtatcgtgcggg

SEQ ID NO: 28172 - DNA, 1711 bp, Artificial Sequence
  chemically treated genomic DNA (Homo sapiens) CpG-island No: 28172
cccgcacgatacgactactaaatcccctaaacgacgacccaaaaaaaaacccgaaaacgaaaaaatcgaaaaaaacgaaaacgcgaaaacgaaaaaactaacgactaactcacacgaaaactccgacccctaccaaaaaatctctattttaacgatccaattctccacatcataaatctacgtacgcgtatatacgtataaccctaaaaccctaaccccaaaaaccccgaaaacaatcgaatccatctaacaactccgccgcgatccgccccacctcctctaccctcgaacgcccaacttctaaaaacccgctatcataatcgaccccgtcacgaaacccaaactaccgaaaacgaaaaaaaacaaaaacccctaccccgactccccgactcgaaaaatccattccacttccatcccgaaatcgaaaacccgaattctccaacacacgcgcgacgaaacgacgccaaaacgactcgcgacacgccgcgactctcccgcccttccctaaacccccaaccccacgccgaaaccccgacgctctcgattccgccctcaaacaaacttttccaaatccccgaaaactcgaaaaaccgacgccatcgacgtacctaaaaccgaataactcacgaacccaactcgatcgccgaaccgaaatctatctccgtaatccccgctccgaaaaccgaaacgcgaatccccaaccccgccaacccgtcctctcccctcgaaaaccgaaccgaacgaacgacgccaaaaactcgacgccgacgaaaaaaaaaataaaaattaaacgcgacgcccgatcgatccccgcgaccgccgaaaccgccgtcccccgccctcctccccgcccgcccttcctccccgcccgcctacccccgccaccccgcgcccgtaactcacctcgacgccgaaacaaactaatccgaacgaacgaaacgcaaaactctcccacacttcgcgccgccaataacaaattaaaaaaaaaaatacaaataccaaataaaacgacgacgcccctaataaaacgaaacgaaaaacgaaataaaacgcgcgaaaaacgaaacgaacgccgaaaaaaaccgaaccaaaacacgaaacgacaaaaacgcccgaaaaaaaaacgcgaaccgacgcaaacctacaccgaaacgaacgaacgaaaaaaaaaattacactaaaaacacacacgtccccgcaaacgacgactaaaacgaacgcgaaaaaaacaaaacgaaaaaaaaaaaaaaaccgaaaaaaaaaaccgacgaaaaaaactacgaacgaacgaaataaaaaaaaaaacgaaaaaaaaacgaaacatctcgataaaaacaacgcccctccgccccgacccgcccgccgcgatcgccaacacgacataaaaaaccgtaccaaaaacccgcgcgacctctccttcccctcgcgactcgctcgcgcccgaaaaaccacgaaacaaaacgcccgcaaaacccgcgtcgtacgccgcgacccgaacgaacgctccccactctacttctaaccaacgaaactccgaactctctactcgttccgcgcccttcccgatacgaaacccccatacaacgccccgcaaaaaaatcccttccccgcgaactcgaaaaaatttcgtccaaccccctcgacccgtacaaataaaaacttacttaacgcctttaaaccaaaccctacgctccacattattaaactccta

SEQ ID NO: 28173 - DNA, 518 bp, Artificial Sequence
  chemically treated genomic DNA (Homo sapiens) CpG-island No: 28173
gttttcgggtcggcgggtatttacgtgtttggaggtgagggttgtgatgtcgcggataaggttgtttagtttcgaggagaaggacgttttggcggtcgcgggtttattatcgggttggttttgtagaaagagtttcggtagcgtcgttagcgttttttttattatgtcgtttatcgtcgtcgtcgttcgcgatgtcgtcgtcgttcgcgatttcgtagtcgttcggttttatgttcggtcgtcgttgtcggttcggttttcgtaagtattttttgttttttgaataagaaatttttattggcgttttatttgaataagtttagcgtcgttttcgcgagaggttattagagggcgtaagagatcgcgggggtggaaaaggtcgttcgttcgagattacgcgcgtaagtagattttttttttcgcgacggggtagcggtttcggaattttttagaatcgtgagtttttttgaggaagtcgtcgggggtttggttttgttaggtattgttttttagagttt

SEQ ID NO: 28174 - DNA, 518 bp, Artificial Sequence
  chemically treated genomic DNA (Homo sapiens) CpG-island No: 28174
aaactctaaaaaacaatacctaacaaaaccaaacccccgacgacttcctcaaaaaaactcacgattctaaaaaattccgaaaccgctaccccgtcgcgaaaaaaaaaatctacttacgcgcgtaatctcgaacgaacgaccttttccacccccgcgatctcttacgccctctaataacctctcgcgaaaacgacgctaaacttattcaaataaaacgccaataaaaatttcttattcaaaaaacaaaaaatacttacgaaaaccgaaccgacaacgacgaccgaacataaaaccgaacgactacgaaatcgcgaacgacgacgacatcgcgaacgacgacgacgataaacgacataataaaaaaaacgctaacgacgctaccgaaactctttctacaaaaccaacccgataataaacccgcgaccgccaaaacgtccttctcctcgaaactaaacaaccttatccgcgacatcacaaccctcacctccaaacacgtaaatacccgccgacccgaaaac

SEQ ID NO: 28175 - DNA, 518 bp, Artificial Sequence
  chemically treated genomic DNA (Homo sapiens) CpG-island No: 28175
ggattttgggagatagtgtttaatagggttaggttttcgacggtttttttaggaggatttacggttttgggggatttcggaatcgttatttcgtcgcgagaaaggaggtttatttacgcgcgtaatttcgagcgagcggttttttttattttcgcggttttttgcgttttttggtggtttttcgcgagaacgacgttgaatttgtttaggtgggacgttaataaagattttttatttaaaaaataggaagtgtttacggaggtcgggtcggtagcggcggtcgggtatgaagtcgggcggttacgggatcgcgggcggcggcggtatcgcgggcggcggcggcgatgagcgatatagtggagaagacgttgacggcgttgtcgggattttttttgtagaattagttcggtggtgggttcgcggtcgttaaggcgttttttttttcgaggttgggtagttttgttcgcggtattatagtttttatttttaagtacgtaggtgttcgtcggttcgggagt

SEQ ID NO: 28176 - DNA, 518 bp, Artificial Sequence
  chemically treated genomic DNA (Homo sapiens) CpG-island No: 28176
actcccgaaccgacgaacacctacgtacttaaaaataaaaactataataccgcgaacaaaactacccaacctcgaaaaaaaaaacgccttaacgaccgcgaacccaccaccgaactaattctacaaaaaaaatcccgacaacgccgtcaacgtcttctccactatatcgctcatcgccgccgccgcccgcgataccgccgccgcccgcgatcccgtaaccgcccgacttcatacccgaccgccgctaccgacccgacctccgtaaacacttcctattttttaaataaaaaatctttattaacgtcccacctaaacaaattcaacgtcgttctcgcgaaaaaccaccaaaaaacgcaaaaaaccgcgaaaataaaaaaaaccgctcgctcgaaattacgcgcgtaaataaacctcctttctcgcgacgaaataacgattccgaaatcccccaaaaccgtaaatcctcctaaaaaaaccgtcgaaaacctaaccctattaaacactatctcccaaaatcc

SEQ ID NO: 28177 - DNA, 505 bp, Artificial Sequence
  chemically treated genomic DNA (Homo sapiens) CpG-island No: 28177
gacggcgtttcgattgcgtttttggcgacggtcggaattttgttcggttttttgtaatgtttttatgggaaggttcgtatattcgtgatcgtttttggtagcggtttagttcgggatttggcgttttattcgttattggttagttttcggcgtgacgcgtaggggggcggggttttattagttgtttgcgggatgtttcgagtaggcgtattttggaaataatatcgtatcgtgcggagtggttttttttcgtttcggtttgtgttcgtcgtcgtcgtcgtttttgtttgcgtttttcgttttttgtcgtagttcggtgagcgttcgggtggtcgtcgggggtcgggcggagttggatcgtagttttttggggaagtggggagcggagtcgcgttgcgtacgggggttcgggaagggtttgggttgcggacgtttggggtgattatgaagaattggggcgttggggtgagggaacggggtgtagaatttatagttgggtgcgttg

SEQ ID NO: 28178 - DNA, 505 bp, Artificial Sequence
  chemically treated genomic DNA (Homo sapiens) CpG-island No: 28178
caacgcacccaactataaattctacaccccgttccctcaccccaacgccccaattcttcataatcaccccaaacgtccgcaacccaaacccttcccgaacccccgtacgcaacgcgactccgctccccacttccccaaaaaactacgatccaactccgcccgacccccgacgaccacccgaacgctcaccgaactacgacaaaaaacgaaaaacgcaaacaaaaacgacgacgacgacgaacacaaaccgaaacgaaaaaaaaccactccgcacgatacgatattatttccaaaatacgcctactcgaaacatcccgcaaacaactaataaaaccccgcccccctacgcgtcacgccgaaaactaaccaataacgaataaaacgccaaatcccgaactaaaccgctaccaaaaacgatcacgaatatacgaaccttcccataaaaacattacaaaaaaccgaacaaaattccgaccgtcgccaaaaacgcaatcgaaacgccgtc

SEQ ID NO: 28179 - DNA, 505 bp, Artificial Sequence
  chemically treated genomic DNA (Homo sapiens) CpG-island No: 28179
tagcgtatttaattgtgggttttgtatttcgtttttttattttagcgttttagttttttatggttattttagacgttcgtagtttaaatttttttcgggttttcgtgcgtagcgcgatttcgttttttatttttttaaggagttgcgatttaatttcgttcggttttcggcggttattcgggcgtttatcgggttgcggtaggaggcgggaggcgtaggtaggggcggcggcggcggcgggtataggtcggggcgggaggaggttatttcgtacggtgcggtattgtttttaaaatacgtttgttcggggtatttcgtaaatagttgatgaggtttcgtttttttgcgcgttacgtcgaggattgattaatggcgagtgaagcgttaagtttcgggttgggtcgttgttagggacggttacgaatgtacgaatttttttatggaaatattgtaaggggtcgagtaaaatttcgatcgtcgttagaagcgtagtcggagcgtcgtt

SEQ ID NO: 28180 - DNA, 505 bp, Artificial Sequence
  chemically treated genomic DNA (Homo sapiens) CpG-island No: 28180
aacgacgctccgactacgcttctaacgacgatcgaaattttactcgaccccttacaatatttccataaaaaaattcgtacattcgtaaccgtccctaacaacgacccaacccgaaacttaacgcttcactcgccattaatcaatcctcgacgtaacgcgcaaaaaaacgaaacctcatcaactatttacgaaataccccgaacaaacgtattttaaaaacaataccgcaccgtacgaaataacctcctcccgccccgacctatacccgccgccgccgccgcccctacctacgcctcccgcctcctaccgcaacccgataaacgcccgaataaccgccgaaaaccgaacgaaattaaatcgcaactccttaaaaaaataaaaaacgaaatcgcgctacgcacgaaaacccgaaaaaaatttaaactacgaacgtctaaaataaccataaaaaactaaaacgctaaaataaaaaaacgaaatacaaaacccacaattaaatacgcta

SEQ ID NO: 28181 - DNA, 785 bp, Artificial Sequence
  chemically treated genomic DNA (Homo sapiens) CpG-island No: 28181
cgggtttttttttaaattcgtttttcgtacgttttcgttttggtttttttttttattttttttattttttttttatttttacgttcgtttatcgttttacgattcgattttttttttatttattttatcgttcgacgttcggatttttacgtgcgggtacgatttatttttttttattcgaacgggtcgcgtatcggattttaatcggtattttaatcgttatcgtaatcgtttttcgttttcgatttcgtattcgtaatcgatttcggtaacgtttttcgtatttcgtacggtatttcgtattcgtaatcgcggacgggaatcggtatcgagtttcgttatcgcgacgggtatcgtaatcgtcgttttatgttattcgttttttattttatcgtattcgattcggtcgagtttacgttcgaacgttcgcgtttcggtattttttcgattcgtattagatttatttcgcgacgaattttatttgattttatttcgatcgtatttaattcggttcgtattttttcgtttcgatttaattcggatcgtattcgtttcgtttcgttttcgtattacgcggtcgcgaatcgttcgtatttcgttcgttcgacgttttttcggtatcgtacgcgtatttcgtcgttttcgtcgtttagcgagatatcgcgttacgtttcgtattttttttcgttatttcgtttttaatttttttattttcgtcgcgtatttttcgatttttattttcgttacgtatcgcggaattgttttttcgttacgatatcgtcgtt

SEQ ID NO: 28182 - DNA, 785 bp, Artificial Sequence
  chemically treated genomic DNA (Homo sapiens) CpG-island No: 28182
aacgacgatatcgtaacgaaaaaacaattccgcgatacgtaacgaaaataaaaatcgaaaaatacgcgacgaaaataaaaaaattaaaaacgaaataacgaaaaaaaatacgaaacgtaacgcgatatctcgctaaacgacgaaaacgacgaaatacgcgtacgataccgaaaaaacgtcgaacgaacgaaatacgaacgattcgcgaccgcgtaatacgaaaacgaaacgaaacgaatacgatccgaattaaatcgaaacgaaaaaatacgaaccgaattaaatacgatcgaaataaaatcaaataaaattcgtcgcgaaataaatctaatacgaatcgaaaaaataccgaaacgcgaacgttcgaacgtaaactcgaccgaatcgaatacgataaaataaaaaacgaataacataaaacgacgattacgatacccgtcgcgataacgaaactcgataccgattcccgtccgcgattacgaatacgaaataccgtacgaaatacgaaaaacgttaccgaaatcgattacgaatacgaaatcgaaaacgaaaaacgattacgataacgattaaaataccgattaaaatccgatacgcgacccgttcgaataaaaaaaaataaatcgtacccgcacgtaaaaatccgaacgtcgaacgataaaataaataaaaaaaaaatcgaatcgtaaaacgataaacgaacgtaaaaataaaaaaaaaataaaaaaaataaaaaaaaaaaccaaaacgaaaacgtacgaaaaacgaatttaaaaaaaaacccg

SEQ ID NO: 28183 - DNA, 785 bp, Artificial Sequence
  chemically treated genomic DNA (Homo sapiens) CpG-island No: 28183
ggcggcggtgtcgtggcgagagggtagtttcgcggtgcgtgacggaggtgggagtcggggagtgcgcgacggaggtggaggagttggaggcggggtggcgagggggggtacggggcgtggcgcggtgtttcgttgggcggcgggagcggcggggtgcgcgtgcggtatcgggagggcgtcgagcgggcggggtgcgagcggttcgcggtcgcgtggtgcggggacggggcgagacgggtgcggttcgggttgggtcggggcgaagggatgcgggtcgggttgagtgcggtcggagtggggttaggtggggttcgtcgcggggtaagtttgatgcggatcgggggggtgtcggggcgcgggcgttcgggcgtgggttcggtcgggtcgggtacggtgggatggggggcgaatagtatggggcggcggttgcggtgttcgtcgcggtagcggggttcggtgtcgattttcgttcgcggttgcgggtgcggagtgtcgtgcgggatgcggggggcgttgtcgggatcggttgcggatgcgggatcgggggcggggggcggttgcggtggcgattgaggtgtcgattgaggttcgatgcgcggttcgttcgggtgggagggagtggatcgtgttcgtacgtagggattcgggcgtcggacggtggggtgggtggggggggggtcgggtcgtggggcggtgggcgggcgtgggggtgggggggaggtgggggaggtgggggggggggttagggcgggggcgtgcggggggcgggtttgggggggggttcg

SEQ ID NO: 28184 - DNA, 785 bp, Artificial Sequence
  chemically treated genomic DNA (Homo sapiens) CpG-island No: 28184
cgaacccccccccaaacccgccccccgcacgcccccgccctaacccccccccccacctcccccacctcccccccacccccacgcccgcccaccgccccacgacccgaccccccccccacccaccccaccgtccgacgcccgaatccctacgtacgaacacgatccactccctcccacccgaacgaaccgcgcatcgaacctcaatcgacacctcaatcgccaccgcaaccgccccccgcccccgatcccgcatccgcaaccgatcccgacaacgccccccgcatcccgcacgacactccgcacccgcaaccgcgaacgaaaatcgacaccgaaccccgctaccgcgacgaacaccgcaaccgccgccccatactattcgccccccatcccaccgtacccgacccgaccgaacccacgcccgaacgcccgcgccccgacacccccccgatccgcatcaaacttaccccgcgacgaaccccacctaaccccactccgaccgcactcaacccgacccgcatcccttcgccccgacccaacccgaaccgcacccgtctcgccccgtccccgcaccacgcgaccgcgaaccgctcgcaccccgcccgctcgacgccctcccgataccgcacgcgcaccccgccgctcccgccgcccaacgaaacaccgcgccacgccccgtaccccccctcgccaccccgcctccaactcctccacctccgtcgcgcactccccgactcccacctccgtcacgcaccgcgaaactaccctctcgccacgacaccgccgcc

SEQ ID NO: 28185 - DNA, 662 bp, Artificial Sequence
  chemically treated genomic DNA (Homo sapiens) CpG-island No: 28185
ttcgtcgttgtaagggaaaaggtcgtttttttcgagtttcggagaggttttttaggaatttagagtttttcggggatatcgtttagttttcggcgttcggtttcgtttttgcgcgaattcggtcgtatttattttttcgggcggtttttttttcgtggtttgtggcgttataaggtttttagtcgtttgtgtttcgcggtgcgcgtttcgtttcgggatttgtcgttatcgtcgtttcgttttcggcggtatttatatttaggcgcgttcgcgcgcgcgttcggtttcgtttttgtttggaagtatagttgaagatggcgagttcggcgttttcggagtacgtcgaggagggatgttcggtttttgtcgtcgaggagtaggcgtcgtcgtcgtcgttatcgttttaggtattttcgtagagcggtagtagtaggaggaggaagcgtaggaagttggggcggcggagggcgcggggttgtaggtggaggaggtcgcgggtcgggcggcggtcgcggtaatttggttgttcggggagtcggtgttgtggttgggttgtcgcgtcgacgagttgttgagttggaagaggtcgttgcggagtttgttcggtttcgtcgttgttaatttgttgttttggtgagagtttgggtaaggtgggggcgttg

SEQ ID NO: 28186 - DNA, 662 bp, Artificial Sequence
  chemically treated genomic DNA (Homo sapiens) CpG-island No: 28186
caacgcccccaccttacccaaactctcaccaaaacaacaaattaacaacgacgaaaccgaacaaactccgcaacgacctcttccaactcaacaactcgtcgacgcgacaacccaaccacaacaccgactccccgaacaaccaaattaccgcgaccgccgcccgacccgcgacctcctccacctacaaccccgcgccctccgccgccccaacttcctacgcttcctcctcctactactaccgctctacgaaaatacctaaaacgataacgacgacgacgacgcctactcctcgacgacaaaaaccgaacatccctcctcgacgtactccgaaaacgccgaactcgccatcttcaactatacttccaaacaaaaacgaaaccgaacgcgcgcgcgaacgcgcctaaatataaataccgccgaaaacgaaacgacgataacgacaaatcccgaaacgaaacgcgcaccgcgaaacacaaacgactaaaaaccttataacgccacaaaccacgaaaaaaaaaccgcccgaaaaaataaatacgaccgaattcgcgcaaaaacgaaaccgaacgccgaaaactaaacgatatccccgaaaaactctaaattcctaaaaaacctctccgaaactcgaaaaaaacgaccttttcccttacaacgacgaa

SEQ ID NO: 28187 - DNA, 662 bp, Artificial Sequence
  chemically treated genomic DNA (Homo sapiens) CpG-island No: 28187
tagcgtttttattttgtttaagtttttattagaatagtaggttggtagcgacgaagtcgagtaggtttcgtagcggttttttttagtttagtagttcgtcggcgcggtagtttagttatagtatcggtttttcgagtagttaggttatcgcggtcgtcgttcggttcgcggttttttttatttgtaatttcgcgtttttcgtcgttttagttttttgcgttttttttttttgttgttgtcgttttgcggggatgtttggggcggtggcggcgacggcggcgtttgtttttcggcggtaggagtcgggtattttttttcggcgtgtttcggaggcgtcgggttcgttatttttagttgtgtttttagatagggacggggtcgggcgcgcgcgcgggcgcgtttgggtgtgggtgtcgtcgagggcggggcggcggtggcggtaggtttcggagcggggcgcgtatcgcggggtataggcggttgggggttttgtgacgttataggttacggagggggagtcgttcgggaaagtgggtgcggtcgagttcgcgtaggggcggggtcgggcgtcgggagttgggcggtgttttcggggggttttgggtttttggagggttttttcgggattcgaggaaaacgatttttttttttgtagcggcggg

SEQ ID NO: 28188 - DNA, 662 bp, Artificial Sequence
  chemically treated genomic DNA (Homo sapiens) CpG-island No: 28188
cccgccgctacaaaaaaaaaaatcgttttcctcgaatcccgaaaaaaccctccaaaaacccaaaaccccccgaaaacaccgcccaactcccgacgcccgaccccgcccctacgcgaactcgaccgcacccactttcccgaacgactccccctccgtaacctataacgtcacaaaacccccaaccgcctataccccgcgatacgcgccccgctccgaaacctaccgccaccgccgccccgccctcgacgacacccacacccaaacgcgcccgcgcgcgcgcccgaccccgtccctatctaaaaacacaactaaaaataacgaacccgacgcctccgaaacacgccgaaaaaaaatacccgactcctaccgccgaaaaacaaacgccgccgtcgccgccaccgccccaaacatccccgcaaaacgacaacaacaaaaaaaaaaaacgcaaaaaactaaaacgacgaaaaacgcgaaattacaaataaaaaaaaccgcgaaccgaacgacgaccgcgataacctaactactcgaaaaaccgatactataactaaactaccgcgccgacgaactactaaactaaaaaaaaccgctacgaaacctactcgacttcgtcgctaccaacctactattctaataaaaacttaaacaaaataaaaacgcta

SEQ ID NO: 28189 - DNA, 852 bp, Artificial Sequence
  chemically treated genomic DNA (Homo sapiens) CpG-island No: 28189
gttcgtttgttcgatttgttgcgcggtttggtggtggagttgaatttcgcggtggtgattgttatttatgatttaggcgtcgttcgtttgttggcggatcgtttgttggtgatgaagtaggggtaagtggtggagagtgggttaatcgatcgcgtgttcgacgattcgtattattcgtatatatagttgttggtgttatcggttttgtagaattgagtcggtgtcggatgcggcgtaaacgttttattcggtttataaatgcgtttttcgtaggtcggataagacgcgttagcgtcgtattcgatattcgaattacgaggcgaaaaatgattaacgtataaaacgttagtaaaatttttattttgtattagtaaaacggcgtgcgtttgttcgtttttaatcgcgtttcgtttatcgttaacgcgggcgaatgcgtggtgttttacggttatttcggtagcggtaaattaattttgttacgttcgttgtacgttaattatttgttcgacgaaggttaaatttagattaaatacggtgacgagtgggtagatttggttatcgcgttagcgcgtaaagtggtggaaattcgtaaaattatcgtcggttgggttgattagttttgcgcgttattcgcgtatttagtttggaatggtatgcggcgttgtcgaatcgcgttcgagtgagtttcgtcgataagcggcgttttatcgttaaggtgcgaagcgtggacggatttgaatttcggggataagggtattgtcgggtatttgatttttgttgtgatacgttcggataaagcgggggagtttaaatacgggtattattttaaagtaatgacggcgggttataatg

SEQ ID NO: 28190 - DNA, 852 bp, Artificial Sequence
  chemically treated genomic DNA (Homo sapiens) CpG-island No: 28190
cattataacccgccgtcattactttaaaataatacccgtatttaaactcccccgctttatccgaacgtatcacaacaaaaatcaaatacccgacaatacccttatccccgaaattcaaatccgtccacgcttcgcaccttaacgataaaacgccgcttatcgacgaaactcactcgaacgcgattcgacaacgccgcataccattccaaactaaatacgcgaataacgcgcaaaactaatcaacccaaccgacgataattttacgaatttccaccactttacgcgctaacgcgataaccaaatctacccactcgtcaccgtatttaatctaaatttaaccttcgtcgaacaaataattaacgtacaacgaacgtaacaaaattaatttaccgctaccgaaataaccgtaaaacaccacgcattcgcccgcgttaacgataaacgaaacgcgattaaaaacgaacaaacgcacgccgttttactaatacaaaataaaaattttactaacgttttatacgttaatcatttttcgcctcgtaattcgaatatcgaatacgacgctaacgcgtcttatccgacctacgaaaaacgcatttataaaccgaataaaacgtttacgccgcatccgacaccgactcaattctacaaaaccgataacaccaacaactatatatacgaataatacgaatcgtcgaacacgcgatcgattaacccactctccaccacttacccctacttcatcaccaacaaacgatccgccaacaaacgaacgacgcctaaatcataaataacaatcaccaccgcgaaattcaactccaccaccaaaccgcgcaacaaatcgaacaaacgaac

SEQ ID NO: 28191 - DNA, 852 bp, Artificial Sequence
  chemically treated genomic DNA (Homo sapiens) CpG-island No: 28191
tattatagttcgtcgttattattttaagatagtgttcgtgtttaaattttttcgttttgttcgagcgtgttataataaggattaaatattcggtagtatttttgttttcggaatttaggttcgtttacgtttcgtattttagcggtagaacgtcgtttatcggcgaggtttattcggacgcggttcgataacgtcgtatattattttaggttgaatacgcggatgacgcgtagaattggttaatttagtcgacggtggttttgcggatttttattattttgcgcgttggcgcggtgattaggtttatttattcgttatcgtgtttgatttggatttgattttcgtcgggtagatagttggcgtatagcgagcgtagtagagttgatttgtcgttgtcggaatggtcgtggagtattacgtattcgttcgcgttgacggtgagcgaggcgcgattgaggacgggtaggcgtacgtcgttttgttggtgtaggatgaaggttttattgacgttttgtacgttaattatttttcgtttcgtggttcgggtgtcggatgcgacgttgacgcgttttattcgatttacggggagcgtatttgtaggtcggataaggcgtttacgtcgtattcggtatcggtttaattttgtaaaatcgatgatattagtagttgtgtatacggatgatgcgggtcgtcgagtacgcggtcggttaatttattttttattatttgtttttgttttattattagtaaacggttcgttagtaggcgggcgacgtttaaattatgggtgataattattatcgcgaggtttagttttattattaggtcgcgtagtaggtcgagtaggcgggt

SEQ ID NO: 28192 - DNA, 852 bp, Artificial Sequence
  chemically treated genomic DNA (Homo sapiens) CpG-island No: 28192
acccgcctactcgacctactacgcgacctaataataaaactaaacctcgcgataataattatcacccataatttaaacgtcgcccgcctactaacgaaccgtttactaataataaaacaaaaacaaataataaaaaataaattaaccgaccgcgtactcgacgacccgcatcatccgtatacacaactactaatatcatcgattttacaaaattaaaccgataccgaatacgacgtaaacgccttatccgacctacaaatacgctccccgtaaatcgaataaaacgcgtcaacgtcgcatccgacacccgaaccacgaaacgaaaaataattaacgtacaaaacgtcaataaaaccttcatcctacaccaacaaaacgacgtacgcctacccgtcctcaatcgcgcctcgctcaccgtcaacgcgaacgaatacgtaatactccacgaccattccgacaacgacaaatcaactctactacgctcgctatacgccaactatctacccgacgaaaatcaaatccaaatcaaacacgataacgaataaataaacctaatcaccgcgccaacgcgcaaaataataaaaatccgcaaaaccaccgtcgactaaattaaccaattctacgcgtcatccgcgtattcaacctaaaataatatacgacgttatcgaaccgcgtccgaataaacctcgccgataaacgacgttctaccgctaaaatacgaaacgtaaacgaacctaaattccgaaaacaaaaatactaccgaatatttaatccttattataacacgctcgaacaaaacgaaaaaatttaaacacgaacactatcttaaaataataacgacgaactataata

SEQ ID NO: 28193 - DNA, 506 bp, Artificial Sequence
  chemically treated genomic DNA (Homo sapiens) CpG-island No: 28193
cgggtcgaagtcgattttgtacggcgtaattttttcggttagcgttatggttatatacgtacgatcgtgaaagtcgtcgttaaacgtaattacgttagggcgttcggtatgggcgcgagtaatttttatcgcgttttttatcgttttcgtatcggtggtgaagaacgcggttttggtttgttcgtttatcggggtaagggcgttgatttttttcgttagggtgacgtagtttttatacggtataatttgatacgcggtgtgggtaaattgttgtagttgttgttttatcgtcgcgattagattagggtggcgatgttcggtatttagtatcgtaatgtttgcggcgaaatcgatgtattcgttgtttttaatattttttagcgtggcgtttttagtcgattgggcgaagaagtatatattacgttaatttcgcgcggagtggtagaaagacgacgttgatggaatttattgttgtttatgttttatattttttgattttttacggt

SEQ ID NO: 28194 - DNA, 506 bp, Artificial Sequence
  chemically treated genomic DNA (Homo sapiens) CpG-island No: 28194
accgtaaaaaatcaaaaaatataaaacataaacaacaataaattccatcaacgtcgtctttctaccactccgcgcgaaattaacgtaatatatacttcttcgcccaatcgactaaaaacgccacgctaaaaaatattaaaaacaacgaatacatcgatttcgccgcaaacattacgatactaaataccgaacatcgccaccctaatctaatcgcgacgataaaacaacaactacaacaatttacccacaccgcgtatcaaattataccgtataaaaactacgtcaccctaacgaaaaaaatcaacgcccttaccccgataaacgaacaaaccaaaaccgcgttcttcaccaccgatacgaaaacgataaaaaacgcgataaaaattactcgcgcccataccgaacgccctaacgtaattacgtttaacgacgactttcacgatcgtacgtatataaccataacgctaaccgaaaaaattacgccgtacaaaatcgacttcgacccg

SEQ ID NO: 28195 - DNA, 506 bp, Artificial Sequence
  chemically treated genomic DNA (Homo sapiens) CpG-island No: 28195
atcgtgaagagttaaaaggtgtgaaatatgagtaataatgaattttattagcgtcgtttttttgttatttcgcgcggggttggcgtgatgtgtattttttcgtttagtcggttgaaaacgttacgttgaaggatgttgagggtaacgagtatatcgatttcgtcgtaggtattgcggtgttgaatatcggatatcgttattttgatttggtcgcggcggtggagtagtaattgtaatagtttatttatatcgcgtattagattgtgtcgtatgaaagttacgttattttggcggagaaaattaacgtttttgtttcggtgagcgggtaggttaaaatcgcgttttttattatcggtgcggaagcggtggaaaacgcggtgaaaattgttcgcgtttatatcggacgttttggcgtgattgcgtttagcggcggtttttacggtcgtacgtatatgattatggcgttgatcggaaaagttgcgtcgtataaaatcggtttcggttcg

SEQ ID NO: 28196 - DNA, 506 bp, Artificial Sequence
  chemically treated genomic DNA (Homo sapiens) CpG-island No: 28196
cgaaccgaaaccgattttatacgacgcaacttttccgatcaacgccataatcatatacgtacgaccgtaaaaaccgccgctaaacgcaatcacgccaaaacgtccgatataaacgcgaacaattttcaccgcgttttccaccgcttccgcaccgataataaaaaacgcgattttaacctacccgctcaccgaaacaaaaacgttaattttctccgccaaaataacgtaactttcatacgacacaatctaatacgcgatataaataaactattacaattactactccaccgccgcgaccaaatcaaaataacgatatccgatattcaacaccgcaatacctacgacgaaatcgatatactcgttaccctcaacatccttcaacgtaacgttttcaaccgactaaacgaaaaaatacacatcacgccaaccccgcgcgaaataacaaaaaaacgacgctaataaaattcattattactcatatttcacaccttttaactcttcacgat

SEQ ID NO: 28197 - DNA, 690 bp, Artificial Sequence
  chemically treated genomic DNA (Homo sapiens) CpG-island No: 28197
  misc_feature (4)..(6): n is either a, c, g or t
  misc_feature (13)..(14): n is either a, c, g or t
  misc_feature (16)..(16): n is either a, c, g or t
  misc_feature (19)..(19): n is either a, c, g or t
  misc_feature (22)..(23): n is either a, c, g or t
  misc_feature (26)..(26): n is either a, c, g or t
  misc_feature (32)..(32): n is either a, c, g or t
cggnnnggagttnntngtnttnnttnttggangtaatagttcgtggacgttacgaagatgttcgagtttatgatggcgattacgatgacggttacgtttttgagtagcgtgatgtttttttgtagggttacgttttcgttttcgtttgtcggcgtcgcgtcgttcgcgcgtttggcggttattattttttttcgcgtttttttttttttttcggttatcggggtcgttagcgcgcgtcgtttcgggttcgtattcgttatgttttgtttatcggtcgggtttgggatattcgggagtcgtagtcgagcgaggattgtgcgcgtcgttcgtcgttcgtcgttcgtagttgcgttaggaatttcgttcgcgtcgttttttaggtttcggtttattggtttcgtttatcgttcgcggttttttttcgattcgtggttcggcggcggtttttagtttcgttttttcgatttagttcggagtacgtgcgtcgttcggtttagtttggtaggcgatttttaggttcgcgtggttttcgaaggttttcgtatttttgcgttatggagatttcggtttcgcgatttattttttcggcgttcgcgttattttagttcgttttttcgggtgcgtttgggcggggtttggtagttagggcgagtttttttatttattggttcgtagtttttcgttaagttt

SEQ ID NO: 28198 - DNA, 690 bp, Artificial Sequence
  chemically treated genomic DNA (Homo sapiens) CpG-island No: 28198
  misc_feature (659)..(659): n is either a, c, g or t
  misc_feature (665)..(665): n is either a, c, g or t
  misc_feature (668)..(669): n is either a, c, g or t
  misc_feature (672)..(672): n is either a, c, g or t
  misc_feature (675)..(675): n is either a, c, g or t
  misc_feature (677)..(678): n is either a, c, g or t
  misc_feature (685)..(687): n is either a, c, g or t
aaacttaacgaaaaactacgaaccaataaataaaaaaactcgccctaactaccaaaccccgcccaaacgcacccgaaaaaacgaactaaaataacgcgaacgccgaaaaaataaatcgcgaaaccgaaatctccataacgcaaaaatacgaaaaccttcgaaaaccacgcgaacctaaaaatcgcctaccaaactaaaccgaacgacgcacgtactccgaactaaatcgaaaaaacgaaactaaaaaccgccgccgaaccacgaatcgaaaaaaaaccgcgaacgataaacgaaaccaataaaccgaaacctaaaaaacgacgcgaacgaaattcctaacgcaactacgaacgacgaacgacgaacgacgcgcacaatcctcgctcgactacgactcccgaatatcccaaacccgaccgataaacaaaacataacgaatacgaacccgaaacgacgcgcgctaacgaccccgataaccgaaaaaaaaaaaaaaacgcgaaaaaaaataataaccgccaaacgcgcgaacgacgcgacgccgacaaacgaaaacgaaaacgtaaccctacaaaaaaacatcacgctactcaaaaacgtaaccgtcatcgtaatcgccatcataaactcgaacatcttcgtaacgtccacgaactattacntccaanaannaanacnannaactccnnnccg

SEQ ID NO: 28199 - DNA, 690 bp, Artificial Sequence
  chemically treated genomic DNA (Homo sapiens) CpG-island No: 28199
  misc_feature (659)..(659): n is either a, c, g or t
  misc_feature (665)..(665): n is either a, c, g or t
  misc_feature (668)..(669): n is either a, c, g or t
  misc_feature (672)..(672): n is either a, c, g or t
  misc_feature (675)..(675): n is either a, c, g or t
  misc_feature (677)..(678): n is either a, c, g or t
  misc_feature (685)..(687): n is either a, c, g or t
aggtttgacgagaggttgcgggttagtgggtgaaggggttcgttttgattgttaggtttcgtttaggcgtattcgggaggacgggttgggatgacgcgggcgtcgggggggtaggtcgcgaggtcggggtttttatggcgtaggagtacgggggttttcgaggattacgcgggtttgggaatcgtttgttaggttaggtcggacgacgtacgtgtttcgagttgggtcgagggggcggggttgagggtcgtcgtcgggttacgggtcggggaggagtcgcggacggtgggcggggttagtgggtcggggtttaaaaggcggcgcgggcggggtttttgacgtagttgcgggcggcgggcggcgagcggcgcgtataattttcgttcggttgcggttttcgggtgttttaggttcggtcggtaagtagagtatggcgggtgcgggttcgaagcggcgcgcgttagcggtttcggtggtcgaggagaaggaagaggcgcgggagaagataatggtcgttaagcgcgcggacggcgcggcgtcggtaggcgagggcgagggcgtgattttgtaggggaatattacgttatttaagggcgtggtcgttatcgtggtcgttattatgggttcgggtattttcgtgacgtttacgggttgttgtntttagnggnnagngtnannggttttnnntcg

SEQ ID NO: 28200 - DNA, 690 bp, Artificial Sequence
  chemically treated genomic DNA (Homo sapiens) CpG-island No: 28200
  misc_feature (4)..(6): n is either a, c, g or t
  misc_feature (13)..(14): n is either a, c, g or t
  misc_feature (16)..(16): n is either a, c, g or t
  misc_feature (19)..(19): n is either a, c, g or t
  misc_feature (22)..(23): n is either a, c, g or t
  misc_feature (26)..(26): n is either a, c, g or t
  misc_feature (32)..(32): n is either a, c, g or t
cgannnaaaaccnntnacnctnnccnctaaanacaacaacccgtaaacgtcacgaaaatacccgaacccataataacgaccacgataacgaccacgcccttaaataacgtaatattcccctacaaaatcacgccctcgccctcgcctaccgacgccgcgccgtccgcgcgcttaacgaccattatcttctcccgcgcctcttccttctcctcgaccaccgaaaccgctaacgcgcgccgcttcgaacccgcacccgccatactctacttaccgaccgaacctaaaacacccgaaaaccgcaaccgaacgaaaattatacgcgccgctcgccgcccgccgcccgcaactacgtcaaaaaccccgcccgcgccgccttttaaaccccgacccactaaccccgcccaccgtccgcgactcctccccgacccgtaacccgacgacgaccctcaaccccgccccctcgacccaactcgaaacacgtacgtcgtccgacctaacctaacaaacgattcccaaacccgcgtaatcctcgaaaacccccgtactcctacgccataaaaaccccgacctcgcgacctacccccccgacgcccgcgtcatcccaacccgtcctcccgaatacgcctaaacgaaacctaacaatcaaaacgaaccccttcacccactaacccgcaacctctcgtcaaacct

SEQ ID NO: 28201 - DNA, 852 bp, Artificial Sequence
  chemically treated genomic DNA (Homo sapiens) CpG-island No: 28201
  misc_feature (730)..(730): n is either a, c, g or t
aattaatgtttgatgcgacgttgtcgcgttttattaggtttataattattgtcgatttgtaggtttgataaggtatttgtgtcgtattcggtaattaatgtttgatgcgacgttgtcgcgttttattaggtttataattgttgtcgatttgtaggtcggataaggtatttgtgtcgtattcggtaattaatgtttgatgcgacgttgtcgcgttttattaggtttataattattgtcgatttgtaggtcggataaggtatttgtgtcgtattcggtaattaatgtttgatgcgacgttgtcgcgttttattaggtttataattgttgtcgattcgtaggtcggataaggcgttcgcgtcgtattcggtagtgtttattcgcggacgatttaaaatattttttttataagttcgtacgttttttagttattcgttatttgttggcgtatcgtgacgttggtaatatattttttagatcgtttgttacggaaacgattttatgttttattagatagtgttagacgcgtagatgtaatcgttcgatcgtattttagatattgcgtagttatagcggtaggttttagtaacgtacgtagtagggttataggatatattgcgtgtatttaatgattaagcggataagcggtgattagaggtatcgaaaaagttaaggtcgatatgaatttaggatatatagatcgtgaagttatattttacgggtaattggtagngttatattcggtagatacgtgaacgtggttaagaatcgacggtgagtgtatatatggggttttaagatggggggaatttgcggaatattacgggaatcggttaaaagtaataggggtaggat

SEQ ID NO: 28202 - DNA, 852 bp, Artificial Sequence
  chemically treated genomic DNA (Homo sapiens) CpG-island No: 28202
  misc_feature (123)..(123): n is either a, c, g or t
atcctacccctattacttttaaccgattcccgtaatattccgcaaattccccccatcttaaaaccccatatatacactcaccgtcgattcttaaccacgttcacgtatctaccgaatataacnctaccaattacccgtaaaatataacttcacgatctatatatcctaaattcatatcgaccttaactttttcgatacctctaatcaccgcttatccgcttaatcattaaatacacgcaatatatcctataaccctactacgtacgttactaaaacctaccgctataactacgcaatatctaaaatacgatcgaacgattacatctacgcgtctaacactatctaataaaacataaaatcgtttccgtaacaaacgatctaaaaaatatattaccaacgtcacgatacgccaacaaataacgaataactaaaaaacgtacgaacttataaaaaaaatattttaaatcgtccgcgaataaacactaccgaatacgacgcgaacgccttatccgacctacgaatcgacaacaattataaacctaataaaacgcgacaacgtcgcatcaaacattaattaccgaatacgacacaaataccttatccgacctacaaatcgacaataattataaacctaataaaacgcgacaacgtcgcatcaaacattaattaccgaatacgacacaaataccttatccgacctacaaatcgacaacaattataaacctaataaaacgcgacaacgtcgcatcaaacattaattaccgaatacgacacaaataccttatcaaacctacaaatcgacaataattataaacctaataaaacgcgacaacgtcgcatcaaacattaatt

SEQ ID NO: 28203 - DNA, 852 bp, Artificial Sequence
  chemically treated genomic DNA (Homo sapiens) CpG-island No: 28203
  misc_feature (123)..(123): n is either a, c, g or t
gttttatttttgttgtttttgatcggttttcgtggtgtttcgtaagttttttttattttgaggttttatgtgtgtatttatcgtcggtttttggttacgtttacgtatttgtcggatgtgatnttgttagttgttcgtgagatgtggttttacgatttgtgtgttttgggtttatatcggttttgattttttcgatgtttttgattatcgtttgttcgtttggttattgggtatacgtaatatgttttatagttttgttgcgtgcgttgttggaatttatcgttgtagttgcgtaatgtttggaatgcggtcgggcgattatatttgcgcgtttggtattgtttggtagagtatgaaatcgttttcgtggtaggcggtttgggaaatgtattgttaacgttacgatacgttagtaggtagcgaatggttggagagcgtgcgggtttatgagaaagatattttgagtcgttcgcgggtaaatattgtcggatgcggcgcgagcgttttattcggtttacgggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattaggtttataggtcggtaatagttgtaggtttgataagacgcgatagcgtcgtattaggtattgatt

SEQ ID NO: 28204 - DNA, 852 bp, Artificial Sequence
  chemically treated genomic DNA (Homo sapiens) CpG-island No: 28204
  misc_feature (730)..(730): n is either a, c, g or t
aatcaatacctaatacgacgctatcgcgtcttatcaaacctacaactattaccgacctataaacctaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacccgtaaaccgaataaaacgctcgcgccgcatccgacaatatttacccgcgaacgactcaaaatatctttctcataaacccgcacgctctccaaccattcgctacctactaacgtatcgtaacgttaacaatacatttcccaaaccgcctaccacgaaaacgatttcatactctaccaaacaataccaaacgcgcaaatataatcgcccgaccgcattccaaacattacgcaactacaacgataaattccaacaacgcacgcaacaaaactataaaacatattacgtatacccaataaccaaacgaacaaacgataatcaaaaacatcgaaaaaatcaaaaccgatataaacccaaaacacacaaatcgtaaaaccacatctcacgaacaactaacaanatcacatccgacaaatacgtaaacgtaaccaaaaaccgacgataaatacacacataaaacctcaaaataaaaaaaacttacgaaacaccacgaaaaccgatcaaaaacaacaaaaataaaac

SEQ ID NO: 28205 - DNA, 1048 bp, Artificial Sequence
  chemically treated genomic DNA (Homo sapiens) CpG-island No: 28205
cgtgttttttaagggtttttcggcgtcgcggtttagttcggcgttatttgtagttcggttcgtagtcgtttgtttttcgtgtttagtttggtttcgcggcggtttatggataataatttttggtttttgttgacgcgaaagatttcgtatttttttttgagtcgttcgtattcggtcgtcgcgtattttagttttggtatcgacgagttagtggatttgaagttggtttttagtagttcgttcgcgtttatttcgcggggtagcgattcgggttcggtttttgttgtcgttttcgcgtttcggcggaacgagttgcgtagtaggcgggttttgggttttatttttatcgggatttcgtaggtttcgtcgtcgttcgtttcgtacgtgttttcgattattttttcgttcgcggggtttacgagcgacgaggcggtttttatggcgttcgttgtcgttattatttagtgagtattagtaggattgggtagcggaacggaacgggacggggtggggtagaggaacggaacgggacggggcggggtagaggaacggaacgggacggggcgggttagcgggatggagcggggtcggagagtaggattgggcggagtagcgggacggggcggagtagcggaacggggcgaggcgggggagcgggatggggcggggaaataggaggggcggggtagtagaattgggcggggcgggggtgtaggacggggcgggggagtaggacggggcggggtagcggaacggggcggggcggggtcggagagtcggacgaggcgaggtagcggaacggggcggggagggagagcggaagggggtggggtaattggaggggcggggtagcggaacgggacggggtagcggaattggggggatgggcgagggggacggggcggggtagtagggttaggcgggataataagaggggtcgggtaagtggggcggggtatgtgggcggggtagggtaaacgggggtgggtcgagaaagtatatagggttaggcgggttagtaagaagggcggggttagtaggaaggatg

SEQ ID NO: 28206 - DNA, 1048 bp, Artificial Sequence
  chemically treated genomic DNA (Homo sapiens) CpG-island No: 28206
catccttcctactaaccccgcccttcttactaacccgcctaaccctatatactttctcgacccacccccgtttaccctaccccgcccacataccccgccccacttacccgacccctcttattatcccgcctaaccctactaccccgccccgtccccctcgcccatccccccaattccgctaccccgtcccgttccgctaccccgcccctccaattaccccacccccttccgctctccctccccgccccgttccgctacctcgcctcgtccgactctccgaccccgccccgccccgttccgctaccccgccccgtcctactcccccgccccgtcctacacccccgccccgcccaattctactaccccgcccctcctatttccccgccccatcccgctcccccgcctcgccccgttccgctactccgccccgtcccgctactccgcccaatcctactctccgaccccgctccatcccgctaacccgccccgtcccgttccgttcctctaccccgccccgtcccgttccgttcctctaccccaccccgtcccgttccgttccgctacccaatcctactaatactcactaaataataacgacaacgaacgccataaaaaccgcctcgtcgctcgtaaaccccgcgaacgaaaaaataatcgaaaacacgtacgaaacgaacgacgacgaaacctacgaaatcccgataaaaataaaacccaaaacccgcctactacgcaactcgttccgccgaaacgcgaaaacgacaacaaaaaccgaacccgaatcgctaccccgcgaaataaacgcgaacgaactactaaaaaccaacttcaaatccactaactcgtcgataccaaaactaaaatacgcgacgaccgaatacgaacgactcaaaaaaaaatacgaaatctttcgcgtcaacaaaaaccaaaaattattatccataaaccgccgcgaaaccaaactaaacacgaaaaacaaacgactacgaaccgaactacaaataacgccgaactaaaccgcgacgccgaaaaacccttaaaaaacacg

SEQ ID NO: 28207 - DNA, 1048 bp, Artificial Sequence
  chemically treated genomic DNA (Homo sapiens) CpG-island No: 28207
tattttttttgttagtttcgttttttttgttagttcgtttggttttgtgtgttttttcgatttattttcgtttgttttgtttcgtttatatgtttcgttttatttgttcggttttttttgttgtttcgtttagttttgttgtttcgtttcgtttttttcgtttatttttttagtttcgttgtttcgtttcgtttcgttgtttcgtttttttagttgttttattttttttcgtttttttttttcgtttcgtttcgttgtttcgtttcgttcggtttttcggtttcgtttcgtttcgtttcgttgtttcgtttcgttttgttttttcgtttcgttttgtattttcgtttcgtttagttttgttgtttcgttttttttgttttttcgttttatttcgttttttcgtttcgtttcgtttcgttgtttcgtttcgtttcgttgtttcgtttagttttgtttttcggtttcgttttatttcgttggttcgtttcgtttcgtttcgtttttttgtttcgtttcgtttcgtttcgtttttttgttttatttcgtttcgtttcgtttcgttgtttagttttgttggtatttattaggtagtagcggtaacggacgttatggggatcgtttcgtcgttcgtgagtttcgcgggcggggaagtgatcgaggatacgtacggggcgggcggcggcgaggtttgcgagatttcggtggaggtgaagtttaaggttcgtttgttgcgtaattcgtttcgtcgaggcgcgggggcggtagtaggggtcgggttcgggtcgttgtttcgcggggtgggcgcgggcgggttgttgggggttagttttaagtttattggttcgtcggtgttagagttggagtacgcggcggtcgagtacgagcggtttaggaaggagtacgagatttttcgcgttagtaagaattaggagttgttgtttatgggtcgtcgcgaggttaagttggatacggagaataagcggttgcgggtcgaattgtaggtaacgtcgggttgggtcgcgacgtcgggagatttttgggaagtacg

SEQ ID NO: 28208 - DNA, 1048 bp, Artificial Sequence
  chemically treated genomic DNA (Homo sapiens) CpG-island No: 28208
cgtacttcccaaaaatctcccgacgtcgcgacccaacccgacgttacctacaattcgacccgcaaccgcttattctccgtatccaacttaacctcgcgacgacccataaacaacaactcctaattcttactaacgcgaaaaatctcgtactccttcctaaaccgctcgtactcgaccgccgcgtactccaactctaacaccgacgaaccaataaacttaaaactaacccccaacaacccgcccgcgcccaccccgcgaaacaacgacccgaacccgacccctactaccgcccccgcgcctcgacgaaacgaattacgcaacaaacgaaccttaaacttcacctccaccgaaatctcgcaaacctcgccgccgcccgccccgtacgtatcctcgatcacttccccgcccgcgaaactcacgaacgacgaaacgatccccataacgtccgttaccgctactacctaataaataccaacaaaactaaacaacgaaacgaaacgaaacgaaataaaacaaaaaaacgaaacgaaacgaaacgaaacaaaaaaacgaaacgaaacgaaacgaaccaacgaaataaaacgaaaccgaaaaacaaaactaaacgaaacaacgaaacgaaacgaaacaacgaaacgaaacgaaacgaaaaaacgaaataaaacgaaaaaacaaaaaaaacgaaacaacaaaactaaacgaaacgaaaatacaaaacgaaacgaaaaaacaaaacgaaacgaaacaacgaaacgaaacgaaacgaaaccgaaaaaccgaacgaaacgaaacaacgaaacgaaacgaaaaaaaaaaacgaaaaaaaataaaacaactaaaaaaacgaaacaacgaaacgaaacgaaacaacgaaactaaaaaaataaacgaaaaaaacgaaacgaaacaacaaaactaaacgaaacaacaaaaaaaaccgaacaaataaaacgaaacatataaacgaaacaaaacaaacgaaaataaatcgaaaaaacacacaaaaccaaacgaactaacaaaaaaaacgaaactaacaaaaaaaata

SEQ ID NO: 28209 - DNA, 509 bp, Artificial Sequence
  chemically treated genomic DNA (Homo sapiens) CpG-island No: 28209
ttgttcgggtaatcgtttttagtagggattagacgagagcggcgcgtttagtaatgtagtcgttagattgaggtttgatagcgcgttcgttgcgaagggtcgttgacgcggttgcgtatcgcggttttttcgtttttcgtttcgtttatttaggtttaatttgtatacgggagtcgttattttcgcgggcgcgtgcgtagtggcgggtcgggcgcgtgcgtagcgtcggtttttttttagcgcgagttgttgttaacgttttttttttagttttttattttcgtcgttcgtcgcggttcggtattaacgggtggtttcgtcgagggagttgtcgtgtttcgtggtttcgggattgtagtggtgtgcgttttcggcgcgtggcgttaggtatggcgatggattaagtaaacgcgttgtgcgagtagttggtgaaagcggtgacggttatgatggattttaattttatttagcgttatcggttggaagtttttaaggtagttggggttttg

SEQ ID NO: 28210 - DNA, 509 bp, Artificial Sequence
  chemically treated genomic DNA (Homo sapiens) CpG-island No: 28210
caaaaccccaactaccttaaaaacttccaaccgataacgctaaataaaattaaaatccatcataaccgtcaccgctttcaccaactactcgcacaacgcgtttacttaatccatcgccatacctaacgccacgcgccgaaaacgcacaccactacaatcccgaaaccacgaaacacgacaactccctcgacgaaaccacccgttaataccgaaccgcgacgaacgacgaaaataaaaaactaaaaaaaaaacgttaacaacaactcgcgctaaaaaaaaaccgacgctacgcacgcgcccgacccgccactacgcacgcgcccgcgaaaataacgactcccgtatacaaattaaacctaaataaacgaaacgaaaaacgaaaaaaccgcgatacgcaaccgcgtcaacgacccttcgcaacgaacgcgctatcaaacctcaatctaacgactacattactaaacgcgccgctctcgtctaatccctactaaaaacgattacccgaacaa

SEQ ID NO: 28211 - DNA, 509 bp, Artificial Sequence
  chemically treated genomic DNA (Homo sapiens) CpG-island No: 28211
taggattttagttattttgagggtttttagtcggtagcgttgggtggagttggggtttattatgatcgttatcgtttttattagttgttcgtatagcgcgtttatttgatttatcgttatgtttagcgttacgcgtcgagagcgtatattattgtagtttcgggattacgaggtacgatagttttttcggcgagattattcgttggtatcgggtcgcggcgggcggcgggggtgggaagttggaggaggagcgttagtagtaattcgcgttgggaagaagtcggcgttgcgtacgcgttcggttcgttattgcgtacgcgttcgcggaagtggcggttttcgtgtgtaggttgagtttaggtgggcggggcgggaggcggaagggtcgcggtgcgtagtcgcgttaacggtttttcgtagcgggcgcgttgttagattttagtttggcggttgtattgttgggcgcgtcgttttcgtttgatttttgttggggacggttgttcgggtag

SEQ ID NO: 28212 - DNA, 509 bp, Artificial Sequence
  chemically treated genomic DNA (Homo sapiens) CpG-island No: 28212
ctacccgaacaaccgtccccaacaaaaatcaaacgaaaacgacgcgcccaacaatacaaccgccaaactaaaatctaacaacgcgcccgctacgaaaaaccgttaacgcgactacgcaccgcgacccttccgcctcccgccccgcccacctaaactcaacctacacacgaaaaccgccacttccgcgaacgcgtacgcaataacgaaccgaacgcgtacgcaacgccgacttcttcccaacgcgaattactactaacgctcctcctccaacttcccacccccgccgcccgccgcgacccgataccaacgaataatctcgccgaaaaaactatcgtacctcgtaatcccgaaactacaataatatacgctctcgacgcgtaacgctaaacataacgataaatcaaataaacgcgctatacgaacaactaataaaaacgataacgatcataataaaccccaactccacccaacgctaccgactaaaaaccctcaaaataactaaaatccta

SEQ ID NO: 28213 - DNA, 631 bp, Artificial Sequence
  chemically treated genomic DNA (Homo sapiens) CpG-island No: 28213
ttacgttcggaggggtttcgttgatcgggttgcggggggagatgaggggttgcgcgggtgcggtcgggtatcgggttgcggttttcgattcgggaaaggagtagaaaatttcgggaggaggtgtgcgcgttttaagggtcggacgatttgtcgggagtcggttaggggattttcgcgttttggagggttgagcgtatttaagggggaacgcgagtttcggagaatagttgtcgatcgcgggttacggttttgttagttagtgtattgggtcgaggattttacggtcgcgatcggtgttcgatcgttgtcgtcgggagaggtagttgggtttggttacggagtcgcggttgtcgttttggtgttttgttttgtcgttttcggatggcgcggcgtgtatttagtttcggcggcggaggttgcgaggtcgggtttcggttcggcgtcgttttagttagtagtagattttcgggttcggtcggtttcgatttagtttttttttttttcgtcgcgcggatttcggagggaaggagattcgagggtgggggtggggacgtttggattacggtttggtcggtaagtttagagttggggttcgtaggattcgggcggggcgataagggtatttttaggt

SEQ ID NO: 28214 - DNA, 631 bp, Artificial Sequence
  chemically treated genomic DNA (Homo sapiens) CpG-island No: 28214
acctaaaaatacccttatcgccccgcccgaatcctacgaaccccaactctaaacttaccgaccaaaccgtaatccaaacgtccccacccccaccctcgaatctccttccctccgaaatccgcgcgacgaaaaaaaaaaaaactaaatcgaaaccgaccgaacccgaaaatctactactaactaaaacgacgccgaaccgaaacccgacctcgcaacctccgccgccgaaactaaatacacgccgcgccatccgaaaacgacaaaacaaaacaccaaaacgacaaccgcgactccgtaaccaaacccaactacctctcccgacgacaacgatcgaacaccgatcgcgaccgtaaaatcctcgacccaatacactaactaacaaaaccgtaacccgcgatcgacaactattctccgaaactcgcgttcccccttaaatacgctcaaccctccaaaacgcgaaaatcccctaaccgactcccgacaaatcgtccgacccttaaaacgcgcacacctcctcccgaaattttctactcctttcccgaatcgaaaaccgcaacccgatacccgaccgcacccgcgcaacccctcatctccccccgcaacccgatcaacgaaacccctccgaacgtaa

SEQ ID NO: 28215 - DNA, 631 bp, Artificial Sequence
  chemically treated genomic DNA (Homo sapiens) CpG-island No: 28215
gtttgagggtatttttgtcgtttcgttcgggttttgcgggttttagttttgggtttgtcgattagatcgtgatttagacgtttttatttttattttcgagttttttttttttcggagttcgcgcggcggaaggaggagggattgagtcggggtcggtcgggttcggagatttgttgttggttggggcggcgtcgggtcggggttcggtttcgtagttttcgtcgtcggggttaagtgtacgtcgcgttattcgagagcggtagagtagagtattaaagcggtaatcgcggtttcgtaattaagtttagttgtttttttcggcggtagcggtcgggtatcgatcgcggtcgtggggttttcggtttagtgtattaattggtagggtcgtagttcgcgatcggtagttgtttttcggggttcgcgtttttttttgggtgcgtttagttttttagagcgcgggagttttttggtcggttttcggtaggtcgttcggtttttggagcgcgtatattttttttcggagttttttgtttttttttcgggtcggaggtcgtagttcgatgttcggtcgtattcgcgtagttttttattttttttcgtagttcggttagcggggttttttcgggcgtgg

SEQ ID NO: 28216 - DNA, 631 bp, Artificial Sequence
  chemically treated genomic DNA (Homo sapiens) CpG-island No: 28216
ccacgcccgaaaaaaccccgctaaccgaactacgaaaaaaaataaaaaactacgcgaatacgaccgaacatcgaactacgacctccgacccgaaaaaaaaacaaaaaactccgaaaaaaaatatacgcgctccaaaaaccgaacgacctaccgaaaaccgaccaaaaaactcccgcgctctaaaaaactaaacgcacccaaaaaaaaacgcgaaccccgaaaaacaactaccgatcgcgaactacgaccctaccaattaatacactaaaccgaaaaccccacgaccgcgatcgatacccgaccgctaccgccgaaaaaaacaactaaacttaattacgaaaccgcgattaccgctttaatactctactctaccgctctcgaataacgcgacgtacacttaaccccgacgacgaaaactacgaaaccgaaccccgacccgacgccgccccaaccaacaacaaatctccgaacccgaccgaccccgactcaatccctcctccttccgccgcgcgaactccgaaaaaaaaaaaactcgaaaataaaaataaaaacgtctaaatcacgatctaatcgacaaacccaaaactaaaacccgcaaaacccgaacgaaacgacaaaaataccctcaaac

SEQ ID NO: 28217 - DNA, 742 bp, Artificial Sequence
  chemically treated genomic DNA (Homo sapiens) CpG-island No: 28217
ttcgtagacgcgagtagaggtaggtagtcggggcgaaggggcggtattcggttcggagttttattttttggcgttagcgtacgcgttttttcgggtttatttggtcgcggtcggatagcgagaaggtggcgtggttggcgaagcgtgcgttgtttaggcggggcgcgcggtcgggaatttcgggcgcgggcggggggttgggcgtgtcgggagtgtcgggtatcggggatatttcgttggttaagtttagcgtttttatttggcgcgttaggcgttcgagttgcgtttgtagtcgttggttgtttcgttgtaggtcggttatcgtgcgcgttagggggtcggttaggcgtatcgtttttgttattcgtcgttttacgtcgcgttgtagttttcgtatgttttcgtgtagcgcgcgtatcgtattttttagcgtcgtttcgtagcggtttagcgtttcgcgtatagtgcgcgttttttgggcgtcgggggtcggttttatggtttagtagagcgcgcgggtcgagagcgggttagacgggggagaagattcgagtttcgtagtttcgggtcgcgattggtcgttcgtggttggtttcgttcgaggggttgtcggggaggcgggcgcggggcggggtttcgggggcggagtcggggacgatttcgggatatttttttgttttggagtttagcgggacggtgcggagggagagttcgtttagtttttttttttttcggtttttaa

SEQ ID NO: 28218 - DNA, 742 bp, Artificial Sequence
  chemically treated genomic DNA (Homo sapiens) CpG-island No: 28218
ttaaaaaccgaaaaaaaaaaaaactaaacgaactctccctccgcaccgtcccgctaaactccaaaacaaaaaaatatcccgaaatcgtccccgactccgcccccgaaaccccgccccgcgcccgcctccccgacaacccctcgaacgaaaccaaccacgaacgaccaatcgcgacccgaaactacgaaactcgaatcttctcccccgtctaacccgctctcgacccgcgcgctctactaaaccataaaaccgacccccgacgcccaaaaaacgcgcactatacgcgaaacgctaaaccgctacgaaacgacgctaaaaaatacgatacgcgcgctacacgaaaacatacgaaaactacaacgcgacgtaaaacgacgaataacaaaaacgatacgcctaaccgaccccctaacgcgcacgataaccgacctacaacgaaacaaccaacgactacaaacgcaactcgaacgcctaacgcgccaaataaaaacgctaaacttaaccaacgaaatatccccgatacccgacactcccgacacgcccaaccccccgcccgcgcccgaaattcccgaccgcgcgccccgcctaaacaacgcacgcttcgccaaccacgccaccttctcgctatccgaccgcgaccaaataaacccgaaaaaacgcgtacgctaacgccaaaaaataaaactccgaaccgaataccgccccttcgccccgactacctacctctactcgcgtctacgaa

SEQ ID NO: 28219 - DNA, 742 bp, Artificial Sequence
  chemically treated genomic DNA (Homo sapiens) CpG-island No: 28219
ttaagagtcggggaggggagaggttgggcgagtttttttttcgtatcgtttcgttgggttttagggtaggggggtgtttcggagtcgttttcggtttcgttttcgaggtttcgtttcgcgttcgttttttcggtagtttttcgagcgaagttagttacggacggttagtcgcggttcggagttgcggagttcggattttttttttcgtttggttcgttttcgattcgcgcgttttgttgggttatggagtcggttttcgacgtttaggaggcgcgtattgtgcgcgaggcgttgggtcgttacgaggcggcgttggagggtgcggtgcgcgcgttgtacgaggatatgcgggggttgtagcgcggcgtggagcggcgagtggtagaggcgatgcgtttggtcggttttttggcgcgtacggtgatcgatttgtagcgggataattagcggttgtaggcgtagttcgagcgtttgacgcgttaggtggaggcgttgggtttggttagcgggatgttttcggtgttcggtattttcggtacgtttagtttttcgttcgcgttcggggttttcgatcgcgcgtttcgtttgggtagcgtacgtttcgttagttacgttattttttcgttgttcggtcgcggttaggtgagttcgggggagcgcgtgcgttggcgttagggagtggggtttcgaatcgggtgtcgttttttcgtttcgattgtttgtttttgttcgcgtttgcggg

SEQ ID NO: 28220 - DNA, 742 bp, Artificial Sequence
  chemically treated genomic DNA (Homo sapiens) CpG-island No: 28220
cccgcaaacgcgaacaaaaacaaacaatcgaaacgaaaaaacgacacccgattcgaaaccccactccctaacgccaacgcacgcgctcccccgaactcacctaaccgcgaccgaacaacgaaaaaataacgtaactaacgaaacgtacgctacccaaacgaaacgcgcgatcgaaaaccccgaacgcgaacgaaaaactaaacgtaccgaaaataccgaacaccgaaaacatcccgctaaccaaacccaacgcctccacctaacgcgtcaaacgctcgaactacgcctacaaccgctaattatcccgctacaaatcgatcaccgtacgcgccaaaaaaccgaccaaacgcatcgcctctaccactcgccgctccacgccgcgctacaacccccgcatatcctcgtacaacgcgcgcaccgcaccctccaacgccgcctcgtaacgacccaacgcctcgcgcacaatacgcgcctcctaaacgtcgaaaaccgactccataacccaacaaaacgcgcgaatcgaaaacgaaccaaacgaaaaaaaaaatccgaactccgcaactccgaaccgcgactaaccgtccgtaactaacttcgctcgaaaaactaccgaaaaaacgaacgcgaaacgaaacctcgaaaacgaaaccgaaaacgactccgaaacacccccctaccctaaaacccaacgaaacgatacgaaaaaaaaactcgcccaacctctcccctccccgactcttaa

SEQ ID NO: 28221 - DNA, 663 bp, Artificial Sequence
  chemically treated genomic DNA (Homo sapiens) CpG-island No: 28221
tatattttatttcggatttttgcggaattaagtatattttcgtgtttaatggtgataataaggtgtacgttttcgcgtattttggtatttaggttcgcgattacgtgtttttagttttaattttttgggttcgtcgtcgtttttttgtcgggatatgcgtagtttttgttttagatttcgttattttattttcggtttgttacgtagatattttagtagttttttcgtggtcgtaagtcgcgttttttgtttaggtttcgtaatgttttagaagaagtttaagaattcgcgattgtgttttaataggttatagcggtcggtaggtcgggcgttattttgcgtcgtttttttaggcgatatcggttgggcgggatttcggttttttattttcgttatatttatcgaaatacgaaatacgtgtgtttcggttttagtcgtttttaggttagggtacggcgtatgcgtatcggtttgtgtcggttcggaggcggaagaattcggaggggcgggggaattaagagagatcggtttagagttaaaagagcggtattttcgtcgtagttttgagcggaagtttttcgtttagcggcgttttattttttttagttttttgtttatattcgtttcgttttggcggttgtggtatttgtttttttggagttt

SEQ ID NO: 28222 - DNA, 663 bp, Artificial Sequence
  chemically treated genomic DNA (Homo sapiens) CpG-island No: 28222
aaactccaaaaaaacaaataccacaaccgccaaaacgaaacgaatataaacaaaaaactaaaaaaaataaaacgccgctaaacgaaaaacttccgctcaaaactacgacgaaaataccgctcttttaactctaaaccgatctctcttaattcccccgcccctccgaattcttccgcctccgaaccgacacaaaccgatacgcatacgccgtaccctaacctaaaaacgactaaaaccgaaacacacgtatttcgtatttcgataaatataacgaaaataaaaaaccgaaatcccgcccaaccgatatcgcctaaaaaaacgacgcaaaataacgcccgacctaccgaccgctataacctattaaaacacaatcgcgaattcttaaacttcttctaaaacattacgaaacctaaacaaaaaacgcgacttacgaccacgaaaaaactactaaaatatctacgtaacaaaccgaaaataaaataacgaaatctaaaacaaaaactacgcatatcccgacaaaaaaacgacgacgaacccaaaaaattaaaactaaaaacacgtaatcgcgaacctaaataccaaaatacgcgaaaacgtacaccttattatcaccattaaacacgaaaatatacttaattccgcaaaaatccgaaataaaatata

SEQ ID NO: 28223 - DNA, 663 bp, Artificial Sequence
  chemically treated genomic DNA (Homo sapiens) CpG-island No: 28223
gggttttaaaggggtagatgttatagtcgttagggcggagcgggtgtgagtagaaggttgggaaagatgggacgtcgttaggcgagggattttcgtttagagttacggcggaaatgtcgtttttttaattttgggtcggttttttttggttttttcgttttttcgggttttttcgttttcgagtcgatataaatcggtgcgtatgcgtcgtgttttgatttggaagcggttggggtcggagtatacgtgtttcgtgtttcggtgagtgtggcggagatggagagtcgggatttcgtttagtcgatgtcgtttggagaagcgacgtagagtggcgttcggtttgtcgatcgttatggtttattgaagtatagtcgcgagtttttggattttttttgggatattgcgaagtttgagtaggagacgcgatttgcggttacggagaagttgttggagtatttgcgtggtaggtcgaaggtggagtggcggggtttggggtagaggttgcgtatatttcggtaaggaagcggcggcgggtttagggagttgagattgggggtacgtggtcgcgaatttggatgttagggtgcgcgggggcgtgtattttgttgttattattgaatacgagggtgtgtttggtttcgtaggggttcgagatgaaatatg

SEQ ID NO: 28224 - DNA, 663 bp, Artificial Sequence
  chemically treated genomic DNA (Homo sapiens) CpG-island No: 28224
catatttcatctcgaacccctacgaaaccaaacacaccctcgtattcaataataacaacaaaatacacgcccccgcgcaccctaacatccaaattcgcgaccacgtacccccaatctcaactccctaaacccgccgccgcttccttaccgaaatatacgcaacctctaccccaaaccccgccactccaccttcgacctaccacgcaaatactccaacaacttctccgtaaccgcaaatcgcgtctcctactcaaacttcgcaatatcccaaaaaaaatccaaaaactcgcgactatacttcaataaaccataacgatcgacaaaccgaacgccactctacgtcgcttctccaaacgacatcgactaaacgaaatcccgactctccatctccgccacactcaccgaaacacgaaacacgtatactccgaccccaaccgcttccaaatcaaaacacgacgcatacgcaccgatttatatcgactcgaaaacgaaaaaacccgaaaaaacgaaaaaaccaaaaaaaaccgacccaaaattaaaaaaacgacatttccgccgtaactctaaacgaaaatccctcgcctaacgacgtcccatctttcccaaccttctactcacacccgctccgccctaacgactataacatctacccctttaaaaccc

SEQ ID NO: 28225 - DNA, 597 bp, Artificial Sequence
  chemically treated genomic DNA (Homo sapiens) CpG-island No: 28225
gggtcgtagttgttagagtcgcggcggcgaacgaggcgtagcgagttgagcggtggtagcgtcgtagtcggggtcggagcgtaggagtcgacggggttcgattaggatggtgtagtggcggtttcgcggcgtacgtacgcgttgagcgggtttagtttgggtttcgcgtttttcgcgtttttcgtcgtttcgattcgggtcggtatgatgtgtttggaatgcgtttcggcggcggcgggcggcgcggaggaggaggaggcggacgcggagcggcggcgtcggcgtcggggggcgtagcgaggggttggcggtagcggttgttgcggggcgcggggcgcgggcggcgttggagtttcggtcgcgggcgatgaggtgtagacgttgtcgggtagcgtaaggcgggtttcgatcggatttttcggtattttcggtattttcggttgcgtagttattgtaaagggtttcggcgtttagtagtttaaatcggttagtttgggtcgcgggcggggggtagtcgtcgttatttttagtttgggtaacgtgtttaattatttggataggtatatcgtggtaggtgagcgagtgttttatttagtt

SEQ ID NO: 28226 - DNA, 597 bp, Artificial Sequence
  chemically treated genomic DNA (Homo sapiens) CpG-island No: 28226
aactaaataaaacactcgctcacctaccacgatatacctatccaaataattaaacacgttacccaaactaaaaataacgacgactaccccccgcccgcgacccaaactaaccgatttaaactactaaacgccgaaaccctttacaataactacgcaaccgaaaataccgaaaataccgaaaaatccgatcgaaacccgccttacgctacccgacaacgtctacacctcatcgcccgcgaccgaaactccaacgccgcccgcgccccgcgccccgcaacaaccgctaccgccaacccctcgctacgccccccgacgccgacgccgccgctccgcgtccgcctcctcctcctccgcgccgcccgccgccgccgaaacgcattccaaacacatcataccgacccgaatcgaaacgacgaaaaacgcgaaaaacgcgaaacccaaactaaacccgctcaacgcgtacgtacgccgcgaaaccgccactacaccatcctaatcgaaccccgtcgactcctacgctccgaccccgactacgacgctaccaccgctcaactcgctacgcctcgttcgccgccgcgactctaacaactacgaccc

SEQ ID NO: 28227 - DNA, 597 bp, Artificial Sequence
  chemically treated genomic DNA (Homo sapiens) CpG-island No: 28227
ggttgggtggggtattcgtttatttgttacggtgtatttgtttaggtagttgagtacgttgtttaagttgaggatggcggcggttgtttttcgttcgcggtttaagttggtcggtttgggttgttgagcgtcggggttttttgtagtagttgcgtagtcgggggtgtcgggggtgtcggggggttcggtcggggttcgttttacgttgttcgatagcgtttgtattttatcgttcgcggtcgagattttagcgtcgttcgcgtttcgcgtttcgtagtaatcgttatcgttagtttttcgttgcgtttttcggcgtcggcgtcgtcgtttcgcgttcgtttttttttttttcgcgtcgttcgtcgtcgtcgaggcgtattttaggtatattatgtcggttcggatcggggcggcggggggcgcggggggcgcggggtttaggttgggttcgtttagcgcgtgcgtgcgtcgcggagtcgttattgtattattttggtcgggtttcgtcggtttttgcgtttcggtttcggttgcggcgttgttatcgtttagttcgttgcgtttcgttcgtcgtcgcggttttgatagttgcggttt

SEQ ID NO: 28228 - DNA, 597 bp, Artificial Sequence
  chemically treated genomic DNA (Homo sapiens) CpG-island No: 28228
aaaccgcaactatcaaaaccgcgacgacgaacgaaacgcaacgaactaaacgataacaacgccgcaaccgaaaccgaaacgcaaaaaccgacgaaacccgaccaaaataatacaataacgactccgcgacgcacgcacgcgctaaacgaacccaacctaaaccccgcgccccccgcgccccccgccgccccgatccgaaccgacataatatacctaaaatacgcctcgacgacgacgaacgacgcgaaaaaaaaaaaaacgaacgcgaaacgacgacgccgacgccgaaaaacgcaacgaaaaactaacgataacgattactacgaaacgcgaaacgcgaacgacgctaaaatctcgaccgcgaacgataaaatacaaacgctatcgaacaacgtaaaacgaaccccgaccgaaccccccgacacccccgacacccccgactacgcaactactacaaaaaaccccgacgctcaacaacccaaaccgaccaacttaaaccgcgaacgaaaaacaaccgccgccatcctcaacttaaacaacgtactcaactacctaaacaaatacaccgtaacaaataaacgaataccccacccaacc

SEQ ID NO: 28229 - DNA, 531 bp, Artificial Sequence
  chemically treated genomic DNA (Homo sapiens) CpG-island No: 28229
acgttcggtttagtttttattttattgtattttttttttttttcgttttttttttgtattttttttcgtacgtatttttttttttttattttatattattgttttatattttttattcgtttttttaatatattttaatttttcgtattattcgtttatttttatatattattatttttttttttttttttttttttttacgttttttcgatttattttttttttttttgattttttatttttattttgatttttttttttttttttattttatatttcgcgcgtcgcgcggtaatcgtattattttttcgtttatttattatttcgtttttttttttttcgttatattttttatcgtttattttttttttttttttttttatttttttattatttttcgttattttttattttttttttatttttatttcgtcgtttttatttattttttattttattatatttttaatttcgttattttttttattttttttacgttcggtcgtttattttattcgttttataaatttt

SEQ ID NO: 28230 - DNA, 531 bp, Artificial Sequence
  chemically treated genomic DNA (Homo sapiens) CpG-island No: 28230
aaaatttataaaacgaataaaataaacgaccgaacgtaaaaaaaataaaaaaaataacgaaattaaaaatataataaaataaaaaataaataaaaacgacgaaataaaaataaaaaaaaaataaaaaataacgaaaaataataaaaaaataaaaaaaaaaaaaaaaaaaataaacgataaaaaatataacgaaaaaaaaaaaaacgaaataataaataaacgaaaaaataatacgattaccgcgcgacgcgcgaaatataaaataaaaaaaaaaaaaaaaatcaaaataaaaataaaaaatcaaaaaaaaaaaaaataaatcgaaaaaacgtaaaaaaaaaaaaaaaaaaaaaaaaataataatatataaaaataaacgaataatacgaaaaattaaaatatattaaaaaaacgaataaaaaatataaaacaataatataaaataaaaaaaaaaaaatacgtacgaaaaaaaatacaaaaaaaaaacgaaaaaaaaaaaaaatacaataaaataaaaactaaaccgaacgt

SEQ ID NO: 28231 - DNA, 531 bp, Artificial Sequence
  chemically treated genomic DNA (Homo sapiens) CpG-island No: 28231
ggggtttatggagcgggtggggtgggcggtcgggcgtggggagggtggggggggtggcggggttagagatatggtggggtgaggggtaggtgggagcggcgaggtgggggtggggagagagtgggaggtggcggggagtgatggggagatggagagaggagagagaggggtgggcggtgggggatgtggcgaggggggggggggcggaatggtaggtaggcgggaaggtggtgcgattgtcgcgcggcgcgcgagatatggagtaggaggggggggaagagttagagtaagggtggggggttaggggaggaggaggtgggtcgggaagacgtaggggaaaaagggggagggagggggtggtggtgtgtggaggtgggcgggtaatgcggggggttggggtgtgttgggagagcgggtggagagtgtggggtagtggtgtggggtagggaagaggggatgcgtgcggggggggatgtagagggggggcgggggagaggggaggtgtagtagagtgggggttggatcgggcgt

SEQ ID NO: 28232 - DNA, 531 bp, Artificial Sequence
  chemically treated genomic DNA (Homo sapiens) CpG-island No: 28232
acgcccgatccaacccccactctactacacctcccctctcccccgccccccctctacatccccccccgcacgcatcccctcttccctaccccacaccactaccccacactctccacccgctctcccaacacaccccaaccccccgcattacccgcccacctccacacaccaccaccccctccctccccctttttcccctacgtcttcccgacccacctcctcctcccctaaccccccacccttactctaactcttcccccccctcctactccatatctcgcgcgccgcgcgacaatcgcaccaccttcccgcctacctaccattccgcccccccccccctcgccacatcccccaccgcccacccctctctctcctctctccatctccccatcactccccgccacctcccactctctccccacccccacctcgccgctcccacctacccctcaccccaccatatctctaaccccgccaccccccccaccctccccacgcccgaccgcccaccccacccgctccataaacccc

SEQ ID NO: 28233 - DNA, 940 bp, Artificial Sequence
  chemically treated genomic DNA (Homo sapiens) CpG-island No: 28233
  misc_feature (152)..(152): n is either a, c, g or t
tatatttacggttcgatacgtttcggtcgttttagtatttatcgataggggggggtttttaaaaataggcggcgttttcgaacggggagcgcgggcgcggtcgtacgacgcgcgtttaaacgttcggtagggagtacggaagattattcgtntcgtcgatttttattttttcgttaggcgggcgttttaaataagtttggtcgcgcggttttagggtttatttatttttttattaaatttaaggggttcgtcggtttaaaatatttttttttcggggcgcgttaaaaaaaaaaaaaatgggggcgtcggggggttcgcgttcgggtcgttcgtataaagtcgtagaggattttcgatttcggagttacgatagcggtggttcgggagtcgcggggatatcgcgattttacggtttaggcggttttttatatttcgcggagttttagttttttagagtcgcgagttttcgttttaggtcgcgtaaatcgagttcgatttttttcggcgaatagaacgggacggagttagcgttagttagtcgcgttcggtcgtttaaggaatcgtataattttttcgtttttagtcggcggttttttcgttttcggtcgtaagggtcgcgaattacgtcgtttttagggttagtttcgttttgtcgtcggcgagtaggttcgcgttagatacgtagttttatgcgcgttttattttcgattatttacgttcggagttttcggaggttttcgggtttttacgcgagcggttttcgtttcgcgaacgcgagattaggagcggagttttcgaggtcgtaagggtaatagagtcggagcgagtcgtttcgtacgacggtttacggaattaatcgttagcgggagacgtatcgtcggatattttagggttatacggtaaagcggcggcgcgcgtatcggtatcggtttcgcggttt

SEQ ID NO: 28234 - DNA, 940 bp, Artificial Sequence
  chemically treated genomic DNA (Homo sapiens) CpG-island No: 28234
  misc_feature (789)..(789): n is either a, c, g or t
aaaccgcgaaaccgataccgatacgcgcgccgccgctttaccgtataaccctaaaatatccgacgatacgtctcccgctaacgattaattccgtaaaccgtcgtacgaaacgactcgctccgactctattacccttacgacctcgaaaactccgctcctaatctcgcgttcgcgaaacgaaaaccgctcgcgtaaaaacccgaaaacctccgaaaactccgaacgtaaataatcgaaaataaaacgcgcataaaactacgtatctaacgcgaacctactcgccgacgacaaaacgaaactaaccctaaaaacgacgtaattcgcgacccttacgaccgaaaacgaaaaaaccgccgactaaaaacgaaaaaattatacgattccttaaacgaccgaacgcgactaactaacgctaactccgtcccgttctattcgccgaaaaaaatcgaactcgatttacgcgacctaaaacgaaaactcgcgactctaaaaaactaaaactccgcgaaatataaaaaaccgcctaaaccgtaaaatcgcgatatccccgcgactcccgaaccaccgctatcgtaactccgaaatcgaaaatcctctacgactttatacgaacgacccgaacgcgaaccccccgacgcccccattttttttttttttaacgcgccccgaaaaaaaaatattttaaaccgacgaaccccttaaatttaataaaaaaataaataaaccctaaaaccgcgcgaccaaacttatttaaaacgcccgcctaacgaaaaaataaaaatcgacganacgaataatcttccgtactccctaccgaacgtttaaacgcgcgtcgtacgaccgcgcccgcgctccccgttcgaaaacgccgcctatttttaaaaacccccccctatcgataaatactaaaacgaccgaaacgtatcgaaccgtaaatata

SEQ ID NO: 28235 - DNA, 940 bp, Artificial Sequence
  chemically treated genomic DNA (Homo sapiens) CpG-island No: 28235
  misc_feature (789)..(789): n is either a, c, g or t
gggtcgcggggtcggtgtcggtgcgcgcgtcgtcgttttgtcgtgtggttttggggtgttcggcggtgcgtttttcgttggcggttggtttcgtgggtcgtcgtgcggggcggttcgtttcggttttgttgtttttgcggtttcgggggtttcgtttttggtttcgcgttcgcggggcgggggtcgttcgcgtgggggttcgggggttttcgggggtttcgggcgtgggtggtcgggggtggggcgcgtatggggttgcgtgtttggcgcgggtttgttcgtcggcggtagggcggggttggttttgggggcggcgtggttcgcggtttttgcggtcgggggcgggggggtcgtcggttgggggcgggggggttgtgcggttttttgggcggtcgggcgcggttggttggcgttggtttcgtttcgttttgttcgtcggggggggtcgggttcggtttgcgcggtttggggcgggggttcgcggttttggggggttggggtttcgcggggtgtggggggtcgtttgggtcgtggggtcgcggtgttttcgcggttttcgggttatcgttgtcgtggtttcggggtcgggggttttttgcggttttgtgcgggcggttcgggcgcgggtttttcggcgtttttattttttttttttttggcgcgtttcggggggggggtgttttgggtcgacgggttttttgggtttggtgggggggtgggtgggttttggggtcgcgcggttaaatttatttaaggcgttcgtttggcgagaaggtgggggtcggcggngcgggtggtttttcgtgttttttgtcgggcgtttgggcgcgcgtcgtgcggtcgcgttcgcgtttttcgttcgggggcgtcgtttgtttttgggggtttttttttgtcggtgggtgttaaaacggtcggggcgtgtcgggtcgtgggtgtg

SEQ ID NO: 28236 - DNA, 940 bp, Artificial Sequence
  chemically treated genomic DNA (Homo sapiens) CpG-island No: 28236
  misc_feature (152)..(152): n is either a, c, g or t
cacacccacgacccgacacgccccgaccgttttaacacccaccgacaaaaaaaaacccccaaaaacaaacgacgcccccgaacgaaaaacgcgaacgcgaccgcacgacgcgcgcccaaacgcccgacaaaaaacacgaaaaaccacccgcnccgccgacccccaccttctcgccaaacgaacgccttaaataaatttaaccgcgcgaccccaaaacccacccacccccccaccaaacccaaaaaacccgtcgacccaaaacaccccccccccgaaacgcgccaaaaaaaaaaaaaataaaaacgccgaaaaacccgcgcccgaaccgcccgcacaaaaccgcaaaaaacccccgaccccgaaaccacgacaacgataacccgaaaaccgcgaaaacaccgcgaccccacgacccaaacgaccccccacaccccgcgaaaccccaaccccccaaaaccgcgaacccccgccccaaaccgcgcaaaccgaacccgaccccccccgacgaacaaaacgaaacgaaaccaacgccaaccaaccgcgcccgaccgcccaaaaaaccgcacaacccccccgcccccaaccgacgacccccccgcccccgaccgcaaaaaccgcgaaccacgccgcccccaaaaccaaccccgccctaccgccgacgaacaaacccgcgccaaacacgcaaccccatacgcgccccacccccgaccacccacgcccgaaacccccgaaaacccccgaacccccacgcgaacgacccccgccccgcgaacgcgaaaccaaaaacgaaacccccgaaaccgcaaaaacaacaaaaccgaaacgaaccgccccgcacgacgacccacgaaaccaaccgccaacgaaaaacgcaccgccgaacaccccaaaaccacacgacaaaacgacgacgcgcgcaccgacaccgaccccgcgaccc

SEQ ID NO: 28237 - DNA, 1000 bp, Artificial Sequence
  chemically treated genomic DNA (Homo sapiens) CpG-island No: 28237
  misc_feature (332)..(332): n is either a, c, g or t
  misc_feature (383)..(383): n is either a, c, g or t
  misc_feature (464)..(464): n is either a, c, g or t
aatacgcgttttgcggttttatttttttttcgtttttttcgttcgttttttcgttttcgtaggcgttcgtcgcgcgcggcgtttcgcgtttttgttttcgtcgtcgtcgcgggttcgttcgtattttttttttttcgcgttttcggcgcgggttatttttgggttttttttcgttcgtcgttcgttttttcgtattttttcgttttattttatttacgttttttacgttcgttcgcgtagcgtattttcgtcggttttcgtgcggtttggtacgcgcgtttcgcgtttcgtcgttattttcgggtttttttttttttttcgttttcgcgagngtttcgcgtcgtttattcgtttttttttttcgttggttttacggattattnttcgtgcggttcgcgttttcgcgtcgtttttcggcgcgttatatcgtttacgcgggcgacgtcgtcgaagcggtacgatanaggagaaggtaatgtggtgtgggtcgatttcggttcgtcgaggcgcgatcgtagagtcggtcgtttttttttcgttattgttttaggttttatcgtttcgcggtttcgggcgcgtttttcgggcgtcgggggcggcgtatcgattcgttcgtcgcgggttcgttcggcgttttcgttcgttcgcgtgcggcgagggtttcgcgttatttcgttattcgcgacgggttcgcgagttcgggcgtcgcgcgtttcgtcgtttcgtatcgtcgttataggatttcgggattcgtaattttattagttattcggagcggtcgtttcggcgtcgcgtcgcgttttattcgcgggtcggggcgttcgcgcgcgcgttattatgttcgttttggcgggtttttagacggttttcgaggtacgtttttttcgacgtttcgtcgtttattcgcgttcgggtatagtcgaggagtgtttttcgtttttcgttttttagggaaggtttttttttttcggtttcggcgggtatatttatattttgcggt

SEQ ID NO: 28238 - DNA, 1000 bp, Artificial Sequence
  chemically treated genomic DNA (Homo sapiens) CpG-island No: 28238
  misc_feature (537)..(537): n is either a, c, g or t
  misc_feature (618)..(618): n is either a, c, g or t
  misc_feature (669)..(669): n is either a, c, g or t
accgcaaaatataaatatacccgccgaaaccgaaaaaaaaaaaccttccctaaaaaacgaaaaacgaaaaacactcctcgactatacccgaacgcgaataaacgacgaaacgtcgaaaaaaacgtacctcgaaaaccgtctaaaaacccgccaaaacgaacataataacgcgcgcgcgaacgccccgacccgcgaataaaacgcgacgcgacgccgaaacgaccgctccgaataactaataaaattacgaatcccgaaatcctataacgacgatacgaaacgacgaaacgcgcgacgcccgaactcgcgaacccgtcgcgaataacgaaataacgcgaaaccctcgccgcacgcgaacgaacgaaaacgccgaacgaacccgcgacgaacgaatcgatacgccgcccccgacgcccgaaaaacgcgcccgaaaccgcgaaacgataaaacctaaaacaataacgaaaaaaaaacgaccgactctacgatcgcgcctcgacgaaccgaaatcgacccacaccacattaccttctcctntatcgtaccgcttcgacgacgtcgcccgcgtaaacgatataacgcgccgaaaaacgacgcgaaaacgcgaaccgcacgaanaataatccgtaaaaccaacgaaaaaaaaaaacgaataaacgacgcgaaacnctcgcgaaaacgaaaaaaaaaaaaaaacccgaaaataacgacgaaacgcgaaacgcgcgtaccaaaccgcacgaaaaccgacgaaaatacgctacgcgaacgaacgtaaaaaacgtaaataaaataaaacgaaaaaatacgaaaaaacgaacgacgaacgaaaaaaaacccaaaaataacccgcgccgaaaacgcgaaaaaaaaaaaatacgaacgaacccgcgacgacgacgaaaacaaaaacgcgaaacgccgcgcgcgacgaacgcctacgaaaacgaaaaaacgaacgaaaaaaacgaaaaaaaaataaaaccgcaaaacgcgtatt

SEQ ID NO: 28239 - DNA, 1000 bp, Artificial Sequence
  chemically treated genomic DNA (Homo sapiens) CpG-island No: 28239
  misc_feature (537)..(537): n is either a, c, g or t
  misc_feature (618)..(618): n is either a, c, g or t
  misc_feature (669)..(669): n is either a, c, g or t
atcgtagagtgtgggtgtgttcgtcggggtcgaggggggggagttttttttggggggcggggggcgggggatatttttcggttgtgttcgggcgcgggtgggcggcggggcgtcgaggggggcgtgtttcgggggtcgtttgggggttcgttagggcgggtatggtggcgcgcgcgcgagcgtttcggttcgcgggtggggcgcggcgcggcgtcggagcggtcgtttcgggtggttgatgagattgcgggtttcgaggttttgtggcggcggtgcggggcggcggggcgcgcggcgttcgggttcgcgggttcgtcgcgagtggcggggtggcgcgggattttcgtcgtacgcgagcgggcggggacgtcgagcgggttcgcggcgggcgagtcggtgcgtcgttttcggcgttcggggggcgcgttcggggtcgcggggcggtggagtttagggtagtggcggggggggagcggtcggttttgcggtcgcgtttcggcgggtcgaggtcggtttatattatattatttttttttntgtcgtgtcgtttcggcggcgtcgttcgcgtgggcgatgtggcgcgtcggggggcggcgcgggggcgcgggtcgtacgaanagtggttcgtggggttagcggggggggggggcgggtgggcggcgcgggatnttcgcgggggcgaaaaaaaagaaaaaattcgggggtggcgacggggcgcggggcgcgcgtattaggtcgtacgggggtcggcgggggtgcgttgcgcgggcgggcgtggggggcgtgggtggggtggggcgggggggtgcgggggggcgggcggcgggcgggggggggtttaggggtggttcgcgtcgggggcgcgagggggggggggtgcgggcgggttcgcggcggcggcggggataggggcgcggggcgtcgcgcgcggcgggcgtttgcggaggcggagaggcgggcgggaagggcgggggggaggtggggtcgtagggcgcgtgtt

SEQ ID NO: 28240 - DNA, 1000 bp, Artificial Sequence
  chemically treated genomic DNA (Homo sapiens) CpG-island No: 28240
  misc_feature (332)..(332): n is either a, c, g or t
  misc_feature (383)..(383): n is either a, c, g or t
  misc_feature (464)..(464): n is either a, c, g or t
aacacgcgccctacgaccccacctcccccccgcccttcccgcccgcctctccgcctccgcaaacgcccgccgcgcgcgacgccccgcgcccctatccccgccgccgccgcgaacccgcccgcaccccccccccctcgcgcccccgacgcgaaccacccctaaacccccccccgcccgccgcccgcccccccgcacccccccgccccaccccacccacgccccccacgcccgcccgcgcaacgcacccccgccgacccccgtacgacctaatacgcgcgccccgcgccccgtcgccacccccgaattttttcttttttttcgcccccgcgaanatcccgcgccgcccacccgccccccccccccgctaaccccacgaaccactnttcgtacgacccgcgcccccgcgccgccccccgacgcgccacatcgcccacgcgaacgacgccgccgaaacgacacgacanaaaaaaaaataatataatataaaccgacctcgacccgccgaaacgcgaccgcaaaaccgaccgctccccccccgccactaccctaaactccaccgccccgcgaccccgaacgcgccccccgaacgccgaaaacgacgcaccgactcgcccgccgcgaacccgctcgacgtccccgcccgctcgcgtacgacgaaaatcccgcgccaccccgccactcgcgacgaacccgcgaacccgaacgccgcgcgccccgccgccccgcaccgccgccacaaaacctcgaaacccgcaatctcatcaaccacccgaaacgaccgctccgacgccgcgccgcgccccacccgcgaaccgaaacgctcgcgcgcgcgccaccatacccgccctaacgaacccccaaacgacccccgaaacacgcccccctcgacgccccgccgcccacccgcgcccgaacacaaccgaaaaatatcccccgccccccgccccccaaaaaaaactcccccccctcgaccccgacgaacacacccacactctacgat

SEQ ID NO: 28241 - DNA, 1163 bp, Artificial Sequence
  chemically treated genomic DNA (Homo sapiens) CpG-island No: 28241
  misc_feature (127)..(127): n is either a, c, g or t
  misc_feature (621)..(621): n is either a, c, g or t
  misc_feature (907)..(907): n is either a, c, g or t
  misc_feature (1007)..(1007): n is either a, c, g or t
gtgcggcgcgttaatttcgtcgtttttttttatatttcgcgtttcgtacgtcgacgttcgtatcgtcgcgcgtcgcgtttcgtttgtttttcgttttttttcgtcgtttttatttcgttacgttttncggtcgggtatttaatcgatattttttgacgtttagtttttcgttcgtttaggcggtacgtcgtttgagtatcgtttttattttagtttatcgtttatattttttcgtatagttcgtatgtcgattatcgtcgacggtacgtattcgagtggtttcgtcgggtttcgacgcggttatattttatttaatacgttttcgttattttacgcggtatttattttttttttattaatatttttcgtcgttttttcgcgtcgttttttttcgttttcgtttttttttttcgtttaattcgtcgagtgtcgtagcgatcgatcgagttttttttcggttttcgcgttttttacgattatacgtcgttttttttattcgatttttatattattattacgtattcgcgaacgtattttatttttcgtcgtcgttcgttaaattatttttattcgtttcgcgcgtttcgcgtttttcgtacgcgtgttcggcgttgcgttttngagtatatttttatcgaatttttttatttttttgttatttatttaacgtttttttacgtatttcgtttattagtagcgaaagcgacgacgtcgattttttacgttcgttatcgacgcgacgtatatgttcgtgcgtcgtcgggttcgcggttacgcgcgtttttcgtcgtatatacgcgttttcgtacgttttatttagacgtttcgtcgcgttcgcgttattacggagttttattatcgcgtatcgtagagatcggacgaaaatacggaagtagttattattttngtattcgtttacgaaagtagttcgcgtcgttagtcgtatcgcgtcgcgattattttatcgttagattgtcgtatattatattcgagcgattacgcgaaangtaatacgtattttatttataataaattttttaatttttatttattcgtttgtattatttttattttttttttgttttcgcgttacgttattttttattatcgcgtttttatttttcgtttttatatcgttttttgtttcgattagtcgcgtttag

SEQ ID NO: 28242 - DNA, 1163 bp, Artificial Sequence
  chemically treated genomic DNA (Homo sapiens) CpG-island No: 28242
  misc_feature (157)..(157): n is either a, c, g or t
  misc_feature (257)..(257): n is either a, c, g or t
  misc_feature (543)..(543): n is either a, c, g or t
  misc_feature (1037)..(1037): n is either a, c, g or t
ctaaacgcgactaatcgaaacaaaaaacgatataaaaacgaaaaataaaaacgcgataataaaaaataacgtaacgcgaaaacaaaaaaaaaataaaaataatacaaacgaataaataaaaattaaaaaatttattataaataaaatacgtattacntttcgcgtaatcgctcgaatataatatacgacaatctaacgataaaataatcgcgacgcgatacgactaacgacgcgaactactttcgtaaacgaatacnaaaataataactacttccgtattttcgtccgatctctacgatacgcgataataaaactccgtaataacgcgaacgcgacgaaacgtctaaataaaacgtacgaaaacgcgtatatacgacgaaaaacgcgcgtaaccgcgaacccgacgacgcacgaacatatacgtcgcgtcgataacgaacgtaaaaaatcgacgtcgtcgctttcgctactaataaacgaaatacgtaaaaaaacgttaaataaataacaaaaaaataaaaaaattcgataaaaatatactcnaaaacgcaacgccgaacacgcgtacgaaaaacgcgaaacgcgcgaaacgaataaaaataatttaacgaacgacgacgaaaaataaaatacgttcgcgaatacgtaataataatataaaaatcgaataaaaaaaacgacgtataatcgtaaaaaacgcgaaaaccgaaaaaaaactcgatcgatcgctacgacactcgacgaattaaacgaaaaaaaaaaacgaaaacgaaaaaaaacgacgcgaaaaaacgacgaaaaatattaataaaaaaaaaataaataccgcgtaaaataacgaaaacgtattaaataaaatataaccgcgtcgaaacccgacgaaaccactcgaatacgtaccgtcgacgataatcgacatacgaactatacgaaaaaatataaacgataaactaaaataaaaacgatactcaaacgacgtaccgcctaaacgaacgaaaaactaaacgtcaaaaaatatcgattaaatacccgaccgnaaaacgtaacgaaataaaaacgacgaaaaaaaacgaaaaacaaacgaaacgcgacgcgcgacgatacgaacgtcgacgtacgaaacgcgaaatataaaaaaaaacgacgaaattaacgcgccgcac

SEQ ID NO: 28243 - DNA, 1163 bp, Artificial Sequence
  chemically treated genomic DNA (Homo sapiens) CpG-island No: 28243
  misc_feature (157)..(157): n is either a, c, g or t
  misc_feature (257)..(257): n is either a, c, g or t
  misc_feature (543)..(543): n is either a, c, g or t
  misc_feature (1037)..(1037): n is either a, c, g or t
ttgggcgcgattggtcggggtagggggcggtgtgggggcggggggtggaggcgcggtggtggggggtggcgtggcgcgagggtagggggagagtgagagtagtgtaggcgggtgggtgggggttggagggtttgttgtgggtggggtgcgtgttgtntttcgcgtggtcgttcgggtgtggtgtgcggtagtttggcggtggggtagtcgcggcgcggtgcggttggcggcgcgggttgttttcgtgggcgggtgtnggggtggtggttattttcgtgttttcgttcggtttttgcggtgcgcggtggtggggtttcgtagtggcgcgggcgcggcggggcgtttgggtggggcgtgcgggggcgcgtgtgtgcggcggagggcgcgcgtggtcgcggattcggcggcgtacgggtatgtacgtcgcgtcggtggcgggcgtgggggatcggcgtcgtcgttttcgttgttggtgggcggagtgcgtgagggggcgttgggtgggtggtagagaggtggagaggttcggtgggagtgtgtttnagggcgtaacgtcggatacgcgtgcggggggcgcggggcgcgcggggcgggtgggggtggtttggcgagcggcgacgaggggtggggtgcgttcgcggatgcgtggtggtggtgtaggggtcgggtggggggggcggcgtgtaatcgtggggggcgcgggggtcggaggggggttcgatcgatcgttgcggtattcggcgggttggacggggggggggggcgggggcgggggggggcggcgcgggggggcggcggggagtgttggtggggggggagtgggtgtcgcgtggggtggcgggggcgtgttgggtggggtgtggtcgcgtcgaggttcggcggggttattcgggtgcgtgtcgtcggcggtggtcggtatgcgggttgtacgggggggtgtgggcggtggattgaggtggggacggtgtttaggcggcgtgtcgtttgggcgggcggggggttgggcgttagggggtgtcggttgggtgttcggtcgnggggcgtggcggggtgggggcggcgggggggggcggggggtaggcggggcgcggcgcgcggcggtgcgggcgtcggcgtgcggggcgcggggtgtgggggggggcgacggagttggcgcgtcgtat

SEQ ID NO: 28244 - DNA, 1163 bp, Artificial Sequence
  chemically treated genomic DNA (Homo sapiens) CpG-island No: 28244
  misc_feature (127)..(127): n is either a, c, g or t
  misc_feature (621)..(621): n is either a, c, g or t
  misc_feature (907)..(907): n is either a, c, g or t
  misc_feature (1007)..(1007): n is either a, c, g or t
atacgacgcgccaactccgtcgcccccccccacaccccgcgccccgcacgccgacgcccgcaccgccgcgcgccgcgccccgcctaccccccgcccccccccgccgcccccaccccgccacgccccncgaccgaacacccaaccgacaccccctaacgcccaaccccccgcccgcccaaacgacacgccgcctaaacaccgtccccacctcaatccaccgcccacacccccccgtacaacccgcataccgaccaccgccgacgacacgcacccgaataaccccgccgaacctcgacgcgaccacaccccacccaacacgcccccgccaccccacgcgacacccactccccccccaccaacactccccgccgcccccccgcgccgcccccccccgcccccgccccccccccccgtccaacccgccgaataccgcaacgatcgatcgaacccccctccgacccccgcgccccccacgattacacgccgccccccccacccgacccctacaccaccaccacgcatccgcgaacgcaccccacccctcgtcgccgctcgccaaaccacccccacccgccccgcgcgccccgcgccccccgcacgcgtatccgacgttacgccctnaaacacactcccaccgaacctctccacctctctaccacccacccaacgccccctcacgcactccgcccaccaacaacgaaaacgacgacgccgatcccccacgcccgccaccgacgcgacgtacatacccgtacgccgccgaatccgcgaccacgcgcgccctccgccgcacacacgcgcccccgcacgccccacccaaacgccccgccgcgcccgcgccactacgaaaccccaccaccgcgcaccgcaaaaaccgaacgaaaacacgaaaataaccaccaccccnacacccgcccacgaaaacaacccgcgccgccaaccgcaccgcgccgcgactaccccaccgccaaactaccgcacaccacacccgaacgaccacgcgaaanacaacacgcaccccacccacaacaaaccctccaacccccacccacccgcctacactactctcactctccccctaccctcgcgccacgccaccccccaccaccgcgcctccaccccccgcccccacaccgccccctaccccgaccaatcgcgcccaa

SEQ ID NO: 28245 - DNA, 694 bp, Artificial Sequence
  chemically treated genomic DNA (Homo sapiens) CpG-island No: 28245
ttttttttcgttatttattcgttttaatttttcgcgtcgttttcgttttcgtcggtcgcgtttcggcgcgttacggtgagttttcggcgtcgtcggtcgtttttcgtttttatcgtcgtatttttgaggcggcgttttttcgtcggttcgtcggagggttttcgtaatttttatttcggggacgttcgttttcgattttagttattcgtttttttttttcggtcgtttttatcgtttcgttaaatatagtttcgggagtttttattatttcgtagattttttatattttattacgttttttttcggcgcgtcgttattttttacgtttttttattgcggtttcggttcgcgttttatttagtttcgttcgcgtcgggggcgtggaatatcgcgcggttttattttattttatatcgaaggtggttacgtatcgagttttggttgcgcgttttacgtcggggcgtgtcgtcgttacggttttttcgcgttaatttcgtatttttttttcgtatgcgatttattttttttatacgtcgatattttacgcggtcgttcggcggagttggaagggtcgcgtaagaaagagttatattcgttgtgtatttcgtttatcgtcgtttttatcgtaatatattatcggtatttgttcgtgtcgttatattttcggttatattcgaatatattattaatttat

SEQ ID NO: 28246 - DNA, 694 bp, Artificial Sequence
  chemically treated genomic DNA (Homo sapiens) CpG-island No: 28246
ataaattaataatatattcgaatataaccgaaaatataacgacacgaacaaataccgataatatattacgataaaaacgacgataaacgaaatacacaacgaatataactctttcttacgcgacccttccaactccgccgaacgaccgcgtaaaatatcgacgtataaaaaaaataaatcgcatacgaaaaaaaaatacgaaattaacgcgaaaaaaccgtaacgacgacacgccccgacgtaaaacgcgcaaccaaaactcgatacgtaaccaccttcgatataaaataaaataaaaccgcgcgatattccacgcccccgacgcgaacgaaactaaataaaacgcgaaccgaaaccgcaataaaaaaacgtaaaaaataacgacgcgccgaaaaaaaacgtaataaaatataaaaaatctacgaaataataaaaactcccgaaactatatttaacgaaacgataaaaacgaccgaaaaaaaaaaacgaataactaaaatcgaaaacgaacgtccccgaaataaaaattacgaaaaccctccgacgaaccgacgaaaaaacgccgcctcaaaaatacgacgataaaaacgaaaaacgaccgacgacgccgaaaactcaccgtaacgcgccgaaacgcgaccgacgaaaacgaaaacgacgcgaaaaattaaaacgaataaataacgaaaaaaaa

SEQ ID NO: 28247 - DNA, 694 bp, Artificial Sequence
  chemically treated genomic DNA (Homo sapiens) CpG-island No: 28247
gtgggttggtggtgtgttcgggtgtagtcgggggtgtggcggtacgggtaagtatcggtggtgtgttgcggtgggggcggcggtggacggggtgtatagcgggtgtggtttttttttgcgcggtttttttagtttcgtcgggcgatcgcgtggagtgtcggcgtatggggggggtgggtcgtatgcggggggggggtgcgggattggcgcgggggagtcgtggcggcgatacgtttcggcgtggggcgcgtagttagagttcggtgcgtggttattttcggtgtggggtggggtggggtcgcgcggtgttttacgttttcggcgcgagcggggttaggtggagcgcgagtcggggtcgtagtgggaagacgtggggggtagcggcgcgtcgaggggaggcgtaatggggtgtggggagtttacgaggtggtggggattttcgaggttatatttaacggggcggtagggacggtcgggaagaaggggcgggtggttggggtcgggggcgggcgttttcggagtgggggttgcgggggtttttcggcgggtcgacgggggggcgtcgttttaggggtgcggcggtgggggcgaggggcgatcggcggcgtcgggggtttatcgtggcgcgtcggggcgcggtcggcgagggcgggggcggcgcggggaattggggcgggtgggtggcggggggggg

SEQ ID NO: 28248 - DNA, 694 bp, Artificial Sequence
  chemically treated genomic DNA (Homo sapiens) CpG-island No: 28248
cccccccccgccacccacccgccccaattccccgcgccgcccccgccctcgccgaccgcgccccgacgcgccacgataaacccccgacgccgccgatcgcccctcgcccccaccgccgcacccctaaaacgacgcccccccgtcgacccgccgaaaaacccccgcaacccccactccgaaaacgcccgcccccgaccccaaccacccgccccttcttcccgaccgtccctaccgccccgttaaatataacctcgaaaatccccaccacctcgtaaactccccacaccccattacgcctcccctcgacgcgccgctaccccccacgtcttcccactacgaccccgactcgcgctccacctaaccccgctcgcgccgaaaacgtaaaacaccgcgcgaccccaccccaccccacaccgaaaataaccacgcaccgaactctaactacgcgccccacgccgaaacgtatcgccgccacgactcccccgcgccaatcccgcaccccccccccgcatacgacccaccccccccatacgccgacactccacgcgatcgcccgacgaaactaaaaaaaccgcgcaaaaaaaaaccacacccgctatacaccccgtccaccgccgcccccaccgcaacacaccaccgatacttacccgtaccgccacacccccgactacacccgaacacaccaccaacccac

SEQ ID NO: 28249 - DNA, 1329 bp, Artificial Sequence
  chemically treated genomic DNA (Homo sapiens) CpG-island No: 28249
  misc_feature (531)..(531): n is either a, c, g or t
  misc_feature (592)..(592): n is either a, c, g or t
  misc_feature (674)..(674): n is either a, c, g or t
  misc_feature (772)..(772): n is either a, c, g or t
  misc_feature (836)..(836): n is either a, c, g or t
  misc_feature (874)..(874): n is either a, c, g or t
  misc_feature (895)..(895): n is either a, c, g or t
  misc_feature (989)..(989): n is either a, c, g or t
  misc_feature (1008)..(1008): n is either a, c, g or t
  misc_feature (1064)..(1064): n is either a, c, g or t
gcgattttagtcgatttcgagtacggaggatcgagaatatcgttatacgttcggaaacgcgtaaaaatagaaagagaagagagaaagaaggagggggcgtaagaggggggacgtagaggtttagggcggggacgtattacgattttcgaagtagtaacgggaacgcggtatgcgaaggaatcgttcgagacgatagggtgattatcgacgaatattcggatcgataagaagaagaagtttttttttttttggcgcgtgagcggtggagagaattaatcgaagatcgcgtacgcgtcggggttcggagggggaataggagacgttatagtacgcgaaaatcggacgcgcgagaggggagggcgaaggcggtagacgaagtataggcgagggggtcgggatacgtataaagggaaattacgagggaggatcgagagcgagcggaggtacgggagttagagggaatcgatcgggcgttaagaaatatttattgagcggcgacgagacgcgcgaagcgtagggcgtcggtcgganggtagcgagggagtaggcgggtcgcgagggggagggagagaggggcgcgcggttatagatnatatagagatagtcgattttacgggcgacgacggtcgcggagtcggcgagtattcgcgtacgaagatagagcgacgagagangcgtgtagagtacgcgcgagagatagtatcgacgggtcgatgaggagcggagattagttatagataataaacgacgaataataaagttatataaatanataggacgtacgcggcgacggatttatttagagcgattagagatttacgttttatattatatanatattagagatagacgcggtcgcgtagagagcggaggnagagttttagaggcgaagatntcgatcggcgatacgataacgtacgagcgagagagtggacggcgagtgtagtatttgtgcgatgtgagatgtgatatagtagttacgatgtatnagtgagagaaaggcgcgangcggcgcgtttggggaggtcgtcgcgtcgagagcgagtgaggcggtacgaacgatntagcgtttaaattgtgttatatgcgttaacgtagacgtggatgagagcgcgaatcgataggttatcggacgttatacgagcgcgagagaagcgtagatatagagagaacgagaaaaaatcggttcggtgttatattacgcgagttgcgcgcgcgtacgttaggtcgacgaggagcgggatagacgagagcgcggcgcgcggtttaataacgaagagatgtatttcgagggcgatattggcgttcgtagttaagaaggagtatata

SEQ ID NO: 28250 - DNA, 1329 bp, Artificial Sequence
  chemically treated genomic DNA (Homo sapiens) CpG-island No: 28250
  misc_feature (266)..(266): n is either a, c, g or t
  misc_feature (322)..(322): n is either a, c, g or t
  misc_feature (341)..(341): n is either a, c, g or t
  misc_feature (435)..(435): n is either a, c, g or t
  misc_feature (456)..(456): n is either a, c, g or t
  misc_feature (494)..(494): n is either a, c, g or t
  misc_feature (558)..(558): n is either a, c, g or t
  misc_feature (656)..(656): n is either a, c, g or t
  misc_feature (738)..(738): n is either a, c, g or t
  misc_feature (799)..(799): n is either a, c, g or t
tatatactccttcttaactacgaacgccaatatcgccctcgaaatacatctcttcgttattaaaccgcgcgccgcgctctcgtctatcccgctcctcgtcgacctaacgtacgcgcgcgcaactcgcgtaatataacaccgaaccgattttttctcgttctctctatatctacgcttctctcgcgctcgtataacgtccgataacctatcgattcgcgctctcatccacgtctacgttaacgcatataacacaatttaaacgctanatcgttcgtaccgcctcactcgctctcgacgcgacgacctccccaaacgcgccgcntcgcgcctttctctcactnatacatcgtaactactatatcacatctcacatcgcacaaatactacactcgccgtccactctctcgctcgtacgttatcgtatcgccgatcganatcttcgcctctaaaactctncctccgctctctacgcgaccgcgtctatctctaatatntatataatataaaacgtaaatctctaatcgctctaaataaatccgtcgccgcgtacgtcctatntatttatataactttattattcgtcgtttattatctataactaatctccgctcctcatcgacccgtcgatactatctctcgcgcgtactctacacgcntctctcgtcgctctatcttcgtacgcgaatactcgccgactccgcgaccgtcgtcgcccgtaaaatcgactatctctatatnatctataaccgcgcgcccctctctccctccccctcgcgacccgcctactccctcgctaccntccgaccgacgccctacgcttcgcgcgtctcgtcgccgctcaataaatatttcttaacgcccgatcgattccctctaactcccgtacctccgctcgctctcgatcctccctcgtaatttccctttatacgtatcccgaccccctcgcctatacttcgtctaccgccttcgccctcccctctcgcgcgtccgattttcgcgtactataacgtctcctattccccctccgaaccccgacgcgtacgcgatcttcgattaattctctccaccgctcacgcgccaaaaaaaaaaaaacttcttcttcttatcgatccgaatattcgtcgataatcaccctatcgtctcgaacgattccttcgcataccgcgttcccgttactacttcgaaaatcgtaatacgtccccgccctaaacctctacgtcccccctcttacgccccctccttctttctctcttctctttctatttttacgcgtttccgaacgtataacgatattctcgatcctccgtactcgaaatcgactaaaatcgc

SEQ ID NO: 28251 - DNA, 1329 bp, Artificial Sequence
  chemically treated genomic DNA (Homo sapiens) CpG-island No: 28251
  misc_feature (266)..(266): n is either a, c, g or t
  misc_feature (322)..(322): n is either a, c, g or t
  misc_feature (341)..(341): n is either a, c, g or t
  misc_feature (435)..(435): n is either a, c, g or t
  misc_feature (456)..(456): n is either a, c, g or t
  misc_feature (494)..(494): n is either a, c, g or t
  misc_feature (558)..(558): n is either a, c, g or t
  misc_feature (656)..(656): n is either a, c, g or t
  misc_feature (738)..(738): n is either a, c, g or t
  misc_feature (799)..(799): n is either a, c, g or t
tgtgtgtttttttttggttgcgggcgttagtgtcgttttcggggtgtattttttcgttgttgggtcgcgcgtcgcgttttcgtttgtttcgtttttcgtcggtttggcgtgcgcgcgcgtagttcgcgtggtgtggtatcgggtcggttttttttcgttttttttgtgtttgcgtttttttcgcgttcgtgtggcgttcggtggtttgtcggttcgcgtttttatttacgtttgcgttgacgtatgtggtatagtttgaacgttgngtcgttcgtgtcgttttattcgttttcggcgcggcggtttttttaggcgcgtcgtntcgcgttttttttttattngtgtatcgtagttgttatgttatattttatatcgtataggtgttgtattcgtcgtttattttttcgttcgtgcgttgtcgtgtcgtcggtcggngttttcgtttttgggattttnttttcgttttttgcgcgatcgcgtttatttttggtatntgtgtggtgtgaggcgtggatttttggtcgttttgggtgggttcgtcgtcgcgtgcgttttatntgtttgtgtggttttattgttcgtcgtttgttatttgtggttggttttcgttttttatcggttcgtcggtgttgtttttcgcgcgtgttttgtacgtntttttcgtcgttttgttttcgtgcgcgggtgttcgtcgatttcgcggtcgtcgtcgttcgtgaggtcggttatttttgtgtngtttgtgatcgcgcgtttttttttttttttttttcgcggttcgtttgttttttcgttgttnttcggtcggcgttttacgtttcgcgcgtttcgtcgtcgtttagtgggtgttttttggcgttcgatcggttttttttggttttcgtgttttcgttcgttttcggttttttttcgtgatttttttttgtgcgtgtttcggttttttcgtttgtatttcgtttgtcgttttcgtttttttttttcgcgcgttcggttttcgcgtgttgtggcgttttttgtttttttttcgggtttcggcgcgtgcgcggttttcggttggttttttttatcgtttacgcgttaaaaaaaaaaagattttttttttttgtcggttcgggtgttcgtcggtggttattttgtcgtttcgggcggttttttcgtatgtcgcgttttcgttgttgtttcgggggtcgtggtgcgttttcgttttgggtttttgcgtttttttttttgcgtttttttttttttttttttttttttttttgtttttgcgcgttttcgggcgtgtggcggtgttttcggtttttcgtgttcggggtcggttggggtcgt

SEQ ID NO: 28252 - DNA, 1329 bp, Artificial Sequence
  chemically treated genomic DNA (Homo sapiens) CpG-island No: 28252
  misc_feature (531)..(531): n is either a, c, g or t
  misc_feature (592)..(592): n is either a, c, g or t
  misc_feature (674)..(674): n is either a, c, g or t
  misc_feature (772)..(772): n is either a, c, g or t
  misc_feature (836)..(836): n is either a, c, g or t
  misc_feature (874)..(874): n is either a, c, g or t
  misc_feature (895)..(895): n is either a, c, g or t
  misc_feature (989)..(989): n is either a, c, g or t
  misc_feature (1008)..(1008): n is either a, c, g or t
  misc_feature (1064)..(1064): n is either a, c, g or t
acgaccccaaccgaccccgaacacgaaaaaccgaaaacaccgccacacgcccgaaaacgcgcaaaaacaaaaaaaaaaaaaaaaaaaaaaaaaaaaacgcaaaaaaaaaaacgcaaaaacccaaaacgaaaacgcaccacgacccccgaaacaacaacgaaaacgcgacatacgaaaaaaccgcccgaaacgacaaaataaccaccgacgaacacccgaaccgacaaaaaaaaaaaatctttttttttttaacgcgtaaacgataaaaaaaaccaaccgaaaaccgcgcacgcgccgaaacccgaaaaaaaaacaaaaaacgccacaacacgcgaaaaccgaacgcgcgaaaaaaaaaaacgaaaacgacaaacgaaatacaaacgaaaaaaccgaaacacgcacaaaaaaaaatcacgaaaaaaaaccgaaaacgaacgaaaacacgaaaaccaaaaaaaaccgatcgaacgccaaaaaacacccactaaacgacgacgaaacgcgcgaaacgtaaaacgccgaccgaanaacaacgaaaaaacaaacgaaccgcgaaaaaaaaaaaaaaaaaaacgcgcgatcacaaacnacacaaaaataaccgacctcacgaacgacgacgaccgcgaaatcgacgaacacccgcgcacgaaaacaaaacgacgaaaaanacgtacaaaacacgcgcgaaaaacaacaccgacgaaccgataaaaaacgaaaaccaaccacaaataacaaacgacgaacaataaaaccacacaaacanataaaacgcacgcgacgacgaacccacccaaaacgaccaaaaatccacgcctcacaccacacanataccaaaaataaacgcgatcgcgcaaaaaacgaaaanaaaatcccaaaaacgaaaacnccgaccgacgacacgacaacgcacgaacgaaaaaataaacgacgaatacaacacctatacgatataaaatataacataacaactacgatacacnaataaaaaaaaaacgcganacgacgcgcctaaaaaaaccgccgcgccgaaaacgaataaaacgacacgaacgacncaacgttcaaactataccacatacgtcaacgcaaacgtaaataaaaacgcgaaccgacaaaccaccgaacgccacacgaacgcgaaaaaaacgcaaacacaaaaaaaacgaaaaaaaaccgacccgataccacaccacgcgaactacgcgcgcgcacgccaaaccgacgaaaaacgaaacaaacgaaaacgcgacgcgcgacccaacaacgaaaaaatacaccccgaaaacgacactaacgcccgcaaccaaaaaaaaacacaca

SEQ ID NO: 28253 - DNA, 1164 bp, Artificial Sequence
  chemically treated genomic DNA (Homo sapiens) CpG-island No: 28253
  misc_feature (816)..(816): n is either a, c, g or t
  misc_feature (942)..(942): n is either a, c, g or t
  misc_feature (985)..(985): n is either a, c, g or t
  misc_feature (1058)..(1058): n is either a, c, g or t
  misc_feature (1082)..(1082): n is either a, c, g or t
cgttcggcgaaaggacgtataagttttattttacgagggcgtagtatagacgattttcgcggaggtcgcgttgattttatttttttttacgagtatttgttttttcgatattcggtcgttcgatttatcgtttttcgtattataggatagtttaacggaagaaagataaaacggaatataaattgttacgaaggacgtttttcggtatatatttcggtatatttatcggattataggtgcggattttttttttttattttaatttcgttcgttatttttcgatcgtcgtgtggattcgtcgcgtttttttacgataattatattagtatagtattttttttcgggttattttttgaggaatatatcgtcgtcggtttatttcgtcgcgagtttcgtcgcgggtgcgcggttcgttatttagtggtatcgacggttattatataatttttatatattatttatcgttattaagatttaatattaatattattttttagttattgcgtttttatttttttttacgtaattaaataatttttttttttattattttcgatttttagttaagtacgcggtagcgtatataatttcgggtcgcgcgaacgtatagcgttatattttagtattcgatcgttttcgcgttttatttttcgtttcgtatagtaggcgcgttttcgtgttttcgttcgggtcgtttaagattatatttatatacgtttagggaaggacggttcgttaagatataatcgaattatagagatttgatttattcgttaatagttttatttattttcgtcgttatcggatacgtatttnttcgtttattatttcgttcgtttaattttttttattcgtcgatttgtgcgtattttttttatatttattatacgaaaatatagtacgcgtattcgcgataataagcgtttatcggtttttcgtcgnagcgaggcgttttatatattattagattttataatttagagantagtagcgttacgtcgttaacgtagtatatttagtagtatattaggtaatatatagatatacgttgtacgatngaaatagtataaaagattaataantatataatttatatacgtagaatttatgatacggcggtttttcggacggttaacgtcgttacgggatttcgtcgtttagtta

SEQ ID NO: 28254 - DNA, 1164 bp, Artificial Sequence
  chemically treated genomic DNA (Homo sapiens) CpG-island No: 28254
  misc_feature (83)..(83): n is either a, c, g or t
  misc_feature (107)..(107): n is either a, c, g or t
  misc_feature (180)..(180): n is either a, c, g or t
  misc_feature (223)..(223): n is either a, c, g or t
  misc_feature (349)..(349): n is either a, c, g or t
taactaaacgacgaaatcccgtaacgacgttaaccgtccgaaaaaccgccgtatcataaattctacgtatataaattatatanttattaatcttttatactatttcnatcgtacaacgtatatctatatattacctaatatactactaaatatactacgttaacgacgtaacgctactantctctaaattataaaatctaataatatataaaacgcctcgctncgacgaaaaaccgataaacgcttattatcgcgaatacgcgtactatattttcgtataataaatataaaaaaaatacgcacaaatcgacgaataaaaaaaattaaacgaacgaaataataaacgaanaaatacgtatccgataacgacgaaaataaataaaactattaacgaataaatcaaatctctataattcgattatatcttaacgaaccgtccttccctaaacgtatataaatataatcttaaacgacccgaacgaaaacacgaaaacgcgcctactatacgaaacgaaaaataaaacgcgaaaacgatcgaatactaaaatataacgctatacgttcgcgcgacccgaaattatatacgctaccgcgtacttaactaaaaatcgaaaataataaaaaaaaaaattatttaattacgtaaaaaaaaataaaaacgcaataactaaaaaataatattaatattaaatcttaataacgataaataatatataaaaattatataataaccgtcgataccactaaataacgaaccgcgcacccgcgacgaaactcgcgacgaaataaaccgacgacgatatattcctcaaaaaataacccgaaaaaaaatactatactaatataattatcgtaaaaaaacgcgacgaatccacacgacgatcgaaaaataacgaacgaaattaaaataaaaaaaaaaaatccgcacctataatccgataaatataccgaaatatataccgaaaaacgtccttcgtaacaatttatattccgttttatctttcttccgttaaactatcctataatacgaaaaacgataaatcgaacgaccgaatatcgaaaaaacaaatactcgtaaaaaaaaataaaatcaacgcgacctccgcgaaaatcgtctatactacgccctcgtaaaataaaacttatacgtcctttcgccgaacg

SEQ ID NO: 28255 - DNA, 1164 bp, Artificial Sequence
  chemically treated genomic DNA (Homo sapiens) CpG-island No: 28255
  misc_feature (83)..(83): n is either a, c, g or t
  misc_feature (107)..(107): n is either a, c, g or t
  misc_feature (180)..(180): n is either a, c, g or t
  misc_feature (223)..(223): n is either a, c, g or t
  misc_feature (349)..(349): n is either a, c, g or t
tggttgggcggcgaggtttcgtggcggcgttggtcgttcggaggatcgtcgtgttatgggttttgcgtgtgtggattgtgtgnttgttggttttttgtgttgttttngtcgtgtagcgtgtgtttgtgtgttgtttagtgtgttgttaggtgtgttgcgttggcggcgtggcgttgttgntttttgggttgtggggtttggtagtgtgtggagcgtttcgttncggcggggagtcggtgggcgtttattgtcgcgggtgcgcgtgttgtattttcgtgtggtgggtgtgggggagatgcgtataggtcggcgggtgaggggggttgggcgagcgaggtggtgggcgganaggtgcgtgttcggtggcggcgggggtgagtggggttgttggcgggtgagttaagtttttgtggttcgattgtgttttagcgggtcgtttttttttgggcgtgtgtgggtgtagttttgggcggttcgggcgggggtacgggggcgcgtttgttgtgcggggcggagagtggggcgcgagggcgatcgggtgttagagtatgacgttgtgcgttcgcgcggttcggggttgtgtgcgttgtcgcgtatttgattgggggtcgggagtggtgggggagggggttgtttggttacgtgggggggggtggaggcgtaatggttagggggtggtgttgatgttgggttttgatgacgatgggtggtatatgggggttgtgtggtagtcgtcggtgttattgggtggcgggtcgcgtattcgcggcggggttcgcggcggggtgggtcggcggcggtgtgttttttagggggtggttcggggggggatgttgtgttagtgtggttgtcgtgggggggcgcggcggatttatacggcggtcgaggggtggcgggcggggttgaggtggggggggagggttcgtatttgtggttcggtgggtatgtcggggtgtgtgtcggggggcgtttttcgtgatagtttatgtttcgttttgtttttttttcgttgggttgttttgtggtgcggggggcggtgggtcgggcggtcgggtgtcgagggggtaggtgttcgtgggagggggtggggttagcgcgattttcgcgggagtcgtttgtgttacgttttcgtagggtggggtttgtgcgttttttcgtcgggcg

SEQ ID NO: 28256 - DNA, 1164 bp, Artificial Sequence
  chemically treated genomic DNA (Homo sapiens) CpG-island No: 28256
  misc_feature (816)..(816): n is either a, c, g or t
  misc_feature (942)..(942): n is either a, c, g or t
  misc_feature (985)..(985): n is either a, c, g or t
  misc_feature (1058)..(1058): n is either a, c, g or t
  misc_feature (1082)..(1082): n is either a, c, g or t
cgcccgacgaaaaaacgcacaaaccccaccctacgaaaacgtaacacaaacgactcccgcgaaaatcgcgctaaccccaccccctcccacgaacacctaccccctcgacacccgaccgcccgacccaccgccccccgcaccacaaaacaacccaacgaaaaaaaaacaaaacgaaacataaactatcacgaaaaacgccccccgacacacaccccgacatacccaccgaaccacaaatacgaaccctccccccccacctcaaccccgcccgccacccctcgaccgccgtataaatccgccgcgcccccccacgacaaccacactaacacaacatccccccccgaaccaccccctaaaaaacacaccgccgccgacccaccccgccgcgaaccccgccgcgaatacgcgacccgccacccaataacaccgacgactaccacacaacccccatataccacccatcgtcatcaaaacccaacatcaacaccaccccctaaccattacgcctccacccccccccacgtaaccaaacaaccccctcccccaccactcccgacccccaatcaaatacgcgacaacgcacacaaccccgaaccgcgcgaacgcacaacgtcatactctaacacccgatcgccctcgcgccccactctccgccccgcacaacaaacgcgcccccgtacccccgcccgaaccgcccaaaactacacccacacacgcccaaaaaaaaacgacccgctaaaacacaatcgaaccacaaaaacttaactcacccgccaacaaccccactcacccccgccgccaccgaacacgcacctntccgcccaccacctcgctcgcccaacccccctcacccgccgacctatacgcatctcccccacacccaccacacgaaaatacaacacgcgcacccgcgacaataaacgcccaccgactccccgccgnaacgaaacgctccacacactaccaaaccccacaacccaaaaancaacaacgccacgccgccaacgcaacacacctaacaacacactaaacaacacacaaacacacgctacacgacnaaaacaacacaaaaaaccaacaancacacaatccacacacgcaaaacccataacacgacgatcctccgaacgaccaacgccgccacgaaacctcgccgcccaacca

SEQ ID NO: 28257 - DNA, 778 bp, Artificial Sequence
  chemically treated genomic DNA (Homo sapiens) CpG-island No: 28257
  misc_feature (261)..(261): n is either a, c, g or t
  misc_feature (378)..(378): n is either a, c, g or t
tggcggcgagggcgggtcgttagtggtagtcggagcggtagggaggcggtagtttcgttttacgggcggggagatatgttggtcgggcggcgtaggttggaggcgagttgaaaatcgagcggaggaatgtttatacgtttcgaggtaaatttgtcggagaagtgagttagtcgtaaagaggtggcgttttaggaacgcgcgcggggcgagcgagggcgtaggcgggttggcgggcgggcgcgcgggggtcggggtcggttnacgggtcgggttcgaacggggttcgcgtcgtcgtttcgagcgagttgaagggggaggttttcgagttcggaaattgagcggcgagcggcggagtttttttttttcgcgttgtcgatntcggagttgttaggagttttgtcgagttttatttcggagttcgggtttttgtcgcgttattttcgtgtcgggggcgtgggcgtattcgtttgttttttttaggttcggtcggtttttgtcggcgcggcggattcgggagtcgagattttcgagggcgtgcggattgtttcgggtagtcggcggttttcggcgcgtcgagttggacgagcgggcgttaagattattaggggcggatcgacgaggaggaggttaaggagttgggtcggggatcgcgggtaatcgggagtttgcgcggagaggacgcgggttgttggtttgtgaatttaaggagttcgaagttcgtttggtagttcggggcgatgtatgagaatttttttttttggtttattttcgggatgaa

SEQ ID NO: 28258 - DNA, 778 bp, Artificial Sequence
  chemically treated genomic DNA (Homo sapiens) CpG-island No: 28258
  misc_feature (401)..(401): n is either a, c, g or t
  misc_feature (518)..(518): n is either a, c, g or t
ttcatcccgaaaataaaccaaaaaaaaaaattctcatacatcgccccgaactaccaaacgaacttcgaactccttaaattcacaaaccaacaacccgcgtcctctccgcgcaaactcccgattacccgcgatccccgacccaactccttaacctcctcctcgtcgatccgcccctaataatcttaacgcccgctcgtccaactcgacgcgccgaaaaccgccgactacccgaaacaatccgcacgccctcgaaaatctcgactcccgaatccgccgcgccgacaaaaaccgaccgaacctaaaaaaaacaaacgaatacgcccacgcccccgacacgaaaataacgcgacaaaaacccgaactccgaaataaaactcgacaaaactcctaacaactccganatcgacaacgcgaaaaaaaaaaactccgccgctcgccgctcaatttccgaactcgaaaacctcccccttcaactcgctcgaaacgacgacgcgaaccccgttcgaacccgacccgtnaaccgaccccgacccccgcgcgcccgcccgccaacccgcctacgccctcgctcgccccgcgcgcgttcctaaaacgccacctctttacgactaactcacttctccgacaaatttacctcgaaacgtataaacattcctccgctcgattttcaactcgcctccaacctacgccgcccgaccaacatatctccccgcccgtaaaacgaaactaccgcctccctaccgctccgactaccactaacgacccgccctcgccgcca

SEQ ID NO: 28259 - DNA, 778 bp, Artificial Sequence
  chemically treated genomic DNA (Homo sapiens) CpG-island No: 28259
  misc_feature (401)..(401): n is either a, c, g or t
  misc_feature (518)..(518): n is either a, c, g or t
tttatttcgggaatgggttagggaggaaggtttttatgtatcgtttcgagttgttaggcgagtttcgggttttttaaatttataggttaatagttcgcgtttttttcgcgtaggttttcggttgttcgcggttttcggtttagttttttggtttttttttcgtcggttcgtttttggtggttttggcgttcgttcgtttagttcggcgcgtcggggatcgtcggttgttcggggtagttcgtacgttttcggggatttcggttttcggattcgtcgcgtcggtaggagtcggtcgggtttggagggagtaagcggatgcgtttacgttttcggtacggggatggcgcgataggggttcgggtttcggggtggggttcggtagagtttttgatagtttcggngtcggtagcgcgggaggggggagtttcgtcgttcgtcgtttaattttcgggttcgggggtttttttttttaattcgttcggggcggcggcgcgggtttcgttcgggttcggttcgtnggtcggtttcggttttcgcgcgttcgttcgttagttcgtttgcgttttcgttcgtttcgcgcgcgtttttagggcgttatttttttgcgattagtttattttttcggtaggtttgtttcggagcgtgtgaatattttttcgttcggtttttaattcgtttttaatttgcgtcgttcggttagtatgttttttcgttcgtgaagcggggttgtcgtttttttgtcgtttcggttgttattaacgattcgttttcgtcgtta

SEQ ID NO: 28260 - DNA, 778 bp, Artificial Sequence
  chemically treated genomic DNA (Homo sapiens) CpG-island No: 28260
  misc_feature (261)..(261): n is either a, c, g or t
  misc_feature (378)..(378): n is either a, c, g or t
taacgacgaaaacgaatcgttaataacaaccgaaacgacaaaaaaacgacaaccccgcttcacgaacgaaaaaacatactaaccgaacgacgcaaattaaaaacgaattaaaaaccgaacgaaaaaatattcacacgctccgaaacaaacctaccgaaaaaataaactaatcgcaaaaaaataacgccctaaaaacgcgcgcgaaacgaacgaaaacgcaaacgaactaacgaacgaacgcgcgaaaaccgaaaccgaccnacgaaccgaacccgaacgaaacccgcgccgccgccccgaacgaattaaaaaaaaaaacccccgaacccgaaaattaaacgacgaacgacgaaactcccccctcccgcgctaccgacnccgaaactatcaaaaactctaccgaaccccaccccgaaacccgaacccctatcgcgccatccccgtaccgaaaacgtaaacgcatccgcttactccctccaaacccgaccgactcctaccgacgcgacgaatccgaaaaccgaaatccccgaaaacgtacgaactaccccgaacaaccgacgatccccgacgcgccgaactaaacgaacgaacgccaaaaccaccaaaaacgaaccgacgaaaaaaaaaccaaaaaactaaaccgaaaaccgcgaacaaccgaaaacctacgcgaaaaaaacgcgaactattaacctataaatttaaaaaacccgaaactcgcctaacaactcgaaacgatacataaaaaccttcctccctaacccattcccgaaataaa

SEQ ID NO: 28261 - DNA, 523 bp, Artificial Sequence
  chemically treated genomic DNA (Homo sapiens) CpG-island No: 28261
tgcgacgtcgtattttgtttagtattttaaacgcgtatttacggcggataacgaggttattttttggcggtaaaattagttattttcgttggcgtattttatttttcgtattgattggtatttcgcgattggcgtattataattagaataatagtaatttttaaagtagttaatgattatgtcgtcgggcgtggtagcggtaacggttgcgcgtgggcgcggtaagtcggcgttggtagggtaatttatttttcgtattgcgggtagagcgattgttatcgcgttcgtaaaagcgttaacggatgtattggtataatttgcgggcgagaagtttcgttttattgcgtcggatgttttgttagttagcgatgagtaagtcgattggttggtggtcgatgaagtcgtagttatatttgcgttattgttgtattaattggtatcgcgtttttttcgaacgttgttattattacggtgtagggttacgaaggtatcggacgtggtttttgttgaattttgcgttcgt

SEQ ID NO: 28262 - DNA, 523 bp, Artificial Sequence
  chemically treated genomic DNA (Homo sapiens) CpG-island No: 28262
acgaacgcaaaattcaacaaaaaccacgtccgataccttcgtaaccctacaccgtaataataacaacgttcgaaaaaaacgcgataccaattaatacaacaataacgcaaatataactacgacttcatcgaccaccaaccaatcgacttactcatcgctaactaacaaaacatccgacgcaataaaacgaaacttctcgcccgcaaattataccaatacatccgttaacgcttttacgaacgcgataacaatcgctctacccgcaatacgaaaaataaattaccctaccaacgccgacttaccgcgcccacgcgcaaccgttaccgctaccacgcccgacgacataatcattaactactttaaaaattactattattctaattataatacgccaatcgcgaaataccaatcaatacgaaaaataaaatacgccaacgaaaataactaattttaccgccaaaaaataacctcgttatccgccgtaaatacgcgtttaaaatactaaacaaaatacgacgtcgca

SEQ ID NO: 28263 - DNA, 523 bp, Artificial Sequence
  chemically treated genomic DNA (Homo sapiens) CpG-island No: 28263
gcgagcgtaaaatttagtaaaaattacgttcggtgttttcgtagttttgtatcgtagtggtaataacgttcgaggaaaacgcgatattagttgatgtaataatggcgtaggtatggttgcggttttatcgattattagttagtcggtttgtttatcgttggttaataaggtattcggcgtaataaagcgaaatttttcgttcgtaaattgtgttagtatattcgttgacgtttttgcgggcgcggtgataatcgttttgttcgtaatacgagaaatgagttgttttgttaacgtcgatttatcgcgtttacgcgtagtcgttatcgttgttacgttcggcggtatggttattagttgttttaagagttgttgttgttttggttgtggtgcgttagtcgcggggtattagttagtacggggagtaaaatgcgttaacgagaatggttggttttgtcgttagaggatagtttcgttattcgtcgtaagtacgcgtttgagatgttggataaaatgcggcgtcgta

SEQ ID NO: 28264 - DNA, 523 bp, Artificial Sequence
  chemically treated genomic DNA (Homo sapiens) CpG-island No: 28264
tacgacgccgcattttatccaacatctcaaacgcgtacttacgacgaataacgaaactatcctctaacgacaaaaccaaccattctcgttaacgcattttactccccgtactaactaataccccgcgactaacgcaccacaaccaaaacaacaacaactcttaaaacaactaataaccataccgccgaacgtaacaacgataacgactacgcgtaaacgcgataaatcgacgttaacaaaacaactcatttctcgtattacgaacaaaacgattatcaccgcgcccgcaaaaacgtcaacgaatatactaacacaatttacgaacgaaaaatttcgctttattacgccgaataccttattaaccaacgataaacaaaccgactaactaataatcgataaaaccgcaaccatacctacgccattattacatcaactaatatcgcgttttcctcgaacgttattaccactacgatacaaaactacgaaaacaccgaacgtaatttttactaaattttacgctcgc

SEQ ID NO: 28265 - DNA, 940 bp, Artificial Sequence
  chemically treated genomic DNA (Homo sapiens) CpG-island No: 28265
  misc_feature (13)..(13): n is either a, c, g or t
  misc_feature (161)..(161): n is either a, c, g or t
  misc_feature (236)..(236): n is either a, c, g or t
  misc_feature (337)..(337): n is either a, c, g or t
  misc_feature (339)..(339): n is either a, c, g or t
  misc_feature (381)..(381): n is either a, c, g or t
  misc_feature (407)..(407): n is either a, c, g or t
  misc_feature (428)..(428): n is either a, c, g or t
  misc_feature (444)..(444): n is either a, c, g or t
ggcgcgggttttntcgtcggttcgtttttgttttacgatgggattttttttagttgacgatcgtatttaatattatatattcgatttcgtattttatatcgtatcgtataatgcgttatcgttatttcgatttttacgtatatgtgtaggttatatgagtngttatattagtataggcgattatttttagtcgattaatttatgcgttaacgttttttcgattaatagcgtcgcgnattgtatcgtcgacgtttcgttattacgatattttaattgcgatcggatattacgtcgattcgatgtatcgagtgcgtcgcggcgttcgcgtcgcggcggntnacgcgatttagcgtttagaggatcgtgttaagtcgttatgtnagaggttaatgattacgtaggttcgnacgagttttaggttcgttttnacgtatttcgcgttantgtagatttttatttttatagcggatcgagcgcggtcgtttatttcgttagtattgtagtatagtttatcgagtatttagtattcgatcgtttaacgttttcgtattacgtttttaatcgtgtcgtattgtcgttatgcggtagcgtttttttaattggtattcgttatgacgtcgtgtgtacgtatttatttagcgtttgtcgaatatagtaatacgtatacgtcgttgtttcggtcgttataagtataattcgttattcgtattaagtacgttagaatattttatcgaagtagtttatcgggtagtcgtagacgattcgtagtgtattttgtttattgtagagcgaattagtcgttttcgtttttcgtcgagtagcgtagtttacgtagtttgttttcgatcgcgtattgtcgggtttagttattgtttttggtcgtgtcgttgatagtcgcgtcgtcgtcgcgttttagttttatacgattttatttattgtt

SEQ ID NO: 28266 - DNA, 940 bp, Artificial Sequence
  chemically treated genomic DNA (Homo sapiens) CpG-island No: 28266
  misc_feature (497)..(497): n is either a, c, g or t
  misc_feature (513)..(513): n is either a, c, g or t
  misc_feature (534)..(534): n is either a, c, g or t
  misc_feature (560)..(560): n is either a, c, g or t
  misc_feature (602)..(602): n is either a, c, g or t
  misc_feature (604)..(604): n is either a, c, g or t
  misc_feature (705)..(705): n is either a, c, g or t
  misc_feature (780)..(780): n is either a, c, g or t
  misc_feature (928)..(928): n is either a, c, g or t
aacaataaataaaatcgtataaaactaaaacgcgacgacgacgcgactatcaacgacacgaccaaaaacaataactaaacccgacaatacgcgatcgaaaacaaactacgtaaactacgctactcgacgaaaaacgaaaacgactaattcgctctacaataaacaaaatacactacgaatcgtctacgactacccgataaactacttcgataaaatattctaacgtacttaatacgaataacgaattatacttataacgaccgaaacaacgacgtatacgtattactatattcgacaaacgctaaataaatacgtacacacgacgtcataacgaataccaattaaaaaaacgctaccgcataacgacaatacgacacgattaaaaacgtaatacgaaaacgttaaacgatcgaatactaaatactcgataaactatactacaatactaacgaaataaacgaccgcgctcgatccgctataaaaataaaaatctacantaacgcgaaatacgtnaaaacgaacctaaaactcgtncgaacctacgtaatcattaacctctnacataacgacttaacacgatcctctaaacgctaaatcgcgtnanccgccgcgacgcgaacgccgcgacgcactcgatacatcgaatcgacgtaatatccgatcgcaattaaaatatcgtaataacgaaacgtcgacgatacaatncgcgacgctattaatcgaaaaaacgttaacgcataaattaatcgactaaaaataatcgcctatactaatataacnactcatataacctacacatatacgtaaaaatcgaaataacgataacgcattatacgatacgatataaaatacgaaatcgaatatataatattaaatacgatcgtcaactaaaaaaaatcccatcgtaaaacaaaaacgaaccgacganaaaacccgcgcc

SEQ ID NO: 28267 - DNA, 940 bp, Artificial Sequence
  chemically treated genomic DNA (Homo sapiens) CpG-island No: 28267
  misc_feature (497)..(497): n is either a, c, g or t
  misc_feature (513)..(513): n is either a, c, g or t
  misc_feature (534)..(534): n is either a, c, g or t
  misc_feature (560)..(560): n is either a, c, g or t
  misc_feature (602)..(602): n is either a, c, g or t
  misc_feature (604)..(604): n is either a, c, g or t
  misc_feature (705)..(705): n is either a, c, g or t
  misc_feature (780)..(780): n is either a, c, g or t
  misc_feature (928)..(928): n is either a, c, g or t
agtagtgagtgagatcgtgtaggattgagacgcgacggcggcgcgattgttagcggtacggttagagatagtagttagattcggtagtacgcgatcgagggtagattacgtggattacgttattcgacggggagcggaggcggttggttcgttttatagtgaatagggtgtattgcgggtcgtttgcggttgttcgatgggttgtttcgatggggtgttttagcgtatttggtgcgggtagcgggttgtgtttgtggcgatcggagtagcgacgtatgcgtattattatgttcggtagacgttgggtagatgcgtatatacgacgttataacgaatattagttaggaggacgttatcgtatggcggtagtacggtacggttgaggacgtgatacgggagcgttgaacgatcgagtattgagtgttcgatggattatattatagtgttgacgagataaacgatcgcgttcgattcgttgtggaagtaaggatttgtantggcgcgggatgcgtnggggcggatttaggattcgtncggatttacgtgattattgatttttnatatggcgatttagtacggttttttgagcgttgagtcgcgtngntcgtcgcggcgcgggcgtcgcgacgtattcgatgtatcgagtcggcgtgatgttcgatcgtagttaaggtatcgtggtagcgggacgtcgacggtgtaatncgcgacgttgttgatcgagaaagcgttggcgtataggttggtcgattagagataatcgtttatgttggtatggtnatttatgtggtttatatatatgcgtgggggtcgggatgacgatggcgtattgtgcgatacggtgtaagatacggagtcggatatgtaatgttggatgcggtcgttaattggaggaggttttatcgtagaataaagacgagtcgacggnggggttcgcgtt

SEQ ID NO: 28268 - DNA, 940 bp, Artificial Sequence
  chemically treated genomic DNA (Homo sapiens) CpG-island No: 28268
  misc_feature (13)..(13): n is either a, c, g or t
  misc_feature (161)..(161): n is either a, c, g or t
  misc_feature (236)..(236): n is either a, c, g or t
  misc_feature (337)..(337): n is either a, c, g or t
  misc_feature (339)..(339): n is either a, c, g or t
  misc_feature (381)..(381): n is either a, c, g or t
  misc_feature (407)..(407): n is either a, c, g or t
  misc_feature (428)..(428): n is either a, c, g or t
  misc_feature (444)..(444): n is either a, c, g or t
aacgcgaaccccnccgtcgactcgtctttattctacgataaaacctcctccaattaacgaccgcatccaacattacatatccgactccgtatcttacaccgtatcgcacaatacgccatcgtcatcccgacccccacgcatatatataaaccacataaatnaccataccaacataaacgattatctctaatcgaccaacctatacgccaacgctttctcgatcaacaacgtcgcgnattacaccgtcgacgtcccgctaccacgataccttaactacgatcgaacatcacgccgactcgatacatcgaatacgtcgcgacgcccgcgccgcgacgancnacgcgactcaacgctcaaaaaaccgtactaaatcgccatatnaaaaatcaataatcacgtaaatccgnacgaatcctaaatccgccccnacgcatcccgcgccantacaaatccttacttccacaacgaatcgaacgcgatcgtttatctcgtcaacactataatataatccatcgaacactcaatactcgatcgttcaacgctcccgtatcacgtcctcaaccgtaccgtactaccgccatacgataacgtcctcctaactaatattcgttataacgtcgtatatacgcatctacccaacgtctaccgaacataataatacgcatacgtcgctactccgatcgccacaaacacaacccgctacccgcaccaaatacgctaaaacaccccatcgaaacaacccatcgaacaaccgcaaacgacccgcaatacaccctattcactataaaacgaaccaaccgcctccgctccccgtcgaataacgtaatccacgtaatctaccctcgatcgcgtactaccgaatctaactactatctctaaccgtaccgctaacaatcgcgccgccgtcgcgtctcaatcctacacgatctcactcactact

SEQ ID NO: 28269 - DNA, 524 bp, Artificial Sequence
  chemically treated genomic DNA (Homo sapiens) CpG-island No: 28269
  misc_feature (2)..(2): n is either a, c, g or t
  misc_feature (25)..(25): n is either a, c, g or t
  misc_feature (32)..(32): n is either a, c, g or t
  misc_feature (44)..(44): n is either a, c, g or t
  misc_feature (88)..(88): n is either a, c, g or t
  misc_feature (147)..(147): n is either a, c, g or t
  misc_feature (232)..(232): n is either a, c, g or t
  misc_feature (499)..(499): n is either a, c, g or t
tncgcgggcgcgcgcgggtcggttngtcgttncgggcgtcgggnggtcgcgggtttttttttttttcgttcggtcgttcgtcggattncgcggttcgcgcgtcgtcggcggttagtagcggcggtttaagatttataaagaggagtnagttaataatttatatcgattaacgaatcgacgcgcggagagtaggaatacgtcggggggagagaaagcgagcgagaataggaancgaatcgacgggcgaggcgcgagagagaggcggaagagatcggcggaagaggcgaaaatatttagcgagaggagataggtaaagacgtagcggttacggtaaagcgagaaatattttatacggtaaggacgcgttttagttagttcggatcgtacgagaggtagaacggggtacgagatcggcgtcgcgcgcgtcggagatagatagtcgatgttaacggttatttaataaatagattatatattaagagtaagagaaagaaggcgnaaagagaggatagtacgttattaat

SEQ ID NO: 28270 - DNA, 524 bp, Artificial Sequence
  chemically treated genomic DNA (Homo sapiens) CpG-island No: 28270
  misc_feature (26)..(26): n is either a, c, g or t
  misc_feature (293)..(293): n is either a, c, g or t
  misc_feature (378)..(378): n is either a, c, g or t
  misc_feature (437)..(437): n is either a, c, g or t
  misc_feature (481)..(481): n is either a, c, g or t
  misc_feature (493)..(493): n is either a, c, g or t
  misc_feature (500)..(500): n is either a, c, g or t
  misc_feature (523)..(523): n is either a, c, g or t
attaataacgtactatcctctctttncgccttctttctcttactcttaatatataatctatttattaaataaccgttaacatcgactatctatctccgacgcgcgcgacgccgatctcgtaccccgttctacctctcgtacgatccgaactaactaaaacgcgtccttaccgtataaaatatttctcgctttaccgtaaccgctacgtctttacctatctcctctcgctaaatattttcgcctcttccgccgatctcttccgcctctctctcgcgcctcgcccgtcgattcgnttcctattctcgctcgctttctctccccccgacgtattcctactctccgcgcgtcgattcgttaatcgatataaattattaactnactcctctttataaatcttaaaccgccgctactaaccgccgacgacgcgcgaaccgcgnaatccgacgaacgaccgaacgaaaaaaaaaaaaacccgcgaccncccgacgcccgnaacgacnaaccgacccgcgcgcgcccgcgna

SEQ ID NO: 28271 - DNA, 524 bp, Artificial Sequence
  chemically treated genomic DNA (Homo sapiens) CpG-island No: 28271
  misc_feature (26)..(26): n is either a, c, g or t
  misc_feature (293)..(293): n is either a, c, g or t
  misc_feature (378)..(378): n is either a, c, g or t
  misc_feature (437)..(437): n is either a, c, g or t
  misc_feature (481)..(481): n is either a, c, g or t
  misc_feature (493)..(493): n is either a, c, g or t
  misc_feature (500)..(500): n is either a, c, g or t
  misc_feature (523)..(523): n is either a, c, g or t
gttgatggcgtgttgttttttttttncgtttttttttttttgtttttggtgtgtggtttgtttgttgggtggtcgttggtatcggttgtttgttttcggcgcgcgcggcgtcggtttcgtgtttcgttttgtttttcgtgcggttcgggttggttggggcgcgtttttgtcgtgtggggtgtttttcgttttgtcgtggtcgttgcgtttttgtttgttttttttcgttgggtgttttcgtttttttcgtcggtttttttcgtttttttttcgcgtttcgttcgtcggttcgntttttgttttcgttcgtttttttttttttcggcgtgtttttgtttttcgcgcgtcggttcgttggtcggtgtgggttgttggttngtttttttttgtgggttttgggtcgtcgttgttggtcgtcggcggcgcgcgggtcgcgnggttcggcgggcggtcgggcggggggggggggggttcgcggttnttcggcgttcgnggcggtnggtcggttcgcgcgcgttcgcgng

SEQ ID NO: 28272 - DNA, 524 bp, Artificial Sequence
  chemically treated genomic DNA (Homo sapiens) CpG-island No: 28272
  misc_feature (2)..(2): n is either a, c, g or t
  misc_feature (25)..(25): n is either a, c, g or t
  misc_feature (32)..(32): n is either a, c, g or t
  misc_feature (44)..(44): n is either a, c, g or t
  misc_feature (88)..(88): n is either a, c, g or t
  misc_feature (147)..(147): n is either a, c, g or t
  misc_feature (232)..(232): n is either a, c, g or t
  misc_feature (499)..(499): n is either a, c, g or t
cncgcgaacgcgcgcgaaccgaccnaccgccncgaacgccgaanaaccgcgaaccccccccccccccgcccgaccgcccgccgaaccncgcgacccgcgcgccgccgacgaccaacaacgacgacccaaaacccacaaaaaaaaacnaaccaacaacccacaccgaccaacgaaccgacgcgcgaaaaacaaaaacacgccgaaaaaaaaaaaaacgaacgaaaacaaaaancgaaccgacgaacgaaacgcgaaaaaaaaacgaaaaaaaccgacgaaaaaaacgaaaacacccaacgaaaaaaaacaaacaaaaacgcaacgaccacgacaaaacgaaaaacaccccacacgacaaaaacgcgccccaaccaacccgaaccgcacgaaaaacaaaacgaaacacgaaaccgacgccgcgcgcgccgaaaacaaacaaccgataccaacgaccacccaacaaacaaaccacacaccaaaaacaaaaaaaaaaaaacgnaaaaaaaaaacaacacgccatcaac

SEQ ID NO: 28273 - DNA, 581 bp, Artificial Sequence
  chemically treated genomic DNA (Homo sapiens) CpG-island No: 28273
ggatttcgtttttgcgttttgtatttcgcgtttcggttcggtttcgtttttgcgcgtagtttcgtattttgacgtttcgtttattgatttttcgttttttgtgtttttttcgcggcgtcgtgtggttacgttttttgtgtttttttttttatacgtttcgtgtagtttcgtattatcgtagcgtagtttcgtttttagttcgttttttaggtttcgtttttagttcgtttttcggtttcgttttcgttttgtttcgtttattttagggttatattttttcggttcggtttcgcgttgcgttaagcgggcggcggcggaggggcgggtttggttggtttggggttcggatttggggtcggagtcgcgggagtcggcggacgttggattaggagtttcgacgtgatcgcgtggcgggtggtcgggttttcgggtgttcgggtgtcggtttcgggattcggtcgtttattgtcgggagtcggattgttatgatgggtttgagtttcggttttcggatcggttcgtttttattgcggtcgttatgtggtgtttgtattgtaattcggagaggatttagttttttt

SEQ ID NO: 28274 - DNA, 581 bp, Artificial Sequence
  chemically treated genomic DNA (Homo sapiens) CpG-island No: 28274
aaaaaaactaaatcctctccgaattacaatacaaacaccacataacgaccgcaataaaaacgaaccgatccgaaaaccgaaactcaaacccatcataacaatccgactcccgacaataaacgaccgaatcccgaaaccgacacccgaacacccgaaaacccgaccacccgccacgcgatcacgtcgaaactcctaatccaacgtccgccgactcccgcgactccgaccccaaatccgaaccccaaaccaaccaaacccgcccctccgccgccgcccgcttaacgcaacgcgaaaccgaaccgaaaaaatataaccctaaaataaacgaaacaaaacgaaaacgaaaccgaaaaacgaactaaaaacgaaacctaaaaaacgaactaaaaacgaaactacgctacgataatacgaaactacacgaaacgtataaaaaaaaaaacacaaaaaacgtaaccacacgacgccgcgaaaaaaacacaaaaaacgaaaaatcaataaacgaaacgtcaaaatacgaaactacgcgcaaaaacgaaaccgaaccgaaacgcgaaatacaaaacgcaaaaacgaaatcc

SEQ ID NO: 28275 - DNA, 581 bp, Artificial Sequence
  chemically treated genomic DNA (Homo sapiens) CpG-island No: 28275
gaagggattgggtttttttcgagttgtagtgtaggtattatatggcggtcgtagtgggagcggatcggttcgggagtcgggatttaggtttattatagtagttcgattttcgatagtgagcggtcggatttcggggtcgatattcggatattcggagattcgattattcgttacgcgattacgtcggggtttttggtttagcgttcgtcggttttcgcggtttcggttttaagttcgagttttaggttagttaagttcgttttttcgtcgtcgttcgtttggcgtagcgcgaggtcgggtcggaggaatgtggttttgaagtgggcggggtagggcgggggcggggtcggagggcgagttgggggcggggtttggagggcgagttgggggcggggttgcgttgcggtggtgcgagattgtacggagcgtgtggggaagagagtataggaggcgtggttatacggcgtcgcggaagaagtatagggggcggggggttagtgggcggggcgttagggtgcggggttacgcgtaggggcggggtcgagtcgaggcgcggggtgtagagcgtaagggcggagttt

SEQ ID NO: 28276 - DNA, 581 bp, Artificial Sequence
  chemically treated genomic DNA (Homo sapiens) CpG-island No: 28276
aaactccgcccttacgctctacaccccgcgcctcgactcgaccccgcccctacgcgtaaccccgcaccctaacgccccgcccactaaccccccgccccctatacttcttccgcgacgccgtataaccacgcctcctatactctcttccccacacgctccgtacaatctcgcaccaccgcaacgcaaccccgcccccaactcgccctccaaaccccgcccccaactcgccctccgaccccgcccccgccctaccccgcccacttcaaaaccacattcctccgacccgacctcgcgctacgccaaacgaacgacgacgaaaaaacgaacttaactaacctaaaactcgaacttaaaaccgaaaccgcgaaaaccgacgaacgctaaaccaaaaaccccgacgtaatcgcgtaacgaataatcgaatctccgaatatccgaatatcgaccccgaaatccgaccgctcactatcgaaaatcgaactactataataaacctaaatcccgactcccgaaccgatccgctcccactacgaccgccatataatacctacactacaactcgaaaaaaacccaatcccttc

SEQ ID NO: 28277 - DNA, 711 bp, Artificial Sequence
  chemically treated genomic DNA (Homo sapiens) CpG-island No: 28277
gtcgcgtgggatagttatttagagcggattacgttagcgtaaagcggagtagtaagtcgtacgcgcggagaagacgatttttagtttagagatatttaaagtataatttttatcgatgtataaagacggagagaggcgagttcgtttacgtcggtggtgcgttatatcgtatagacggagtagtttatttagacgacgagggtataagtttacgatagatagcgatgcgcgaggtatcgcgaaagacgtcgtaaatagaaaagtagcggattacgatagagtattagatcgttttgaacgatagataagattaataattttcggttagagtaatataaatcgagttattttatcgtaatttaagcgtaggtcgttattattatacgtatgtattataacgtaaagtataaataagggcgtagcgaacggaggagataggcgatagacgcgtatttatagtagcgaggaagggtcggaatagggtacgagttttgtgtagatatatacgcgcgattcggaatcgtagggtatttatcgaagaaaacgtagagtagagattaaggagtagtaggagtaagtgagaggtacgtatacgcggagtacggaagttagcgtaaataatataaggaggggcgaaagtatttagagagtaggagcgggagaagcgatataaattttagggagtaatagagagaataattatacgattag

SEQ ID NO: 28278 - DNA, 711 bp, Artificial Sequence
  chemically treated genomic DNA (Homo sapiens) CpG-island No: 28278
ctaatcgtataattattctctctattactccctaaaatttatatcgcttctcccgctcctactctctaaatactttcgcccctccttatattatttacgctaacttccgtactccgcgtatacgtacctctcacttactcctactactccttaatctctactctacgttttcttcgataaataccctacgattccgaatcgcgcgtatatatctacacaaaactcgtaccctattccgacccttcctcgctactataaatacgcgtctatcgcctatctcctccgttcgctacgcccttatttatactttacgttataatacatacgtataataataacgacctacgcttaaattacgataaaataactcgatttatattactctaaccgaaaattattaatcttatctatcgttcaaaacgatctaatactctatcgtaatccgctacttttctatttacgacgtctttcgcgatacctcgcgcatcgctatctatcgtaaacttataccctcgtcgtctaaataaactactccgtctatacgatataacgcaccaccgacgtaaacgaactcgcctctctccgtctttatacatcgataaaaattatactttaaatatctctaaactaaaaatcgtcttctccgcgcgtacgacttactactccgctttacgctaacgtaatccgctctaaataactatcccacgcgac

SEQ ID NO: 28279 - DNA, 711 bp, Artificial Sequence
  chemically treated genomic DNA (Homo sapiens) CpG-island No: 28279
ttggtcgtgtggttattttttttgttgttttttggagtttgtatcgtttttttcgtttttgttttttaggtgttttcgtttttttttgtgttgtttgcgttggttttcgtgtttcgcgtgtgcgtgttttttatttatttttgttattttttggtttttgttttgcgtttttttcggtgggtgttttgcggtttcgagtcgcgcgtgtgtgtttgtatagagttcgtattttgtttcggttttttttcgttgttgtgggtgcgcgtttgtcgtttgtttttttcgttcgttgcgtttttgtttgtgttttgcgttgtagtgtatgcgtgtggtggtggcggtttgcgtttgggttgcggtgggatggttcggtttatgttgttttggtcgagagttattgattttgtttgtcgtttaaagcggtttagtgttttgtcgtggttcgttgtttttttatttgcggcgtttttcgcggtgtttcgcgtatcgttgtttgtcgtgggtttgtgttttcgtcgtttgggtaggttgtttcgtttgtgcggtgtagcgtattatcgacgtggacggattcgttttttttcgtttttgtgtatcggtgggagttgtgttttggatgtttttgggttgggggtcgtttttttcgcgcgtgcggtttgttgtttcgttttgcgttgacgtgattcgttttgagtggttgttttacgcggt

SEQ ID NO: 28280 - DNA, 711 bp, Artificial Sequence
  chemically treated genomic DNA (Homo sapiens) CpG-island No: 28280
accgcgtaaaacaaccactcaaaacgaatcacgtcaacgcaaaacgaaacaacaaaccgcacgcgcgaaaaaaacgacccccaacccaaaaacatccaaaacacaactcccaccgatacacaaaaacgaaaaaaaacgaatccgtccacgtcgataatacgctacaccgcacaaacgaaacaacctacccaaacgacgaaaacacaaacccacgacaaacaacgatacgcgaaacaccgcgaaaaacgccgcaaataaaaaaacaacgaaccacgacaaaacactaaaccgctttaaacgacaaacaaaatcaataactctcgaccaaaacaacataaaccgaaccatcccaccgcaacccaaacgcaaaccgccaccaccacacgcatacactacaacgcaaaacacaaacaaaaacgcaacgaacgaaaaaaacaaacgacaaacgcgcacccacaacaacgaaaaaaaaccgaaacaaaatacgaactctatacaaacacacacgcgcgactcgaaaccgcaaaacacccaccgaaaaaaacgcaaaacaaaaaccaaaaaataacaaaaataaataaaaaacacgcacacgcgaaacacgaaaaccaacgcaaacaacacaaaaaaaaacgaaaacacctaaaaaacaaaaacgaaaaaaacgatacaaactccaaaaaacaacaaaaaaaataaccacacgaccaa

SEQ ID NO: 28281 - DNA, 572 bp, Artificial Sequence
  chemically treated genomic DNA (Homo sapiens) CpG-island No: 28281
cgtttttttgtacgggatcgttcgatcgcgtttttgtagtatttttttttttttttttttgtcgcgggtttttcgttgtttttttttttttttttttatttttcgtgcgtttttcgttttttcgtttttttcgttttcgtttttttttttttcgtcgtttcgtttcgtgttttttttgttgtttttttttttacgttcgttgtcgttttatcggtttggtttcgtgtcggtttttcgcggtcggcgtcgttttcgttgcgttcgttgtttttttcgtttcgtttttttgttttttttttttcgtcgcgtcgcggttttttcgcgttagtttttaggtgtgtttttcgtttttttttttttttttattgtttcgtgcgttcgttttcgtttttttgtttttttcgttttatagtacgcgttatttggtcgttgtcgttgttcgttttacgtttgtttatatttttttcgtttttatttgtcgttttcgttgttttttcgtcgtcgtcgttttttttattgttttcgtttttttcgtgcgtttggtttgttcgtcgttttttttttgttttgcg

SEQ ID NO: 28282 - DNA, 572 bp, Artificial Sequence
  chemically treated genomic DNA (Homo sapiens) CpG-island No: 28282
cgcaaaacaaaaaaaaaacgacgaacaaaccaaacgcacgaaaaaaacgaaaacaataaaaaaaacgacgacgacgaaaaaacaacgaaaacgacaaataaaaacgaaaaaaatataaacaaacgtaaaacgaacaacgacaacgaccaaataacgcgtactataaaacgaaaaaaacaaaaaaacgaaaacgaacgcacgaaacaataaaaaaaaaaaaaaaaacgaaaaacacacctaaaaactaacgcgaaaaaaccgcgacgcgacgaaaaaaaaaaaacaaaaaaacgaaacgaaaaaaacaacgaacgcaacgaaaacgacgccgaccgcgaaaaaccgacacgaaaccaaaccgataaaacgacaacgaacgtaaaaaaaaaaacaacaaaaaaaacacgaaacgaaacgacgaaaaaaaaaaaaacgaaaacgaaaaaaacgaaaaaacgaaaaacgcacgaaaaataaaaaaaaaaaaaaaaaaacaacgaaaaacccgcgacaaaaaaaaaaaaaaaaaaatactacaaaaacgcgatcgaacgatcccgtacaaaaaaacg

SEQ ID NO: 28283 - DNA, 572 bp, Artificial Sequence
  chemically treated genomic DNA (Homo sapiens) CpG-island No: 28283
cgtaggataagagaagaacgacgaatagattagacgtacggaagaggcggaagtagtgaaggaagcggcgacggcgagaaagtagcggaagcggtaagtagaaacgaaggagatgtaagtaaacgtaaagcgagtagcgatagcggttagatagcgcgtgttgtaagacggaaaagatagagggacgagagcgagcgtacggagtaataaaaagaggaaggagaacggagagtatatttgggagttagcgcgggagggtcgcggcgcgacgaaagggagggggtagggaggcggagcggaaggggtagcgaacgtagcgagggcggcgtcgatcgcggaggatcgatacgaggttaggtcggtgaggcgatagcgagcgtaaggagaaggatagtagagggagtacgaggcgaggcgacggaggagaaaagggcggaagcgagagaagcgaggaggcgaaagacgtacgagaagtggaggaaggaaaagaggggtagcgaaggattcgcggtagagggaaaaagagggggatgttgtagagacgcgatcgagcggtttcgtgtaggagggcg

SEQ ID NO: 28284 - DNA, 572 bp, Artificial Sequence
  chemically treated genomic DNA (Homo sapiens) CpG-island No: 28284
cgccctcctacacgaaaccgctcgatcgcgtctctacaacatccccctctttttccctctaccgcgaatccttcgctacccctcttttccttcctccacttctcgtacgtctttcgcctcctcgcttctctcgcttccgcccttttctcctccgtcgcctcgcctcgtactccctctactatccttctccttacgctcgctatcgcctcaccgacctaacctcgtatcgatcctccgcgatcgacgccgccctcgctacgttcgctaccccttccgctccgcctccctaccccctccctttcgtcgcgccgcgaccctcccgcgctaactcccaaatatactctccgttctccttcctctttttattactccgtacgctcgctctcgtccctctatcttttccgtcttacaacacgcgctatctaaccgctatcgctactcgctttacgtttacttacatctccttcgtttctacttaccgcttccgctactttctcgccgtcgccgcttccttcactacttccgcctcttccgtacgtctaatctattcgtcgttcttctcttatcctacg

SEQ ID NO: 28285 - DNA, 607 bp, Artificial Sequence
  chemically treated genomic DNA (Homo sapiens) CpG-island No: 28285
gcgttcgataagtcggtttcgaaagatatggttatttggaatcgtgaacgggttagcgacgtttaggacggtattgtttcgtcgatagttggtgttgatttgtttattttcggttatatttttgcgcgttagtttttgaagtatgttaattagatgtatatcgatattggtgtcgtgttttgcggaaattttacgttggtataggtttaaggtggtgtttatgcgtaaattatttcgtcgtaagtgtaaagtatgcggtgaatatttcgtgtcgaaattttacgatattcggattcggtggtgtagttcggagtatggcgtaattttcgtaatggaagaacgtaagaaggataacgtgaaagtcgcggttaagcgtattaaggagtaaaaagaggttgaaaaggacgggcgtaaacgtcgtaaggagcggttggtagagtttaggttagacggatattataaggtttaggtttagaaagtttttaacgtttttattcgtgcgcgcgacgtcgatttgttatgtattagttgcggcgagattaattcgtttgatttgtatggtggttagtgggattgcggttattttaagatagtaggtgtttatttt

SEQ ID NO: 28286 - DNA, 607 bp, Artificial Sequence
  chemically treated genomic DNA (Homo sapiens) CpG-island No: 28286
aaaataaacacctactatcttaaaataaccgcaatcccactaaccaccatacaaatcaaacgaattaatctcgccgcaactaatacataacaaatcgacgtcgcgcgcacgaataaaaacgttaaaaactttctaaacctaaaccttataatatccgtctaacctaaactctaccaaccgctccttacgacgtttacgcccgtccttttcaacctctttttactccttaatacgcttaaccgcgactttcacgttatccttcttacgttcttccattacgaaaattacgccatactccgaactacaccaccgaatccgaatatcgtaaaatttcgacacgaaatattcaccgcatactttacacttacgacgaaataatttacgcataaacaccaccttaaacctataccaacgtaaaatttccgcaaaacacgacaccaatatcgatatacatctaattaacatacttcaaaaactaacgcgcaaaaatataaccgaaaataaacaaatcaacaccaactatcgacgaaacaataccgtcctaaacgtcgctaacccgttcacgattccaaataaccatatctttcgaaaccgacttatcgaacgc

SEQ ID NO: 28287 - DNA, 607 bp, Artificial Sequence
  chemically treated genomic DNA (Homo sapiens) CpG-island No: 28287
agggtaagtatttattgttttgaaatggtcgtaattttattggttattatgtagattaggcggattggtttcgtcgtagttgatgtatggtaaatcggcgtcgcgcgtacggataaaggcgttgaaagttttttgagtttgagttttgtagtattcgtttggtttgagttttgttagtcgttttttgcggcgtttgcgttcgttttttttagtttttttttgttttttgatgcgtttagtcgcggtttttacgttgttttttttgcgtttttttattgcgaggattgcgttatgtttcgggttgtattatcggattcggatgtcgtggaatttcggtacgaagtatttatcgtatattttgtatttacggcgggatggtttacgtatgggtattattttgaatttgtattagcgtgaggttttcgtagaatacggtattagtatcgatgtatatttggttggtatattttaggggttggcgcgtaggggtgtggtcgaagataaatagattagtattagttatcggcgagataatgtcgttttgagcgtcgttaattcgtttacgattttagatgattatgtttttcgggatcggtttgtcgaacgt

SEQ ID NO: 28288 - DNA, 607 bp, Artificial Sequence
  chemically treated genomic DNA (Homo sapiens) CpG-island No: 28288
acgttcgacaaaccgatcccgaaaaacataatcatctaaaatcgtaaacgaattaacgacgctcaaaacgacattatctcgccgataactaatactaatctatttatcttcgaccacacccctacgcgccaacccctaaaatataccaaccaaatatacatcgatactaataccgtattctacgaaaacctcacgctaatacaaattcaaaataatacccatacgtaaaccatcccgccgtaaatacaaaatatacgataaatacttcgtaccgaaattccacgacatccgaatccgataatacaacccgaaacataacgcaatcctcgcaataaaaaaacgcaaaaaaaacaacgtaaaaaccgcgactaaacgcatcaaaaaacaaaaaaaaactaaaaaaaacgaacgcaaacgccgcaaaaaacgactaacaaaactcaaaccaaacgaatactacaaaactcaaactcaaaaaactttcaacgcctttatccgtacgcgcgacgccgatttaccatacatcaactacgacgaaaccaatccgcctaatctacataataaccaataaaattacgaccatttcaaaacaataaatacttaccct

SEQ ID NO: 28289 - DNA, 943 bp, Artificial Sequence
  chemically treated genomic DNA (Homo sapiens) CpG-island No: 28289
tcggcgttacgtgttgtttatggttattacgcgtatcggtttttcgttcgtgggcgagttttttaattagtagggtaatattttttattttttcgagtcgttgtggtatatcgagcgtatagtgtttttcgagtcggggggcgttaacgtcgcgggttcggttttggtgtatcgcgacgtgtttaagtagttttttttgtgcgatttgtacgtgttggagtattttattacgtcgttgttcgaggattatttgatttagtttatgtttcgtcggggttttagtcgttttttgtgcgaggatttcgtttgtacgtttttcgttaagaaggttttcgagaagtattattgtaagaatcgtcgttgcggtttttttaacgtgacgttggtcgtagaggtttgtcgtcgtaaggagtatatggtttttaaggcggtgcgtattcggtagttggagtttttgtagtcgttggtcgaggattttcgtttggatttgcgcgttatttagttggtgcgcgattttcgggtcgtgttggtttcgcgtatggtggttttcgtcggtaagtataagatttggaagaagtggttggacgacgagggttaggacggtttgagggaagaggaggtgtagcggttgcggggtaattgcgagagtattcgtttgttcgcggagttggggttgcggtagttcgtttggttgcggggtcgttatatgttggtgcgttacgaggacgtggtacgcgggtcgttgtagaaggttcgcgagatgtatcgtttcgtcggtatttttttgatttcgtaggtggaagattggatttaaaagaatacgtaggcggtttacgacggtagcggtatttattttacgtagaagaatttttcggagtagttcgagaagtggcgttttagtatgttttttaagttggtttaggtggtgtaggtcgtttgcggt

SEQ ID NO: 28290 - DNA, 943 bp, Artificial Sequence
  chemically treated genomic DNA (Homo sapiens) CpG-island No: 28290
accgcaaacgacctacaccacctaaaccaacttaaaaaacatactaaaacgccacttctcgaactactccgaaaaattcttctacgtaaaataaataccgctaccgtcgtaaaccgcctacgtattcttttaaatccaatcttccacctacgaaatcaaaaaaataccgacgaaacgatacatctcgcgaaccttctacaacgacccgcgtaccacgtcctcgtaacgcaccaacatataacgaccccgcaaccaaacgaactaccgcaaccccaactccgcgaacaaacgaatactctcgcaattaccccgcaaccgctacacctcctcttccctcaaaccgtcctaaccctcgtcgtccaaccacttcttccaaatcttatacttaccgacgaaaaccaccatacgcgaaaccaacacgacccgaaaatcgcgcaccaactaaataacgcgcaaatccaaacgaaaatcctcgaccaacgactacaaaaactccaactaccgaatacgcaccgccttaaaaaccatatactccttacgacgacaaacctctacgaccaacgtcacgttaaaaaaaccgcaacgacgattcttacaataatacttctcgaaaaccttcttaacgaaaaacgtacaaacgaaatcctcgcacaaaaaacgactaaaaccccgacgaaacataaactaaatcaaataatcctcgaacaacgacgtaataaaatactccaacacgtacaaatcgcacaaaaaaaactacttaaacacgtcgcgatacaccaaaaccgaacccgcgacgttaacgccccccgactcgaaaaacactatacgctcgatataccacaacgactcgaaaaaataaaaaatattaccctactaattaaaaaactcgcccacgaacgaaaaaccgatacgcgtaataaccataaacaacacgtaacgccga

SEQ ID NO: 28291 - DNA, 943 bp, Artificial Sequence
  chemically treated genomic DNA (Homo sapiens) CpG-island No: 28291
gtcgtaggcggtttgtattatttgggttagtttgaagggtatgttgaagcgttatttttcgaattgtttcgaggagtttttttgcgtggagtagatgtcgttgtcgtcgtgggtcgtttgcgtgtttttttggatttagttttttatttgcggggttagggggatgtcggcgaagcggtatatttcgcgggttttttgtagcggttcgcgtgttacgttttcgtagcgtattagtatgtagcggtttcgtagttaggcgggttgtcgtagttttagtttcgcggataggcggatgttttcgtagttgtttcgtagtcgttgtattttttttttttttaggtcgttttggttttcgtcgtttagttattttttttaggttttatatttgtcggcgaaggttattatgcgcgaggttagtacggttcgggggtcgcgtattagttggatgacgcgtaggtttaggcgggggttttcggttagcggttgtaggaattttagttgtcggatgcgtatcgttttgagggttatgtgttttttgcggcggtaggtttttgcggttagcgttacgttgagggggtcgtagcggcggtttttgtagtggtatttttcgaagatttttttgacgaagggcgtatagacggggttttcgtatagggagcggttggagtttcggcggaatatgaattgagttaggtggttttcgggtagcggcgtgatgaagtgttttagtacgtataggtcgtataggaagagttgtttgagtacgtcgcggtatattagggtcgagttcgcggcgttggcgtttttcggttcgaaggatattgtgcgttcgatgtgttatagcggttcgaagaggtagaagatgttgttttgttggttgaagaattcgtttacgaacgaggagtcggtgcgcgtggtggttatgagtagtacgtggcgtcgg

SEQ ID NO: 28292 - DNA, 943 bp, Artificial Sequence
  chemically treated genomic DNA (Homo sapiens) CpG-island No: 28292
ccgacgccacgtactactcataaccaccacgcgcaccgactcctcgttcgtaaacgaattcttcaaccaacaaaacaacatcttctacctcttcgaaccgctataacacatcgaacgcacaatatccttcgaaccgaaaaacgccaacgccgcgaactcgaccctaatataccgcgacgtactcaaacaactcttcctatacgacctatacgtactaaaacacttcatcacgccgctacccgaaaaccacctaactcaattcatattccgccgaaactccaaccgctccctatacgaaaaccccgtctatacgcccttcgtcaaaaaaatcttcgaaaaataccactacaaaaaccgccgctacgaccccctcaacgtaacgctaaccgcaaaaacctaccgccgcaaaaaacacataaccctcaaaacgatacgcatccgacaactaaaattcctacaaccgctaaccgaaaacccccgcctaaacctacgcgtcatccaactaatacgcgacccccgaaccgtactaacctcgcgcataataaccttcgccgacaaatataaaacctaaaaaaaataactaaacgacgaaaaccaaaacgacctaaaaaaaaaaaaaatacaacgactacgaaacaactacgaaaacatccgcctatccgcgaaactaaaactacgacaacccgcctaactacgaaaccgctacatactaatacgctacgaaaacgtaacacgcgaaccgctacaaaaaacccgcgaaatataccgcttcgccgacatccccctaaccccgcaaataaaaaactaaatccaaaaaaacacgcaaacgacccacgacgacaacgacatctactccacgcaaaaaaactcctcgaaacaattcgaaaaataacgcttcaacatacccttcaaactaacccaaataatacaaaccgcctacgac

SEQ ID NO: 28293 - DNA, 553 bp, Artificial Sequence
  chemically treated genomic DNA (Homo sapiens) CpG-island No: 28293
cgcgatttatttttcgttagttatcggaggtagatcgcgggaggagagttgaggatagtcgcgtgcgtttcgttagtagcggggtgggaggaaggatattaaaatattgtagaagttaagatttttttaggtcgaatttagattacgatgcgcgtttcgggttgcgggcggttggtgttgtcgttgttgtttttggtcgcggtagttttggtcgaaggcgacgttaaggggtttaaggagggcgagattttcggtaattttatggaggacgagtaatggttgtcgtttatttcgtagtatagcggtaagattaagtattggaatcgttttcgagacgtgagttcgtagggttgttaaggtagagattcggggttgcgggttcggggattgagtttcggggtttgcgggagcggtcgtcgtacgtcgtagttcgaggtttcgtagtttgttcggttaattatacggtaagtaaatagtattgggggttatagtttagcgttttttttttgttcgtgcggttcgggtcggcggttttgggattttttagtttcgg

SEQ ID NO: 28294 - DNA, 553 bp, Artificial Sequence
  chemically treated genomic DNA (Homo sapiens) CpG-island No: 28294
ccgaaactaaaaaatcccaaaaccgccgacccgaaccgcacgaacaaaaaaaaaacgctaaactataacccccaatactatttacttaccgtataattaaccgaacaaactacgaaacctcgaactacgacgtacgacgaccgctcccgcaaaccccgaaactcaatccccgaacccgcaaccccgaatctctaccttaacaaccctacgaactcacgtctcgaaaacgattccaatacttaatcttaccgctatactacgaaataaacgacaaccattactcgtcctccataaaattaccgaaaatctcgccctccttaaaccccttaacgtcgccttcgaccaaaactaccgcgaccaaaaacaacaacgacaacaccaaccgcccgcaacccgaaacgcgcatcgtaatctaaattcgacctaaaaaaatcttaacttctacaatattttaatatccttcctcccaccccgctactaacgaaacgcacgcgactatcctcaactctcctcccgcgatctacctccgataactaacgaaaaataaatcgcg

SEQ ID NO: 28295 - DNA, 553 bp, Artificial Sequence
  chemically treated genomic DNA (Homo sapiens) CpG-island No: 28295
tcggggttggggggttttagggtcgtcggttcgggtcgtacggataggggaggggcgttgggttgtgatttttagtattgtttatttgtcgtgtaattagtcgggtaggttgcggagtttcggattgcgacgtgcggcggtcgttttcgtagatttcggagtttaattttcgaattcgtaatttcgggtttttgttttggtagttttgcggatttacgtttcggaagcggttttagtgtttgattttgtcgttgtattgcgagatggacgatagttattgttcgttttttatgaaattgtcgggggtttcgttttttttgagttttttggcgtcgttttcggttagggttgtcgcggttaggagtagtagcggtagtattagtcgttcgtagttcggggcgcgtatcgtggtttgggttcgatttgggggggttttgatttttgtagtattttaatgtttttttttttatttcgttgttggcgaagcgtacgcggttgtttttagtttttttttcgcggtttgttttcggtgattggcggagagtgggtcgcg

SEQ ID NO: 28296 - DNA, 553 bp, Artificial Sequence
  chemically treated genomic DNA (Homo sapiens) CpG-island No: 28296
cgcgacccactctccgccaatcaccgaaaacaaaccgcgaaaaaaaaactaaaaacaaccgcgtacgcttcgccaacaacgaaataaaaaaaaaaacattaaaatactacaaaaatcaaaacccccccaaatcgaacccaaaccacgatacgcgccccgaactacgaacgactaatactaccgctactactcctaaccgcgacaaccctaaccgaaaacgacgccaaaaaactcaaaaaaaacgaaacccccgacaatttcataaaaaacgaacaataactatcgtccatctcgcaatacaacgacaaaatcaaacactaaaaccgcttccgaaacgtaaatccgcaaaactaccaaaacaaaaacccgaaattacgaattcgaaaattaaactccgaaatctacgaaaacgaccgccgcacgtcgcaatccgaaactccgcaacctacccgactaattacacgacaaataaacaatactaaaaatcacaacccaacgcccctcccctatccgtacgacccgaaccgacgaccctaaaaccccccaaccccga

SEQ ID NO: 28297 - DNA, 558 bp, Artificial Sequence
  chemically treated genomic DNA (Homo sapiens) CpG-island No: 28297
ttacggcgcgggtaaggagaaggaagcgacgagtatcgaggcgtcgcgatttaagggattagtatatcgtcgattattaggcgtttaatgaataatacgattttttggattatcggagcgagtaatcggtgtttattttagtattatcgataatgattttatttttaatcgtttttttttttttcggttattattcggtgttttcggataggggtaaagggacggcgagtcggggagtgaggagttgtttttagttagtgcgatttcgggacgcggacgtttaatttagttttattatgtttatatgtagggttgttggcggttgcggttggggtcggggtcggggatttataggttcgggtgtcgtggtgcggggtggggatagttaattatagcgggagacggaggaagttgggggtagttgggtgcgtgttttgtatcgtttatttgtcggggttcggtttttggcggtgggcgagagggagtatattcgtttatattttaggaatttgttggggagatgagttcgtggggttagaaagaagggaaaaatttttt

SEQ ID NO: 28298 - DNA, 558 bp, Artificial Sequence
  chemically treated genomic DNA (Homo sapiens) CpG-island No: 28298
aaaaaatttttcccttctttctaaccccacgaactcatctccccaacaaattcctaaaatataaacgaatatactccctctcgcccaccgccaaaaaccgaaccccgacaaataaacgatacaaaacacgcacccaactacccccaacttcctccgtctcccgctataattaactatccccaccccgcaccacgacacccgaacctataaatccccgaccccgaccccaaccgcaaccgccaacaaccctacatataaacataataaaactaaattaaacgtccgcgtcccgaaatcgcactaactaaaaacaactcctcactccccgactcgccgtccctttacccctatccgaaaacaccgaataataaccgaaaaaaaaaaaaacgattaaaaataaaatcattatcgataatactaaaataaacaccgattactcgctccgataatccaaaaaatcgtattattcattaaacgcctaataatcgacgatatactaatcccttaaatcgcgacgcctcgatactcgtcgcttccttctccttacccgcgccgtaa

SEQ ID NO: 28299 - DNA, 558 bp, Artificial Sequence
  chemically treated genomic DNA (Homo sapiens) CpG-island No: 28299
aaaggattttttttttttttttgattttacgaatttatttttttaataggtttttaaagtatgggcggatgtgttttttttcgtttatcgttaggagtcgagtttcggtaggtgagcggtgtaaaatacgtatttagttgtttttagtttttttcgtttttcgttgtagttggttgtttttatttcgtattacggtattcgagtttgtgagttttcgatttcggttttagtcgtagtcgttaataattttatatataaatatagtaggattggattgagcgttcgcgtttcggagtcgtattggttgggggtaattttttatttttcggttcgtcgtttttttgtttttattcgagagtatcgggtagtagtcgagggaagggaaggcggttaggggtaaggttattgtcggtgatgttagggtaggtatcggttgttcgtttcggtagtttaggaagtcgtgttgtttattggacgtttagtagtcggcggtgtgttggttttttaggtcgcggcgtttcggtgttcgtcgtttttttttttttgttcgcgtcgtgg

SEQ ID NO: 28300 - DNA, 558 bp, Artificial Sequence
  chemically treated genomic DNA (Homo sapiens) CpG-island No: 28300
ccacgacgcgaacaaaaaaaaaaaaacgacgaacaccgaaacgccgcgacctaaaaaaccaacacaccgccgactactaaacgtccaataaacaacacgacttcctaaactaccgaaacgaacaaccgatacctaccctaacatcaccgacaataaccttacccctaaccgccttcccttccctcgactactacccgatactctcgaataaaaacaaaaaaacgacgaaccgaaaaataaaaaattacccccaaccaatacgactccgaaacgcgaacgctcaatccaatcctactatatttatatataaaattattaacgactacgactaaaaccgaaatcgaaaactcacaaactcgaataccgtaatacgaaataaaaacaaccaactacaacgaaaaacgaaaaaaactaaaaacaactaaatacgtattttacaccgctcacctaccgaaactcgactcctaacgataaacgaaaaaaaacacatccgcccatactttaaaaacctattaaaaaaataaattcgtaaaatcaaaaaaaaaaaaaaaatccttt

SEQ ID NO: 28301 - DNA, 506 bp, Artificial Sequence
  chemically treated genomic DNA (Homo sapiens) CpG-island No: 28301
  misc_feature (445)..(445): n is either a, c, g or t
  misc_feature (495)..(496): n is either a, c, g or t
ttcgcgtacgtagcggtttcggttcgttggtacgtcgtagtgtgattgtagatagagtagcggcgcgtagtcgcggcggcgttatttcgcgcgttttatgggcggaggtatcgggcggcgtagataggcggtttcgggtagttattgtagcgatagcgggtaattcgagtggcgattgaaggtggaggtaagattgaagaggcggatgttcgggtcgggtttagtaagaagttgttgaggggcgatttttcgtggaggagcgtttagttttggtgcgttaggcgcggtagcggggcggtcgacgcgcggaagtttgtgtcgtagaagagtagcgcgcgcgttcgcgagttttttagcgttcggcggtttcgggacgttacgtacgcgtcgcgcgtatattcgatgcgtttcgagtttttcgggaagtgggggaatagttttgggnttttattatagtagtatcggtaagtttttcgttttttttttttttttggnntcgcggcgtt

SEQ ID NO: 28302 - DNA, 506 bp, Artificial Sequence
  chemically treated genomic DNA (Homo sapiens) CpG-island No: 28302
  misc_feature (11)..(12): n is either a, c, g or t
  misc_feature (62)..(62): n is either a, c, g or t
aacgccgcgannccaaaaaaaaaaaaaaaacgaaaaacttaccgatactactataataaaancccaaaactattcccccacttcccgaaaaactcgaaacgcatcgaatatacgcgcgacgcgtacgtaacgtcccgaaaccgccgaacgctaaaaaactcgcgaacgcgcgcgctactcttctacgacacaaacttccgcgcgtcgaccgccccgctaccgcgcctaacgcaccaaaactaaacgctcctccacgaaaaatcgcccctcaacaacttcttactaaacccgacccgaacatccgcctcttcaatcttacctccaccttcaatcgccactcgaattacccgctatcgctacaataactacccgaaaccgcctatctacgccgcccgatacctccgcccataaaacgcgcgaaataacgccgccgcgactacgcgccgctactctatctacaatcacactacgacgtaccaacgaaccgaaaccgctacgtacgcgaa

SEQ ID NO: 28303 - DNA, 506 bp, Artificial Sequence
  chemically treated genomic DNA (Homo sapiens) CpG-island No: 28303
  misc_feature (11)..(12): n is either a, c, g or t
  misc_feature (62)..(62): n is either a, c, g or t
gacgtcgcggnnttagggagggaaggaaggcgggggatttgtcggtattgttgtggtggagntttagggttatttttttatttttcgggagattcggagcgtatcgagtgtgcgcgcggcgcgtgcgtggcgtttcggaatcgtcgagcgttgagggattcgcggacgcgcgcgttgtttttttacggtatagattttcgcgcgtcggtcgtttcgttgtcgcgtttggcgtattagagttgggcgtttttttacgaggagtcgttttttaataattttttgttgagttcggttcgggtattcgtttttttaattttatttttatttttagtcgttattcggattattcgttgtcgttgtagtggttgttcgggatcgtttatttgcgtcgttcggtgttttcgtttatggaacgcgcggagtggcgtcgtcgcggttacgcgtcgttgttttatttgtagttatattgcgacgtgttagcggatcgggatcgttacgtgcgcgag

SEQ ID NO: 28304 - DNA, 506 bp, Artificial Sequence
  chemically treated genomic DNA (Homo sapiens) CpG-island No: 28304
  misc_feature (445)..(445): n is either a, c, g or t
  misc_feature (495)..(496): n is either a, c, g or t
ctcgcgcacgtaacgatcccgatccgctaacacgtcgcaatataactacaaataaaacaacgacgcgtaaccgcgacgacgccactccgcgcgttccataaacgaaaacaccgaacgacgcaaataaacgatcccgaacaaccactacaacgacaacgaataatccgaataacgactaaaaataaaaataaaattaaaaaaacgaatacccgaaccgaactcaacaaaaaattattaaaaaacgactcctcgtaaaaaaacgcccaactctaatacgccaaacgcgacaacgaaacgaccgacgcgcgaaaatctataccgtaaaaaaacaacgcgcgcgtccgcgaatccctcaacgctcgacgattccgaaacgccacgcacgcgccgcgcgcacactcgatacgctccgaatctcccgaaaaataaaaaaataaccctaaanctccaccacaacaataccgacaaatcccccgccttccttccctccctaannccgcgacgtc

SEQ ID NO: 28305 - DNA, 1127 bp, Artificial Sequence
  chemically treated genomic DNA (Homo sapiens) CpG-island No: 28305
  misc_feature (352)..(352): n is either a, c, g or t
  misc_feature (931)..(931): n is either a, c, g or t
aggggcgtgagttggttcggttttcgggggaattgggggtttggggttgtttgtgagtggagagggtttgcgggattcggtaggcgggcggggggttgggttttgaggcggcgttgatggggtggttcgggggcggtttttgtgggggaggggtttggggggggcgggtgcgaggaatttgcgtttttgggaggggcgtttgtgggggggttgtcgtagagggggtttgagtgtttgtggggcgcgaacgcggttgggttttgggagaagtcgggcgtggttggtttgcgttgagcgttcgaaggaggagagtttggcgcgaggaggaggttttgtgtgcggcgtcgaaggncggttagatattggggtggtgcggcgttgtgagagagggtggagggattttcgtgcggtggaagaagagagtgcgcgcgcggaaggggtttgttagagttgttgtcgatagaggcgaggaagtgggtttttttgtgggggagagcgtgtttgatgtgttgaggaggtggagaaaatttgtgtggggcgggttgttgggggagaggcgacgtgttgtggggtcggggtgaaggggttgtgttatggcggaggtcgtgtgtgtttgtgcgcgcgcgattttggtcggtcgggcggcgttggagaaggatagattgtttcgcggttgaaagcggttcgatgtgttgtttttgcgggggggttttgtgtcgcgaggaggggttgttttgtcgagagcggcgataagtttcgcgttgtagggggggggcggggaagggaggagcgtgtcgtgcgtgtgggttttttgtggaggagacggttgagaatacgtgaggaaaagataggcgcgtcgtcgttgtgaggtggtgtcgcggtacgaatttttgggggggggtgttgtttgaagaggcggggttttgttggnttgatggagagtgtttcgtttcgtagaggggcgagcggttttttttttttgcgagcgtggggggttgcgcgattgtcggtcgtcggttgatgattgtcgtgaagaggatgtttgacggggttgtttgtgtgagaaggaggtgtgttggcggggggggagtggttgttgcgtgcgaaggagagacggtacggggggt

SEQ ID NO: 28306 - DNA, 1127 bp, Artificial Sequence
  chemically treated genomic DNA (Homo sapiens) CpG-island No: 28306
  misc_feature (197)..(197): n is either a, c, g or t
  misc_feature (776)..(776): n is either a, c, g or t
accccccgtaccgtctctccttcgcacgcaacaaccactccccccccgccaacacacctccttctcacacaaacaaccccgtcaaacatcctcttcacgacaatcatcaaccgacgaccgacaatcgcgcaaccccccacgctcgcaaaaaaaaaaaaccgctcgcccctctacgaaacgaaacactctccatcaanccaacaaaaccccgcctcttcaaacaacacccccccccaaaaattcgtaccgcgacaccacctcacaacgacgacgcgcctatcttttcctcacgtattctcaaccgtctcctccacaaaaaacccacacgcacgacacgctcctcccttccccgccccccccctacaacgcgaaacttatcgccgctctcgacaaaacaacccctcctcgcgacacaaaacccccccgcaaaaacaacacatcgaaccgctttcaaccgcgaaacaatctatccttctccaacgccgcccgaccgaccaaaatcgcgcgcgcacaaacacacacgacctccgccataacacaaccccttcaccccgaccccacaacacgtcgcctctcccccaacaacccgccccacacaaattttctccacctcctcaacacatcaaacacgctctcccccacaaaaaaacccacttcctcgcctctatcgacaacaactctaacaaaccccttccgcgcgcgcactctcttcttccaccgcacgaaaatccctccaccctctctcacaacgccgcaccaccccaatatctaaccgnccttcgacgccgcacacaaaacctcctcctcgcgccaaactctcctccttcgaacgctcaacgcaaaccaaccacgcccgacttctcccaaaacccaaccgcgttcgcgccccacaaacactcaaaccccctctacgacaacccccccacaaacgcccctcccaaaaacgcaaattcctcgcacccgccccccccaaacccctcccccacaaaaaccgcccccgaaccaccccatcaacgccgcctcaaaacccaaccccccgcccgcctaccgaatcccgcaaaccctctccactcacaaacaaccccaaacccccaattcccccgaaaaccgaaccaactcacgcccct

SEQ ID NO: 28307 - DNA, 1127 bp, Artificial Sequence
  chemically treated genomic DNA (Homo sapiens) CpG-island No: 28307
  misc_feature (197)..(197): n is either a, c, g or t
  misc_feature (776)..(776): n is either a, c, g or t
gtttttcgtgtcgtttttttttcgtacgtaataattatttttttttcgttagtatattttttttttatataaatagtttcgttaaatattttttttacgataattattaatcgacgatcgataatcgcgtagttttttacgttcgtaaaaaaaaaagatcgttcgtttttttgcgaggcgaagtattttttattaanttaatagagtttcgtttttttaaataatatttttttttaaaaattcgtgtcgcggtattattttataacgacgacgcgtttgttttttttttacgtatttttagtcgttttttttatagaaaatttatacgtacgatacgtttttttttttttcgttttttttttatagcgcggagtttatcgtcgttttcgatagaatagttttttttcgcggtataaaattttttcgtagaaataatatatcgagtcgtttttagtcgcggaataatttgtttttttttagcgtcgttcggtcgattaagatcgcgcgcgtataaatatatacggttttcgttatggtatagtttttttatttcgattttataatacgtcgttttttttttaataattcgttttatataaattttttttatttttttaatatattaaatacgtttttttttataaagaggtttattttttcgtttttgtcggtagtagttttaataaatttttttcgcgcgcgtattttttttttttatcgtacgggagtttttttatttttttttataacgtcgtattattttaatatttggtcgnttttcggcgtcgtatataaaatttttttttcgcgttaaatttttttttttcgagcgtttagcgtaaattaattacgttcggttttttttagaatttaatcgcgttcgcgttttataggtatttagattttttttgcgataatttttttataggcgttttttttaaaggcgtaaatttttcgtattcgttttttttaagttttttttttataaaagtcgttttcgggttattttattagcgtcgttttaaaatttaatttttcgttcgtttgtcgaatttcgtaggttttttttatttataagtaattttaaatttttaattttttcgaaaatcggattaatttacgttttt

SEQ ID NO: 28308 - DNA, 1127 bp, Artificial Sequence
  chemically treated genomic DNA (Homo sapiens) CpG-island No: 28308
  misc_feature (352)..(352): n is either a, c, g or t
  misc_feature (931)..(931): n is either a, c, g or t
aaaaacgtaaattaatccgattttcgaaaaaattaaaaatttaaaattacttataaataaaaaaaacctacgaaattcgacaaacgaacgaaaaattaaattttaaaacgacgctaataaaataacccgaaaacgacttttataaaaaaaaaacttaaaaaaaacgaatacgaaaaatttacgcctttaaaaaaaacgcctataaaaaaattatcgcaaaaaaaatctaaatacctataaaacgcgaacgcgattaaattctaaaaaaaaccgaacgtaattaatttacgctaaacgctcgaaaaaaaaaaatttaacgcgaaaaaaaaattttatatacgacgccgaaaancgaccaaatattaaaataatacgacgttataaaaaaaaataaaaaaactcccgtacgataaaaaaaaaaaatacgcgcgcgaaaaaaatttattaaaactactaccgacaaaaacgaaaaaataaacctctttataaaaaaaaacgtatttaatatattaaaaaaataaaaaaaatttatataaaacgaattattaaaaaaaaaacgacgtattataaaatcgaaataaaaaaactataccataacgaaaaccgtatatatttatacgcgcgcgatcttaatcgaccgaacgacgctaaaaaaaaacaaattattccgcgactaaaaacgactcgatatattatttctacgaaaaaattttataccgcgaaaaaaaactattctatcgaaaacgacgataaactccgcgctataaaaaaaaaacgaaaaaaaaaaaaacgtatcgtacgtataaattttctataaaaaaaacgactaaaaatacgtaaaaaaaaaacaaacgcgtcgtcgttataaaataataccgcgacacgaatttttaaaaaaaaatattatttaaaaaaacgaaactctattaanttaataaaaaatacttcgcctcgcaaaaaaacgaacgatcttttttttttacgaacgtaaaaaactacgcgattatcgatcgtcgattaataattatcgtaaaaaaaatatttaacgaaactatttatataaaaaaaaaatatactaacgaaaaaaaaataattattacgtacgaaaaaaaaacgacacgaaaaac

SEQ ID NO: 28309 - DNA, 536 bp, Artificial Sequence
  chemically treated genomic DNA (Homo sapiens) CpG-island No: 28309
  misc_feature (222)..(222): n is either a, c, g or t
tttttttttttttttacgtttttttttgataaggtttgagtggcgggcgagacgagggttgggcggggtttttcgtttttcgggcggggtgttatttttaggtttcgcgagtattttcgggtcgttagtttagttttgcggtttttgcggcggttggagaggtggtcggagaagtaggaattttttgtcgggttcgtggcggtttttgttcgtttcgggggnggaagcgttttttttatagggagtgtgttatagagggtagggttaaggagggaaatatagtcgcgttttttttcgttttttcggagtcggagtgcgttggtggggtagtttttgaggttttttcgtttttgggatttgttcgttatcgatcgttgtcggtaaagtttcgcggcggtatcggagaagggcggcgaggcggcggtgatggtcgcgtttcgtggcgggaggttcgtcgtttatagggcgtttatagaatttatttaggggaggtttttagtttattatcgtatttttagttaggtgaatgttttaaa

SEQ ID NO: 28310 - DNA, 536 bp, Artificial Sequence
  chemically treated genomic DNA (Homo sapiens) CpG-island No: 28310
  misc_feature (315)..(315): n is either a, c, g or t
tttaaaacattcacctaactaaaaatacgataataaactaaaaacctcccctaaataaattctataaacgccctataaacgacgaacctcccgccacgaaacgcgaccatcaccgccgcctcgccgcccttctccgataccgccgcgaaactttaccgacaacgatcgataacgaacaaatcccaaaaacgaaaaaacctcaaaaactaccccaccaacgcactccgactccgaaaaaacgaaaaaaaacgcgactatatttccctccttaaccctaccctctataacacactccctataaaaaaaacgcttccncccccgaaacgaacaaaaaccgccacgaacccgacaaaaaattcctacttctccgaccacctctccaaccgccgcaaaaaccgcaaaactaaactaacgacccgaaaatactcgcgaaacctaaaaataacaccccgcccgaaaaacgaaaaaccccgcccaaccctcgtctcgcccgccactcaaaccttatcaaaaaaaaacgtaaaaaaaaaaaaaaa

SEQ ID NO: 28311 - DNA, 536 bp, Artificial Sequence
  chemically treated genomic DNA (Homo sapiens) CpG-island No: 28311
  misc_feature (315)..(315): n is either a, c, g or t
tttaagatatttatttggttgaaaatacggtggtgggttgaagattttttttaggtgggttttgtgggcgttttgtgaacgacgagtttttcgttacgggacgcgattattatcgtcgtttcgtcgttttttttcggtgtcgtcgcggggttttgtcggtaacggtcggtaacgggtagattttaggagcgaaagggttttagagattattttattaacgtatttcgatttcgggggggcggaagagagcgcggttgtgtttttttttttaattttgttttttataatatattttttgtggggaaggcgtttttnttttcggagcggatagaagtcgttacgagttcggtaggaggtttttattttttcgattatttttttagtcgtcgtagaaatcgtagaattgagttgacgattcggaagtgttcgcggaatttggaagtgatatttcgttcgagggacgggaggtttcgtttagttttcgtttcgttcgttatttaagttttgttagggaagggcgtggagagggaaggagg

SEQ ID NO: 28312 - DNA, 536 bp, Artificial Sequence
  chemically treated genomic DNA (Homo sapiens) CpG-island No: 28312
  misc_feature (222)..(222): n is either a, c, g or t
cctccttccctctccacgcccttccctaacaaaacttaaataacgaacgaaacgaaaactaaacgaaacctcccgtccctcgaacgaaatatcacttccaaattccgcgaacacttccgaatcgtcaactcaattctacgatttctacgacgactaaaaaaataatcgaaaaaataaaaacctcctaccgaactcgtaacgacttctatccgctccgaaaanaaaaacgccttccccacaaaaaatatattataaaaaacaaaattaaaaaaaaaaacacaaccgcgctctcttccgcccccccgaaatcgaaatacgttaataaaataatctctaaaaccctttcgctcctaaaatctacccgttaccgaccgttaccgacaaaaccccgcgacgacaccgaaaaaaaacgacgaaacgacgataataatcgcgtcccgtaacgaaaaactcgtcgttcacaaaacgcccacaaaacccacctaaaaaaaatcttcaacccaccaccgtattttcaaccaaataaatatcttaaa

SEQ ID NO: 28313 - DNA, 522 bp, Artificial Sequence
  chemically treated genomic DNA (Homo sapiens) CpG-island No: 28313
tttttcgatatttttgcgtcggggtttttttttagcgtttcgggaaagcgttcgtcgtaggtttgttaggggtttattaatatcgtaatatcgttttcgttttttttttcggtatcgttgtaaacgtttcgggtcgttattcggatttgacggtggttggagcggtacgggcgacgtaaggtaggtattgtattttggggtaaggtaaggtggataattagcggatgcggcgcggtcgcggtttgggtttgggtttttcgcgtcgtttattgttttattgggttttttttttcgcgtttatcggagggcgggtagttgttcgttatcgagattcgagattacggtgcggcggtttaatttgggttacgtttcgttttagaggagtggtcggggtttttcgttttaattggtcgggtttaggcgtttttaagatcggtcgtttcggaaaagtcgggtcgtgggtttattttttttcggggtaagatttaacgtttggaaattttgagggtttttttttaaatt

SEQ ID NO: 28314 - DNA, 522 bp, Artificial Sequence
  chemically treated genomic DNA (Homo sapiens) CpG-island No: 28314
aatttaaaaaaaaaccctcaaaatttccaaacgttaaatcttaccccgaaaaaaaataaacccacgacccgacttttccgaaacgaccgatcttaaaaacgcctaaacccgaccaattaaaacgaaaaaccccgaccactcctctaaaacgaaacgtaacccaaattaaaccgccgcaccgtaatctcgaatctcgataacgaacaactacccgccctccgataaacgcgaaaaaaaaaacccaataaaacaataaacgacgcgaaaaacccaaacccaaaccgcgaccgcgccgcatccgctaattatccaccttaccttaccccaaaatacaatacctaccttacgtcgcccgtaccgctccaaccaccgtcaaatccgaataacgacccgaaacgtttacaacgataccgaaaaaaaaaacgaaaacgatattacgatattaataaacccctaacaaacctacgacgaacgctttcccgaaacgctaaaaaaaaaccccgacgcaaaaatatcgaaaaa

SEQ ID NO: 28315 - DNA, 522 bp, Artificial Sequence
  chemically treated genomic DNA (Homo sapiens) CpG-island No: 28315
aatttaaaggggggtttttagggtttttaggcgttgagttttgtttcggggggaggtaagtttacggttcggttttttcggaacggtcggttttggaaacgtttagattcggttagttagggcgggaggtttcggttatttttttagagcggagcgtggtttaggttgagtcgtcgtatcgtggtttcgggtttcggtgacgagtagttgttcgtttttcggtgagcgcggagaaaggggtttagtggggtagtgggcgacgcggagggtttaggtttaggtcgcggtcgcgtcgtattcgttggttgtttattttgttttgttttagggtgtaatatttgttttgcgtcgttcgtgtcgttttagttatcgttaaattcgggtagcgattcggggcgtttgtagcggtgtcgaggaagaggacgggaacggtgttacggtattggtgggtttttaataggtttgcggcgaacgttttttcggagcgttagggaagggtttcggcgtagggatgtcggaggg

SEQ ID NO: 28316 - DNA, 522 bp, Artificial Sequence
  chemically treated genomic DNA (Homo sapiens) CpG-island No: 28316
ccctccgacatccctacgccgaaacccttccctaacgctccgaaaaaacgttcgccgcaaacctattaaaaacccaccaataccgtaacaccgttcccgtcctcttcctcgacaccgctacaaacgccccgaatcgctacccgaatttaacgataactaaaacgacacgaacgacgcaaaacaaatattacaccctaaaacaaaacaaaataaacaaccaacgaatacgacgcgaccgcgacctaaacctaaaccctccgcgtcgcccactaccccactaaacccctttctccgcgctcaccgaaaaacgaacaactactcgtcaccgaaacccgaaaccacgatacgacgactcaacctaaaccacgctccgctctaaaaaaataaccgaaacctcccgccctaactaaccgaatctaaacgtttccaaaaccgaccgttccgaaaaaaccgaaccgtaaacttacctccccccgaaacaaaactcaacgcctaaaaaccctaaaaacccccctttaaatt

SEQ ID NO: 28317 - DNA, 1102 bp, Artificial Sequence
  chemically treated genomic DNA (Homo sapiens) CpG-island No: 28317
ttcgatatcgaggtttaagatttcgtatttcgggtagcgaatataggagaaaagtatatcgcggttcggtcgcggggttttaaggcgttcgtgtcgtcgttgtttttggggtgtcgagagcgacgcggggtttatttttttcgtcggttcgaggttcgaagttcggttcgttatcgttttcggtcggcgtttttcgtacgtggcggtcgtgattgtttcggggcggtattttttcgcgttttcgttttagttttttttcgtttttttcgggatttttcgtgttcgggcgtcgcggaaggatcgtacgtacgcgcgcgcgtacgtttagtcgtgttcgcggaaaacggagggcgttgcggtaaggagtagtcgttataggtatagtcgtttcgtagtttttcgtcgttggtttgttagtttcgcggttgcgggcggtcgggcggtcgagcgcgttttgaggttcgttttttatcgttgaattcgcgttttttcgtcgtagtttttcggggaggggggcggtcggtgtttgcgtagagtcgtttttttttcgttttcgtttcgttttttttcgcgtcgtcgtcgttcgttatcgtcgtcgtcgtcgttgcgtttgttgtttttcgtcgttcgcgttgtagtgcgaagggttcgaagatggtcggttggtagagttacgtggataatttgatgtgcgatggttgttgttaggaggtcgttattgtcggttattgcgacgttaaatacgtttgggtagttacggtcgggggcgttttttagagtattacggtgaggattagtggcggtcggtattttggtttttgtatcggagcggggtggtcggtcgcgggggtatcgtagcgcggggttggaatattgagggtcgagttcgtaggtgtgttaggtagcgggcgtcgaggatgcggttgtcgggcgggcggggaggtcgaggttcggggacgtttttttattcggggttgcgttgataggttgggggcggcggtcggattttttgttggttttggtcgggcgttttcggcgtttttagcgtcggtttaggtgttcgggttgggggagggggtacgtatcggttagggtaagggga

SEQ ID NO: 28318 - DNA, 1102 bp, Artificial Sequence
  chemically treated genomic DNA (Homo sapiens) CpG-island No: 28318
tccccttaccctaaccgatacgtaccccctcccccaacccgaacacctaaaccgacgctaaaaacgccgaaaacgcccgaccaaaaccaacaaaaaatccgaccgccgcccccaacctatcaacgcaaccccgaataaaaaaacgtccccgaacctcgacctccccgcccgcccgacaaccgcatcctcgacgcccgctacctaacacacctacgaactcgaccctcaatattccaaccccgcgctacgatacccccgcgaccgaccaccccgctccgatacaaaaaccaaaataccgaccgccactaatcctcaccgtaatactctaaaaaacgcccccgaccgtaactacccaaacgtatttaacgtcgcaataaccgacaataacgacctcctaacaacaaccatcgcacatcaaattatccacgtaactctaccaaccgaccatcttcgaacccttcgcactacaacgcgaacgacgaaaaacaacaaacgcaacgacgacgacgacgataacgaacgacgacgacgcgaaaaaaaacgaaacgaaaacgaaaaaaaaacgactctacgcaaacaccgaccgcccccctccccgaaaaactacgacgaaaaaacgcgaattcaacgataaaaaacgaacctcaaaacgcgctcgaccgcccgaccgcccgcaaccgcgaaactaacaaaccaacgacgaaaaactacgaaacgactatacctataacgactactccttaccgcaacgccctccgttttccgcgaacacgactaaacgtacgcgcgcgcgtacgtacgatccttccgcgacgcccgaacacgaaaaatcccgaaaaaaacgaaaaaaaactaaaacgaaaacgcgaaaaaataccgccccgaaacaatcacgaccgccacgtacgaaaaacgccgaccgaaaacgataacgaaccgaacttcgaacctcgaaccgacgaaaaaaataaaccccgcgtcgctctcgacaccccaaaaacaacgacgacacgaacgccttaaaaccccgcgaccgaaccgcgatatacttttctcctatattcgctacccgaaatacgaaatcttaaacctcgatatcgaa

SEQ ID NO: 28319 - DNA, 1102 bp, Artificial Sequence
  chemically treated genomic DNA (Homo sapiens) CpG-island No: 28319
tttttttgttttggtcggtgcgtgtttttttttttaattcgggtatttggatcgacgttgggaacgtcgggggcgttcggttagggttagtaaggagttcggtcgtcgtttttagtttgttagcgtagtttcgggtgagggggcgttttcgggtttcggttttttcgttcgttcggtagtcgtattttcggcgttcgttgtttagtatatttgcgggttcggtttttagtgttttagtttcgcgttgcggtgttttcgcggtcggttatttcgtttcggtgtagggattagggtatcggtcgttattggtttttatcgtaatgttttgaaagacgttttcggtcgtggttgtttagacgtatttggcgtcgtagtagtcgataatggcggttttttggtagtagttatcgtatattaggttatttacgtagttttgttaatcggttattttcgagtttttcgtattgtagcgcggacggcgaggagtagtaggcgtagcggcggcggcggcggtagcgggcggcggcggcgcggggggaggcggggcgggggcggggaggaggcggttttgcgtaggtatcgatcgttttttttttcgaggagttgcggcgggaggacgcgggtttagcgatgagggacgaattttagagcgcgttcggtcgttcggtcgttcgtagtcgcggggttgataaattagcggcgggaggttgcgaagcggttgtgtttgtggcggttgttttttatcgtagcgtttttcgtttttcgcggatacggttgggcgtgcgcgcgcgcgtgcgtgcgattttttcgcggcgttcgggtacggagggtttcgggaagggcggggggagattgaggcgggggcgcggagggatatcgtttcgggataattacggtcgttacgtgcgggaggcgtcggtcgggagcggtggcgggtcgagtttcggatttcgggtcggcggagagggtggatttcgcgtcgttttcggtattttaggaatagcggcggtacggacgttttggagtttcgcggtcgggtcgcgatgtgttttttttttgtgttcgttgttcgggatgcggaattttgagtttcggtgtcggg

SEQ ID NO: 28320 - DNA, 1102 bp, Artificial Sequence
  chemically treated genomic DNA (Homo sapiens) CpG-island No: 28320
cccgacaccgaaactcaaaattccgcatcccgaacaacgaacacaaaaaaaaaacacatcgcgacccgaccgcgaaactccaaaacgtccgtaccgccgctattcctaaaataccgaaaacgacgcgaaatccaccctctccgccgacccgaaatccgaaactcgacccgccaccgctcccgaccgacgcctcccgcacgtaacgaccgtaattatcccgaaacgatatccctccgcgcccccgcctcaatctccccccgcccttcccgaaaccctccgtacccgaacgccgcgaaaaaatcgcacgcacgcgcgcgcgcacgcccaaccgtatccgcgaaaaacgaaaaacgctacgataaaaaacaaccgccacaaacacaaccgcttcgcaacctcccgccgctaatttatcaaccccgcgactacgaacgaccgaacgaccgaacgcgctctaaaattcgtccctcatcgctaaacccgcgtcctcccgccgcaactcctcgaaaaaaaaaacgatcgatacctacgcaaaaccgcctcctccccgcccccgccccgcctccccccgcgccgccgccgcccgctaccgccgccgccgccgctacgcctactactcctcgccgtccgcgctacaatacgaaaaactcgaaaataaccgattaacaaaactacgtaaataacctaatatacgataactactaccaaaaaaccgccattatcgactactacgacgccaaatacgtctaaacaaccacgaccgaaaacgtctttcaaaacattacgataaaaaccaataacgaccgataccctaatccctacaccgaaacgaaataaccgaccgcgaaaacaccgcaacgcgaaactaaaacactaaaaaccgaacccgcaaatatactaaacaacgaacgccgaaaatacgactaccgaacgaacgaaaaaaccgaaacccgaaaacgccccctcacccgaaactacgctaacaaactaaaaacgacgaccgaactccttactaaccctaaccgaacgcccccgacgttcccaacgtcgatccaaatacccgaattaaaaaaaaaaacacgcaccgaccaaaacaaaaaaa

SEQ ID NO: 28321 - DNA, 588 bp, Artificial Sequence
  chemically treated genomic DNA (Homo sapiens) CpG-island No: 28321
tcggttcgggttttttattggcgcgttcgtagcggcgttttatttttagtaggcgttgtggtaatataaggaatgcgcggcgcgttaggcgttcggggcgtacgttggcggcgcggtcgttttaaggaggcgtcggggcggggacggatcggagtggtcggttggcggggagtcgttagttcggcggtcgcggggttcggcgggcgcgacgttgtttttttatcggcgtaggttaggagggggcggtttgagtgtcgtagtcgagtcggggttggagcgcgcggtgagtggtcgggcggttttggaggggagggggttcggtcgcgtcgtttttcgtttcggtcgtcgttttgtttcggggcgggaggtgtggtcgtttttcgggttcggtcgcgtttttcgtttgcggggtgcgttttgggatcggttgtgcgtggcgttttgtttttatcgcgggttttcgcgtaacggtgtgcgttcgtgaaatcggttacgattaagattttagtggggagggtttgcgcgtcgtttagagagatttttttatggtaattatagttttttggttgtttgggcgagaattcggtg

SEQ ID NO: 28322 - DNA, 588 bp, Artificial Sequence
  chemically treated genomic DNA (Homo sapiens) CpG-island No: 28322
caccgaattctcgcccaaacaaccaaaaaactataattaccataaaaaaatctctctaaacgacgcgcaaaccctccccactaaaatcttaatcgtaaccgatttcacgaacgcacaccgttacgcgaaaacccgcgataaaaacaaaacgccacgcacaaccgatcccaaaacgcaccccgcaaacgaaaaacgcgaccgaacccgaaaaacgaccacacctcccgccccgaaacaaaacgacgaccgaaacgaaaaacgacgcgaccgaaccccctcccctccaaaaccgcccgaccactcaccgcgcgctccaaccccgactcgactacgacactcaaaccgccccctcctaacctacgccgataaaaaaacaacgtcgcgcccgccgaaccccgcgaccgccgaactaacgactccccgccaaccgaccactccgatccgtccccgccccgacgcctccttaaaacgaccgcgccgccaacgtacgccccgaacgcctaacgcgccgcgcattccttatattaccacaacgcctactaaaaataaaacgccgctacgaacgcgccaataaaaaacccgaaccga

SEQ ID NO: 28323 - DNA, 588 bp, Artificial Sequence
  chemically treated genomic DNA (Homo sapiens) CpG-island No: 28323
tatcgggttttcgtttaggtagttaaggaattgtaattattatgaaagggtttttttgagcggcgcgtaggttttttttattggggttttggtcgtggtcgattttacgaacgtatatcgttacgcgggagttcgcgatgggggtaaaacgttacgtatagtcggttttagggcgtatttcgtaagcggagagcgcggtcgagttcggagggcggttatatttttcgtttcggaataaagcgacggtcggggcgagaggcggcgcggtcgggtttttttttttttaaggtcgttcgattatttatcgcgcgttttagtttcggttcggttacggtatttaggtcgtttttttttagtttgcgtcggtgaggaggtagcgtcgcgttcgtcgggtttcgcggtcgtcggattgacggtttttcgttagtcggttatttcggttcgttttcgtttcggcgtttttttaaagcgatcgcgtcgttagcgtgcgtttcgagcgtttagcgcgtcgcgtattttttatattgttatagcgtttgttaaaaatagagcgtcgttgcgggcgcgttagtggggagttcgggtcgg

SEQ ID NO: 28324 - DNA, 588 bp, Artificial Sequence
  chemically treated genomic DNA (Homo sapiens) CpG-island No: 28324
ccgacccgaactccccactaacgcgcccgcaacgacgctctatttttaacaaacgctataacaatataaaaaatacgcgacgcgctaaacgctcgaaacgcacgctaacgacgcgatcgctttaaaaaaacgccgaaacgaaaacgaaccgaaataaccgactaacgaaaaaccgtcaatccgacgaccgcgaaacccgacgaacgcgacgctacctcctcaccgacgcaaactaaaaaaaaacgacctaaataccgtaaccgaaccgaaactaaaacgcgcgataaataatcgaacgaccttaaaaaaaaaaaaacccgaccgcgccgcctctcgccccgaccgtcgctttattccgaaacgaaaaatataaccgccctccgaactcgaccgcgctctccgcttacgaaatacgccctaaaaccgactatacgtaacgttttacccccatcgcgaactcccgcgtaacgatatacgttcgtaaaatcgaccacgaccaaaaccccaataaaaaaaacctacgcgccgctcaaaaaaaccctttcataataattacaattccttaactacctaaacgaaaacccgata

SEQ ID NO: 28325 - DNA, 1426 bp, Artificial Sequence
  chemically treated genomic DNA (Homo sapiens) CpG-island No: 28325
  misc_feature (595)..(595): n is either a, c, g or t
  misc_feature (1385)..(1385): n is either a, c, g or t
ggaaaaaatttttttggtgattattggcgatcgtagcgtaatcggtatggtagcgcgcgattagatggtggggtcgtggtaggtgtcggtcgttaattgcgcggttattatcgttagtttcgatagttattacggtgaagcgatggcgattggcgagcgtgcgtcggttgcgttgttggatttcgtcgtttttgttcgtttggcggtcggtgaagcgttaattaatatcgtcgtaatataaattggcgatattaaacgtattaaatttttcgttaattggatggcggcggtaggttattttggtgaagatgcgggtttgtatgaagtcgttaaagtcgtgggcgaagagttttgttcggcgttgggtttgacgatttcggtgggtaaagattttatgtcgatgaaaattcgttggtaggaaggtaacgaagagcgcgaaatgacgtcgtcgttgtcgttggtgatttttgtatttgttcgcgtggaagatgtacgttatattattacgtcgtagttttttatcgaagataacgtattgttgttgattgatttgggtaaaggtaataacgcgttgggcgtaacggcgtttgcgtangtttatcgttagtttggcgataaattcgtagatgtacgcgatgtcgcgtaattgaaaagttttttatgacgcgatttaggcgttggttgtatagcgtaagttgttggcgtattacgatcgttttgatggcggtttgttggtaacgttggcggaaatggtttttgttggttattgtggtattgacgcggatatcgttattttgggtgacgatcgtttggcggcgttgtttaacgaagaattgggtgcggtgatttaggttcgtgtcgttgatcgtgaagcggtcgagttcgtattggtatagtatgggtttgttgattgtgtttattatgtagggtaggcggttttcggtgatcgttttgtgattatcgttaacgggtagattgtatttagcgaaagtcgtattacgttgcgtgtttggtgggtagaaattatttggtagatgtagcgtttgcgtgataattcggagtgtgtcgattaggagtattaggcgaaatttaacgacgtcgattcgggtttgaatgtaaaattgtcgttcgatattaacgaagatgtggtagtatcgtatattgttattggcgtacgttcgaaagttgtcgtattgcgtgagtagggcgtgaattcgtatgttgaaatggcggtagttttttatcgtgtaggttttgatgttatcgacgtgtatatgagtgaattgttgatcggacgtacgggtttggaaaaattttacgttttggtcgcgtgtcggggtttttttttacgggatgtgttgggtgttcgtgaaagttgggcgaanttaattttgtttaatgattcgtgtacgttaataatttgtaa

SEQ ID NO: 28326 - DNA, 1426 bp, Artificial Sequence
  chemically treated genomic DNA (Homo sapiens) CpG-island No: 28326
  misc_feature (42)..(42): n is either a, c, g or t
  misc_feature (832)..(832): n is either a, c, g or t
ttacaaattattaacgtacacgaatcattaaacaaaattaanttcgcccaactttcacgaacacccaacacatcccgtaaaaaaaaaccccgacacgcgaccaaaacgtaaaatttttccaaacccgtacgtccgatcaacaattcactcatatacacgtcgataacatcaaaacctacacgataaaaaactaccgccatttcaacatacgaattcacgccctactcacgcaatacgacaactttcgaacgtacgccaataacaatatacgatactaccacatcttcgttaatatcgaacgacaattttacattcaaacccgaatcgacgtcgttaaatttcgcctaatactcctaatcgacacactccgaattatcacgcaaacgctacatctaccaaataatttctacccaccaaacacgcaacgtaatacgactttcgctaaatacaatctacccgttaacgataatcacaaaacgatcaccgaaaaccgcctaccctacataataaacacaatcaacaaacccatactataccaatacgaactcgaccgcttcacgatcaacgacacgaacctaaatcaccgcacccaattcttcgttaaacaacgccgccaaacgatcgtcacccaaaataacgatatccgcgtcaataccacaataaccaacaaaaaccatttccgccaacgttaccaacaaaccgccatcaaaacgatcgtaatacgccaacaacttacgctatacaaccaacgcctaaatcgcgtcataaaaaacttttcaattacgcgacatcgcgtacatctacgaatttatcgccaaactaacgataaacntacgcaaacgccgttacgcccaacgcgttattacctttacccaaatcaatcaacaacaatacgttatcttcgataaaaaactacgacgtaataatataacgtacatcttccacgcgaacaaatacaaaaatcaccaacgacaacgacgacgtcatttcgcgctcttcgttaccttcctaccaacgaattttcatcgacataaaatctttacccaccgaaatcgtcaaacccaacgccgaacaaaactcttcgcccacgactttaacgacttcatacaaacccgcatcttcaccaaaataacctaccgccgccatccaattaacgaaaaatttaatacgtttaatatcgccaatttatattacgacgatattaattaacgcttcaccgaccgccaaacgaacaaaaacgacgaaatccaacaacgcaaccgacgcacgctcgccaatcgccatcgcttcaccgtaataactatcgaaactaacgataataaccgcgcaattaacgaccgacacctaccacgaccccaccatctaatcgcgcgctaccataccgattacgctacgatcgccaataatcaccaaaaaaattttttcc

SEQ ID NO: 28327 - DNA, 1426 bp, Artificial Sequence
  chemically treated genomic DNA (Homo sapiens) CpG-island No: 28327
  misc_feature (42)..(42): n is either a, c, g or t
  misc_feature (832)..(832): n is either a, c, g or t
ttgtaaattattggcgtatacgggttattgaataggattganttcgtttaatttttacgggtatttagtatatttcgtaagaagaaatttcggtacgcgattagggcgtggaatttttttaggttcgtgcgttcggttagtagtttatttatatgtacgtcgatagtattaaagtttgtacggtggaaagttgtcgttattttaatatgcgagtttacgttttgtttacgtagtacggtaattttcggacgtgcgttagtggtaatatacggtgttgttatattttcgttgatatcgaacgatagttttatatttaggttcggatcggcgtcgttagatttcgtttgatgtttttgatcggtatatttcgggttgttacgtaggcgttgtatttgttaggtagtttttgtttattagatacgtaacgtggtgcggttttcgttgaatatagtttgttcgttggcggtaattataaaacggttatcggaaatcgtttgttttatataatggatataattagtaagtttatgttgtgttagtacggattcgatcgttttacggttagcggtacgaatttgaattatcgtatttagtttttcgttaaataacgtcgttaggcgatcgttatttagagtggcgatattcgcgttaatgttataatgattagtaaaggttattttcgttagcgttattagtaggtcgttattagagcggtcgtgatacgttagtagtttacgttgtgtaattagcgtttgaatcgcgttatagaaagttttttagttgcgcgatatcgcgtatatttgcgggtttgtcgttaagttgacgataaatntgcgtaagcgtcgttgcgtttagcgcgttattgtttttgtttaaattaattagtagtagtgcgttattttcggtagaaagttgcggcgtgatggtgtgacgtatattttttacgcgggtaaatgtagaaattattagcgatagcggcgacgttatttcgcgtttttcgttatttttttgttagcgggtttttatcgatatggagtttttatttatcgggatcgttaggtttagcgtcggataaagtttttcgtttacggttttaacggttttatataggttcgtatttttattagggtggtttgtcgtcgttatttagttggcggaaagtttgatgcgtttgatatcgttaatttgtgttgcggcgatgttggttaacgttttatcgatcgttagacgggtagaggcggcgaaatttagtagcgtaatcggcgtacgttcgttaatcgttatcgttttatcgtagtagttgtcgaggttggcggtagtgatcgcgtagttagcgatcggtatttgttacggttttattatttgatcgcgcgttattatgtcggttacgttgcggtcgttaatggttattaggaaggtttttttt

SEQ ID NO: 28328 - DNA, 1426 bp, Artificial Sequence
  chemically treated genomic DNA (Homo sapiens) CpG-island No: 28328
  misc_feature (595)..(595): n is either a, c, g or t
  misc_feature (1385)..(1385): n is either a, c, g or t
aaaaaaaaccttcctaataaccattaacgaccgcaacgtaaccgacataataacgcgcgatcaaataataaaaccgtaacaaataccgatcgctaactacgcgatcactaccgccaacctcgacaactactacgataaaacgataacgattaacgaacgtacgccgattacgctactaaatttcgccgcctctacccgtctaacgatcgataaaacgttaaccaacatcgccgcaacacaaattaacgatatcaaacgcatcaaactttccgccaactaaataacgacgacaaaccaccctaataaaaatacgaacctatataaaaccgttaaaaccgtaaacgaaaaactttatccgacgctaaacctaacgatcccgataaataaaaactccatatcgataaaaacccgctaacaaaaaaataacgaaaaacgcgaaataacgtcgccgctatcgctaataatttctacatttacccgcgtaaaaaatatacgtcacaccatcacgccgcaactttctaccgaaaataacgcactactactaattaatttaaacaaaaacaataacgcgctaaacgcaacgacgcttacgcanatttatcgtcaacttaacgacaaacccgcaaatatacgcgatatcgcgcaactaaaaaactttctataacgcgattcaaacgctaattacacaacgtaaactactaacgtatcacgaccgctctaataacgacctactaataacgctaacgaaaataacctttactaatcattataacattaacgcgaatatcgccactctaaataacgatcgcctaacgacgttatttaacgaaaaactaaatacgataattcaaattcgtaccgctaaccgtaaaacgatcgaatccgtactaacacaacataaacttactaattatatccattatataaaacaaacgatttccgataaccgttttataattaccgccaacgaacaaactatattcaacgaaaaccgcaccacgttacgtatctaataaacaaaaactacctaacaaatacaacgcctacgtaacaacccgaaatataccgatcaaaaacatcaaacgaaatctaacgacgccgatccgaacctaaatataaaactatcgttcgatatcaacgaaaatataacaacaccgtatattaccactaacgcacgtccgaaaattaccgtactacgtaaacaaaacgtaaactcgcatattaaaataacgacaactttccaccgtacaaactttaatactatcgacgtacatataaataaactactaaccgaacgcacgaacctaaaaaaattccacgccctaatcgcgtaccgaaatttcttcttacgaaatatactaaatacccgtaaaaattaaacgaantcaatcctattcaataacccgtatacgccaataatttacaa

SEQ ID NO: 28329 - DNA, 750 bp, Artificial Sequence
  chemically treated genomic DNA (Homo sapiens) CpG-island No: 28329
  misc_feature (105)..(105): n is either a, c, g or t
  misc_feature (157)..(157): n is either a, c, g or t
  misc_feature (278)..(278): n is either a, c, g or t
tcgtatcgtcgtgtttttcggtttaagtttttatattcgggcgaattggcgtgttttattagttcggtagtatgaattattattcgttagttattttattggagnacgacgaagatcgttgtcgaagcggcgtttttatcgtttttagtatgacgtnttgtattggtttattggtgaaattcgttcgtagtgatcgtttagtgtagggttttacgattatagtagtttagtcgcgaacgtgtacgtagttttttttcgtattatagtagaattcgaantcgttagagtattatcgttgatgttttttttacgtttattttgtttgtatgtgttcgttcgatgcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttattttttattttcgggtaataagggcgcgtgcgttatttatttttttgttcgtttatatttaacggtttttttgaggagtttattttttatcgtttttttgtcgagtaggcgttggagt

SEQ ID NO: 28330 - DNA, 750 bp, Artificial Sequence
  chemically treated genomic DNA (Homo sapiens) CpG-island No: 28330
  misc_feature (473)..(473): n is either a, c, g or t
  misc_feature (594)..(594): n is either a, c, g or t
  misc_feature (646)..(646): n is either a, c, g or t
actccaacgcctactcgacaaaaaaacgataaaaaataaactcctcaaaaaaaccgttaaatataaacgaacaaaaaaataaataacgcacgcgcccttattacccgaaaataaaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgcatcgaacgaacacatacaaacaaaataaacgtaaaaaaaacatcaacgataatactctaacganttcgaattctactataatacgaaaaaaaactacgtacacgttcgcgactaaactactataatcgtaaaaccctacactaaacgatcactacgaacgaatttcaccaataaaccaatacaanacgtcatactaaaaacgataaaaacgccgcttcgacaacgatcttcgtcgtnctccaataaaataactaacgaataataattcatactaccgaactaataaaacacgccaattcgcccgaatataaaaacttaaaccgaaaaacacgacgatacga

SEQ ID NO: 28331 - DNA, 750 bp, Artificial Sequence
  chemically treated genomic DNA (Homo sapiens) CpG-island No: 28331
  misc_feature (473)..(473): n is either a, c, g or t
  misc_feature (594)..(594): n is either a, c, g or t
  misc_feature (646)..(646): n is either a, c, g or t
attttagcgtttgttcggtaagaaaacgatggaaaatgaattttttaaagaagtcgttgaatatggacgggtaaaaaagtggatagcgtacgcgtttttattgttcggggatggggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgtatcgaacgggtatatataggtagagtgggcgtgaagaaagtattagcgatggtgttttgacggnttcgagttttgttgtgatacggagagagattgcgtgtacgttcgcggttggattgttgtgatcgtaaggttttgtattgggcggttattacgggcgggttttattagtgaattagtatagnacgttatgttgggagcggtgggaacgtcgtttcggtaacgattttcgtcgtnttttagtgaagtggttgacggataatggtttatgttatcgggttaatgaaatacgttagttcgttcggatgtggggatttgaatcgaagaatacggcggtgcgg

SEQ ID NO: 28332 - DNA, 750 bp, Artificial Sequence
  chemically treated genomic DNA (Homo sapiens) CpG-island No: 28332
  misc_feature (105)..(105): n is either a, c, g or t
  misc_feature (157)..(157): n is either a, c, g or t
  misc_feature (278)..(278): n is either a, c, g or t
ccgcaccgccgtattcttcgattcaaatccccacatccgaacgaactaacgtatttcattaacccgataacataaaccattatccgtcaaccacttcactaaaanacgacgaaaatcgttaccgaaacgacgttcccaccgctcccaacataacgtnctatactaattcactaataaaacccgcccgtaataaccgcccaatacaaaaccttacgatcacaacaatccaaccgcgaacgtacacgcaatctctctccgtatcacaacaaaactcgaanccgtcaaaacaccatcgctaatactttcttcacgcccactctacctatatatacccgttcgatacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccccatccccgaacaataaaaacgcgtacgctatccacttttttacccgtccatattcaacgacttctttaaaaaattcattttccatcgttttcttaccgaacaaacgctaaaat

SEQ ID NO: 28333 - DNA, 517 bp, Artificial Sequence
  chemically treated genomic DNA (Homo sapiens) CpG-island No: 28333
  misc_feature (61)..(61): n is either a, c, g or t
acgtagttttttacgtatttgcgtatttagcgcgttaaacggtttattaagtagtagaatntgcggttttatagttagcgcgcgcgttagcgttacgcgttgtttttggtcgtcggaaagttgcgtcggataacgattcgttagatgggtaagttggattatttttagtaattttgttattttcgttttgatggttgcggtattcgggcgttcgcgacgcggtagtatcgttaggttaaaagcgatattgtcgaatatcgttatatggcggaatagcgcgtaatgttggaatacgaaatcgattttacgattacgtgcgtgtaggcggtttacgtcggtgtcgtggaagcgaatatgttcgttggtttgatgttttagttcggcgataatgcgtagtagcgtggttttttcggaatcggacggttttagtaacgcgattatttgatttgaaggaatatttagtgagatatcgtttagtatttgggtgcgattaaacgattttttaatattggtaatt

SEQ ID NO: 28334 - DNA, 517 bp, Artificial Sequence
  chemically treated genomic DNA (Homo sapiens) CpG-island No: 28334
  misc_feature (457)..(457): n is either a, c, g or t
aattaccaatattaaaaaatcgtttaatcgcacccaaatactaaacgatatctcactaaatattccttcaaatcaaataatcgcgttactaaaaccgtccgattccgaaaaaaccacgctactacgcattatcgccgaactaaaacatcaaaccaacgaacatattcgcttccacgacaccgacgtaaaccgcctacacgcacgtaatcgtaaaatcgatttcgtattccaacattacgcgctattccgccatataacgatattcgacaatatcgcttttaacctaacgatactaccgcgtcgcgaacgcccgaataccgcaaccatcaaaacgaaaataacaaaattactaaaaataatccaacttacccatctaacgaatcgttatccgacgcaactttccgacgaccaaaaacaacgcgtaacgctaacgcgcgcgctaactataaaaccgcanattctactacttaataaaccgtttaacgcgctaaatacgcaaatacgtaaaaaactacgt

SEQ ID NO: 28335 - DNA, 517 bp, Artificial Sequence
  chemically treated genomic DNA (Homo sapiens) CpG-island No: 28335
  misc_feature (457)..(457): n is either a, c, g or t
gattgttaatattaagaagtcgtttggtcgtatttaggtgttgaacgatattttattggatatttttttaggttagatggtcgcgttgttggggtcgttcggtttcgggaaaattacgttgttgcgtattatcgtcgggttggagtattaaattagcgggtatattcgtttttacggtatcgacgtgagtcgtttgtacgtacgtgatcgtaaagtcggtttcgtgttttagtattacgcgttgtttcgttatatgacggtgttcgataatatcgtttttggtttgacggtgttgtcgcgtcgcgagcgttcgaatgtcgtagttattaaagcgaaagtgataaaattgttggaaatggtttagtttgtttatttggcggatcgttattcggcgtagtttttcggcggttagaaatagcgcgtggcgttggcgcgcgcgttggttgtggaatcgtanattttgttgtttgatgaatcgtttggcgcgttggatgcgtaggtgcgtaaagagttgcgt

SEQ ID NO: 28336 - DNA, 517 bp, Artificial Sequence
  chemically treated genomic DNA (Homo sapiens) CpG-island No: 28336
  misc_feature (61)..(61): n is either a, c, g or t
acgcaactctttacgcacctacgcatccaacgcgccaaacgattcatcaaacaacaaaatntacgattccacaaccaacgcgcgcgccaacgccacgcgctatttctaaccgccgaaaaactacgccgaataacgatccgccaaataaacaaactaaaccatttccaacaattttatcactttcgctttaataactacgacattcgaacgctcgcgacgcgacaacaccgtcaaaccaaaaacgatattatcgaacaccgtcatataacgaaacaacgcgtaatactaaaacacgaaaccgactttacgatcacgtacgtacaaacgactcacgtcgataccgtaaaaacgaatatacccgctaatttaatactccaacccgacgataatacgcaacaacgtaattttcccgaaaccgaacgaccccaacaacgcgaccatctaacctaaaaaaatatccaataaaatatcgttcaacacctaaatacgaccaaacgacttcttaatattaacaatc

SEQ ID NO: 28337 - DNA, 688 bp, Artificial Sequence
  chemically treated genomic DNA (Homo sapiens) CpG-island No: 28337
taggcgcggttggtggcgtaattagacgttagcgttttgattaacggttagagcggtatcgggaaagagattttcgtttaggttatttataacgttagttcgcgtaatagtaaattatttattgttattaattgtggcgtattgttcgagtaattgttggagtcggagttgtttggttatgcgcgtggcgcgtttattggcgttgttagtaatcgcgaaggtttattttaggcggcggaaggcggaacgttatttttcgatgaaattggcgatatgtttgcgtcgttataggttaaattgttgcgcgtgttgtaggagcgtaaagtgcgttcgttgggtagtaatcgcgatattgatattaatgtgcggattatttttgttatttatcgtgatttgttaaaagcgatggcgcgcggggaatttcgcgaagatttttattatcgttttaacgttgttagtttgaaaatttcggtattggcggagcgtatagaagatatttcgttattggtaaattatttgttgcgttaggcggtagagcgatataaatcgtttgttcgcgcgttttttatcgatgcgatgaaacgtttgatgatcgcgagttggtcgggtaatgtgcgttagttggttaacgtgattgaatagtgcgtggcgttgattttatttttagtgagtagtgatacgttggtgg

SEQ ID NO: 28338 - DNA, 688 bp, Artificial Sequence
  chemically treated genomic DNA (Homo sapiens) CpG-island No: 28338
ccaccaacgtatcactactcactaaaaataaaatcaacgccacgcactattcaatcacgttaaccaactaacgcacattacccgaccaactcgcgatcatcaaacgtttcatcgcatcgataaaaaacgcgcgaacaaacgatttatatcgctctaccgcctaacgcaacaaataatttaccaataacgaaatatcttctatacgctccgccaataccgaaattttcaaactaacaacgttaaaacgataataaaaatcttcgcgaaattccccgcgcgccatcgcttttaacaaatcacgataaataacaaaaataatccgcacattaatatcaatatcgcgattactacccaacgaacgcactttacgctcctacaacacgcgcaacaatttaacctataacgacgcaaacatatcgccaatttcatcgaaaaataacgttccgccttccgccgcctaaaataaaccttcgcgattactaacaacgccaataaacgcgccacgcgcataaccaaacaactccgactccaacaattactcgaacaatacgccacaattaataacaataaataatttactattacgcgaactaacgttataaataacctaaacgaaaatctctttcccgataccgctctaaccgttaatcaaaacgctaacgtctaattacgccaccaaccgcgccta

SEQ ID NO: 28339 - DNA, 688 bp, Artificial Sequence
  chemically treated genomic DNA (Homo sapiens) CpG-island No: 28339
ttattagcgtattattatttattggagatgaggttagcgttacgtattgtttaattacgttgattaattggcgtatattattcggttagttcgcggttattaggcgttttatcgtatcggtagagaacgcgcggataaacggtttatgtcgttttgtcgtttggcgtaataggtgatttgttagtagcggaatgttttttgtgcgtttcgttagtgtcggaatttttaggttgataacgttgaggcggtaatagagattttcgcggaatttttcgcgcgttatcgtttttggtagattacggtgagtggtagaaataattcgtatattgatattaatatcgcggttattgtttagcgggcgtattttacgtttttgtaatacgcgtagtagtttgatttgtaacggcgtaggtatatcgttaattttatcgagaaatagcgtttcgtttttcgtcgtttggaataaattttcgcgattgttgatagcgttagtaaacgcgttacgcgtatgattaaatagtttcgattttagtaattgttcgggtaatgcgttatagttaatagtaataaatggtttgttgttgcgcgggttggcgttgtggatagtttgggcgaaaatttttttttcggtgtcgttttgatcgttaattaaaacgttgacgtttgattgcgttattagtcgcgtttg

SEQ ID NO: 28340 - DNA, 688 bp, Artificial Sequence
  chemically treated genomic DNA (Homo sapiens) CpG-island No: 28340
caaacgcgactaataacgcaatcaaacgtcaacgttttaattaacgatcaaaacgacaccgaaaaaaaaattttcgcccaaactatccacaacgccaacccgcgcaacaacaaaccatttattactattaactataacgcattacccgaacaattactaaaatcgaaactatttaatcatacgcgtaacgcgtttactaacgctatcaacaatcgcgaaaatttattccaaacgacgaaaaacgaaacgctatttctcgataaaattaacgatatacctacgccgttacaaatcaaactactacgcgtattacaaaaacgtaaaatacgcccgctaaacaataaccgcgatattaatatcaatatacgaattatttctaccactcaccgtaatctaccaaaaacgataacgcgcgaaaaattccgcgaaaatctctattaccgcctcaacgttatcaacctaaaaattccgacactaacgaaacgcacaaaaaacattccgctactaacaaatcacctattacgccaaacgacaaaacgacataaaccgtttatccgcgcgttctctaccgatacgataaaacgcctaataaccgcgaactaaccgaataatatacgccaattaatcaacgtaattaaacaatacgtaacgctaacctcatctccaataaataataatacgctaataa

SEQ ID NO: 28341 - DNA, 626 bp, Artificial Sequence
  chemically treated genomic DNA (Homo sapiens) CpG-island No: 28341
  misc_feature (605)..(605): n is either a, c, g or t
  misc_feature (611)..(611): n is either a, c, g or t
  misc_feature (615)..(615): n is either a, c, g or t
  misc_feature (625)..(625): n is either a, c, g or t
gtatcgttttacggtgtagtttgtttcgcgtatattcgattagcggcgtttcgtttagttttattttcgttaggtaatcgttgttatacgttagttattttatcggcggtaggttgttcggcgtgacgcggtttgttagtttttgttcgttgtatgcgtgtttcgttttatgttgttatagtagttttttcgttttcgggttttttatcgtttggtattcgtcggttaggcggtttttatcgttatagttatagtggacggtaatacggtggttttcgttgatatggttgatgtttgttagttagtcgtggttattatattgttatcgttttgcggttttattttttacggtgcggtgcgtgaggcggtttgtttcgttatagtgttagtgggtgattagatttttattttcgttgcggataagtttgtcggttaggtcgtggtgataacgttgtgtgcggtcgttaaagtcggttttttgtattagtcggttaagtatatcgtaacggaaggtggtgtggttgtcgtttttattggttaggttgatgattcgttcggtagtatcgtattgttataatgagggttagttcgtttgtgtggtcggnttgaantcgnaatttatttnt

SEQ ID NO: 28342 - DNA, 626 bp, Artificial Sequence
  chemically treated genomic DNA (Homo sapiens) CpG-island No: 28342
  misc_feature (2)..(2): n is either a, c, g or t
  misc_feature (12)..(12): n is either a, c, g or t
  misc_feature (16)..(16): n is either a, c, g or t
  misc_feature (22)..(22): n is either a, c, g or t
anaaataaattncganttcaanccgaccacacaaacgaactaaccctcattataacaatacgatactaccgaacgaatcatcaacctaaccaataaaaacgacaaccacaccaccttccgttacgatatacttaaccgactaatacaaaaaaccgactttaacgaccgcacacaacgttatcaccacgacctaaccgacaaacttatccgcaacgaaaataaaaatctaatcacccactaacactataacgaaacaaaccgcctcacgcaccgcaccgtaaaaaataaaaccgcaaaacgataacaatataataaccacgactaactaacaaacatcaaccatatcaacgaaaaccaccgtattaccgtccactataactataacgataaaaaccgcctaaccgacgaataccaaacgataaaaaacccgaaaacgaaaaaactactataacaacataaaacgaaacacgcatacaacgaacaaaaactaacaaaccgcgtcacgccgaacaacctaccgccgataaaataactaacgtataacaacgattacctaacgaaaataaaactaaacgaaacgccgctaatcgaatatacgcgaaacaaactacaccgtaaaacgatac

SEQ ID NO: 28343 - DNA, 626 bp, Artificial Sequence
  chemically treated genomic DNA (Homo sapiens) CpG-island No: 28343
  misc_feature (2)..(2): n is either a, c, g or t
  misc_feature (12)..(12): n is either a, c, g or t
  misc_feature (16)..(16): n is either a, c, g or t
  misc_feature (22)..(22): n is either a, c, g or t
gnaaatgaattncgantttaantcggttatataggcgggttgatttttattatggtaatacgatgttgtcggacgggttattagtttgattagtgaaaacggtagttatattatttttcgttacgatgtatttgatcggttgatataggaaatcggttttgacggtcgtatatagcgttattattacgatttgatcggtaaatttattcgtagcgaggatgagggtttggttatttattggtattatgacgaagtagatcgttttacgtatcgtatcgtgaagggtgaaatcgtagagcggtggtagtatgatggttacggttggttgatagatattagttatattagcgaaggttatcgtgttgtcgtttattatggttatgacgataaaggtcgtttgatcggcgaatgttagacggtggagaattcggagacgggggaattgttgtggtagtatgagacgaaatacgtatataacgagtaggggttggtaaatcgcgttacgtcggatagtttgtcgtcggtggagtggttgacgtatggtagcggttatttggcgggaatgaagttgggcgggacgtcgttggtcgagtatacgcgggataggttgtatcgtgagacggtgt

SEQ ID NO: 28344 - DNA, 626 bp, Artificial Sequence
  chemically treated genomic DNA (Homo sapiens) CpG-island No: 28344
  misc_feature (605)..(605): n is either a, c, g or t
  misc_feature (611)..(611): n is either a, c, g or t
  misc_feature (615)..(615): n is either a, c, g or t
  misc_feature (625)..(625): n is either a, c, g or t
acaccgtctcacgatacaacctatcccgcgtatactcgaccaacgacgtcccgcccaacttcattcccgccaaataaccgctaccatacgtcaaccactccaccgacgacaaactatccgacgtaacgcgatttaccaacccctactcgttatatacgtatttcgtctcatactaccacaacaattcccccgtctccgaattctccaccgtctaacattcgccgatcaaacgacctttatcgtcataaccataataaacgacaacacgataaccttcgctaatataactaatatctatcaaccaaccgtaaccatcatactaccaccgctctacgatttcacccttcacgatacgatacgtaaaacgatctacttcgtcataataccaataaataaccaaaccctcatcctcgctacgaataaatttaccgatcaaatcgtaataataacgctatatacgaccgtcaaaaccgatttcctatatcaaccgatcaaatacatcgtaacgaaaaataatataactaccgttttcactaatcaaactaataacccgtccgacaacatcgtattaccataataaaaatcaacccgcctatataaccganttaaantcgnaattcatttnc

SEQ ID NO: 28345 - DNA, 538 bp, Artificial Sequence
  chemically treated genomic DNA (Homo sapiens) CpG-island No: 28345
  misc_feature (401)..(401): n is either a, c, g or t
  misc_feature (405)..(405): n is either a, c, g or t
ggtcggataaggcgtttacgtcgtattcggtaacggtgtcgattgtttgatgcgacgtttgcgcgttttattaggtttataaattttcgtatttttcgtaggtcggataaggcgtttacgtttttttcggtaatagtgttaattgtttgatgcgacgtttgcgcgttttattaggtttataaattttcgtattattcgtaggtcggataaggcgtttacgtcgtattcggtaacggtgtcgattgtttgatgcgacgtttgcgcgttttattaggtttataaattttcgtatttttcgtaggtcggataaggcgtttacgtcgtattcggtaatggtgtcgattgtttgatgcgacgtttgcgcgttttattaggtttataatttttcgtatttttcgtangttnggataaggcgttacgttcgtattcgggaatagtgtcgattgtttgatgcgacgttcgcgcgttttattaggtcgttttttatttggataaatttcgaattatatttaattggtttttttttatttgaggtaat

SEQ ID NO: 28346 - DNA, 538 bp, Artificial Sequence
  chemically treated genomic DNA (Homo sapiens) CpG-island No: 28346
  misc_feature (134)..(134): n is either a, c, g or t
  misc_feature (138)..(138): n is either a, c, g or t
attacctcaaataaaaaaaaaccaattaaatataattcgaaatttatccaaataaaaaacgacctaataaaacgcgcgaacgtcgcatcaaacaatcgacactattcccgaatacgaacgtaacgccttatccnaacntacgaaaaatacgaaaaattataaacctaataaaacgcgcaaacgtcgcatcaaacaatcgacaccattaccgaatacgacgtaaacgccttatccgacctacgaaaaatacgaaaatttataaacctaataaaacgcgcaaacgtcgcatcaaacaatcgacaccgttaccgaatacgacgtaaacgccttatccgacctacgaataatacgaaaatttataaacctaataaaacgcgcaaacgtcgcatcaaacaattaacactattaccgaaaaaaacgtaaacgccttatccgacctacgaaaaatacgaaaatttataaacctaataaaacgcgcaaacgtcgcatcaaacaatcgacaccgttaccgaatacgacgtaaacgccttatccgacc

SEQ ID NO: 28347 - DNA, 538 bp, Artificial Sequence
  chemically treated genomic DNA (Homo sapiens) CpG-island No: 28347
  misc_feature (134)..(134): n is either a, c, g or t
  misc_feature (138)..(138): n is either a, c, g or t
gttgttttaagtaaagagaagttagttaagtgtagttcgaaatttatttagatgagaggcggtttgataagacgcgcgagcgtcgtattaggtagtcggtattgttttcggatgcgggcgtaacgttttatttnggtntacggagggtgcggggaattgtaggtttgataagacgcgtaagcgtcgtattaggtagtcggtattattgtcggatgcggcgtaaacgttttattcggtttacggagggtgcgggaatttgtaggtttgataagacgcgtaagcgtcgtattaggtagtcggtatcgttgtcggatgcggcgtaaacgttttattcggtttacggatggtgcgggaatttgtaggtttgataagacgcgtaagcgtcgtattaggtagttggtattgttgtcggaaaaggcgtaaacgttttattcggtttacggagggtgcgggaatttgtaggtttgataagacgcgtaagcgtcgtattaggtagtcggtatcgttgtcggatgcggcgtaaacgttttattcggtt

SEQ ID NO: 28348 - DNA, 538 bp, Artificial Sequence
  chemically treated genomic DNA (Homo sapiens) CpG-island No: 28348
  misc_feature (401)..(401): n is either a, c, g or t
  misc_feature (405)..(405): n is either a, c, g or t
aaccgaataaaacgtttacgccgcatccgacaacgataccgactacctaatacgacgcttacgcgtcttatcaaacctacaaattcccgcaccctccgtaaaccgaataaaacgtttacgccttttccgacaacaataccaactacctaatacgacgcttacgcgtcttatcaaacctacaaattcccgcaccatccgtaaaccgaataaaacgtttacgccgcatccgacaacgataccgactacctaatacgacgcttacgcgtcttatcaaacctacaaattcccgcaccctccgtaaaccgaataaaacgtttacgccgcatccgacaataataccgactacctaatacgacgcttacgcgtcttatcaaacctacaattccccgcaccctccgtanaccnaaataaaacgttacgcccgcatccgaaaacaataccgactacctaatacgacgctcgcgcgtcttatcaaaccgcctctcatctaaataaatttcgaactacacttaactaacttctctttacttaaaacaac

SEQ ID NO: 28349 - DNA, 900 bp, Artificial Sequence
  chemically treated genomic DNA (Homo sapiens) CpG-island No: 28349
tttaatcgtagcgggcgttacgaggtcgtttttttttttttttcgttttgcggtagagagcgtaattttttgcgttgcgaggatcggtcggtggtttttacgtatttgttgatcgcggattacgggttttcgcgttttttttattgcggcggtggcgaggttttggtcgtgtttttcgagtcggcgcgtttgttgtttttggtcgttaacgggcgtttgtattattcggcgtcggagcgtgcgggcggcgtgggtttggtgcgtttcgttttggttttcgagtttagcgtttgtttcgagtacgggttcggcgcgtttgcgttgttttcgtacgtgcgttggtagggtcgtcgtttcgtttttattatggatttggtttcgttgttgttcgcggttcggtcgttttgagcggggttaagggaaaggcgggaggtcgcgggcgtttttcgtttcgttttttcgggattttacgtttcggaaagttcgcgttattcgcgttcgcggtagtttagtgcgtttgcgcgttcggtttcgtttttattcggcgttgtttttggtgttgtcgcggttcggttttttcggatatttcgttttttacggcgcgcgtttttcgcgtattcgatttcggcgtttttcggattggtttgcgttcgagacgttaggtataggcggcgggcgcggggttttggtgcgcgtgcgcgagcgtttttcgtttttttttagttcggcgattgttcgggttcggtcgttatttgtacggcgggggagtcgttcgtcgcgggagcgttaggtgaggggacgttcgatttaaggttattaggcgtgggggcgttgggggatcggggattatttcggttttgattttggtgcgtttcgagaagggcgtgggttttggagggg

SEQ ID NO: 28350 - DNA, 900 bp, Artificial Sequence
  chemically treated genomic DNA (Homo sapiens) CpG-island No: 28350
cccctccaaaacccacgcccttctcgaaacgcaccaaaatcaaaaccgaaataatccccgatcccccaacgcccccacgcctaataaccttaaatcgaacgtcccctcacctaacgctcccgcgacgaacgactcccccgccgtacaaataacgaccgaacccgaacaatcgccgaactaaaaaaaaacgaaaaacgctcgcgcacgcgcaccaaaaccccgcgcccgccgcctatacctaacgtctcgaacgcaaaccaatccgaaaaacgccgaaatcgaatacgcgaaaaacgcgcgccgtaaaaaacgaaatatccgaaaaaaccgaaccgcgacaacaccaaaaacaacgccgaataaaaacgaaaccgaacgcgcaaacgcactaaactaccgcgaacgcgaataacgcgaactttccgaaacgtaaaatcccgaaaaaacgaaacgaaaaacgcccgcgacctcccgcctttcccttaaccccgctcaaaacgaccgaaccgcgaacaacaacgaaaccaaatccataataaaaacgaaacgacgaccctaccaacgcacgtacgaaaacaacgcaaacgcgccgaacccgtactcgaaacaaacgctaaactcgaaaaccaaaacgaaacgcaccaaacccacgccgcccgcacgctccgacgccgaataatacaaacgcccgttaacgaccaaaaacaacaaacgcgccgactcgaaaaacacgaccaaaacctcgccaccgccgcaataaaaaaaacgcgaaaacccgtaatccgcgatcaacaaatacgtaaaaaccaccgaccgatcctcgcaacgcaaaaaattacgctctctaccgcaaaacgaaaaaaaaaaaaaaacgacctcgtaacgcccgctacgattaaa

SEQ ID NO: 28351 - DNA, 900 bp, Artificial Sequence
  chemically treated genomic DNA (Homo sapiens) CpG-island No: 28351
tttttttaggatttacgtttttttcggagcgtattagggttagagtcgggatggttttcgattttttagcgtttttacgtttggtgattttgggtcgggcgtttttttatttgacgttttcgcggcgagcggttttttcgtcgtgtaggtggcggtcgggttcgagtagtcgtcgggttgggagggggcgggggacgttcgcgtacgcgtattagagtttcgcgttcgtcgtttgtgtttgacgtttcgagcgtaggttaattcggagggcgtcggagtcgggtgcgcggggggcgcgcgtcgtggggagcggggtgttcgggagggtcgggtcgcggtagtattaaggatagcgtcgggtgggggcggggtcgagcgcgtaggcgtattaggttgtcgcgagcgcgggtggcgcgggtttttcggggcgtggagtttcgggggagcggggcgagaggcgttcgcggtttttcgttttttttttggtttcgtttagggcgatcgagtcgcgagtagtagcggggttaggtttatggtgagggcgaggcggcggttttgttagcgtacgtgcgagggtagcgtaggcgcgtcgggttcgtattcgaagtaggcgttgagttcgaaggttagggcggagcgtattaggtttacgtcgttcgtacgtttcggcgtcgggtggtataggcgttcgttggcggttaggggtagtaggcgcgtcggttcgaagggtacggttagggtttcgttatcgtcgtagtaggagaggcgcggaggttcgtggttcgcggttagtaggtgcgtgaagattatcggtcggttttcgtagcgtaggaagttgcgttttttgtcgtagggcgagaggaaggggaaagcggtttcgtagcgttcgttgcggttggg

SEQ ID NO: 28352 - DNA, 900 bp, Artificial Sequence
  chemically treated genomic DNA (Homo sapiens) CpG-island No: 28352
cccaaccgcaacgaacgctacgaaaccgctttccccttcctctcgccctacgacaaaaaacgcaacttcctacgctacgaaaaccgaccgataatcttcacgcacctactaaccgcgaaccacgaacctccgcgcctctcctactacgacgataacgaaaccctaaccgtacccttcgaaccgacgcgcctactacccctaaccgccaacgaacgcctataccacccgacgccgaaacgtacgaacgacgtaaacctaatacgctccgccctaaccttcgaactcaacgcctacttcgaatacgaacccgacgcgcctacgctaccctcgcacgtacgctaacaaaaccgccgcctcgccctcaccataaacctaaccccgctactactcgcgactcgatcgccctaaacgaaaccaaaaaaaaaacgaaaaaccgcgaacgcctctcgccccgctcccccgaaactccacgccccgaaaaacccgcgccacccgcgctcgcgacaacctaatacgcctacgcgctcgaccccgcccccacccgacgctatccttaatactaccgcgacccgaccctcccgaacaccccgctccccacgacgcgcgccccccgcgcacccgactccgacgccctccgaattaacctacgctcgaaacgtcaaacacaaacgacgaacgcgaaactctaatacgcgtacgcgaacgtcccccgccccctcccaacccgacgactactcgaacccgaccgccacctacacgacgaaaaaaccgctcgccgcgaaaacgtcaaataaaaaaacgcccgacccaaaatcaccaaacgtaaaaacgctaaaaaatcgaaaaccatcccgactctaaccctaatacgctccgaaaaaaacgtaaatcctaaaaaaa

SEQ ID NO: 28353 - DNA, 798 bp, Artificial Sequence
  chemically treated genomic DNA (Homo sapiens) CpG-island No: 28353
ggatattcggtattcgatacgggtagcggtatgtttttttttagtaatattacgttggcgtacgtcggtaagtacgagtgcgaggtttttaacgtcggcggcgttgttcgcgtgttttttcggtttttggttaacgcgtttcggtagtagtcgtagtagttcgcgtaatcgtcgttttcggtcgttcgtttcgtcggtagcgagtttcggttcgaggcgggtagtatggtttttcgcgttttgggcgtggttatatagacggttattgcggcggttatcgcgttgttggcgtttacggcgttgtttttggtcgttatgatttgtcgtcggcgtcgtaggcgaaaaaaggcgcgggggttttcgggggagggagcgttgttcgttaacgattatttggacggtttttgtacgttcgtatagttagaggagtttcgcgacgagcgcggttacgagatgttcgttattaatcgttttaagtcgtttttcgtcgagggttcggcggaggcgttcgttgattgcggttcggaatagggggcggggtcgggatttcgcgtgttttcgtcggtcgtttacgagatttattgttagggtcgcgggcgcgcggatgacgtgggcgtcggagattggtcggtgcggtttcgcgtatgtttcgttagtaaaggtggaagtcgcgtagtgtgcgttgagtcgtgtgtggggcgcgagtcgggaacgttgtattcgggaattttggggtagtaatggaaggtggtcggggaggttttaatattttttttgaagttttttcgaaaagatatt

SEQ ID NO: 28354 - DNA, 798 bp, Artificial Sequence
  chemically treated genomic DNA (Homo sapiens) CpG-island No: 28354
aatatcttttcgaaaaaacttcaaaaaaaatattaaaacctccccgaccaccttccattactaccccaaaattcccgaatacaacgttcccgactcgcgccccacacacgactcaacgcacactacgcgacttccacctttactaacgaaacatacgcgaaaccgcaccgaccaatctccgacgcccacgtcatccgcgcgcccgcgaccctaacaataaatctcgtaaacgaccgacgaaaacacgcgaaatcccgaccccgccccctattccgaaccgcaatcaacgaacgcctccgccgaaccctcgacgaaaaacgacttaaaacgattaataacgaacatctcgtaaccgcgctcgtcgcgaaactcctctaactatacgaacgtacaaaaaccgtccaaataatcgttaacgaacaacgctccctcccccgaaaacccccgcgccttttttcgcctacgacgccgacgacaaatcataacgaccaaaaacaacgccgtaaacgccaacaacgcgataaccgccgcaataaccgtctatataaccacgcccaaaacgcgaaaaaccatactacccgcctcgaaccgaaactcgctaccgacgaaacgaacgaccgaaaacgacgattacgcgaactactacgactactaccgaaacgcgttaaccaaaaaccgaaaaaacacgcgaacaacgccgccgacgttaaaaacctcgcactcgtacttaccgacgtacgccaacgtaatattactaaaaaaaaacataccgctacccgtatcgaataccgaatatcc

SEQ ID NO: 28355 - DNA, 798 bp, Artificial Sequence
  chemically treated genomic DNA (Homo sapiens) CpG-island No: 28355
gatgttttttcggaagagttttaagggaggtgttggggttttttcggttattttttattgttattttaggattttcgagtgtaacgttttcggttcgcgttttatatacggtttagcgtatattgcgcggtttttatttttattgacggagtatgcgcgaggtcgtatcggttaattttcggcgtttacgttattcgcgcgttcgcggttttagtagtggatttcgtaggcgatcggcgggggtacgcggagtttcggtttcgttttttgtttcgggtcgtagttagcgggcgttttcgtcggattttcggcgaagagcggtttggagcggttgatgacgaatatttcgtggtcgcgttcgtcgcggagtttttttagttgtgcgaacgtataggggtcgtttaagtagtcgttgacgaatagcgttttttttttcggaggttttcgcgttttttttcgtttgcggcgtcggcgatagattatggcgattaggagtagcgtcgtgagcgttagtagcgcgatggtcgtcgtaatggtcgtttgtgtggttacgtttagggcgcggaaggttatgttgttcgtttcgggtcggggttcgttgtcggcggggcgggcggtcggaggcggcggttgcgcgggttgttgcggttgttgtcgggacgcgttgattaggagtcggaagggtacgcgggtagcgtcgtcggcgttggaggtttcgtattcgtatttatcggcgtgcgttagcgtgatgttgttgaggaagagtatgtcgttgttcgtgtcggatgtcgagtgttt

SEQ ID NO: 28356 - DNA, 798 bp, Artificial Sequence
  chemically treated genomic DNA (Homo sapiens) CpG-island No: 28356
aaacactcgacatccgacacgaacaacgacatactcttcctcaacaacatcacgctaacgcacgccgataaatacgaatacgaaacctccaacgccgacgacgctacccgcgtacccttccgactcctaatcaacgcgtcccgacaacaaccgcaacaacccgcgcaaccgccgcctccgaccgcccgccccgccgacaacgaaccccgacccgaaacgaacaacataaccttccgcgccctaaacgtaaccacacaaacgaccattacgacgaccatcgcgctactaacgctcacgacgctactcctaatcgccataatctatcgccgacgccgcaaacgaaaaaaaacgcgaaaacctccgaaaaaaaaaacgctattcgtcaacgactacttaaacgacccctatacgttcgcacaactaaaaaaactccgcgacgaacgcgaccacgaaatattcgtcatcaaccgctccaaaccgctcttcgccgaaaatccgacgaaaacgcccgctaactacgacccgaaacaaaaaacgaaaccgaaactccgcgtacccccgccgatcgcctacgaaatccactactaaaaccgcgaacgcgcgaataacgtaaacgccgaaaattaaccgatacgacctcgcgcatactccgtcaataaaaataaaaaccgcgcaatatacgctaaaccgtatataaaacgcgaaccgaaaacgttacactcgaaaatcctaaaataacaataaaaaataaccgaaaaaaccccaacacctcccttaaaactcttccgaaaaaacatc

SEQ ID NO: 28357 - DNA, 773 bp, Artificial Sequence
  chemically treated genomic DNA (Homo sapiens) CpG-island No: 28357
  misc_feature (194)..(194): n is either a, c, g or t
cgtgcgtcgtttcgtttagatattttttcggtcgttcgcgtttatcggtttcgtaatcgtagttatcgtttttagtttcgtttagatcgttcgtcgtttttcgttcggcgtcgcggcgtttcgcgatgacgttgacgttttttattggttgtttgttcgaggttcgacggattggttgtttaggggcggtggtntcgttttcggttcgtcgcgtattcgtattggttgtcggttttcgcgacggttgcgcgggagattcgttggacgatcgtaagcgcggaggtcgggcgggcgcgcgcgttatggagcggttgcgggacgtgcgggagcggttgtaggcgtgggagcgcgcgtttcgacggtagcgcgggcggcgatcgagttaggtgcgggttgtttaggggtcgaggggttgagggcgcggttcgcggttgacgcgtttttaaataggacgacgtggaggcggcgtcggaggagattcgcggtgagcgcgcggcggggcggcgggggcgagaagatatcgggtcggtaggggtttaggttttattttgatttcgtttttcgttcgtttacgtagcgttttatcgggagtatcgtattttgaagcgtattacgggttaggtcggcggcgggtttcgtagtttcgagtcgtttttcgcggcggtcgaagaggtatttaggtttcgtcgttttagtttttttttatttttttgtttggcggagtggcgggagttacggagtcgcggttaggttttcgtggggtatagaatttg

SEQ ID NO: 28358 - DNA, 773 bp, Artificial Sequence
  chemically treated genomic DNA (Homo sapiens) CpG-island No: 28358
  misc_feature (580)..(580): n is either a, c, g or t
caaattctataccccacgaaaacctaaccgcgactccgtaactcccgccactccgccaaacaaaaaaataaaaaaaaactaaaacgacgaaacctaaatacctcttcgaccgccgcgaaaaacgactcgaaactacgaaacccgccgccgacctaacccgtaatacgcttcaaaatacgatactcccgataaaacgctacgtaaacgaacgaaaaacgaaatcaaaataaaacctaaacccctaccgacccgatatcttctcgcccccgccgccccgccgcgcgctcaccgcgaatctcctccgacgccgcctccacgtcgtcctatttaaaaacgcgtcaaccgcgaaccgcgccctcaacccctcgacccctaaacaacccgcacctaactcgatcgccgcccgcgctaccgtcgaaacgcgcgctcccacgcctacaaccgctcccgcacgtcccgcaaccgctccataacgcgcgcgcccgcccgacctccgcgcttacgatcgtccaacgaatctcccgcgcaaccgtcgcgaaaaccgacaaccaatacgaatacgcgacgaaccgaaaacganaccaccgcccctaaacaaccaatccgtcgaacctcgaacaaacaaccaataaaaaacgtcaacgtcatcgcgaaacgccgcgacgccgaacgaaaaacgacgaacgatctaaacgaaactaaaaacgataactacgattacgaaaccgataaacgcgaacgaccgaaaaaatatctaaacgaaacgacgcacg

SEQ ID NO: 28359 - DNA, 773 bp, Artificial Sequence
  chemically treated genomic DNA (Homo sapiens) CpG-island No: 28359
  misc_feature (580)..(580): n is either a, c, g or t
taagttttgtgttttacggaggtttggtcgcgatttcgtggttttcgttatttcgttaaatagggaagtgggaggaggttggggcggcggggtttgggtattttttcggtcgtcgcggggagcgattcggagttgcggagttcgtcgtcggtttggttcgtggtacgttttagagtgcggtattttcggtagagcgttgcgtgggcgagcgggaggcggggttagggtggggtttgggtttttgtcgattcggtgttttttcgttttcgtcgtttcgtcgcgcgtttatcgcgggtttttttcggcgtcgtttttacgtcgttttgtttgggaacgcgttagtcgcgggtcgcgtttttagtttttcggtttttgggtagttcgtatttggttcggtcgtcgttcgcgttgtcgtcggaacgcgcgtttttacgtttgtagtcgttttcgtacgtttcgtagtcgttttatggcgcgcgcgttcgttcggttttcgcgtttgcgatcgtttagcgaatttttcgcgtagtcgtcgcgggggtcgatagttaatgcggatgcgcggcgggtcgggggcggngttatcgtttttgggtagttagttcgtcgggtttcggataagtagttaatgggaggcgttaacgttatcgcggggcgtcgcggcgtcgggcggggagcggcggacggtttaggcggggttggaggcggtggttgcggttgcgggatcggtgagcgcgggcggtcgggggggtgtttgagcggggcggcgtacg

SEQ ID NO: 28360 - DNA, 773 bp, Artificial Sequence
  chemically treated genomic DNA (Homo sapiens) CpG-island No: 28360
  misc_feature (194)..(194): n is either a, c, g or t
cgtacgccgccccgctcaaacacccccccgaccgcccgcgctcaccgatcccgcaaccgcaaccaccgcctccaaccccgcctaaaccgtccgccgctccccgcccgacgccgcgacgccccgcgataacgttaacgcctcccattaactacttatccgaaacccgacgaactaactacccaaaaacgataacnccgcccccgacccgccgcgcatccgcattaactatcgacccccgcgacgactacgcgaaaaattcgctaaacgatcgcaaacgcgaaaaccgaacgaacgcgcgcgccataaaacgactacgaaacgtacgaaaacgactacaaacgtaaaaacgcgcgttccgacgacaacgcgaacgacgaccgaaccaaatacgaactacccaaaaaccgaaaaactaaaaacgcgacccgcgactaacgcgttcccaaacaaaacgacgtaaaaacgacgccgaaaaaaacccgcgataaacgcgcgacgaaacgacgaaaacgaaaaaacaccgaatcgacaaaaacccaaaccccaccctaaccccgcctcccgctcgcccacgcaacgctctaccgaaaataccgcactctaaaacgtaccacgaaccaaaccgacgacgaactccgcaactccgaatcgctccccgcgacgaccgaaaaaatacccaaaccccgccgccccaacctcctcccacttccctatttaacgaaataacgaaaaccacgaaatcgcgaccaaacctccgtaaaacacaaaactta

SEQ ID NO: 28361 - DNA, 586 bp, Artificial Sequence
  chemically treated genomic DNA (Homo sapiens) CpG-island No: 28361
gttttcgaggaatttacggcgaagttcgcgttttaggtttatgttcggatcgtcgcgggattcggatttttcgcgttgcgtcgcggtttcgtttttcgtcgtcgatacgtaggtttcgtttttcgtcgtcgatacgtaggtttcgtttttcgacggcggcggcgggcgcggggtatttcgggaagtacggtcggttcgttcgcggtattttcggagttttcgtgcgggaggagttggggcggggtggcggcgataattggggcgttttattttaggggtcgttttttcggacgtcgggttggttcgcgcgtggagttttttgttcggttcggggagtgtttggtggggatttcgttttttttcgtaggcggcggggacgcgggaggtcgggggttcggagttagttcgttcggggtcgtagcgcgttttgggtggggttttttgggttgtagttttcgtgtcgttcgcgttatttatggtggacgagttgtgtcgtcgttttaatttttttcgaaatttatatatatagtttgtttataggcgtaattattaaaaacgaacgtagtgtttagatagattgacgata

SEQ ID NO: 28362 - DNA, 586 bp, Artificial Sequence
  chemically treated genomic DNA (Homo sapiens) CpG-island No: 28362
tatcgtcaatctatctaaacactacgttcgtttttaataattacgcctataaacaaactatatatataaatttcgaaaaaaattaaaacgacgacacaactcgtccaccataaataacgcgaacgacacgaaaactacaacccaaaaaaccccacccaaaacgcgctacgaccccgaacgaactaactccgaacccccgacctcccgcgtccccgccgcctacgaaaaaaaacgaaatccccaccaaacactccccgaaccgaacaaaaaactccacgcgcgaaccaacccgacgtccgaaaaaacgacccctaaaataaaacgccccaattatcgccgccaccccgccccaactcctcccgcacgaaaactccgaaaataccgcgaacgaaccgaccgtacttcccgaaataccccgcgcccgccgccgccgtcgaaaaacgaaacctacgtatcgacgacgaaaaacgaaacctacgtatcgacgacgaaaaacgaaaccgcgacgcaacgcgaaaaatccgaatcccgcgacgatccgaacataaacctaaaacgcgaacttcgccgtaaattcctcgaaaac

SEQ ID NO: 28363 - DNA, 586 bp, Artificial Sequence
  chemically treated genomic DNA (Homo sapiens) CpG-island No: 28363
tatcgttagtttatttggatattacgttcgtttttaatagttgcgtttgtgagtaggttgtgtgtgtgaatttcgggaggaattggggcggcggtatagttcgtttattatgagtagcgcgggcggtacgggggttgtagtttagaagattttatttagggcgcgttgcgatttcggacgggttggtttcgggttttcggtttttcgcgttttcgtcgtttacgaggaggaacggggtttttattaggtatttttcgggtcgggtagagggttttacgcgcgggttaattcggcgttcgggaagacggtttttagggtgggacgttttagttgtcgtcgttatttcgttttagtttttttcgtacgagaatttcgaggatgtcgcgggcgggtcgatcgtatttttcggaatgtttcgcgttcgtcgtcgtcgtcgaggggcggggtttgcgtgtcggcggcgaggggcggggtttgcgtgtcggcggcgaggggcggggtcgcggcgtagcgcgggaagttcggatttcgcggcgattcgagtatgagtttggagcgcgagtttcgtcgtaagtttttcggggat

SEQ ID NO: 28364 - DNA, 586 bp, Artificial Sequence
  chemically treated genomic DNA (Homo sapiens) CpG-island No: 28364
atccccgaaaaacttacgacgaaactcgcgctccaaactcatactcgaatcgccgcgaaatccgaacttcccgcgctacgccgcgaccccgcccctcgccgccgacacgcaaaccccgcccctcgccgccgacacgcaaaccccgcccctcgacgacgacgacgaacgcgaaacattccgaaaaatacgatcgacccgcccgcgacatcctcgaaattctcgtacgaaaaaaactaaaacgaaataacgacgacaactaaaacgtcccaccctaaaaaccgtcttcccgaacgccgaattaacccgcgcgtaaaaccctctacccgacccgaaaaatacctaataaaaaccccgttcctcctcgtaaacgacgaaaacgcgaaaaaccgaaaacccgaaaccaacccgtccgaaatcgcaacgcgccctaaataaaatcttctaaactacaacccccgtaccgcccgcgctactcataataaacgaactataccgccgccccaattcctcccgaaattcacacacacaacctactcacaaacgcaactattaaaaacgaacgtaatatccaaataaactaacgata

SEQ ID NO: 28365 - DNA, 650 bp, Artificial Sequence
  chemically treated genomic DNA (Homo sapiens) CpG-island No: 28365
gagatttttttcggtttcgtttttcgagtaatagttttgttttcgtttatttggttttggtggtttacgtagtagaaatattcgcgggttcggggtttcggattttggttttgcgtgtaggaaacgtttttattttcgttgtaggttcgggtttttcgcgatcgcgttaaggttagggttcggagcgtttcgtaaggcggttatatttttttttcgcgtcggaagcgattagtaggttacgtcgggggcggtgttgcgcgaattcgcgtttgttcgtagtagtttcgcgtttcgcgtttcggcggcgttcgttttcgcgattcgggttcggcgtttttttttttttttcgggtttcgggggttcgttcgttttggtttttcgagaggcgtgtgtcggcgacgtttttttcggttcgtttcgcgttttttttcgttttcggtcgcgtttataaggaacgggaggacgcgtagggtttatgtgtattttatttattcgtgtcgtcgtttttcgggtttatgcgtttgggcgagcgttttagtcgggcgggatcgtaaaggtttcgggattattcgattgaggacgtcgtttaggtttcggtagggttggggtttttgtttttaataaataaaaacggaattttaaaaaatat

SEQ ID NO: 28366 - DNA, 650 bp, Artificial Sequence
  chemically treated genomic DNA (Homo sapiens) CpG-island No: 28366
atattttttaaaattccgtttttatttattaaaaacaaaaaccccaaccctaccgaaacctaaacgacgtcctcaatcgaataatcccgaaacctttacgatcccgcccgactaaaacgctcgcccaaacgcataaacccgaaaaacgacgacacgaataaataaaatacacataaaccctacgcgtcctcccgttccttataaacgcgaccgaaaacgaaaaaaaacgcgaaacgaaccgaaaaaaacgtcgccgacacacgcctctcgaaaaaccaaaacgaacgaacccccgaaacccgaaaaaaaaaaaaaaacgccgaacccgaatcgcgaaaacgaacgccgccgaaacgcgaaacgcgaaactactacgaacaaacgcgaattcgcgcaacaccgcccccgacgtaacctactaatcgcttccgacgcgaaaaaaaaatataaccgccttacgaaacgctccgaaccctaaccttaacgcgatcgcgaaaaacccgaacctacaacgaaaataaaaacgtttcctacacgcaaaaccaaaatccgaaaccccgaacccgcgaatatttctactacgtaaaccaccaaaaccaaataaacgaaaacaaaactattactcgaaaaacgaaaccgaaaaaaatctc

SEQ ID NO: 28367 - DNA, 650 bp, Artificial Sequence
  chemically treated genomic DNA (Homo sapiens) CpG-island No: 28367
atattttttagagtttcgtttttatttattaaaaataaaagttttagttttgtcgaggtttgggcggcgtttttagtcgggtggtttcggggtttttgcggtttcgttcggttgagacgttcgtttagacgtatggattcgagaggcgacgatacgagtgaataaagtgtatatggattttgcgcgttttttcgttttttgtgggcgcggtcgggggcgggaagagacgcggggcggatcggaaggggcgtcgtcggtatacgtttttcggaaggttagggcgggcgagttttcgaggttcgagggagagggaagagcgtcgggttcgggtcgcggaggcgggcgtcgtcggaacgcgaagcgcggggttattgcgggtaggcgcgagttcgcgtagtatcgttttcggcgtgatttgttggtcgttttcggcgcgggaggagaatgtggtcgttttgcgggacgtttcggattttggttttggcgcggtcgcggggagttcgggtttgtagcggggatgggggcgttttttatacgtagggttagagttcggagtttcggattcgcgagtatttttattacgtggattattagggttaggtgggcgggggtagggttgttgttcgagaggcggggtcgggagaggtttt

SEQ ID NO: 28368 - DNA, 650 bp, Artificial Sequence
  chemically treated genomic DNA (Homo sapiens) CpG-island No: 28368
aaaacctctcccgaccccgcctctcgaacaacaaccctacccccgcccacctaaccctaataatccacgtaataaaaatactcgcgaatccgaaactccgaactctaaccctacgtataaaaaacgcccccatccccgctacaaacccgaactccccgcgaccgcgccaaaaccaaaatccgaaacgtcccgcaaaacgaccacattctcctcccgcgccgaaaacgaccaacaaatcacgccgaaaacgatactacgcgaactcgcgcctacccgcaataaccccgcgcttcgcgttccgacgacgcccgcctccgcgacccgaacccgacgctcttccctctccctcgaacctcgaaaactcgcccgccctaaccttccgaaaaacgtataccgacgacgccccttccgatccgccccgcgtctcttcccgcccccgaccgcgcccacaaaaaacgaaaaaacgcgcaaaatccatatacactttattcactcgtatcgtcgcctctcgaatccatacgtctaaacgaacgtctcaaccgaacgaaaccgcaaaaaccccgaaaccacccgactaaaaacgccgcccaaacctcgacaaaactaaaacttttatttttaataaataaaaacgaaactctaaaaaatat

SEQ ID NO: 28369 - DNA, 753 bp, Artificial Sequence
  chemically treated genomic DNA (Homo sapiens) CpG-island No: 28369
tcggggtcgagtcgagggttttcggtacggtttcgtcgtttcgcgtttcgtgttcgttttcgtttcgggaatttcggcgtgggggtggggtaggcggcgggagacgacgggttgtacggttagtttcgtttatttgggcggggttttcgggtttcgcggtcgtcgcggcgttattatttttgcggaagaggttgtagaagatgtagatgagtaacgagtaaaaggcgtatatgggagcgcggggcggtagagggtttcgtttcgcgtcgtttcgcgttttcgcgtttagattcggcgttcgttcgtcgtagtgtcggtgcgtatgttcgcgacggtcgtttttacggttcggtttttacggttggaaggcgagcgcggggacgggggtattagaaataggtgttcgcggtcgtatttggagattcgtcgttttttacggcgtcgttcggcgcgttttaatttttatatcgcggatatcgggttgagagcgtttacggttttcgcgatttttttttcggaattttttttatttttcgcgtagttttttatcgtttcggtttcgcggagtttttaatacgtcggggtttttttttttttttttatagtttcgtttattttagtttcgtttagatttttttttttcgtagtttcgtttaaatttcgttttttgtagtttcgtttaggttttttttttttcggttttttttagtttcgtttagatttttttttttggagttatcgtttagggtttcg

SEQ ID NO: 28370 - DNA, 753 bp, Artificial Sequence
  chemically treated genomic DNA (Homo sapiens) CpG-island No: 28370
cgaaaccctaaacgataactccaaaaaaaaaaatctaaacgaaactaaaaaaaaccgaaaaaaaaaaaacctaaacgaaactacaaaaaacgaaatttaaacgaaactacgaaaaaaaaaaatctaaacgaaactaaaataaacgaaactataaaaaaaaaaaaaaaaaccccgacgtattaaaaactccgcgaaaccgaaacgataaaaaactacgcgaaaaataaaaaaaattccgaaaaaaaaatcgcgaaaaccgtaaacgctctcaacccgatatccgcgatataaaaattaaaacgcgccgaacgacgccgtaaaaaacgacgaatctccaaatacgaccgcgaacacctatttctaatacccccgtccccgcgctcgccttccaaccgtaaaaaccgaaccgtaaaaacgaccgtcgcgaacatacgcaccgacactacgacgaacgaacgccgaatctaaacgcgaaaacgcgaaacgacgcgaaacgaaaccctctaccgccccgcgctcccatatacgccttttactcgttactcatctacatcttctacaacctcttccgcaaaaataataacgccgcgacgaccgcgaaacccgaaaaccccgcccaaataaacgaaactaaccgtacaacccgtcgtctcccgccgcctaccccacccccacgccgaaattcccgaaacgaaaacgaacacgaaacgcgaaacgacgaaaccgtaccgaaaaccctcgactcgaccccga

SEQ ID NO: 28371 - DNA, 753 bp, Artificial Sequence
  chemically treated genomic DNA (Homo sapiens) CpG-island No: 28371
cggggttttgggcggtggttttaagaaaaggggtttgggcgagattgagagggatcgagaggggaggagtttgggcgaggttgtaaggaacggggtttgggcggggttgcgaggagggggggtttgggcggggttgagatgggcggggttgtagggagaggaaggagaatttcggcgtgttgaaggtttcgcgaaatcggagcggtgggggattacgcggagggtgggagggatttcgagaggagggtcgcgggagtcgtgggcgtttttagttcggtgttcgcggtgtaggggttggggcgcgtcgggcggcgtcgtgagaaacggcgggtttttaggtgcggtcgcgggtatttgtttttagtattttcgttttcgcgttcgttttttagtcgtgggagtcgggtcgtgggggcggtcgtcgcgagtatgcgtatcggtattgcggcgggcgggcgtcgagtttgggcgcggggacgcggggcggcgcgaagcggggttttttgtcgtttcgcgtttttatgtacgttttttattcgttgtttatttatattttttatagtttttttcgtagggatggtggcgtcgcggcggtcgcggagttcggggatttcgtttaggtgagcggggttggtcgtgtagttcgtcgtttttcgtcgtttgttttatttttacgtcgaggttttcggggcgggggcgggtacggggcgcggggcgacggggtcgtgtcgaggattttcggttcggtttcga

SEQ ID NO: 28372 - DNA, 753 bp, Artificial Sequence
  chemically treated genomic DNA (Homo sapiens) CpG-island No: 28372
tcgaaaccgaaccgaaaatcctcgacacgaccccgtcgccccgcgccccgtacccgcccccgccccgaaaacctcgacgtaaaaataaaacaaacgacgaaaaacgacgaactacacgaccaaccccgctcacctaaacgaaatccccgaactccgcgaccgccgcgacgccaccatccctacgaaaaaaactataaaaaatataaataaacaacgaataaaaaacgtacataaaaacgcgaaacgacaaaaaaccccgcttcgcgccgccccgcgtccccgcgcccaaactcgacgcccgcccgccgcaataccgatacgcatactcgcgacgaccgcccccacgacccgactcccacgactaaaaaacgaacgcgaaaacgaaaatactaaaaacaaatacccgcgaccgcacctaaaaacccgccgtttctcacgacgccgcccgacgcgccccaacccctacaccgcgaacaccgaactaaaaacgcccacgactcccgcgaccctcctctcgaaatccctcccaccctccgcgtaatcccccaccgctccgatttcgcgaaaccttcaacacgccgaaattctccttcctctccctacaaccccgcccatctcaaccccgcccaaaccccccctcctcgcaaccccgcccaaaccccgttccttacaacctcgcccaaactcctcccctctcgatccctctcaatctcgcccaaaccccttttcttaaaaccaccgcccaaaaccccg

SEQ ID NO: 28373 - DNA, 546 bp, Artificial Sequence
  chemically treated genomic DNA (Homo sapiens) CpG-island No: 28373
ttttcggtcgtcgggttcgcggtcgttttttgtttggagcgcgcggggtagaagttggagtttttcgtttattgcgtgttcgttatttagcggatttagtttagcgtcgagttcgtcgtcgagaacgatacggatatcgatagcggttacggcggcgaagtcgaggttcggtcggatcgcgagaaaggtaaaggcgcgggggcgagtcgcgttattattaagtaggagtttttcggggaggattcgtcggcgtttaagaggatgaagttggattttcgcggcggcggtagcggcggcggttcggggggcggcgcggcggcggcggtagtcgcgtttttggggttcgattttgtcgtcgcggtcgcgttgttgagattcgacgtcgttttgtttagttcgttggtggcgttcggcggaggcggaggcgcgtttttttcgtagttcgcggtcgtcgcggtttttttttgtttgtttttttgttttttttcgttttttgtagttgtcgtttacgtgtagttttttttggataagagcggtttggagaag

SEQ ID NO: 28374 - DNA, 546 bp, Artificial Sequence
  chemically treated genomic DNA (Homo sapiens) CpG-island No: 28374
cttctccaaaccgctcttatccaaaaaaaactacacgtaaacgacaactacaaaaaacgaaaaaaaacaaaaaaacaaacaaaaaaaaaccgcgacgaccgcgaactacgaaaaaaacgcgcctccgcctccgccgaacgccaccaacgaactaaacaaaacgacgtcgaatctcaacaacgcgaccgcgacgacaaaatcgaaccccaaaaacgcgactaccgccgccgccgcgccgccccccgaaccgccgccgctaccgccgccgcgaaaatccaacttcatcctcttaaacgccgacgaatcctccccgaaaaactcctacttaataataacgcgactcgcccccgcgcctttacctttctcgcgatccgaccgaacctcgacttcgccgccgtaaccgctatcgatatccgtatcgttctcgacgacgaactcgacgctaaactaaatccgctaaataacgaacacgcaataaacgaaaaactccaacttctaccccgcgcgctccaaacaaaaaacgaccgcgaacccgacgaccgaaaa

SEQ ID NO: 28375 - DNA, 546 bp, Artificial Sequence
  chemically treated genomic DNA (Homo sapiens) CpG-island No: 28375
tttttttaggtcgtttttgtttaggaagggttgtacgtaggcggtagttgtagaaggcgagaggaagtagaagggtaggtagaagggggtcgcggcggtcgcgggttgcgggaagggcgcgttttcgttttcgtcgaacgttattagcgagttgagtagggcggcgtcgggttttagtagcgcggtcgcggcggtagggtcgggttttagaagcgcggttgtcgtcgtcgtcgcgtcgtttttcgggtcgtcgtcgttgtcgtcgtcgcgggaatttagttttatttttttgggcgtcggcgagtttttttcgggaggtttttgtttgatggtgacgcggttcgttttcgcgtttttgtttttttcgcggttcggtcgggtttcggtttcgtcgtcgtagtcgttgtcggtgttcgtgtcgttttcggcggcgagttcggcgttgggttgagttcgttggatgacgggtacgtagtaggcgaggggttttagtttttgtttcgcgcgttttaggtagggggcggtcgcggattcggcggtcgaggg

SEQ ID NO: 28376 - DNA, 546 bp, Artificial Sequence
  chemically treated genomic DNA (Homo sapiens) CpG-island No: 28376
ccctcgaccgccgaatccgcgaccgccccctacctaaaacgcgcgaaacaaaaactaaaacccctcgcctactacgtacccgtcatccaacgaactcaacccaacgccgaactcgccgccgaaaacgacacgaacaccgacaacgactacgacgacgaaaccgaaacccgaccgaaccgcgaaaaaaacaaaaacgcgaaaacgaaccgcgtcaccatcaaacaaaaacctcccgaaaaaaactcgccgacgcccaaaaaaataaaactaaattcccgcgacgacgacaacgacgacgacccgaaaaacgacgcgacgacgacgacaaccgcgcttctaaaacccgaccctaccgccgcgaccgcgctactaaaacccgacgccgccctactcaactcgctaataacgttcgacgaaaacgaaaacgcgcccttcccgcaacccgcgaccgccgcgacccccttctacctacccttctacttcctctcgccttctacaactaccgcctacgtacaacccttcctaaacaaaaacgacctaaaaaaa

SEQ ID NO: 28377 - DNA, 669 bp, Artificial Sequence
  chemically treated genomic DNA (Homo sapiens) CpG-island No: 28377
gtcgtgcggtttgtgcggtcgtcgtacgtttcgtcgggtttcgtgtttttatcgtcgttttacgtgtttcgggagcgtcgcggtcgtttcgtcgtttttcggaggcgcggggttgggggagttgtaggaatcgttttttttttttgattttttagtttcgtttcgttatcgtcgtcgcggaattttagtttcgttcggagtttcgggcggttttcgtcggtgggaaggacgtttatggttttcggcgcgcggttgttcggttttcgttgtttttttcgtttcgcggcgtcggttagtttcgggaggaggcgcggtttcgttttcgtcggtggtgttttttcgggcgcggcgttagcgggttttggattttcgaggtgttcgggtttttttcgagtcggtatttgagtcgttttttttcgtttcggatcgggcgagaaggagattgttacgttattgagttatttggggttatttgttgttcgggttcggtttttatttagagcgttttttcgtgcgcgagaaggcgtaggacgtggttaaatattcgtgggaaagagttaataatatcgagggggaaggcgtttaagtcgttcgtattttatttttaattaagtacgtgatttaatttaaaaagagggtgatttttgttttttatttagtcggtaggtt

SEQ ID NO: 28378 - DNA, 669 bp, Artificial Sequence
  chemically treated genomic DNA (Homo sapiens) CpG-island No: 28378
aacctaccgactaaataaaaaacaaaaatcaccctctttttaaattaaatcacgtacttaattaaaaataaaatacgaacgacttaaacgccttccccctcgatattattaactctttcccacgaatatttaaccacgtcctacgccttctcgcgcacgaaaaaacgctctaaataaaaaccgaacccgaacaacaaataaccccaaataactcaataacgtaacaatctccttctcgcccgatccgaaacgaaaaaaaacgactcaaataccgactcgaaaaaaacccgaacacctcgaaaatccaaaacccgctaacgccgcgcccgaaaaaacaccaccgacgaaaacgaaaccgcgcctcctcccgaaactaaccgacgccgcgaaacgaaaaaaacaacgaaaaccgaacaaccgcgcgccgaaaaccataaacgtccttcccaccgacgaaaaccgcccgaaactccgaacgaaactaaaattccgcgacgacgataacgaaacgaaactaaaaaatcaaaaaaaaaaaacgattcctacaactcccccaaccccgcgcctccgaaaaacgacgaaacgaccgcgacgctcccgaaacacgtaaaacgacgataaaaacacgaaacccgacgaaacgtacgacgaccgcacaaaccgcacgac

SEQ ID NO: 28379 - DNA, 669 bp, Artificial Sequence
  chemically treated genomic DNA (Homo sapiens) CpG-island No: 28379
agtttgtcggttgaataagaggtaagagttattttttttttgagttaaattacgtgtttaattaaaagtgaggtgcgggcggtttaggcgttttttttttcggtgttgttggtttttttttacgggtgtttggttacgttttgcgttttttcgcgtacgggagagcgttttgggtagaggtcgggttcgggtagtaggtggttttaggtagtttagtggcgtggtagtttttttttcgttcggttcggagcggaggggagcggtttaggtgtcggttcgggggaggttcgggtatttcggggatttagagttcgttggcgtcgcgttcgggagggtattatcggcgaggacgaagtcgcgttttttttcggaattggtcggcgtcgcgaggcgggaggagtagcgggagtcgggtagtcgcgcgtcggggattatggacgttttttttatcggcgggggtcgttcggggtttcggacggagttggaatttcgcggcggcggtggcgaggcgaggttggagagttaggaggaagaaacgatttttgtagtttttttagtttcgcgttttcggggagcggcggagcggtcgcggcgttttcgggatacgtgggacggcgatgaggatacggagttcggcgaggcgtgcggcggtcgtataagtcgtacggt

SEQ ID NO: 28380 - DNA, 669 bp, Artificial Sequence
  chemically treated genomic DNA (Homo sapiens) CpG-island No: 28380
accgtacgacttatacgaccgccgcacgcctcgccgaactccgtatcctcatcgccgtcccacgtatcccgaaaacgccgcgaccgctccgccgctccccgaaaacgcgaaactaaaaaaactacaaaaatcgtttcttcctcctaactctccaacctcgcctcgccaccgccgccgcgaaattccaactccgtccgaaaccccgaacgacccccgccgataaaaaaaacgtccataatccccgacgcgcgactacccgactcccgctactcctcccgcctcgcgacgccgaccaattccgaaaaaaaacgcgacttcgtcctcgccgataataccctcccgaacgcgacgccaacgaactctaaatccccgaaatacccgaacctcccccgaaccgacacctaaaccgctcccctccgctccgaaccgaacgaaaaaaaaactaccacgccactaaactacctaaaaccacctactacccgaacccgacctctacccaaaacgctctcccgtacgcgaaaaaacgcaaaacgtaaccaaacacccgtaaaaaaaaaccaacaacaccgaaaaaaaaaacgcctaaaccgcccgcacctcacttttaattaaacacgtaatttaactcaaaaaaaaaataactcttacctcttattcaaccgacaaact

SEQ ID NO: 28381 - DNA, 723 bp, Artificial Sequence
  chemically treated genomic DNA (Homo sapiens) CpG-island No: 28381
gattattggaatatgattatattacgcgtatgagttacgaatacgcgattatttacgtaaaacgttgttatgttcgagaaaacggtagtaaattcgatttaacgggtatatacgagaataatgatatttcggttaaagttcgttattgtcgattcgttcgcgattcgcgggaatacgtttttatttgttttttacgacggaaatcgcgttaacgcggttttatatgttgcgacgcgcgtattttatgcgtgttttcgttggatatattttcggtttatcgcgaaatagttatcgatattcgattaaagatggatcgatgtaggtcgtatattaggcgtatattcgcgttatatacgtcgcggattatatttttattcgttggtttattgtcgcgtataaattcgggatatttttcgcgcgattcgacggggattatcggggataattattcgtagcgatgagtagtaaagattgataatttatcgcgtatataatttttcgtatttttacggcgttgttttatgagttattttatttatatatcgatacggaacgacgcggagaacgacgttatgatgatttcgttgacgtcgcgaggagatacgtttaatatttgtttgcgtatttgcgggagtatattatcgatttaatcgcgtaatatgcgtattttatatcgttcgtatgtatttgtagttatattcggtatatatgagtgtttataat

SEQ ID NO: 28382 - DNA, 723 bp, Artificial Sequence
  chemically treated genomic DNA (Homo sapiens) CpG-island No: 28382
attataaacactcatatataccgaatataactacaaatacatacgaacgatataaaatacgcatattacgcgattaaatcgataatatactcccgcaaatacgcaaacaaatattaaacgtatctcctcgcgacgtcaacgaaatcatcataacgtcgttctccgcgtcgttccgtatcgatatataaataaaataactcataaaacaacgccgtaaaaatacgaaaaattatatacgcgataaattatcaatctttactactcatcgctacgaataattatccccgataatccccgtcgaatcgcgcgaaaaatatcccgaatttatacgcgacaataaaccaacgaataaaaatataatccgcgacgtatataacgcgaatatacgcctaatatacgacctacatcgatccatctttaatcgaatatcgataactatttcgcgataaaccgaaaatatatccaacgaaaacacgcataaaatacgcgcgtcgcaacatataaaaccgcgttaacgcgatttccgtcgtaaaaaacaaataaaaacgtattcccgcgaatcgcgaacgaatcgacaataacgaactttaaccgaaatatcattattctcgtatatacccgttaaatcgaatttactaccgttttctcgaacataacaacgttttacgtaaataatcgcgtattcgtaactcatacgcgtaatataatcatattccaataatc

SEQ ID NO: 28383 - DNA, 723 bp, Artificial Sequence
  chemically treated genomic DNA (Homo sapiens) CpG-island No: 28383
gttgtaggtatttatatgtgtcgggtatagttgtaggtgtatgcgagcgatatagggtgcgtatgttgcgcggttagatcggtggtgtgttttcgtagatacgtagatagatgttgagcgtgttttttcgcggcgttagcgaggttattatggcgtcgtttttcgcgtcgtttcgtgtcgatgtgtgggtagagtagtttatggagtagcgtcgtagagatgcgagggattgtgtgcgcggtgagttgttagtttttgttgtttatcgttgcgggtggttgttttcgatgattttcgtcgggtcgcgcgggggatgtttcggatttgtgcgcggtagtaggttagcgagtgagggtgtgattcgcggcgtgtgtggcgcgaatatgcgtttgatatgcggtttgtatcgatttatttttgatcggatgtcggtggttatttcgcgataggtcgggggtatgtttagcggggatacgtatgagatgcgcgcgtcgtagtatgtgaggtcgcgttggcgcggttttcgtcgtgagaggtagatggaggcgtgttttcgcgaatcgcgggcgagtcggtagtggcgaattttgatcgggatgttattgttttcgtatgtgttcgttgagtcgagtttgttgtcgttttttcgggtatagtagcgttttgcgtgagtgatcgcgtgttcgtggtttatgcgcgtggtatggttatattttagtggtt

SEQ ID NO: 28384 - DNA, 723 bp, Artificial Sequence
  chemically treated genomic DNA (Homo sapiens) CpG-island No: 28384
aaccactaaaatataaccataccacgcgcataaaccacgaacacgcgatcactcacgcaaaacgctactatacccgaaaaaacgacaacaaactcgactcaacgaacacatacgaaaacaataacatcccgatcaaaattcgccactaccgactcgcccgcgattcgcgaaaacacgcctccatctacctctcacgacgaaaaccgcgccaacgcgacctcacatactacgacgcgcgcatctcatacgtatccccgctaaacatacccccgacctatcgcgaaataaccaccgacatccgatcaaaaataaatcgatacaaaccgcatatcaaacgcatattcgcgccacacacgccgcgaatcacaccctcactcgctaacctactaccgcgcacaaatccgaaacatcccccgcgcgacccgacgaaaatcatcgaaaacaaccacccgcaacgataaacaacaaaaactaacaactcaccgcgcacacaatccctcgcatctctacgacgctactccataaactactctacccacacatcgacacgaaacgacgcgaaaaacgacgccataataacctcgctaacgccgcgaaaaaacacgctcaacatctatctacgtatctacgaaaacacaccaccgatctaaccgcgcaacatacgcaccctatatcgctcgcatacacctacaactatacccgacacatataaatacctacaac

SEQ ID NO: 28385 - DNA, 681 bp, Artificial Sequence
  chemically treated genomic DNA (Homo sapiens) CpG-island No: 28385
  misc_feature (68)..(68): n is either a, c, g or t
  misc_feature (235)..(235): n is either a, c, g or t
  misc_feature (463)..(463): n is either a, c, g or t
  misc_feature (570)..(570): n is either a, c, g or t
  misc_feature (654)..(654): n is either a, c, g or t
gggtcgtcgggcggtcgcgcgcgcgggtcgcgtagcgggcgcgcgcggcggcgggtcgtcgtcggagncggtcgtcgtcgtttcggttttttttcgtcgcggtcgcggcgcgcgcgtcgcgggcggggggtcgggcgcgcggtcggtttcggcgcgcggcgcgttcggtcgcgtcggtcgcgcgcggcggacgcgcgtttcgttttcggtcgtcgatcgggcgcgtcgtacgttncgtcggtcgcggcgtcgttcgttcgtcggcgtcgtcgcgcggggcgcgtcgtcgcgagtcgcgacgcgcgcgtgcgtcgcggcgggcggaggcggcggggagacgatcgcgcgtcgcgttcgacggcgcgacgcggggcggcgttcgaatcgggtcggtcgcgatttcgcgggcgagttcggtcgcggcgggcgggcgcgcgggggcgcgcggcgcgttgtttcgggntagcggcggcgtcgcggcgcggcgggcgtcgtcgtcgggcgacggggtcgggttcgtcgtttcgcggtttgttgcgcgttatttttttgcgttcgtttagttcgttngtcgggcgcgcgggcgtgcgggtcgcgttcgcgttgttcgcggttcgtttgtttatggacgttttaataggttttattttcgtntgttcgatcgcggagtttttcgttttt

SEQ ID NO: 28386 - DNA, 681 bp, Artificial Sequence
  chemically treated genomic DNA (Homo sapiens) CpG-island No: 28386
  misc_feature (28)..(28): n is either a, c, g or t
  misc_feature (112)..(112): n is either a, c, g or t
  misc_feature (219)..(219): n is either a, c, g or t
  misc_feature (447)..(447): n is either a, c, g or t
  misc_feature (614)..(614): n is either a, c, g or t
aaaaacgaaaaactccgcgatcgaacanacgaaaataaaacctattaaaacgtccataaacaaacgaaccgcgaacaacgcgaacgcgacccgcacgcccgcgcgcccgacnaacgaactaaacgaacgcaaaaaaataacgcgcaacaaaccgcgaaacgacgaacccgaccccgtcgcccgacgacgacgcccgccgcgccgcgacgccgccgctancccgaaacaacgcgccgcgcgcccccgcgcgcccgcccgccgcgaccgaactcgcccgcgaaatcgcgaccgacccgattcgaacgccgccccgcgtcgcgccgtcgaacgcgacgcgcgatcgtctccccgccgcctccgcccgccgcgacgcacgcgcgcgtcgcgactcgcgacgacgcgccccgcgcgacgacgccgacgaacgaacgacgccgcgaccgacgnaacgtacgacgcgcccgatcgacgaccgaaaacgaaacgcgcgtccgccgcgcgcgaccgacgcgaccgaacgcgccgcgcgccgaaaccgaccgcgcgcccgaccccccgcccgcgacgcgcgcgccgcgaccgcgacgaaaaaaaaccgaaacgacgacgaccgnctccgacgacgacccgccgccgcgcgcgcccgctacgcgacccgcgcgcgcgaccgcccgacgaccc

SEQ ID NO: 28387 - DNA, 681 bp, Artificial Sequence
  chemically treated genomic DNA (Homo sapiens) CpG-island No: 28387
  misc_feature (28)..(28): n is either a, c, g or t
  misc_feature (112)..(112): n is either a, c, g or t
  misc_feature (219)..(219): n is either a, c, g or t
  misc_feature (447)..(447): n is either a, c, g or t
  misc_feature (614)..(614): n is either a, c, g or t
ggagacgagggatttcgcggtcgagtanacggggatagaatttattgagacgtttatagataggcggatcgcgaatagcgcgggcgcgattcgtacgttcgcgcgttcggtnaacgagttgaacgagcgtaggaaggtagcgcgtagtagatcgcgggacgacggattcgatttcgtcgttcggcggcggcgttcgtcgcgtcgcggcgtcgtcgttgnttcggggtagcgcgtcgcgcgttttcgcgcgttcgttcgtcgcggtcgggttcgttcgcggggtcgcggtcggttcggttcgagcgtcgtttcgcgtcgcgtcgtcgggcgcggcgcgcggtcgttttttcgtcgttttcgttcgtcgcggcgtacgcgcgcgtcgcggttcgcggcggcgcgtttcgcgcgacggcgtcggcgggcgggcggcgtcgcggtcggcgnggcgtgcggcgcgttcggtcggcggtcgggggcggggcgcgcgttcgtcgcgcgcggtcggcgcggtcgggcgcgtcgcgcgtcggggtcggtcgcgcgttcggtttttcgttcgcggcgcgcgcgtcgcggtcgcggcgggggggggtcggggcggcggcggtcgntttcggcggcggttcgtcgtcgcgcgcgttcgttgcgcggttcgcgcgcgcggtcgttcggcggttt

SEQ ID NO: 28388 - DNA, 681 bp, Artificial Sequence
  chemically treated genomic DNA (Homo sapiens) CpG-island No: 28388
  misc_feature (68)..(68): n is either a, c, g or t
  misc_feature (235)..(235): n is either a, c, g or t
  misc_feature (463)..(463): n is either a, c, g or t
  misc_feature (570)..(570): n is either a, c, g or t
  misc_feature (654)..(654): n is either a, c, g or t
aaaccgccgaacgaccgcgcgcgcgaaccgcgcaacgaacgcgcgcgacgacgaaccgccgccgaaancgaccgccgccgccccgacccccccccgccgcgaccgcgacgcgcgcgccgcgaacgaaaaaccgaacgcgcgaccgaccccgacgcgcgacgcgcccgaccgcgccgaccgcgcgcgacgaacgcgcgccccgcccccgaccgccgaccgaacgcgccgcacgccncgccgaccgcgacgccgcccgcccgccgacgccgtcgcgcgaaacgcgccgccgcgaaccgcgacgcgcgcgtacgccgcgacgaacgaaaacgacgaaaaaacgaccgcgcgccgcgcccgacgacgcgacgcgaaacgacgctcgaaccgaaccgaccgcgaccccgcgaacgaacccgaccgcgacgaacgaacgcgcgaaaacgcgcgacgcgctaccccgaancaacgacgacgccgcgacgcgacgaacgccgccgccgaacgacgaaatcgaatccgtcgtcccgcgatctactacgcgctaccttcctacgctcgttcaactcgttnaccgaacgcgcgaacgtacgaatcgcgcccgcgctattcgcgatccgcctatctataaacgtctcaataaattctatccccgtntactcgaccgcgaaatccctcgtctcc

SEQ ID NO: 28389 - DNA, 908 bp, Artificial Sequence
  chemically treated genomic DNA (Homo sapiens) CpG-island No: 28389
cgttcgttggggttaagttatttttttttttagttttgtttttcgttttcgttttttttaataattttagttacgttttttattgtttcgtttcgtttcgcggcgacgttattttcggtcgattagtttttttaattttttttggttttcgttttcgttcgttttcggtcgtcgtcgtcgtcgttgttgtcgttgttgttgtttttgaggttgttggttgaggtcggaggatcgagcggcggcggcggcggcggttgagagggcggcggcgggagcggagcgggacgagggaacgggaggaagcgagcgaggagcgcgtagagcgcgttttttcgttcgtttgaggagtcgaagtagtttcggtttcgtcgtcgtcgtttgttcgtcggataaagtcgagagttcgcgtttatagttatgttttcgttagtcggtagcggttattagtttagttagagtcgcgttatttttattcgtatcgtggttattagcgacgtcgcgtagttattttatgattattgtattacgttcggggggacgtttttttttattatatcgggaggtgagcgtcggttagtcgttcgtcgcgttcggtgtttcgtcgcggttttttaatttttcggcgtttcggtgttcggtcgtttcgttttcgtttttagttttatcgaagtttcggggacgttgtttttgggttcgttcgagcgttcgggattttttatttcgtgttcgtttttgttcgtagttcgagtcggcgcgcgttttattcgggaatgtggttgttttgtcgcgaaaaagagtttttgttttcgtttcgtggtaggtttacgtattcgatttagtttttttttttttttttgtttttttttcgggcggatttggttttatttggttttgtattatagtttgta

SEQ ID NO: 28390 - DNA, 908 bp, Artificial Sequence
  chemically treated genomic DNA (Homo sapiens) CpG-island No: 28390
tacaaactataatacaaaaccaaataaaaccaaatccgcccgaaaaaaaaacaaaaaaaaaaaaaaaaactaaatcgaatacgtaaacctaccacgaaacgaaaacaaaaactctttttcgcgacaaaacaaccacattcccgaataaaacgcgcgccgactcgaactacgaacaaaaacgaacacgaaataaaaaatcccgaacgctcgaacgaacccaaaaacaacgtccccgaaacttcgataaaactaaaaacgaaaacgaaacgaccgaacaccgaaacgccgaaaaattaaaaaaccgcgacgaaacaccgaacgcgacgaacgactaaccgacgctcacctcccgatataataaaaaaaaacgtccccccgaacgtaatacaataatcataaaataactacgcgacgtcgctaataaccacgatacgaataaaaataacgcgactctaactaaactaataaccgctaccgactaacgaaaacataactataaacgcgaactctcgactttatccgacgaacaaacgacgacgacgaaaccgaaactacttcgactcctcaaacgaacgaaaaaacgcgctctacgcgctcctcgctcgcttcctcccgttccctcgtcccgctccgctcccgccgccgccctctcaaccgccgccgccgccgccgctcgatcctccgacctcaaccaacaacctcaaaaacaacaacaacgacaacaacgacgacgacgacgaccgaaaacgaacgaaaacgaaaaccaaaaaaaattaaaaaaactaatcgaccgaaaataacgtcgccgcgaaacgaaacgaaacaataaaaaacgtaactaaaattattaaaaaaaacgaaaacgaaaaacaaaactaaaaaaaaaaataacttaaccccaacgaacg

SEQ ID NO: 28391 - DNA, 908 bp, Artificial Sequence
  chemically treated genomic DNA (Homo sapiens) CpG-island No: 28391
tgtagattgtaatgtaaggttaagtggagttaaattcgttcgggaaggaggtagagaggagagagagaattgggtcgaatgcgtaagtttgttacgaagcggaaataagagttttttttcgcgataggatagttatattttcgagtggggcgcgcgtcgattcgagttgcgggtaagagcgaatacgaagtaaagggtttcgaacgttcgggcgggtttaagggtagcgttttcggggtttcggtggagttgggggcgggggcgaagcggtcgggtatcgaggcgtcgaggagttagaggatcgcggcgggatatcgggcgcggcggacggttggtcggcgtttatttttcggtgtggtggagaagagcgttttttcgggcgtggtgtaatagttatgaggtagttgcgcggcgtcgttgatggttacggtgcgggtggggatggcgcggttttggttgggttggtggtcgttgtcggttgacgaggatatggttgtgggcgcgggttttcggttttgttcggcgggtaggcggcggcggcggggtcggggttgtttcggttttttaggcggacggaaaagcgcgttttgcgcgtttttcgttcgttttttttcgttttttcgtttcgtttcgttttcgtcgtcgtttttttagtcgtcgtcgtcgtcgtcgttcgatttttcggttttagttagtagttttaggagtaatagtagcggtagtagcggcgacgacgacgatcggaagcgggcgaaggcgggagttagagggagttggggaagttggtcggtcggaggtgacgtcgtcgcggggcggggcgaggtagtgaggggcgtggttgaagttgttgaagggggcggggacgaggggtagggttgaggaagagagtggtttaattttagcgagcg

SEQ ID NO: 28392 - DNA, 908 bp, Artificial Sequence
  chemically treated genomic DNA (Homo sapiens) CpG-island No: 28392
cgctcgctaaaattaaaccactctcttcctcaaccctacccctcgtccccgcccccttcaacaacttcaaccacgcccctcactacctcgccccgccccgcgacgacgtcacctccgaccgaccaacttccccaactccctctaactcccgccttcgcccgcttccgatcgtcgtcgtcgccgctactaccgctactattactcctaaaactactaactaaaaccgaaaaatcgaacgacgacgacgacgacgactaaaaaaacgacgacgaaaacgaaacgaaacgaaaaaacgaaaaaaaacgaacgaaaaacgcgcaaaacgcgcttttccgtccgcctaaaaaaccgaaacaaccccgaccccgccgccgccgcctacccgccgaacaaaaccgaaaacccgcgcccacaaccatatcctcgtcaaccgacaacgaccaccaacccaaccaaaaccgcgccatccccacccgcaccgtaaccatcaacgacgccgcgcaactacctcataactattacaccacgcccgaaaaaacgctcttctccaccacaccgaaaaataaacgccgaccaaccgtccgccgcgcccgatatcccgccgcgatcctctaactcctcgacgcctcgatacccgaccgcttcgcccccgcccccaactccaccgaaaccccgaaaacgctacccttaaacccgcccgaacgttcgaaaccctttacttcgtattcgctcttacccgcaactcgaatcgacgcgcgccccactcgaaaatataactatcctatcgcgaaaaaaaactcttatttccgcttcgtaacaaacttacgcattcgacccaattctctctctcctctctacctccttcccgaacgaatttaactccacttaaccttacattacaatctaca

SEQ ID NO: 28393 - DNA, 914 bp, Artificial Sequence
  chemically treated genomic DNA (Homo sapiens) CpG-island No: 28393
tattacgcggtatttattttttattaggtcgggtcgtatattacgtaataggtttattttttattaggttggatttatatattatacgataggtttattttttattaggtcggatcgtatattacgcggtaggtttatattttattaggtagggtttatacgttgtatgataggtttatattttattaagtcgggttatatattacgcggtaggtttattttttattaggtcgggtttatacgttgtacgataggtttatattttattaggtcgggtttatacgttacgcgataggtttatattttattaggtcgggtttatacgttgtatgataggtttatattttattaagtcgggtcgtatattacgtagtatttattttttattagggcgggtcgtattttacgcgataggtttattttttattaggtcgggtttatacgttgtacgataggtttatattttattaggtcgggtttatacgttacgcgataggtttatattttattaggtcgggtttatacgttgtacgataggtttatattttattaggttgggtttatatattacgtgataggtttattttttattaggtcgggtttatacgttgtacgataggtttatattttattaggtcgggtttatacgttgtacgataggtttatattttattaggttgggtttatatattacgtgataggtttattttttattaggtcgggtttatacgttgcgcgagaggtttatattttattaggtcgggtttatacgttgtacgataggtttacgttttattaggttgggtttatatattacgtgataggtttattttttattaggtcgggttgtatattacgcgataggtttattttgtattaggtcgggttataatttttgtttttttattgtgttt

SEQ ID NO: 28394 - DNA, 914 bp, Artificial Sequence
  chemically treated genomic DNA (Homo sapiens) CpG-island No: 28394
aaacacaataaaaaaacaaaaattataacccgacctaatacaaaataaacctatcgcgtaatatacaacccgacctaataaaaaataaacctatcacgtaatatataaacccaacctaataaaacgtaaacctatcgtacaacgtataaacccgacctaataaaatataaacctctcgcgcaacgtataaacccgacctaataaaaaataaacctatcacgtaatatataaacccaacctaataaaatataaacctatcgtacaacgtataaacccgacctaataaaatataaacctatcgtacaacgtataaacccgacctaataaaaaataaacctatcacgtaatatataaacccaacctaataaaatataaacctatcgtacaacgtataaacccgacctaataaaatataaacctatcgcgtaacgtataaacccgacctaataaaatataaacctatcgtacaacgtataaacccgacctaataaaaaataaacctatcgcgtaaaatacgacccgccctaataaaaaataaatactacgtaatatacgacccgacttaataaaatataaacctatcatacaacgtataaacccgacctaataaaatataaacctatcgcgtaacgtataaacccgacctaataaaatataaacctatcgtacaacgtataaacccgacctaataaaaaataaacctaccgcgtaatatataacccgacttaataaaatataaacctatcatacaacgtataaaccctacctaataaaatataaacctaccgcgtaatatacgatccgacctaataaaaaataaacctatcgtataatatataaatccaacctaataaaaaataaacctattacgtaatatacgacccgacctaataaaaaataaataccgcgtaata

SEQ ID NO: 28395 - DNA, 914 bp, Artificial Sequence
  chemically treated genomic DNA (Homo sapiens) CpG-island No: 28395
aaatataataggaaggtaagaattgtggttcggtttagtataaggtaggtttgtcgcgtaatgtgtagttcggtttagtagaaggtaggtttgttacgtaatgtgtggatttagtttagtagaacgtaagtttgtcgtgtaacgtgtggattcggtttagtagaatgtaagtttttcgcgtaacgtgtggattcggtttagtagaaggtaggtttgttacgtaatgtgtggatttagtttagtagaatgtaggtttgtcgtgtaacgtgtggattcggtttagtagaatgtaagtttgtcgtgtaacgtgtggattcggtttagtagaaggtaggtttgttacgtaatgtgtggatttagtttagtagaatgtaggtttgtcgtgtaacgtgtggattcggtttagtagaatgtaagtttgtcgcgtaacgtgtggattcggtttagtagaatgtaagtttgtcgtgtaacgtgtggattcggtttagtagaaggtaggtttgtcgcgtaaggtgcggttcgttttagtagaaggtaggtgttgcgtaatgtgcggttcggtttagtagaatgtaggtttattatgtaacgtgtggattcggtttagtagaatgtaagtttgtcgcgtaacgtgtggattcggtttagtagaatgtaagtttgtcgtgtaacgtgtggattcggtttagtagaaggtaggtttgtcgcgtaatgtgtggttcggtttagtagaatgtaggtttattatgtaacgtgtggattttgtttagtagaatgtaggtttgtcgcgtaatgtgcggttcggtttagtagaaggtaggtttgtcgtgtaatgtgtggatttagtttagtagaaggtaggtttgttgcgtaatgtgcggttcggtttagtagaaggtaggtgtcgcgtaatg

SEQ ID NO: 28396 - DNA, 914 bp, Artificial Sequence
  chemically treated genomic DNA (Homo sapiens) CpG-island No: 28396
cattacgcgacacctaccttctactaaaccgaaccgcacattacgcaacaaacctaccttctactaaactaaatccacacattacacgacaaacctaccttctactaaaccgaaccgcacattacgcgacaaacctacattctactaaacaaaatccacacgttacataataaacctacattctactaaaccgaaccacacattacgcgacaaacctaccttctactaaaccgaatccacacgttacacgacaaacttacattctactaaaccgaatccacacgttacgcgacaaacttacattctactaaaccgaatccacacgttacataataaacctacattctactaaaccgaaccgcacattacgcaacacctaccttctactaaaacgaaccgcaccttacgcgacaaacctaccttctactaaaccgaatccacacgttacacgacaaacttacattctactaaaccgaatccacacgttacgcgacaaacttacattctactaaaccgaatccacacgttacacgacaaacctacattctactaaactaaatccacacattacgtaacaaacctaccttctactaaaccgaatccacacgttacacgacaaacttacattctactaaaccgaatccacacgttacacgacaaacctacattctactaaactaaatccacacattacgtaacaaacctaccttctactaaaccgaatccacacgttacgcgaaaaacttacattctactaaaccgaatccacacgttacacgacaaacttacgttctactaaactaaatccacacattacgtaacaaacctaccttctactaaaccgaactacacattacgcgacaaacctaccttatactaaaccgaaccacaattcttaccttcctattatattt

SEQ ID NO: 28397 - DNA, 545 bp, Artificial Sequence
  chemically treated genomic DNA (Homo sapiens) CpG-island No: 28397
agttttcgcgttttttttaaaattcgggcgtttttttttttgtattttcgtttttggggtttttatacgtttttcgtggttgatttttaagtcgggcgggtgcgttgtgcgacgcggaaagcgtcgtagagtacgtagaatacgattggttgagttttcggaagtgacgtattttaatcgttcgatagtggaagttttatttgcgttcgacggcggaagtttcgggagtgttaagtattcgcgtgtatacggttgtcggtatggtatattataattttaagaaaattacggtggtgtcgttcgttaaggtaggcggtttcgggagggttattgtaattttcgcgttttttttagttgggttttcggggagggttcgggtttgtagtcgtgggagagcggtcgtttttcgttcgtttatttttcgtttttgggtttgatcgtttggtcgcgtattcgggattatttttttttttttagtagaattcggggtttattagagatcggattttttagagatcggggtttatttaagatcgtggtttatt

SEQ ID NO: 28398 - DNA, 545 bp, Artificial Sequence
  chemically treated genomic DNA (Homo sapiens) CpG-island No: 28398
aataaaccacgatcttaaataaaccccgatctctaaaaaatccgatctctaataaaccccgaattctactaaaaaaaaaaaaataatcccgaatacgcgaccaaacgatcaaacccaaaaacgaaaaataaacgaacgaaaaacgaccgctctcccacgactacaaacccgaaccctccccgaaaacccaactaaaaaaaacgcgaaaattacaataaccctcccgaaaccgcctaccttaacgaacgacaccaccgtaattttcttaaaattataatataccataccgacaaccgtatacacgcgaatacttaacactcccgaaacttccgccgtcgaacgcaaataaaacttccactatcgaacgattaaaatacgtcacttccgaaaactcaaccaatcgtattctacgtactctacgacgctttccgcgtcgcacaacgcacccgcccgacttaaaaatcaaccacgaaaaacgtataaaaaccccaaaaacgaaaatacaaaaaaaaaaacgcccgaattttaaaaaaaacgcgaaaact

SEQ ID NO: 28399 - DNA, 545 bp, Artificial Sequence
  chemically treated genomic DNA (Homo sapiens) CpG-island No: 28399
ggtggattacggttttaggtggatttcggtttttgggggattcgatttttggtggatttcggattttgttgggggaggggaaatgatttcgagtacgcggttagacggttaggtttaggagcgggggatgggcgagcggaaggcgatcgtttttttacggttataggttcggatttttttcggggatttagttgaggagaacgcgaaagttgtagtggttttttcggggtcgtttattttggcggacggtattatcgtaatttttttgaagttgtaatgtgttatgtcggtagtcgtatgtacgcgggtatttggtattttcggaattttcgtcgtcgggcgtaggtgggatttttattgtcgggcggttgaggtacgttattttcgggagtttagttaatcgtgttttgcgtgttttacggcgtttttcgcgtcgtatagcgtattcgttcggtttggaggttagttacggagggcgtgtgagggttttaggagcgagggtatagaggagaggacgttcgggttttagggggagcgcggagatt

SEQ ID NO: 28400 - DNA, 545 bp, Artificial Sequence
  chemically treated genomic DNA (Homo sapiens) CpG-island No: 28400
aatctccgcgctccccctaaaacccgaacgtcctctcctctataccctcgctcctaaaaccctcacacgccctccgtaactaacctccaaaccgaacgaatacgctatacgacgcgaaaaacgccgtaaaacacgcaaaacacgattaactaaactcccgaaaataacgtacctcaaccgcccgacaataaaaatcccacctacgcccgacgacgaaaattccgaaaataccaaatacccgcgtacatacgactaccgacataacacattacaacttcaaaaaaattacgataataccgtccgccaaaataaacgaccccgaaaaaaccactacaactttcgcgttctcctcaactaaatccccgaaaaaaatccgaacctataaccgtaaaaaaacgatcgccttccgctcgcccatcccccgctcctaaacctaaccgtctaaccgcgtactcgaaatcatttcccctcccccaacaaaatccgaaatccaccaaaaatcgaatcccccaaaaaccgaaatccacctaaaaccgtaatccacc

SEQ ID NO: 28401 - DNA, 697 bp, Artificial Sequence
  chemically treated genomic DNA (Homo sapiens) CpG-island No: 28401
attgatcgcgtcgttttcgttaggttttcgcgcggtcggtatcgcggttttgagcgtaggcggtttcgggttttaggttttaggcggatcgcgtttcgggttcgtagttttttcgtttcggttgtcgggttacggggtagatggattcggagcgtttcgtcggtgagtagttacgattttcgaggttatttttcgcgaatcgttcggcggtaggagtacgtgattaagggtgggggcgttggtttagtagtcgaaggggtttttagcgcgtttagatttttcggggttgcggggcggaagtcggggcgtgattttcggcgtcgtcgggtgtggggcggaggtgtggggcggttttcggagaatttagcggcgcgggattggggcgggattttcggcgatatcggaagtgtattagcgttaggttggggttgtggggtcgcgttagtgcggagatagcggtgttttgcgcgttttcgggttagtacggggggtcgcgtcgtagggatttattggcggtgcgcgatttgggttggtttcgggggtggcgggcgtagttgttgtgataggtgagtgtcgttatttttttatttgttaggcgtcgagtcgtttttcggatgtttcgaagaggagtcgggatattgtagggtttaagggggtgtaggggtagtcggggtatagtggcggatggggtgtaggt

SEQ ID NO: 28402 - DNA, 697 bp, Artificial Sequence
  chemically treated genomic DNA (Homo sapiens) CpG-island No: 28402
acctacaccccatccgccactataccccgactacccctacacccccttaaaccctacaatatcccgactcctcttcgaaacatccgaaaaacgactcgacgcctaacaaataaaaaaataacgacactcacctatcacaacaactacgcccgccacccccgaaaccaacccaaatcgcgcaccgccaataaatccctacgacgcgaccccccgtactaacccgaaaacgcgcaaaacaccgctatctccgcactaacgcgaccccacaaccccaacctaacgctaatacacttccgatatcgccgaaaatcccgccccaatcccgcgccgctaaattctccgaaaaccgccccacacctccgccccacacccgacgacgccgaaaatcacgccccgacttccgccccgcaaccccgaaaaatctaaacgcgctaaaaaccccttcgactactaaaccaacgcccccacccttaatcacgtactcctaccgccgaacgattcgcgaaaaataacctcgaaaatcgtaactactcaccgacgaaacgctccgaatccatctaccccgtaacccgacaaccgaaacgaaaaaactacgaacccgaaacgcgatccgcctaaaacctaaaacccgaaaccgcctacgctcaaaaccgcgataccgaccgcgcgaaaacctaacgaaaacgacgcgatcaat

SEQ ID NO: 28403 - DNA, 697 bp, Artificial Sequence
  chemically treated genomic DNA (Homo sapiens) CpG-island No: 28403
atttgtattttattcgttattatgtttcgattgtttttgtatttttttgagttttgtagtgtttcgattttttttcggggtattcggggaacgattcggcgtttgataggtaggaagatggcggtatttatttgttatagtagttgcgttcgttattttcggagttagtttaggtcgcgtatcgttagtgagtttttacgacgcggtttttcgtattgattcgaagacgcgtaggatatcgttgttttcgtattgacgcgattttataattttaatttggcgttaatgtattttcggtgtcgtcggaagtttcgttttagtttcgcgtcgttgggtttttcggaagtcgttttatattttcgttttatattcggcggcgtcggaagttacgtttcggttttcgtttcgtagtttcgaggggtttgggcgcgttgaagattttttcggttgttgggttaacgtttttatttttggttacgtatttttgtcgtcgagcggttcgcgggaggtggtttcgggggtcgtagttatttatcggcggggcgtttcgagtttatttgtttcgtagttcggtagtcggggcgggagggttgcgagttcggggcgcggttcgtttgaggtttgagattcggggtcgtttgcgtttagggtcgcggtgtcggtcgcgcgggagtttggcggggacggcgcggttagt

SEQ ID NO: 28404 - DNA, 697 bp, Artificial Sequence
  chemically treated genomic DNA (Homo sapiens) CpG-island No: 28404
actaaccgcgccgtccccgccaaactcccgcgcgaccgacaccgcgaccctaaacgcaaacgaccccgaatctcaaacctcaaacgaaccgcgccccgaactcgcaaccctcccgccccgactaccgaactacgaaacaaataaactcgaaacgccccgccgataaataactacgacccccgaaaccacctcccgcgaaccgctcgacgacaaaaatacgtaaccaaaaataaaaacgttaacccaacaaccgaaaaaatcttcaacgcgcccaaacccctcgaaactacgaaacgaaaaccgaaacgtaacttccgacgccgccgaatataaaacgaaaatataaaacgacttccgaaaaacccaacgacgcgaaactaaaacgaaacttccgacgacaccgaaaatacattaacgccaaattaaaattataaaatcgcgtcaatacgaaaacaacgatatcctacgcgtcttcgaatcaatacgaaaaaccgcgtcgtaaaaactcactaacgatacgcgacctaaactaactccgaaaataacgaacgcaactactataacaaataaataccgccatcttcctacctatcaaacgccgaatcgttccccgaataccccgaaaaaaaatcgaaacactacaaaactcaaaaaaatacaaaaacaatcgaaacataataacgaataaaatacaaat

SEQ ID NO: 28405 - DNA, 646 bp, Artificial Sequence
  chemically treated genomic DNA (Homo sapiens) CpG-island No: 28405
attgtgcgtagacgacgatttttttcgttgataaagaatggtaacgtttttgacgtttcgatttacgttttcgttttttacggggcgcgggcgtttattatagttcgggaaggttcggtttttttttagttcgggagattaacgtcgttatttttagttgtttaggttttcgcgtcgagattttacgggtggtttagatttcgggtttttttttcgtttcgtttcgtagtttttcgatgtcgttttgtttttgtttttcgaatttcgtcgttcgtttatagtatttgattagttttcggttatagataatcgtcggtttcggatggcgttcgttttgagtatagtttgcggcgcgtatcgtttattggtttcgttttcgggtcgcgtagttaatcgttcgcgttagcgttagtttacgttatatcgttcggttaattggcgttcgtacgcgtttgacgatataatttcgttaagtttcgtttggtggtgttatttttttggtttgtgataacggtagacgcgcgaagtatcgggaatttgagtcgtgatcgcgggttttggcgtttttaagggggttaatacgttttatttttagtttcgtagaggtagcgtttcgcgattgggcggtgttcgagattatagacgt

SEQ ID NO: 28406 - DNA, 646 bp, Artificial Sequence
  chemically treated genomic DNA (Homo sapiens) CpG-island No: 28406
acgtctataatctcgaacaccgcccaatcgcgaaacgctacctctacgaaactaaaaataaaacgtattaacccccttaaaaacgccaaaacccgcgatcacgactcaaattcccgatacttcgcgcgtctaccgttatcacaaaccaaaaaaataacaccaccaaacgaaacttaacgaaattatatcgtcaaacgcgtacgaacgccaattaaccgaacgatataacgtaaactaacgctaacgcgaacgattaactacgcgacccgaaaacgaaaccaataaacgatacgcgccgcaaactatactcaaaacgaacgccatccgaaaccgacgattatctataaccgaaaactaatcaaatactataaacgaacgacgaaattcgaaaaacaaaaacaaaacgacatcgaaaaactacgaaacgaaacgaaaaaaaaacccgaaatctaaaccacccgtaaaatctcgacgcgaaaacctaaacaactaaaaataacgacgttaatctcccgaactaaaaaaaaaccgaaccttcccgaactataataaacgcccgcgccccgtaaaaaacgaaaacgtaaatcgaaacgtcaaaaacgttaccattctttatcaacgaaaaaaatcgtcgtctacgcacaat

SEQ ID NO: 28407 - DNA, 646 bp, Artificial Sequence
  chemically treated genomic DNA (Homo sapiens) CpG-island No: 28407
gcgtttgtggtttcgggtatcgtttagtcgcgggacgttgtttttgcggaattgggggtggggcgtgttgatttttttaaaggcgttagagttcgcggttacggtttaggttttcggtgtttcgcgcgtttgtcgttgttataggttagggaggtggtattattaggcgaagtttggcgagattgtgtcgttaagcgcgtacgggcgttaattggtcgggcgatgtggcgtggattggcgttggcgcgagcgattggttgcgcggttcgggggcggggttagtgggcggtgcgcgtcgtagattgtgtttaaagcgggcgttattcgggatcggcggttgtttgtggtcggaggttgattaggtattgtggacgggcggcggagttcgggagataggggtagggcggtatcggggagttgcgggacggggcggggaggaggttcgaggtttgagttattcgtgaggtttcggcgcggaggtttggatagttgggggtggcggcgttggtttttcgaattggagggaggtcgggttttttcgggttgtggtgggcgttcgcgtttcgtggaaggcggaggcgtgagtcggggcgttagagacgttgttattttttgttagcggaaaagatcgtcgtttgcgtatagt

SEQ ID NO: 28408 - DNA, 646 bp, Artificial Sequence
  chemically treated genomic DNA (Homo sapiens) CpG-island No: 28408
actatacgcaaacgacgatcttttccgctaacaaaaaataacaacgtctctaacgccccgactcacgcctccgccttccacgaaacgcgaacgcccaccacaacccgaaaaaacccgacctccctccaattcgaaaaaccaacgccgccacccccaactatccaaacctccgcgccgaaacctcacgaataactcaaacctcgaacctcctccccgccccgtcccgcaactccccgataccgccctacccctatctcccgaactccgccgcccgtccacaatacctaatcaacctccgaccacaaacaaccgccgatcccgaataacgcccgctttaaacacaatctacgacgcgcaccgcccactaaccccgcccccgaaccgcgcaaccaatcgctcgcgccaacgccaatccacgccacatcgcccgaccaattaacgcccgtacgcgcttaacgacacaatctcgccaaacttcgcctaataataccacctccctaacctataacaacgacaaacgcgcgaaacaccgaaaacctaaaccgtaaccgcgaactctaacgcctttaaaaaaatcaacacgccccacccccaattccgcaaaaacaacgtcccgcgactaaacgatacccgaaaccacaaacgc

SEQ ID NO: 28409 - DNA, 739 bp, Artificial Sequence
  chemically treated genomic DNA (Homo sapiens) CpG-island No: 28409
gatttcggcgtttcgttttatatttcgtttatttacgcgttagttagcgtcgtatagtttcgttatcgtttttcggagttttttttcggttcgtatttttatcgtttttattacggtaggtagatcgtcgtttgagtcgcgttgttatattgcggttcgttaatttttatttattatacgtttagcgtttttacgtgagtatatacgtcgcgtcgttatatagtgttatgtatatacgtacgttagcgtcgtagcgcgtttcgggtttagtatagtcggtgtttatttttagtttttacgggtatcgtttcgttttttcgtgtcggtttatcgttttcgcgttatttttaatcggagcggcgcgatatcgttacgtcgttatattttcgaattatcggggttaagacgtttattagtatataaaagtcgtatatacgatatttaataattttcgtattatattttttttttcgatatttttttcgtaacgtttagatttttagaagatcgtcgattttagacgtatattgacgcgtttcggtagtattcgttattttcgcgtcgtttttattttatttttcgtattagttattttttcgattattattcgtttttatcgttcggtttgcgtttttttttgcgggagtcgattcggttttttaatatatttttagtttttcggtagggtcgttagacgattcgggattgagttatttggcggtcgtagtcgtacgatcgt

SEQ ID NO: 28410 - DNA, 739 bp, Artificial Sequence
  chemically treated genomic DNA (Homo sapiens) CpG-island No: 28410
acgatcgtacgactacgaccgccaaataactcaatcccgaatcgtctaacgaccctaccgaaaaactaaaaatatattaaaaaaccgaatcgactcccgcaaaaaaaaacgcaaaccgaacgataaaaacgaataataatcgaaaaaataactaatacgaaaaataaaataaaaacgacgcgaaaataacgaatactaccgaaacgcgtcaatatacgtctaaaatcgacgatcttctaaaaatctaaacgttacgaaaaaaatatcgaaaaaaaaaatataatacgaaaattattaaatatcgtatatacgacttttatatactaataaacgtcttaaccccgataattcgaaaatataacgacgtaacgatatcgcgccgctccgattaaaaataacgcgaaaacgataaaccgacacgaaaaaacgaaacgatacccgtaaaaactaaaaataaacaccgactatactaaacccgaaacgcgctacgacgctaacgtacgtatatacataacactatataacgacgcgacgtatatactcacgtaaaaacgctaaacgtataataaataaaaattaacgaaccgcaatataacaacgcgactcaaacgacgatctacctaccgtaataaaaacgataaaaatacgaaccgaaaaaaaactccgaaaaacgataacgaaactatacgacgctaactaacgcgtaaataaacgaaatataaaacgaaacgccgaaatc

SEQ ID NO: 28411 - DNA, 739 bp, Artificial Sequence
  chemically treated genomic DNA (Homo sapiens) CpG-island No: 28411
gcgatcgtgcggttacgatcgttagatgatttagtttcgggtcgtttagcgattttgtcgggagattaggggtgtgttggggggtcgggtcggttttcgtaggggggggcgtaggtcggacggtgggggcggatagtggtcgggggggtggttggtgcggagggtgaggtgggggcggcgcgggggtgacgggtgttgtcggagcgcgttagtgtgcgtttggggtcggcggttttttgggggtttgggcgttgcggaggaggtgtcgggggggggggtgtggtgcgggggttgttgggtgtcgtgtgtgcggtttttgtgtgttagtgggcgttttggtttcggtggttcgggggtgtggcggcgtggcggtgtcgcgtcgtttcggttgggggtggcgcggggacggtgggtcggtacggggaggcggggcggtgttcgtgggagttgagggtgggtatcggttgtgttgggttcgaggcgcgttgcggcgttagcgtgcgtgtgtgtatggtattgtgtggcggcgcggcgtgtgtgtttacgtgggagcgttgagcgtgtggtgagtgagggttggcgggtcgtagtgtggtagcgcggtttaagcggcggtttgtttgtcgtggtggaggcggtgggggtgcgggtcgagggggggtttcgggggacggtggcggggttgtgcggcgttggttggcgcgtgggtgggcggagtgtggagcggggcgtcggggtt

SEQ ID NO: 28412 - DNA, 739 bp, Artificial Sequence
  chemically treated genomic DNA (Homo sapiens) CpG-island No: 28412
aaccccgacgccccgctccacactccgcccacccacgcgccaaccaacgccgcacaaccccgccaccgtcccccgaaaccccccctcgacccgcacccccaccgcctccaccacgacaaacaaaccgccgcttaaaccgcgctaccacactacgacccgccaaccctcactcaccacacgctcaacgctcccacgtaaacacacacgccgcgccgccacacaataccatacacacacgcacgctaacgccgcaacgcgcctcgaacccaacacaaccgatacccaccctcaactcccacgaacaccgccccgcctccccgtaccgacccaccgtccccgcgccacccccaaccgaaacgacgcgacaccgccacgccgccacacccccgaaccaccgaaaccaaaacgcccactaacacacaaaaaccgcacacacgacacccaacaacccccgcaccacacccccccccccgacacctcctccgcaacgcccaaacccccaaaaaaccgccgaccccaaacgcacactaacgcgctccgacaacacccgtcacccccgcgccgcccccacctcaccctccgcaccaaccacccccccgaccactatccgcccccaccgtccgacctacgcccccccctacgaaaaccgacccgaccccccaacacacccctaatctcccgacaaaatcgctaaacgacccgaaactaaatcatctaacgatcgtaaccgcacgatcgc

SEQ ID NO: 28413 - DNA, 684 bp, Artificial Sequence
  chemically treated genomic DNA (Homo sapiens) CpG-island No: 28413
gaaaaagagtgcgttaaacgcggtgatgattattaggagatttttgtttagtaggttcgggaaattatggagcgtcgtgttgcgggtttgaaattatcggtatgggtcgttgtagtttttgaggtcggagtgaaaaaattaaacgaggaggagtaagatggcgtacgagttgcgtaatttttcgtatattgttagtatggtttttaatgagtcgttgatgtttgaattcgtttatgcgcgggtttttttttgcgcgttggttggttagttgggtattattcggttgatagatatcgtttttggtattacgtttgatgtcggataaatagtcgaatcgttggcgttgtttggtgaggatgatgatatggattttcgtttattacgtattattagggtaaatggtatcgcggtttgtcggtttcgtacgttggttagtaaaattcgtgcgttttagttttatttcgatgacggttataacggattatgtcgtttgttagtaatcggattcgcgttgacgatttttgattgtcgcggggagggtcggttgatgttattattcgtgttaaaatatggttgtcgcgacgcgcgatattagtgtgagggttaagtaacggcggtaggtattgtgtaaggggttttgacggggttataggttatttttagtttttgcgtttagggtataat

SEQ ID NO: 28414 - DNA, 684 bp, Artificial Sequence
  chemically treated genomic DNA (Homo sapiens) CpG-island No: 28414
attataccctaaacgcaaaaactaaaaataacctataaccccgtcaaaaccccttacacaatacctaccgccgttacttaaccctcacactaatatcgcgcgtcgcgacaaccatattttaacacgaataataacatcaaccgaccctccccgcgacaatcaaaaatcgtcaacgcgaatccgattactaacaaacgacataatccgttataaccgtcatcgaaataaaactaaaacgcacgaattttactaaccaacgtacgaaaccgacaaaccgcgataccatttaccctaataatacgtaataaacgaaaatccatatcatcatcctcaccaaacaacgccaacgattcgactatttatccgacatcaaacgtaataccaaaaacgatatctatcaaccgaataatacccaactaaccaaccaacgcgcaaaaaaaaacccgcgcataaacgaattcaaacatcaacgactcattaaaaaccatactaacaatatacgaaaaattacgcaactcgtacgccatcttactcctcctcgtttaattttttcactccgacctcaaaaactacaacgacccataccgataatttcaaacccgcaacacgacgctccataatttcccgaacctactaaacaaaaatctcctaataatcatcaccgcgtttaacgcactctttttc

SEQ ID NO: 28415 - DNA, 684 bp, Artificial Sequence
  chemically treated genomic DNA (Homo sapiens) CpG-island No: 28415
attatattttaggcgtaaagattaggagtaatttgtagtttcgttaaggttttttgtataatgtttatcgtcgttgtttggtttttatattgatatcgcgcgtcgcggtagttatgttttggtacggatagtggtattagtcgatttttttcgcgataattaaagatcgttaacgcgggttcgattgttggtaggcgatatgattcgttgtaatcgttatcggaataaggttgaagcgtacgggttttattgattagcgtgcggaatcggtaagtcgcgatattatttgttttgatagtgcgtgatggacggggatttatgttattatttttattaaatagcgttagcggttcggttatttgttcggtattaagcgtgatgttagagacggtatttgttagtcgggtgatgtttaattggttagttagcgcgtaaaagaaaattcgcgtataggcgggtttaagtattagcggtttattaaaggttatattggtaatatgcggaagattacgtagttcgtgcgttattttgttttttttcgtttgatttttttatttcggttttaaaagttgtagcggtttatgtcggtggttttagattcgtagtacgacgttttatggtttttcggatttgttgggtaaaaattttttgataattattatcgcgtttggcgtattttttttt

SEQ ID NO: 28416 - DNA, 684 bp, Artificial Sequence
  chemically treated genomic DNA (Homo sapiens) CpG-island No: 28416
aaaaaaaaatacgccaaacgcgataataattatcaaaaaatttttacccaacaaatccgaaaaaccataaaacgtcgtactacgaatctaaaaccaccgacataaaccgctacaacttttaaaaccgaaataaaaaaatcaaacgaaaaaaaacaaaataacgcacgaactacgtaatcttccgcatattaccaatataacctttaataaaccgctaatacttaaacccgcctatacgcgaattttcttttacgcgctaactaaccaattaaacatcacccgactaacaaataccgtctctaacatcacgcttaataccgaacaaataaccgaaccgctaacgctatttaataaaaataataacataaatccccgtccatcacgcactatcaaaacaaataatatcgcgacttaccgattccgcacgctaatcaataaaacccgtacgcttcaaccttattccgataacgattacaacgaatcatatcgcctaccaacaatcgaacccgcgttaacgatctttaattatcgcgaaaaaaatcgactaataccactatccgtaccaaaacataactaccgcgacgcgcgatatcaatataaaaaccaaacaacgacgataaacattatacaaaaaaccttaacgaaactacaaattactcctaatctttacgcctaaaatataat

SEQ ID NO: 28417 - DNA, 931 bp, Artificial Sequence
  chemically treated genomic DNA (Homo sapiens) CpG-island No: 28417
  misc_feature (580)..(580): n is either a, c, g or t
aggcgatttgtcggggattttttatttcgtagttttttgggagtcgtaaagagagttaggaaaggtcgtgtagtagcgtcgtagtcgggttggtaacggtagaggaatcggtagtgaggtttttttttatattttgttagtttaattgtcgtcgtcgtcgtcgtcgttatcgcgggttcgggtattggttcgagggcggcgtagggcggggcgggggttgttgggatgtaggtttgagaggttggcgcgcgcgatacggggcgggtttcggcggcggcgcgcgcgtgttttgtcggtttgtgcggcgttgcggcgacgaggttatggtagtggggagggggcgaatgtagtgttgcgcggggtaggcgggaggtgatcgagagaggtagggatgggggcgtcggagtggagcggttgcggcggtttgggttgttgattgcgtatttggaatagtagtaggcggcggcgcggaacgttaggtaggtgagtgcggcggtcgggattcggatgcggcgcggttgaggggcggttgggtcgcggcgtcggttgcggtttttcgggcgtgttggcggtgcgtttntagttatcgttatttgcggcgttggcgatttttgtggttgtatcgcgttttttgttagtttggaggaaaattcgtatcggtcggtgggggcgtttggtttggttgcggttcgttttgggttttttaaggtgagtggcgtttttcggtttttgggcggtagagacgttgtcgggcgtttcgggttattgtcgttttgggtttcgtttttgaggggcgtttttgtggagagacggcgtattggtttcgcgtttatgcggatattttcggaatttttcgatttttaggtgtttttttgcgtagaagtgtattttagaggcgtggatttagggttattaggttatggatatgttt

SEQ ID NO: 28418 - DNA, 931 bp, Artificial Sequence
  chemically treated genomic DNA (Homo sapiens) CpG-island No: 28418
  misc_feature (352)..(352): n is either a, c, g or t
aaacatatccataacctaataaccctaaatccacgcctctaaaatacacttctacgcaaaaaaacacctaaaaatcgaaaaattccgaaaatatccgcataaacgcgaaaccaatacgccgtctctccacaaaaacgcccctcaaaaacgaaacccaaaacgacaataacccgaaacgcccgacaacgtctctaccgcccaaaaaccgaaaaacgccactcaccttaaaaaacccaaaacgaaccgcaaccaaaccaaacgcccccaccgaccgatacgaattttcctccaaactaacaaaaaacgcgatacaaccacaaaaatcgccaacgccgcaaataacgataactanaaacgcaccgccaacacgcccgaaaaaccgcaaccgacgccgcgacccaaccgcccctcaaccgcgccgcatccgaatcccgaccgccgcactcacctacctaacgttccgcgccgccgcctactactattccaaatacgcaatcaacaacccaaaccgccgcaaccgctccactccgacgcccccatccctacctctctcgatcacctcccgcctaccccgcgcaacactacattcgccccctccccactaccataacctcgtcgccgcaacgccgcacaaaccgacaaaacacgcgcgcgccgccgccgaaacccgccccgtatcgcgcgcgccaacctctcaaacctacatcccaacaacccccgccccgccctacgccgccctcgaaccaatacccgaacccgcgataacgacgacgacgacgacgacaattaaactaacaaaatataaaaaaaaacctcactaccgattcctctaccgttaccaacccgactacgacgctactacacgacctttcctaactctctttacgactcccaaaaaactacgaaataaaaaatccccgacaaatcgcct

SEQ ID NO: 28419 - DNA, 931 bp, Artificial Sequence
  chemically treated genomic DNA (Homo sapiens) CpG-island No: 28419
  misc_feature (352)..(352): n is either a, c, g or t
aaatatgtttataatttaataattttgggtttacgtttttgaaatatatttttgcgtaaaaaggtatttgagggtcgggaagtttcggaggtgttcgtatagacgcggggttagtacgtcgtttttttatagaaacgttttttaggaacgggatttaaagcgatagtgattcgggacgttcggtagcgtttttgtcgtttaggggtcggggggcgttatttattttggagagtttagggcgggtcgtaattaagttagacgtttttatcggtcggtacgggtttttttttaagttggtaggaagcgcggtgtaattataagagtcgttagcgtcgtaggtagcgatagttangaacgtatcgttagtacgttcgggggatcgtagtcggcgtcgcgatttagtcgttttttagtcgcgtcgtattcgggtttcggtcgtcgtatttatttgtttggcgtttcgcgtcgtcgtttgttattattttaagtgcgtagttagtagtttaggtcgtcgtaatcgttttatttcggcgtttttatttttgtttttttcgattatttttcgtttgtttcgcgtagtattatattcgttttttttttattgttatggtttcgtcgtcgtagcgtcgtataggtcgatagagtacgcgcgcgtcgtcgtcgagattcgtttcgtgtcgcgcgcgttagttttttaggtttgtattttagtagttttcgtttcgttttgcgtcgttttcgggttaatgttcgggttcgcggtggcggcggcggcggcggcggtagttgggttggtagggtgtggggagaggttttattgtcgatttttttatcgttgttagttcggttgcgacgttgttgtacggttttttttaattttttttgcgatttttagaggattgcggaatagggaattttcggtaagtcgttt

SEQ ID NO: 28420 - DNA, 931 bp, Artificial Sequence
  chemically treated genomic DNA (Homo sapiens) CpG-island No: 28420
  misc_feature (580)..(580): n is either a, c, g or t
aaacgacttaccgaaaattccctattccgcaatcctctaaaaatcgcaaaaaaaattaaaaaaaaccgtacaacaacgtcgcaaccgaactaacaacgataaaaaaatcgacaataaaacctctccccacaccctaccaacccaactaccgccgccgccgccgccgccaccgcgaacccgaacattaacccgaaaacgacgcaaaacgaaacgaaaactactaaaatacaaacctaaaaaactaacgcgcgcgacacgaaacgaatctcgacgacgacgcgcgcgtactctatcgacctatacgacgctacgacgacgaaaccataacaataaaaaaaaaacgaatataatactacgcgaaacaaacgaaaaataatcgaaaaaaacaaaaataaaaacgccgaaataaaacgattacgacgacctaaactactaactacgcacttaaaataataacaaacgacgacgcgaaacgccaaacaaataaatacgacgaccgaaacccgaatacgacgcgactaaaaaacgactaaatcgcgacgccgactacgatcccccgaacgtactaacgatacgttcntaactatcgctacctacgacgctaacgactcttataattacaccgcgcttcctaccaacttaaaaaaaaacccgtaccgaccgataaaaacgtctaacttaattacgacccgccctaaactctccaaaataaataacgccccccgacccctaaacgacaaaaacgctaccgaacgtcccgaatcactatcgctttaaatcccgttcctaaaaaacgtttctataaaaaaacgacgtactaaccccgcgtctatacgaacacctccgaaacttcccgaccctcaaatacctttttacgcaaaaatatatttcaaaaacgtaaacccaaaattattaaattataaacatattt

SEQ ID NO: 28421 - DNA, 553 bp, Artificial Sequence
  chemically treated genomic DNA (Homo sapiens) CpG-island No: 28421
  misc_feature (350)..(350): n is either a, c, g or t
cggttcggtcgtttcgtacgggcgtatatacgcgtgtagagtattgcgttgtttttcggcgtagtgaattcgtataatggtttgggagttcgtcggtcgtattttcgttttcgtcgtatttttattcgtattcgtacgtatattattttgtatcgggtcgtcgtatcgtcgtttgttttatcgtattacggggtcgtcgcgtcgtcgtcgggttagtttagttttgttagtttagttattcgtcgttttcggcgtcggtttattagtgcgtcgggtttgtagttcgtttgtgttcggtagttcgagttcgttatgatgtattgtttttattgggattacgatagtaagantcggcgttgattcgcgtttcgatttttgagagtttatcgtatgtcggtgtagacggatgcgaggatgtagggacgcgcgacgtcggtttcggtcgtagtcgacgacgtcgtcgttagtttgattttatattttttgggttcgtttttggagttagcgtttagggtttttttgtgttttttcgtttttttaagtttttgtcgtt

SEQ ID NO: 28422 - DNA, 553 bp, Artificial Sequence
  chemically treated genomic DNA (Homo sapiens) CpG-island No: 28422
  misc_feature (204)..(204): n is either a, c, g or t
aacgacaaaaacttaaaaaaacgaaaaaacacaaaaaaaccctaaacgctaactccaaaaacgaacccaaaaaatataaaatcaaactaacgacgacgtcgtcgactacgaccgaaaccgacgtcgcgcgtccctacatcctcgcatccgtctacaccgacatacgataaactctcaaaaatcgaaacgcgaatcaacgccgantcttactatcgtaatcccaataaaaacaatacatcataacgaactcgaactaccgaacacaaacgaactacaaacccgacgcactaataaaccgacgccgaaaacgacgaataactaaactaacaaaactaaactaacccgacgacgacgcgacgaccccgtaatacgataaaacaaacgacgatacgacgacccgatacaaaataatatacgtacgaatacgaataaaaatacgacgaaaacgaaaatacgaccgacgaactcccaaaccattatacgaattcactacgccgaaaaacaacgcaatactctacacgcgtatatacgcccgtacgaaacgaccgaaccg

SEQ ID NO: 28423 - DNA, 553 bp, Artificial Sequence
  chemically treated genomic DNA (Homo sapiens) CpG-island No: 28423
  misc_feature (204)..(204): n is either a, c, g or t
agcgataggagtttaggaaagcgaaaaagtatagagggattttgggcgttggttttagaggcgggtttagagggtgtgaggttaggttggcggcggcgtcgtcggttgcgatcggggtcggcgtcgcgcgtttttgtattttcgtattcgtttgtatcggtatgcggtgggtttttagagatcgaggcgcgaattagcgtcggnttttgttgtcgtggttttagtaagagtaatgtattatggcgagttcgggttgtcgggtataagcgaattgtaggttcggcgtattggtgggtcggcgtcgggggcggcggatggttgggttggtagggttgagttggttcggcggcggcgcggcggtttcgtggtgcggtggggtaggcggcggtgcggcggttcgatgtagaatggtgtgcgtgcggatgcgggtgggggtgcggcggaggcgggggtgcggtcggcgggtttttaggttattgtacgagtttattacgtcggggggtagcgtaatgttttgtacgcgtgtgtacgttcgtacgaggcggtcgggtcg

SEQ ID NO: 28424 - DNA, 553 bp, Artificial Sequence
  chemically treated genomic DNA (Homo sapiens) CpG-island No: 28424
  misc_feature (350)..(350): n is either a, c, g or t
cgacccgaccgcctcgtacgaacgtacacacgcgtacaaaacattacgctaccccccgacgtaataaactcgtacaataacctaaaaacccgccgaccgcacccccgcctccgccgcacccccacccgcatccgcacgcacaccattctacatcgaaccgccgcaccgccgcctaccccaccgcaccacgaaaccgccgcgccgccgccgaaccaactcaaccctaccaacccaaccatccgccgcccccgacgccgacccaccaatacgccgaacctacaattcgcttatacccgacaacccgaactcgccataatacattactcttactaaaaccacgacaacaaaanccgacgctaattcgcgcctcgatctctaaaaacccaccgcataccgatacaaacgaatacgaaaatacaaaaacgcgcgacgccgaccccgatcgcaaccgacgacgccgccgccaacctaacctcacaccctctaaacccgcctctaaaaccaacgcccaaaatccctctatactttttcgctttcctaaactcctatcgct

SEQ ID NO: 28425 - DNA, 559 bp, Artificial Sequence
  chemically treated genomic DNA (Homo sapiens) CpG-island No: 28425
acggcgtacggtatttatagtgataggtttttagtacggcgtacggtatttatagtgataggtttttagtacggcgtacggtatttagagtgttaggtttttagtacggcgtacggtatttatagtgttaggtttttagtacggcgtacggtatttatagtgttaggtttttagtacggcgtacggtatttatagtgttaggtttttagtacggcgtacggtatttatagtgataggtttttagtacggcgtacggtatttatagtgataggtttttagtacggcgtacggtatttatagtgttaggtttttagtacggcgtacggtttttatagtgttaggtttttagtacggcgtacggtatttatagtgttaggtttttagtacggcgtacggtttttatagtgataggtttttagtacggcgtacggtttttatagtgataggtttttagtacggcgtacggtttttatagtgataggtttttagtacggcgttcggtttttatagtgataggtttttagtacggcgtacggtatttatagtgataggtttttag

SEQ ID NO: 28426 - DNA, 559 bp, Artificial Sequence
  chemically treated genomic DNA (Homo sapiens) CpG-island No: 28426
ctaaaaacctatcactataaataccgtacgccgtactaaaaacctatcactataaaaaccgaacgccgtactaaaaacctatcactataaaaaccgtacgccgtactaaaaacctatcactataaaaaccgtacgccgtactaaaaacctatcactataaaaaccgtacgccgtactaaaaacctaacactataaataccgtacgccgtactaaaaacctaacactataaaaaccgtacgccgtactaaaaacctaacactataaataccgtacgccgtactaaaaacctatcactataaataccgtacgccgtactaaaaacctatcactataaataccgtacgccgtactaaaaacctaacactataaataccgtacgccgtactaaaaacctaacactataaataccgtacgccgtactaaaaacctaacactataaataccgtacgccgtactaaaaacctaacactctaaataccgtacgccgtactaaaaacctatcactataaataccgtacgccgtactaaaaacctatcactataaataccgtacgccgt

SEQ ID NO: 28427 - DNA, 559 bp, Artificial Sequence
  chemically treated genomic DNA (Homo sapiens) CpG-island No: 28427
ttgggagtttgttattgtgagtgtcgtgcgtcgtgttgggagtttgttattgtgagggtcgagcgtcgtgttgggagtttgttattgtgagggtcgtgcgtcgtgttgggagtttgttattgtgagggtcgtgcgtcgtgttgggagtttgttattgtgagggtcgtgcgtcgtgttgggagtttggtattgtgagtgtcgtgcgtcgtgttgggagtttggtattgtgagggtcgtgcgtcgtgttgggagtttggtattgtgagtgtcgtgcgtcgtgttgggagtttgttattgtgagtgtcgtgcgtcgtgttgggagtttgttattgtgagtgtcgtgcgtcgtgttgggagtttggtattgtgagtgtcgtgcgtcgtgttgggagtttggtattgtgagtgtcgtgcgtcgtgttgggagtttggtattgtgagtgtcgtgcgtcgtgttgggagtttggtattttgagtgtcgtgcgtcgtgttgggagtttgttattgtgagtgtcgtgcgtcgtgttgggagtttgttattgtgagtgtcgtgcgtcgt

SEQ ID NO: 28428 - DNA, 559 bp, Artificial Sequence
  chemically treated genomic DNA (Homo sapiens) CpG-island No: 28428
acgacgcacgacactcacaataacaaactcccaacacgacgcacgacactcacaataacaaactcccaacacgacgcacgacactcaaaataccaaactcccaacacgacgcacgacactcacaataccaaactcccaacacgacgcacgacactcacaataccaaactcccaacacgacgcacgacactcacaataccaaactcccaacacgacgcacgacactcacaataacaaactcccaacacgacgcacgacactcacaataacaaactcccaacacgacgcacgacactcacaataccaaactcccaacacgacgcacgaccctcacaataccaaactcccaacacgacgcacgacactcacaataccaaactcccaacacgacgcacgaccctcacaataacaaactcccaacacgacgcacgaccctcacaataacaaactcccaacacgacgcacgaccctcacaataacaaactcccaacacgacgctcgaccctcacaataacaaactcccaacacgacgcacgacactcacaataacaaactcccaa

SEQ ID NO: 28429 - DNA, 1290 bp, Artificial Sequence
  chemically treated genomic DNA (Homo sapiens) CpG-island No: 28429
gcggagaggaggcgcggggttgggtttatatcggcggcggcggcggttttatttttttcgcgtttatttttttattatgcggggtcgcggtttatggtgagttttagtagttagtattatcggttggagacgaagaagaagaagaagaggaggcggcgagcgcgggggaaggcgaaaaagaaaaagaaagaaggggagagggttttcggtagtattaggatcgacgcgcgtattagtttcggagtttagttcgcgcgcgtttgtggggtcgtttgatttcggggttaaagcggcggcggcggtagcgggcgcggcggttcgggttgcgtatcggcgcgggattaaggagcgcgggatgtatttcggtgtagcggtcgtcggcgaggacgatttttttttgtataagagtttgagcgtttttatttttaagcgtttggaagcggtttttcgttttacgttttcgggtatggatttgtttttggcgtcgtcgtttcgggaacgttcggcgttttttttttcgtcgtttttgggttgtttcgagtcggttgatttcgagggggtagggttgttgttgtcgtcgtttggaggaggcggcggcggtagcgcgggaagtggcggcggcggcggcggcggggtggggtatttcgggttgttagtaggtttagtcggcgttgggggcgattatagtataagtagtttgtcggtcggggtcgttttttgttttaagtacggcgaaagcgcgagtcggggttcggtggtcgagagtagcggcggcgagtagagtttcgacgacgatagcgacggtcgttgcgagttcgtgttgcgggtcggagtagtcgattagcgggttttttcgggagcgggaggtggtggcgcgaaggtagtcgagggttgttttaatgtttatttttacggcggcgttagcgttttttcggggggtttgggcggcggcggcggcgggggtagtagtagcggtagtagtggcggcggtggcggtagcggtagcggtagcggcggtagtagtagtagtagtagtagtagtagtaagaaatttaaagagtaaaaggcgttgcggtttaatattaatgttcgagagcgtcggcggatgtacgatttgaacgacgcgttggacgagttgcgcgcggtgattttttacgcgtatagtttttcggtgcgaaagttttttaagatcgttacgatgttgttcgttaagaaatatatttttatgtaggcgtaggttttggaggagatgcggcgtatagttgtttattttaattagggttaggttat

SEQ ID NO: 28430 - DNA, 1290 bp, Artificial Sequence
  chemically treated genomic DNA (Homo sapiens) CpG-island No: 28430
ataacctaaccctaattaaaataaacaactatacgccgcatctcctccaaaacctacgcctacataaaaatatatttcttaacgaacaacatcgtaacgatcttaaaaaactttcgcaccgaaaaactatacgcgtaaaaaatcaccgcgcgcaactcgtccaacgcgtcgttcaaatcgtacatccgccgacgctctcgaacattaatattaaaccgcaacgccttttactctttaaatttcttactactactactactactactactactaccgccgctaccgctaccgctaccgccaccgccgccactactaccgctactactacccccgccgccgccgccgcccaaaccccccgaaaaaacgctaacgccgccgtaaaaataaacattaaaacaaccctcgactaccttcgcgccaccacctcccgctcccgaaaaaacccgctaatcgactactccgacccgcaacacgaactcgcaacgaccgtcgctatcgtcgtcgaaactctactcgccgccgctactctcgaccaccgaaccccgactcgcgctttcgccgtacttaaaacaaaaaacgaccccgaccgacaaactacttatactataatcgcccccaacgccgactaaacctactaacaacccgaaataccccaccccgccgccgccgccgccgccacttcccgcgctaccgccgccgcctcctccaaacgacgacaacaacaaccctaccccctcgaaatcaaccgactcgaaacaacccaaaaacgacgaaaaaaaaaacgccgaacgttcccgaaacgacgacgccaaaaacaaatccatacccgaaaacgtaaaacgaaaaaccgcttccaaacgcttaaaaataaaaacgctcaaactcttatacaaaaaaaaatcgtcctcgccgacgaccgctacaccgaaatacatcccgcgctccttaatcccgcgccgatacgcaacccgaaccgccgcgcccgctaccgccgccgccgctttaaccccgaaatcaaacgaccccacaaacgcgcgcgaactaaactccgaaactaatacgcgcgtcgatcctaatactaccgaaaaccctctccccttctttctttttctttttcgccttcccccgcgctcgccgcctcctcttcttcttcttcttcgtctccaaccgataatactaactactaaaactcaccataaaccgcgaccccgcataataaaaaaataaacgcgaaaaaaataaaaccgccgccgccgccgatataaacccaaccccgcgcctcctctccgc

SEQ ID NO: 28431 - DNA, 1290 bp, Artificial Sequence
  chemically treated genomic DNA (Homo sapiens) CpG-island No: 28431
atggtttggttttggttgaggtaggtaattatgcgtcgtattttttttagggtttgcgtttgtatgaggatgtattttttggcgagtagtatcgtggcgattttggagagttttcgtatcgaggggttgtgcgcgtaggggattatcgcgcgtagttcgtttagcgcgtcgtttaggtcgtgtattcgtcggcgttttcgggtattgatgttaagtcgtagcgttttttgttttttggattttttgttgttgttgttgttgttgttgttgttgtcgtcgttgtcgttatcgttatcgttatcgtcgttattgttatcgttgttgttattttcgtcgtcgtcgtcgtttaggtttttcggggggacgttggcgtcgtcgtggaggtgggtattggagtagttttcggttgttttcgcgttattatttttcgttttcggggaggttcgttggtcggttatttcggttcgtagtacgagttcgtagcgatcgtcgttgtcgtcgtcggggttttgttcgtcgtcgttgttttcggttatcgagtttcggttcgcgttttcgtcgtatttgaggtaaagggcggtttcggtcggtaggttgtttatgttatggtcgtttttaacgtcggttgaatttattagtagttcggggtattttatttcgtcgtcgtcgtcgtcgttatttttcgcgttgtcgtcgtcgttttttttaggcggcggtaatagtagttttgttttttcggggttagtcggttcgaagtagtttaggggcgacgaggaggaggacgtcgggcgttttcgaggcggcggcgttagggataggtttatgttcgggggcgtggagcggaaagtcgtttttaagcgtttggaggtggaggcgtttaggtttttgtgtaggaagaggtcgttttcgtcggcggtcgttgtatcgaggtgtatttcgcgttttttggtttcgcgtcggtgcgtagttcgggtcgtcgcgttcgttgtcgtcgtcgtcgttttggtttcggagttaggcggttttatagacgcgcgcgagttgggtttcggagttggtgcgcgcgtcggttttggtgttgtcgggagttttttttttttttttttttttttttttcgttttttttcgcgttcgtcgtttttttttttttttttttttcgtttttagtcgatggtgttggttgttggggtttattatgggtcgcggtttcgtatggtgggagggtgggcgcggagggagtggagtcgtcgtcgtcgtcgatatgagtttagtttcgcgtttttttttcgt

SEQ ID NO: 28432 - DNA, 1290 bp, Artificial Sequence
  chemically treated genomic DNA (Homo sapiens) CpG-island No: 28432
acgaaaaaaaaacgcgaaactaaactcatatcgacgacgacgacgactccactccctccgcgcccaccctcccaccatacgaaaccgcgacccataataaaccccaacaaccaacaccatcgactaaaaacgaaaaaaaaaaaaaaaaaaaaacgacgaacgcgaaaaaaaacgaaaaaaaaaaaaaaaaaaaaaaaaaaaactcccgacaacaccaaaaccgacgcgcgcaccaactccgaaacccaactcgcgcgcgtctataaaaccgcctaactccgaaaccaaaacgacgacgacgacaacgaacgcgacgacccgaactacgcaccgacgcgaaaccaaaaaacgcgaaatacacctcgatacaacgaccgccgacgaaaacgacctcttcctacacaaaaacctaaacgcctccacctccaaacgcttaaaaacgactttccgctccacgcccccgaacataaacctatccctaacgccgccgcctcgaaaacgcccgacgtcctcctcctcgtcgcccctaaactacttcgaaccgactaaccccgaaaaaacaaaactactattaccgccgcctaaaaaaaacgacgacgacaacgcgaaaaataacgacgacgacgacgacgaaataaaataccccgaactactaataaattcaaccgacgttaaaaacgaccataacataaacaacctaccgaccgaaaccgccctttacctcaaatacgacgaaaacgcgaaccgaaactcgataaccgaaaacaacgacgacgaacaaaaccccgacgacgacaacgacgatcgctacgaactcgtactacgaaccgaaataaccgaccaacgaacctccccgaaaacgaaaaataataacgcgaaaacaaccgaaaactactccaatacccacctccacgacgacgccaacgtccccccgaaaaacctaaacgacgacgacgacgaaaataacaacaacgataacaataacgacgataacgataacgataacgacaacgacgacaacaacaacaacaacaacaacaacaacaaaaaatccaaaaaacaaaaaacgctacgacttaacatcaatacccgaaaacgccgacgaatacacgacctaaacgacgcgctaaacgaactacgcgcgataatcccctacgcgcacaacccctcgatacgaaaactctccaaaatcgccacgatactactcgccaaaaaatacatcctcatacaaacgcaaaccctaaaaaaaatacgacgcataattacctacctcaaccaaaaccaaaccat

SEQ ID NO: 28433 - DNA, 651 bp, Artificial Sequence
  chemically treated genomic DNA (Homo sapiens) CpG-island No: 28433
aggtttcgcggttcgggggcgttcgtagtgtcgttggatcggcggtagcgttggttacgtcgtgggatgggattggttcggaacgcgggtggcggttcggtttcggagattcgcgtagtagtcggagtattttcgtgtttcgtttattatttttttttttttcgcgttcggcggagggtttcggcgcgcggggtaggtttggagcgtcgtgagtaggtcggatgcgggatacgttagtgattattagagttagattcggagcgcgttgtcggcggtgacggttaggttgggtttttgtttttgggtcgagttgtcgagttttttcggggatttgaaggtgaagggagaggcgtcggtcggggtcgcgggtcgagttaagggcgagtttcgtattcggcgttttttaggtggggcgaagttcgagggttagaggttggcgaaggattttcgtttagtttgaaatttagttgcgtttaacgtcgggggaggcggagcgaggggaattcgggcgtcgggaatttcggaagtgggagggatgggtttttgcgcggggagacgtcgggtttggcgaatatttttaagaatcggtcggtggttttattttcgaaaattttttcgtgtttagcgatttttatatttagtgtttttttt

SEQ ID NO: 28434 - DNA, 651 bp, Artificial Sequence
  chemically treated genomic DNA (Homo sapiens) CpG-island No: 28434
aaaaaaaacactaaatataaaaatcgctaaacacgaaaaaattttcgaaaataaaaccaccgaccgattcttaaaaatattcgccaaacccgacgtctccccgcgcaaaaacccatccctcccacttccgaaattcccgacgcccgaattcccctcgctccgcctcccccgacgttaaacgcaactaaatttcaaactaaacgaaaatccttcgccaacctctaaccctcgaacttcgccccacctaaaaaacgccgaatacgaaactcgcccttaactcgacccgcgaccccgaccgacgcctctcccttcaccttcaaatccccgaaaaaactcgacaactcgacccaaaaacaaaaacccaacctaaccgtcaccgccgacaacgcgctccgaatctaactctaataatcactaacgtatcccgcatccgacctactcacgacgctccaaacctaccccgcgcgccgaaaccctccgccgaacgcgaaaaaaaaaaaaataataaacgaaacacgaaaatactccgactactacgcgaatctccgaaaccgaaccgccacccgcgttccgaaccaatcccatcccacgacgtaaccaacgctaccgccgatccaacgacactacgaacgcccccgaaccgcgaaacct

SEQ ID NO: 28435 - DNA, 651 bp, Artificial Sequence
  chemically treated genomic DNA (Homo sapiens) CpG-island No: 28435
aagggaaatattaaatatgagaatcgttaaatacgaaagagttttcggaggtagagttatcgatcggtttttgaggatgttcgttaagttcggcgttttttcgcgtagaagtttattttttttattttcggggttttcggcgttcgggtttttttcgtttcgtttttttcggcgttgggcgtagttgggttttaagttgggcgggggtttttcgttagtttttggttttcgaatttcgttttatttggaaggcgtcggatgcgagattcgtttttggttcggttcgcggtttcggtcggcgtttttttttttatttttaagttttcgagggagttcggtaattcggtttaaggataggggtttagtttagtcgttatcgtcggtagcgcgtttcgggtttggttttggtaattattggcgtatttcgtattcggtttgtttacggcgttttaggtttgtttcgcgcgtcgaaatttttcgtcggacgcggaggaaaagaaggtggtgagcgaagtacggagatgtttcgattgttgcgcgggttttcgaagtcgaatcgttattcgcgtttcgggttagttttattttacggcgtggttagcgttgtcgtcggtttagcgatattgcgggcgttttcgggtcgcggggttt

SEQ ID NO: 28436 - DNA, 651 bp, Artificial Sequence
  chemically treated genomic DNA (Homo sapiens) CpG-island No: 28436
aaaccccgcgacccgaaaacgcccgcaatatcgctaaaccgacgacaacgctaaccacgccgtaaaataaaactaacccgaaacgcgaataacgattcgacttcgaaaacccgcgcaacaatcgaaacatctccgtacttcgctcaccaccttcttttcctccgcgtccgacgaaaaatttcgacgcgcgaaacaaacctaaaacgccgtaaacaaaccgaatacgaaatacgccaataattaccaaaaccaaacccgaaacgcgctaccgacgataacgactaaactaaacccctatccttaaaccgaattaccgaactccctcgaaaacttaaaaataaaaaaaaaaacgccgaccgaaaccgcgaaccgaaccaaaaacgaatctcgcatccgacgccttccaaataaaacgaaattcgaaaaccaaaaactaacgaaaaacccccgcccaacttaaaacccaactacgcccaacgccgaaaaaaacgaaacgaaaaaaacccgaacgccgaaaaccccgaaaataaaaaaaataaacttctacgcgaaaaaacgccgaacttaacgaacatcctcaaaaaccgatcgataactctacctccgaaaactctttcgtatttaacgattctcatatttaatatttccctt

SEQ ID NO: 28437 - DNA, 571 bp, Artificial Sequence
  chemically treated genomic DNA (Homo sapiens) CpG-island No: 28437
gcggcgtatcgcggggattttgcgggattaggttaaagattaggatcgttttttaatcgttcgcggtcgcgtagttttgggcggtttgggtttgttttttttcgcgtagggtttttttttttgtcggtcgttgtttcgtatatggttttggtcgtattttcgttttattgttattattgtttacgttttgcgttttcgtttgatcgcgtggagtcggaattcgtttttttcgtttcgcgttgttttaggtttgtttcgtattagtagttaagcgtaggtttttattgtaagttcgtaatttttttatcgttgggtttattggcgattttcggcgttatgcgcgtgaaatgtgggcgacgggttcgtttttggcgggcggcgcgcgcggtttttagatgtagtcgtcgcgtcggggtagttgacgtcgtttttaaagacgcgttttgttggacggcgttgattttacgtagttagcggagttttttgggaatagtttaggcgtcggtgtcgattttaatttttttgtttaggttttttgagttgcgttattagtttattatgtattattaag

SEQ ID NO: 28438 - DNA, 571 bp, Artificial Sequence
  chemically treated genomic DNA (Homo sapiens) CpG-island No: 28438
cttaataatacataataaactaataacgcaactcaaaaaacctaaacaaaaaaattaaaatcgacaccgacgcctaaactattcccaaaaaactccgctaactacgtaaaatcaacgccgtccaacaaaacgcgtctttaaaaacgacgtcaactaccccgacgcgacgactacatctaaaaaccgcgcgcgccgcccgccaaaaacgaacccgtcgcccacatttcacgcgcataacgccgaaaatcgccaataaacccaacgataaaaaaattacgaacttacaataaaaacctacgcttaactactaatacgaaacaaacctaaaacaacgcgaaacgaaaaaaacgaattccgactccacgcgatcaaacgaaaacgcaaaacgtaaacaataataacaataaaacgaaaatacgaccaaaaccatatacgaaacaacgaccgacaaaaaaaaaaaccctacgcgaaaaaaaacaaacccaaaccgcccaaaactacgcgaccgcgaacgattaaaaaacgatcctaatctttaacctaatcccgcaaaatccccgcgatacgccgc

SEQ ID NO: 28439 - DNA, 571 bp, Artificial Sequence
  chemically treated genomic DNA (Homo sapiens) CpG-island No: 28439
tttagtaatatatggtaagttggtaacgtaatttaagaagtttgagtagagaggttgaagtcggtatcggcgtttgggttgtttttaggagatttcgttggttgcgtggggttagcgtcgtttagtagggcgcgtttttggaggcggcgttagttgtttcggcgcggcggttgtatttggaaatcgcgcgcgtcgttcgttaagggcgagttcgtcgtttatattttacgcgtatggcgtcgggggtcgttagtaggtttagcgatgagggggttgcgggtttgtagtagagatttgcgtttagttgttggtgcggggtaggtttggggtagcgcggggcgaggaaggcgggtttcggttttacgcggttaaacggggacgtagggcgtgggtagtggtggtagtggagcgggagtacgattagagttatgtgcggggtagcgatcggtaggagggaaagttttgcgcggggaagggtaggtttaggtcgtttagggttacgcggtcgcgaacggttgggggacggttttggtttttggtttggtttcgtaagattttcgcgatgcgtcgt

SEQ ID NO: 28440 - DNA, 571 bp, Artificial Sequence
  chemically treated genomic DNA (Homo sapiens) CpG-island No: 28440
acgacgcatcgcgaaaatcttacgaaaccaaaccaaaaaccaaaaccgtcccccaaccgttcgcgaccgcgtaaccctaaacgacctaaacctacccttccccgcgcaaaactttccctcctaccgatcgctaccccgcacataactctaatcgtactcccgctccactaccaccactacccacgccctacgtccccgtttaaccgcgtaaaaccgaaacccgccttcctcgccccgcgctaccccaaacctaccccgcaccaacaactaaacgcaaatctctactacaaacccgcaaccccctcatcgctaaacctactaacgacccccgacgccatacgcgtaaaatataaacgacgaactcgcccttaacgaacgacgcgcgcgatttccaaatacaaccgccgcgccgaaacaactaacgccgcctccaaaaacgcgccctactaaacgacgctaaccccacgcaaccaacgaaatctcctaaaaacaacccaaacgccgataccgacttcaacctctctactcaaacttcttaaattacgttaccaacttaccatatattactaaa

SEQ ID NO: 28441 - DNA, 660 bp, Artificial Sequence
  chemically treated genomic DNA (Homo sapiens) CpG-island No: 28441
gcggttgcgcgtgtagtatatgtaggattattttaattataagtatcggtcgcggcggcgtaagtaggtgaagcggttgaagcgggtggagggcggttttatgtacggtatggatgagtcgtaggcggtcgcgatgggtttcgagggcggtcgcgtggttatggacggtttgggtttttagtttttcgagtagggttttttcgtcggttcgtcgttgttgttttcgtatatgggcggttattatcgcgattgttagagtttgggcgcgttttcgttcgacggttattcgttgtttacgttcgatacgttttcgatggacggcgtggatttcgattcggtttttttcgtcgtttcgatgttcggggattgttcggcggtcggtatttatagttacgcgtaggtttcggattacgttggtttttcggagtttttcgtcggttttatgtattttcgattaggtttagagttcgcgggtttttcgatttcgggttttttggcgttatttagcgttttttacgtgtattacggcgcgatgggttcgttcggggcgggcggcgggcgcggtttttagatgtagtcgtaatattagtattagtattagtattagtattatttttcgggtttcggatagtcgtcgtttttttcggaggtattgttttg

SEQ ID NO: 28442 - DNA, 660 bp, Artificial Sequence
  chemically treated genomic DNA (Homo sapiens) CpG-island No: 28442
caaaacaatacctccgaaaaaaacgacgactatccgaaacccgaaaaataatactaatactaatactaatactaatattacgactacatctaaaaaccgcgcccgccgcccgccccgaacgaacccatcgcgccgtaatacacgtaaaaaacgctaaataacgccaaaaaacccgaaatcgaaaaacccgcgaactctaaacctaatcgaaaatacataaaaccgacgaaaaactccgaaaaaccaacgtaatccgaaacctacgcgtaactataaataccgaccgccgaacaatccccgaacatcgaaacgacgaaaaaaaccgaatcgaaatccacgccgtccatcgaaaacgtatcgaacgtaaacaacgaataaccgtcgaacgaaaacgcgcccaaactctaacaatcgcgataataaccgcccatatacgaaaacaacaacgacgaaccgacgaaaaaaccctactcgaaaaactaaaaacccaaaccgtccataaccacgcgaccgccctcgaaacccatcgcgaccgcctacgactcatccataccgtacataaaaccgccctccacccgcttcaaccgcttcacctacttacgccgccgcgaccgatacttataattaaaataatcctacatatactacacgcgcaaccgc

SEQ ID NO: 28443 - DNA, 660 bp, Artificial Sequence
  chemically treated genomic DNA (Homo sapiens) CpG-island No: 28443
tagggtagtgttttcggagggggcgacggttgttcggggttcggggggtggtgttggtgttggtgttggtgttggtgttgcggttgtatttggaaatcgcgttcgtcgttcgtttcgggcgagtttatcgcgtcgtagtatacgtgaagggcgttgggtggcgttaggaggttcggaatcgagggattcgcgggttttgggtttagtcgggggtgtatgggatcggcgggaggtttcggggggttagcgtagttcgagatttgcgcgtagttgtaggtgtcggtcgtcgggtagttttcgggtatcggggcggcgaagaaagtcgggtcggggtttacgtcgtttatcggggacgtgtcgggcgtgggtaacgggtagtcgtcgagcggaggcgcgtttagattttggtagtcgcggtagtggtcgtttatgtgcggaggtagtagcggcgggtcggcggggaagttttgttcggggaattggaggtttaggtcgtttatggttacgcggtcgttttcggggtttatcgcggtcgtttgcggtttatttatgtcgtgtatgaagtcgttttttattcgttttagtcgttttatttgtttgcgtcgtcgcggtcggtatttgtagttggggtggttttgtatgtgttgtacgcgtagtcgt

SEQ ID NO: 28444 - DNA, 660 bp, Artificial Sequence
  chemically treated genomic DNA (Homo sapiens) CpG-island No: 28444
acgactacgcgtacaacacatacaaaaccaccccaactacaaataccgaccgcgacgacgcaaacaaataaaacgactaaaacgaataaaaaacgacttcatacacgacataaataaaccgcaaacgaccgcgataaaccccgaaaacgaccgcgtaaccataaacgacctaaacctccaattccccgaacaaaacttccccgccgacccgccgctactacctccgcacataaacgaccactaccgcgactaccaaaatctaaacgcgcctccgctcgacgactacccgttacccacgcccgacacgtccccgataaacgacgtaaaccccgacccgactttcttcgccgccccgatacccgaaaactacccgacgaccgacacctacaactacgcgcaaatctcgaactacgctaaccccccgaaacctcccgccgatcccatacacccccgactaaacccaaaacccgcgaatccctcgattccgaacctcctaacgccacccaacgcccttcacgtatactacgacgcgataaactcgcccgaaacgaacgacgaacgcgatttccaaatacaaccgcaacaccaacaccaacaccaacaccaacaccaccccccgaaccccgaacaaccgtcgccccctccgaaaacactacccta

SEQ ID NO: 28445 - DNA, 619 bp, Artificial Sequence
  chemically treated genomic DNA (Homo sapiens) CpG-island No: 28445
gtttgaaggtgatgcgggatgtcgttttttcgcgcgtgaggttgcggttttgacggtgagtggggggcgcgtgttgtcgtcggttaggatttttttttattacggatatcggagtcggtgcgttttttatacgaatcgtggattatttttcgcgagtacgtattgttttttgcgtttacgttggttttttttttttacggacgcgcggcggtattttttttagggttaaggtcgcgttttttttttcgttcggggtttttattatttttttcgttcggttttggatttttttaggttttttcgtattttcgttcgtatcggacggtttcggtttttttttcgtttatatttttttgggtttcgttagatcggcgttttttttattttggatttttttagattttcggtttttttttttttcgtgttttttcgcgcgttttttatcgggcgtcgtgtttagggttaggatggtcggagttttaggggcgtagtcgggattttcgggtcgttttttttgtcgcgtttttcggggtttcgcgttttttgggatgggttcggaaaggggtggggagtttttttaaaatataaaaatggaggttttttttgtttgatgtatatt

SEQ ID NO: 28446 - DNA, 619 bp, Artificial Sequence
  chemically treated genomic DNA (Homo sapiens) CpG-island No: 28446
aatatacatcaaacaaaaaaaacctccatttttatattttaaaaaaactccccacccctttccgaacccatcccaaaaaacgcgaaaccccgaaaaacgcgacaaaaaaaacgacccgaaaatcccgactacgcccctaaaactccgaccatcctaaccctaaacacgacgcccgataaaaaacgcgcgaaaaaacacgaaaaaaaaaaaaaccgaaaatctaaaaaaatccaaaataaaaaaaacgccgatctaacgaaacccaaaaaaatataaacgaaaaaaaaaccgaaaccgtccgatacgaacgaaaatacgaaaaaacctaaaaaaatccaaaaccgaacgaaaaaaataataaaaaccccgaacgaaaaaaaaaacgcgaccttaaccctaaaaaaaataccgccgcgcgtccgtaaaaaaaaaaaaccaacgtaaacgcaaaaaacaatacgtactcgcgaaaaataatccacgattcgtataaaaaacgcaccgactccgatatccgtaataaaaaaaaatcctaaccgacgacaacacgcgccccccactcaccgtcaaaaccgcaacctcacgcgcgaaaaaacgacatcccgcatcaccttcaaac

SEQ ID NO: 28447 - DNA, 619 bp, Artificial Sequence
  chemically treated genomic DNA (Homo sapiens) CpG-island No: 28447
gatgtgtattaaataaaaaaaatttttatttttatattttggggaagttttttattttttttcgggtttattttaggggacgcgagatttcgaggaacgcggtaagaagagcggttcgggggtttcgattgcgtttttaggatttcggttattttggttttaggtacggcgttcggtagaaagcgcgcgggagggtacgagggggaggaaagtcggagatttgaggagatttaaggtgggagggacgtcggtttgacggggtttaagggggtatgggcggggaaaggatcgaggtcgttcgatgcggacgggggtgcgggagggtttgagggggtttaaggtcgggcgaggggaatggtgggaatttcgaacgggggagagggcgcggttttggttttggggaggatgtcgtcgcgcgttcgtgaggggaggggattagcgtaaacgtaggaggtagtgcgtgttcgcggggaatagtttacgattcgtgtggaggacgtatcggtttcggtgttcgtgatgggagagggttttggtcggcgataatacgcgttttttatttatcgttagagtcgtagttttacgcgcgaaggaacggtatttcgtattatttttagat

SEQ ID NO: 28448 - DNA, 619 bp, Artificial Sequence
  chemically treated genomic DNA (Homo sapiens) CpG-island No: 28448
atctaaaaataatacgaaataccgttccttcgcgcgtaaaactacgactctaacgataaataaaaaacgcgtattatcgccgaccaaaaccctctcccatcacgaacaccgaaaccgatacgtcctccacacgaatcgtaaactattccccgcgaacacgcactacctcctacgtttacgctaatcccctcccctcacgaacgcgcgacgacatcctccccaaaaccaaaaccgcgccctctcccccgttcgaaattcccaccattcccctcgcccgaccttaaaccccctcaaaccctcccgcacccccgtccgcatcgaacgacctcgatcctttccccgcccatacccccttaaaccccgtcaaaccgacgtccctcccaccttaaatctcctcaaatctccgactttcctccccctcgtaccctcccgcgcgctttctaccgaacgccgtacctaaaaccaaaataaccgaaatcctaaaaacgcaatcgaaacccccgaaccgctcttcttaccgcgttcctcgaaatctcgcgtcccctaaaataaacccgaaaaaaaataaaaaacttccccaaaatataaaaataaaaattttttttatttaatacacatc

SEQ ID NO: 28449 - DNA, 818 bp, Artificial Sequence
  chemically treated genomic DNA (Homo sapiens) CpG-island No: 28449
  misc_feature (800)..(800): n is either a, c, g or t
ggagtcgcgagggagaggagggtttagagttcggagtgggcggtgtttgagtaggggcggggcggggtcggggtttggagttggggacgcgggtcggggtcgggagttgcggattcgttggcgggtgggaggagcggagtcggggcgacgttggcggagatttaggggatcgttcggttggggtttgcgtttttcggattattagtttcgggcgttggtttttatcgaggttgtttaggcgtcgttttttcgcgttattgttataggaggcgtttgttgggcgcgttatggatttcgtttcgcggaaacgtttggttcgggttttgtttttagtgagcggttggagcggtcgcggggtcgtaaaatttttaggatttcgaggaaaggcgtttttcggagttgttcgaggtcgggttcggcgtttatttattattcgtttcgtttttttttagtttcgtattattttttatttcgtttttttcgggttttttttacgtttagtaaaatttgtatatttttttcggacggttatcgattcgtagtttcggcgaggaagttgtttgcgtttcgattgtttggattttttcgcgtggttttcggcgaattttagtagtcggaaggtgttaggttcgtttgacgcgttttttttttggggaagaaacgggcgggggtttaggagggattttggtcgggttttttcggcgtgttgattcgaaatcgcgcgggaaaatttgcgttaattataggagggaagattttggtagtttttagttttttagggaggtttaagtgaaaaatanacgttggtttcgtttcgg

SEQ ID NO: 28450 - DNA, 818 bp, Artificial Sequence
  chemically treated genomic DNA (Homo sapiens) CpG-island No: 28450
  misc_feature (19)..(19): n is either a, c, g or t
ccgaaacgaaaccaacgtntatttttcacttaaacctccctaaaaaactaaaaactaccaaaatcttccctcctataattaacgcaaattttcccgcgcgatttcgaatcaacacgccgaaaaaacccgaccaaaatccctcctaaacccccgcccgtttcttccccaaaaaaaaaacgcgtcaaacgaacctaacaccttccgactactaaaattcgccgaaaaccacgcgaaaaaatccaaacaatcgaaacgcaaacaacttcctcgccgaaactacgaatcgataaccgtccgaaaaaaatatacaaattttactaaacgtaaaaaaaacccgaaaaaaacgaaataaaaaataatacgaaactaaaaaaaaacgaaacgaataataaataaacgccgaacccgacctcgaacaactccgaaaaacgcctttcctcgaaatcctaaaaattttacgaccccgcgaccgctccaaccgctcactaaaaacaaaacccgaaccaaacgtttccgcgaaacgaaatccataacgcgcccaacaaacgcctcctataacaataacgcgaaaaaacgacgcctaaacaacctcgataaaaaccaacgcccgaaactaataatccgaaaaacgcaaaccccaaccgaacgatcccctaaatctccgccaacgtcgccccgactccgctcctcccacccgccaacgaatccgcaactcccgaccccgacccgcgtccccaactccaaaccccgaccccgccccgcccctactcaaacaccgcccactccgaactctaaaccctcctctccctcgcgactcc

SEQ ID NO: 28451 - DNA, 818 bp, Artificial Sequence
  chemically treated genomic DNA (Homo sapiens) CpG-island No: 28451
  misc_feature (19)..(19): n is either a, c, g or t
tcgaggcgaggttagcgtntgttttttatttgggtttttttggggggttgggggttgttagaatttttttttttgtggttggcgtaagttttttcgcgcggtttcggattaatacgtcgggggagttcggttaaagttttttttggattttcgttcgttttttttttaggggaggggcgcgttaggcggatttggtatttttcggttgttggggttcgtcgggagttacgcggggaggtttaggtagtcgggacgtaggtagttttttcgtcgaggttgcgagtcggtggtcgttcgggggaggtgtgtaggttttgttggacgtagaaggaattcgaaggaggcggggtggagggtggtgcggggttggggaggggcgaggcgagtggtgagtggacgtcgggttcggtttcgggtaatttcgaggggcgttttttttcggggttttggaggttttgcgatttcgcggtcgttttagtcgtttattggggataaggttcgagttaggcgttttcgcgaggcggggtttatagcgcgtttagtaggcgttttttgtggtagtgacgcgggggagcggcgtttgaatagtttcggtgggaattagcgttcgaagttggtgattcggggggcgtaggttttaatcgggcgattttttggattttcgttagcgtcgtttcgatttcgttttttttattcgttagcgagttcgtaattttcggtttcggttcgcgtttttagttttaggtttcggtttcgtttcgtttttgtttaggtatcgtttatttcgggttttgggtttttttttttttcgcggtttt

SEQ ID NO: 28452 - DNA, 818 bp, Artificial Sequence
  chemically treated genomic DNA (Homo sapiens) CpG-island No: 28452
  misc_feature (800)..(800): n is either a, c, g or t
aaaaccgcgaaaaaaaaaaaaacccaaaacccgaaataaacgatacctaaacaaaaacgaaacgaaaccgaaacctaaaactaaaaacgcgaaccgaaaccgaaaattacgaactcgctaacgaataaaaaaaacgaaatcgaaacgacgctaacgaaaatccaaaaaatcgcccgattaaaacctacgccccccgaatcaccaacttcgaacgctaattcccaccgaaactattcaaacgccgctcccccgcgtcactaccacaaaaaacgcctactaaacgcgctataaaccccgcctcgcgaaaacgcctaactcgaaccttatccccaataaacgactaaaacgaccgcgaaatcgcaaaacctccaaaaccccgaaaaaaaacgcccctcgaaattacccgaaaccgaacccgacgtccactcaccactcgcctcgcccctccccaaccccgcaccaccctccaccccgcctccttcgaattccttctacgtccaacaaaacctacacacctcccccgaacgaccaccgactcgcaacctcgacgaaaaaactacctacgtcccgactacctaaacctccccgcgtaactcccgacgaaccccaacaaccgaaaaataccaaatccgcctaacgcgcccctcccctaaaaaaaaaacgaacgaaaatccaaaaaaaactttaaccgaactcccccgacgtattaatccgaaaccgcgcgaaaaaacttacgccaaccacaaaaaaaaaaattctaacaacccccaaccccccaaaaaaacccaaataaaaaacanacgctaacctcgcctcga

SEQ ID NO: 28453 - DNA, 1291 bp, Artificial Sequence
  chemically treated genomic DNA (Homo sapiens) CpG-island No: 28453
tcgtggcgattttggagagttttcgtatcgaggggttgtgcgcgtaggggattatcgcgcgtagttcgtttagcgcgtcgtttaggtcgtgtattcgtcggcgttttcgggtattgatgttaagtcgtagcgttttttgttttttggattttttgttgttgttgttgttgttgttgttgttgtcgtcgttgtcgttatcgttatcgttatcgtcgttattgttatcgttgttgttattttcgtcgtcgtcgtcgtttaggtttttcggggggacgttggcgtcgtcgtggaggtgggtattggagtagttttcggttgttttcgcgttattatttttcgttttcggggaggttcgttggtcggttatttcggttcgtagtacgagttcgtagcgatcgtcgttgtcgtcgtcggggttttgttcgtcgtcgttgttttcggttatcgagtttcggttcgcgttttcgtcgtatttgaggtaaagggcggtttcggtcggtaggttgtttatgttatggtcgtttttaacgtcggttgaatttattagtagttcggggtattttatttcgtcgtcgtcgtcgtcgttatttttcgcgttgtcgtcgtcgttttttttaggcggcggtaatagtagttttgttttttcggggttagtcggttcgaagtagtttaggggcgacgaggaggaggacgtcgggcgttttcgaggcggcggcgttagggataggtttatgttcgggggcgtggagcggaaagtcgtttttaagcgtttggaggtggaggcgtttaggtttttgtgtaggaagaggtcgttttcgtcggcggtcgttgtatcgaggtgtatttcgcgttttttggtttcgcgtcggtgcgtagttcgggtcgtcgcgttcgttgtcgtcgtcgtcgttttggtttcggagttaggcggttttatagacgcgcgcgagttgggtttcggagttggtgcgcgcgtcggttttggtgttgtcgggagttttttttttttttttttttttttttttcgttttttttcgcgttcgtcgtttttttttttttttttttttcgtttttagtcgatggtgttggttgttggggtttattatgggtcgcggtttcgtatggtgggagggtgggcgcggagggagtggagtcgtcgtcgtcgtcgatatgagtttagtttcgcgtttttttttcgtatcgtttattttgtttggatttatttttaagagattttcggatttattaaatagtcgtcgttatagacgggggagttttttatattattatt

SEQ ID NO: 28454 - DNA, 1291 bp, Artificial Sequence
  chemically treated genomic DNA (Homo sapiens) CpG-island No: 28454
aataataatataaaaaactcccccgtctataacgacgactatttaataaatccgaaaatctcttaaaaataaatccaaacaaaataaacgatacgaaaaaaaaacgcgaaactaaactcatatcgacgacgacgacgactccactccctccgcgcccaccctcccaccatacgaaaccgcgacccataataaaccccaacaaccaacaccatcgactaaaaacgaaaaaaaaaaaaaaaaaaaaacgacgaacgcgaaaaaaaacgaaaaaaaaaaaaaaaaaaaaaaaaaaaactcccgacaacaccaaaaccgacgcgcgcaccaactccgaaacccaactcgcgcgcgtctataaaaccgcctaactccgaaaccaaaacgacgacgacgacaacgaacgcgacgacccgaactacgcaccgacgcgaaaccaaaaaacgcgaaatacacctcgatacaacgaccgccgacgaaaacgacctcttcctacacaaaaacctaaacgcctccacctccaaacgcttaaaaacgactttccgctccacgcccccgaacataaacctatccctaacgccgccgcctcgaaaacgcccgacgtcctcctcctcgtcgcccctaaactacttcgaaccgactaaccccgaaaaaacaaaactactattaccgccgcctaaaaaaaacgacgacgacaacgcgaaaaataacgacgacgacgacgacgaaataaaataccccgaactactaataaattcaaccgacgttaaaaacgaccataacataaacaacctaccgaccgaaaccgccctttacctcaaatacgacgaaaacgcgaaccgaaactcgataaccgaaaacaacgacgacgaacaaaaccccgacgacgacaacgacgatcgctacgaactcgtactacgaaccgaaataaccgaccaacgaacctccccgaaaacgaaaaataataacgcgaaaacaaccgaaaactactccaatacccacctccacgacgacgccaacgtccccccgaaaaacctaaacgacgacgacgacgaaaataacaacaacgataacaataacgacgataacgataacgataacgacaacgacgacaacaacaacaacaacaacaacaacaacaaaaaatccaaaaaacaaaaaacgctacgacttaacatcaatacccgaaaacgccgacgaatacacgacctaaacgacgcgctaaacgaactacgcgcgataatcccctacgcgcacaacccctcgatacgaaaactctccaaaatcgccacga

SEQ ID NO: 28455 - DNA, 1291 bp, Artificial Sequence
  chemically treated genomic DNA (Homo sapiens) CpG-island No: 28455
gataatgatgtaaaagattttttcgtttgtggcggcggttgtttgatgggttcggaaattttttgaaggtgaatttaagtaagataaacggtgcggagaggaggcgcggggttgggtttatatcggcggcggcggcggttttatttttttcgcgtttatttttttattatgcggggtcgcggtttatggtgagttttagtagttagtattatcggttggagacgaagaagaagaagaagaggaggcggcgagcgcgggggaaggcgaaaaagaaaaagaaagaaggggagagggttttcggtagtattaggatcgacgcgcgtattagtttcggagtttagttcgcgcgcgtttgtggggtcgtttgatttcggggttaaagcggcggcggcggtagcgggcgcggcggttcgggttgcgtatcggcgcgggattaaggagcgcgggatgtatttcggtgtagcggtcgtcggcgaggacgatttttttttgtataagagtttgagcgtttttatttttaagcgtttggaagcggtttttcgttttacgttttcgggtatggatttgtttttggcgtcgtcgtttcgggaacgttcggcgttttttttttcgtcgtttttgggttgtttcgagtcggttgatttcgagggggtagggttgttgttgtcgtcgtttggaggaggcggcggcggtagcgcgggaagtggcggcggcggcggcggcggggtggggtatttcgggttgttagtaggtttagtcggcgttgggggcgattatagtataagtagtttgtcggtcggggtcgttttttgttttaagtacggcgaaagcgcgagtcggggttcggtggtcgagagtagcggcggcgagtagagtttcgacgacgatagcgacggtcgttgcgagttcgtgttgcgggtcggagtagtcgattagcgggttttttcgggagcgggaggtggtggcgcgaaggtagtcgagggttgttttaatgtttatttttacggcggcgttagcgttttttcggggggtttgggcggcggcggcggcgggggtagtagtagcggtagtagtggcggcggtggcggtagcggtagcggtagcggcggtagtagtagtagtagtagtagtagtagtaagaaatttaaagagtaaaaggcgttgcggtttaatattaatgttcgagagcgtcggcggatgtacgatttgaacgacgcgttggacgagttgcgcgcggtgattttttacgcgtatagtttttcggtgcgaaagttttttaagatcgttacga

SEQ ID NO: 28456 - DNA, 1291 bp, Artificial Sequence
  chemically treated genomic DNA (Homo sapiens) CpG-island No: 28456
tcgtaacgatcttaaaaaactttcgcaccgaaaaactatacgcgtaaaaaatcaccgcgcgcaactcgtccaacgcgtcgttcaaatcgtacatccgccgacgctctcgaacattaatattaaaccgcaacgccttttactctttaaatttcttactactactactactactactactactaccgccgctaccgctaccgctaccgccaccgccgccactactaccgctactactacccccgccgccgccgccgcccaaaccccccgaaaaaacgctaacgccgccgtaaaaataaacattaaaacaaccctcgactaccttcgcgccaccacctcccgctcccgaaaaaacccgctaatcgactactccgacccgcaacacgaactcgcaacgaccgtcgctatcgtcgtcgaaactctactcgccgccgctactctcgaccaccgaaccccgactcgcgctttcgccgtacttaaaacaaaaaacgaccccgaccgacaaactacttatactataatcgcccccaacgccgactaaacctactaacaacccgaaataccccaccccgccgccgccgccgccgccacttcccgcgctaccgccgccgcctcctccaaacgacgacaacaacaaccctaccccctcgaaatcaaccgactcgaaacaacccaaaaacgacgaaaaaaaaaacgccgaacgttcccgaaacgacgacgccaaaaacaaatccatacccgaaaacgtaaaacgaaaaaccgcttccaaacgcttaaaaataaaaacgctcaaactcttatacaaaaaaaaatcgtcctcgccgacgaccgctacaccgaaatacatcccgcgctccttaatcccgcgccgatacgcaacccgaaccgccgcgcccgctaccgccgccgccgctttaaccccgaaatcaaacgaccccacaaacgcgcgcgaactaaactccgaaactaatacgcgcgtcgatcctaatactaccgaaaaccctctccccttctttctttttctttttcgccttcccccgcgctcgccgcctcctcttcttcttcttcttcgtctccaaccgataatactaactactaaaactcaccataaaccgcgaccccgcataataaaaaaataaacgcgaaaaaaataaaaccgccgccgccgccgatataaacccaaccccgcgcctcctctccgcaccgtttatcttacttaaattcaccttcaaaaaatttccgaacccatcaaacaaccgccgccacaaacgaaaaaatcttttacatcattatc

SEQ ID NO: 28457 - DNA, 1187 bp, Artificial Sequence
  chemically treated genomic DNA (Homo sapiens) CpG-island No: 28457
attcgaggtgggtaggtttcgcgcggggcgtgacgttacgcgggcggtttcgttagtcgtgaggttatttggtgggcgcggttaggtcgaatttttagtgtcgttacgggagggggcgggtttagagcgtgttagtgtagtcgaattaaaataagtcggagattcgtttttttttttcggttcgggagcgtttcgtttgcgtttcgggttcgcggcgttcgcgcggttgcgagtttcgggtggtcgcgtgtcggttttaggaagtcggagagggcgcggcggttaggatggcgcggtacgggtcgtgcggttagacgggagtcgagggaatcgtcggttcgcgtttttcgttttttttcggagtcggttttacgtagggtcgggaacggtcgtgtttttgggattcgttttcgttgacgtcgggtatttatttggacgcgagcgagcgagatgtttaattttaaaaatagtaaaggcggtcgtaaaaataagcgcgttaatagtagcggcgacgagtaggaaaatggagtcggggttttggtagcggcgggcgcggcgggagcggcggtcgggggggttttggcggcggcggtcggttgcggggcggcggcggcgggcgcgtcgggcgtcggaggcgcggcgggcgtcggaggcgcggggattggcgtcgcgaacgttgcggtcgtcgcgggggttgcggtcgcgggcgatgttaaaaacggtaagacggggttggcggggcgagcgttaatttttttttcgacggggacggcgcggtggcggggttttgggtggcgcgggcggtgcgtggataatgcgagagttaggaagtgtttatttcgttttttcgtttcgtcgcggttgttttttcgcggtttttacgtttggcggcggggatagatttgcggtttttgttcggtgttcgcgcggggggtagttcgcgttttatattttgaggggttttcggttgcggtagcgttgttttcgggtttagtttgttgttcgcgttggtattgtttcgtcgtgtgtgtcgggtcgaagggaggaaggaagggaggaaagagtcgtttaagttgagaagaatgattcgattgaaaatttaggtatcggttaatttttttcggtgttttaaggttattcgtaattttcggaatgaaggagagagagttttaatttttagtatattt

SEQ ID NO: 28458 - DNA, 1187 bp, Artificial Sequence
  chemically treated genomic DNA (Homo sapiens) CpG-island No: 28458
aaatatactaaaaattaaaactctctctccttcattccgaaaattacgaataaccttaaaacaccgaaaaaaattaaccgatacctaaattttcaatcgaatcattcttctcaacttaaacgactctttcctcccttccttcctcccttcgacccgacacacacgacgaaacaataccaacgcgaacaacaaactaaacccgaaaacaacgctaccgcaaccgaaaacccctcaaaatataaaacgcgaactaccccccgcgcgaacaccgaacaaaaaccgcaaatctatccccgccgccaaacgtaaaaaccgcgaaaaaacaaccgcgacgaaacgaaaaaacgaaataaacacttcctaactctcgcattatccacgcaccgcccgcgccacccaaaaccccgccaccgcgccgtccccgtcgaaaaaaaaattaacgctcgccccgccaaccccgtcttaccgtttttaacatcgcccgcgaccgcaacccccgcgacgaccgcaacgttcgcgacgccaatccccgcgcctccgacgcccgccgcgcctccgacgcccgacgcgcccgccgccgccgccccgcaaccgaccgccgccgccaaaacccccccgaccgccgctcccgccgcgcccgccgctaccaaaaccccgactccattttcctactcgtcgccgctactattaacgcgcttatttttacgaccgcctttactatttttaaaattaaacatctcgctcgctcgcgtccaaataaatacccgacgtcaacgaaaacgaatcccaaaaacacgaccgttcccgaccctacgtaaaaccgactccgaaaaaaaacgaaaaacgcgaaccgacgattccctcgactcccgtctaaccgcacgacccgtaccgcgccatcctaaccgccgcgccctctccgacttcctaaaaccgacacgcgaccacccgaaactcgcaaccgcgcgaacgccgcgaacccgaaacgcaaacgaaacgctcccgaaccgaaaaaaaaaaacgaatctccgacttattttaattcgactacactaacacgctctaaacccgccccctcccgtaacgacactaaaaattcgacctaaccgcgcccaccaaataacctcacgactaacgaaaccgcccgcgtaacgtcacgccccgcgcgaaacctacccacctcgaat

SEQ ID NO: 28459 - DNA, 1187 bp, Artificial Sequence
  chemically treated genomic DNA (Homo sapiens) CpG-island No: 28459
gggtgtgttaagaattgaggtttttttttttttatttcgggggttacgggtggttttggagtatcgggaagaattaatcggtgtttaagtttttaatcggattattttttttaatttgggcggttttttttttttttttttttttttttcggttcggtatatacggcggggtagtgttagcgcgggtagtaggttgggttcgagggtagcgttgtcgtagtcgggagttttttagagtgtggggcgcgggttgtttttcgcgcggatatcgggtaggggtcgtagatttgttttcgtcgttaggcgtggggatcgcgaaggggtagtcgcggcggggcggaggggcggggtgagtattttttgattttcgtattgtttacgtatcgttcgcgttatttagggtttcgttatcgcgtcgttttcgtcggggaggaagttggcgttcgtttcgttagtttcgttttatcgtttttggtatcgttcgcggtcgtagttttcgcggcggtcgtagcgttcgcggcgttagttttcgcgttttcggcgttcgtcgcgttttcggcgttcggcgcgttcgtcgtcgtcgtttcgtaatcggtcgtcgtcgttagggttttttcggtcgtcgttttcgtcgcgttcgtcgttgttagggtttcggttttatttttttgttcgtcgtcgttgttgttggcgcgtttgtttttgcggtcgtttttgttgtttttggggttgggtatttcgttcgttcgcgtttaggtaggtgttcggcgttagcgaaggcggattttagaggtacggtcgttttcggttttgcgtgaagtcggtttcgggaaagaacggagggcgcgagtcggcggttttttcggttttcgtttagtcgtacggttcgtgtcgcgttattttggtcgtcgcgtttttttcggttttttggagtcggtacgcggttattcgaggttcgtagtcgcgcgggcgtcgcgggttcggggcgtaagcgagacgttttcgagtcggagggaaaaggcgggttttcggtttgttttgattcggttgtattgatacgttttgggttcgttttttttcgtgacgatattggggattcggtttggtcgcgtttattaggtgattttacggttgacgggatcgttcgcgtgacgttacgtttcgcgcggggtttgtttatttcgagt

SEQ ID NO: 28460 - DNA, 1187 bp, Artificial Sequence
  chemically treated genomic DNA (Homo sapiens) CpG-island No: 28460
actcgaaataaacaaaccccgcgcgaaacgtaacgtcacgcgaacgatcccgtcaaccgtaaaatcacctaataaacgcgaccaaaccgaatccccaatatcgtcacgaaaaaaaacgaacccaaaacgtatcaatacaaccgaatcaaaacaaaccgaaaacccgccttttccctccgactcgaaaacgtctcgcttacgccccgaacccgcgacgcccgcgcgactacgaacctcgaataaccgcgtaccgactccaaaaaaccgaaaaaaacgcgacgaccaaaataacgcgacacgaaccgtacgactaaacgaaaaccgaaaaaaccgccgactcgcgccctccgttctttcccgaaaccgacttcacgcaaaaccgaaaacgaccgtacctctaaaatccgccttcgctaacgccgaacacctacctaaacgcgaacgaacgaaatacccaaccccaaaaacaacaaaaacgaccgcaaaaacaaacgcgccaacaacaacgacgacgaacaaaaaaataaaaccgaaaccctaacaacgacgaacgcgacgaaaacgacgaccgaaaaaaccctaacgacgacgaccgattacgaaacgacgacgacgaacgcgccgaacgccgaaaacgcgacgaacgccgaaaacgcgaaaactaacgccgcgaacgctacgaccgccgcgaaaactacgaccgcgaacgataccaaaaacgataaaacgaaactaacgaaacgaacgccaacttcctccccgacgaaaacgacgcgataacgaaaccctaaataacgcgaacgatacgtaaacaatacgaaaatcaaaaaatactcaccccgcccctccgccccgccgcgactaccccttcgcgatccccacgcctaacgacgaaaacaaatctacgacccctacccgatatccgcgcgaaaaacaacccgcgccccacactctaaaaaactcccgactacgacaacgctaccctcgaacccaacctactacccgcgctaacactaccccgccgtatataccgaaccgaaaaaaaaaaaaaaaaaaaaaaaaaaccgcccaaattaaaaaaaataatccgattaaaaacttaaacaccgattaattcttcccgatactccaaaaccacccgtaacccccgaaataaaaaaaaaaaaacctcaattcttaacacaccc

SEQ ID NO: 28461 - DNA, 603 bp, Artificial Sequence
  chemically treated genomic DNA (Homo sapiens) CpG-island No: 28461
agaaggtcgagggggtaggtagaaggcgtatacgggcgttacgtttttttcgtttcgtatttttgttttaggtaggtgacggggaaaggaaagggattttgattttatcgtaaataggcggcgtcgtcgcgtggggggaatcgagcgcgcgttttcgttttttggggcggggacggatttagggttcgggttaggtcggggtcgttattttcggatttagcggtttagatgtttagtcggttagtttgttagttttttcgagttttcggttttacgcgtttttagtattatttgtttttcgtatcgcggcggatgatggcggaggaggaggattttgaaagtcggtagtttttttgtttcgatttgatttgttcgaggtttcggtcggtttgttttcgtttcgttcgcgcggtttttcgggtagagtagttcggttttttatttgggagcgcgatggggcgcgtatcgcgaattattcgttttatggcgtatcgcgcgtagagcgttttttatcgttttttttttcgtttttttttggtggtttttggttttttttcgtagagatcgtagggaggtgtttagtcgggagcgtttagagattat

SEQ ID NO: 28462 - DNA, 603 bp, Artificial Sequence
  chemically treated genomic DNA (Homo sapiens) CpG-island No: 28462
ataatctctaaacgctcccgactaaacacctccctacgatctctacgaaaaaaaaccaaaaaccaccaaaaaaaaacgaaaaaaaaaacgataaaaaacgctctacgcgcgatacgccataaaacgaataattcgcgatacgcgccccatcgcgctcccaaataaaaaaccgaactactctacccgaaaaaccgcgcgaacgaaacgaaaacaaaccgaccgaaacctcgaacaaatcaaatcgaaacaaaaaaactaccgactttcaaaatcctcctcctccgccatcatccgccgcgatacgaaaaacaaataatactaaaaacgcgtaaaaccgaaaactcgaaaaaactaacaaactaaccgactaaacatctaaaccgctaaatccgaaaataacgaccccgacctaacccgaaccctaaatccgtccccgccccaaaaaacgaaaacgcgcgctcgattccccccacgcgacgacgccgcctatttacgataaaatcaaaatccctttcctttccccgtcacctacctaaaacaaaaatacgaaacgaaaaaaacgtaacgcccgtatacgccttctacctaccccctcgaccttct

SEQ ID NO: 28463 - DNA, 603 bp, Artificial Sequence
  chemically treated genomic DNA (Homo sapiens) CpG-island No: 28463
gtagtttttgggcgttttcggttgaatatttttttgcggtttttgcgagaaagagttagaagttattaggggagggcgaagaggagggcggtggaggacgttttgcgcgcggtgcgttatgggacgggtagttcgcggtgcgcgttttatcgcgtttttagatggggaatcggattattttattcgagaggtcgcgcgagcggggcgagggtaagtcggtcggggtttcgaataaattaaatcgaagtaaagaaattgtcggtttttaaaatttttttttttcgttattattcgtcgcggtgcggagagtaggtggtgttggaagcgcgtgaggtcgggagttcgagagagttaatagattagtcggttggatatttggatcgttggattcggaggtggcgatttcggtttgattcggattttaaattcgttttcgttttagagggcggaggcgcgcgttcgattttttttacgcggcggcgtcgtttgtttacggtagagttagggtttttttttttttttcgttatttgtttggaataggggtgcggggcgaggagggcgtggcgttcgtgtgcgttttttgtttgttttttcggtttttt

SEQ ID NO: 28464 - DNA, 603 bp, Artificial Sequence
  chemically treated genomic DNA (Homo sapiens) CpG-island No: 28464
aaaaaaccgaaaaaacaaacaaaaaacgcacacgaacgccacgccctcctcgccccgcacccctattccaaacaaataacgaaaaaaaaaaaaaaaccctaactctaccgtaaacaaacgacgccgccgcgtaaaaaaaatcgaacgcgcgcctccgccctctaaaacgaaaacgaatttaaaatccgaatcaaaccgaaatcgccacctccgaatccaacgatccaaatatccaaccgactaatctattaactctctcgaactcccgacctcacgcgcttccaacaccacctactctccgcaccgcgacgaataataacgaaaaaaaaaaattttaaaaaccgacaatttctttacttcgatttaatttattcgaaaccccgaccgacttaccctcgccccgctcgcgcgacctctcgaataaaataatccgattccccatctaaaaacgcgataaaacgcgcaccgcgaactacccgtcccataacgcaccgcgcgcaaaacgtcctccaccgccctcctcttcgccctcccctaataacttctaactctttctcgcaaaaaccgcaaaaaaatattcaaccgaaaacgcccaaaaactac

SEQ ID NO: 28465 - DNA, 1347 bp, Artificial Sequence
  chemically treated genomic DNA (Homo sapiens) CpG-island No: 28465
gattttcgttttcgggttcgcgcgggattcgggtaggcgtcgttttttcggcgtttgtttcgcgaattttggggtatttgtaatttttgggtcgcggagttaggcgtgcgtcgttttttggttttattaacgtgagaacgttttattttcgaagagtttagtttttagggggttatgtttttttgcgtttttcgttcgttaggcggtgtcgtttattcgatcgtattatgcgtgggtagcggtcgcgttcgttggtagttgtgcggcgggaatacgttttaagtaaggtcggatttcgcgcgttttttgttagggacgttacgttacgtttttattcgtagtttcggagtattttcgcgtttcgcgttcgaagttcgggattttcgttttggcgaaacgaggaatatgatatatagtaaaatattttttcgcggtcgttgtattgtcgcgatatattcggcgtttgtttttatagtaagtcggcgaggggttgggatttcgtcgggacgtgttgacgttaggttcgacggggggcggggtttgggcggcggcggcgttagtttttcgggtattttaggcgttttagtttttttagtttttttattttgttttataggtttcgcggttttcggttttttcggttttcgtttttcggttttttcggttttcgtttttcgttattcgtcgttcggattttcgtcgttttttttaggtcgtttcgtcgttatgggtttgcgttcgtcgcgtcgtcgggtcgagggtagttgaggcgcggtgcgaagatgggcgaggatagagtagggttcgagcgttagttttagtagttcgggcgtttcgcgcgcgttcgttcgcgtcggcgaggggatgttcgcgttcgagagcgcgttttttcgtttgtatgggtttagtaatatttatcgagcgcggggcgaggtttacgttttttttttttttttcgcgtttacggcgggcgagttggcgttggataaggtttcgggttttcgtcgtatttttcggattttagttagatttattttttttcgagcgagttcgtgggaagttaggaggacggttttcgtttttaagtcgtgttcgatgttttggacggggatggggacggtttcgtcgtatcgaggattttatttagtttgttacggtttacggggtagagtaggtacggagcggttcggtcggcgtgggaattgggtaggtgcgcgttggtcggcggggttgatgtgggatcggtcgacgttgtttttggagtcgggaaaggtattgttaagatttgacggttttgttttttttgtttatttattatttcggttttggatttttggttgaattgcg

SEQ ID NO: 28466 - DNA, 1347 bp, Artificial Sequence
  chemically treated genomic DNA (Homo sapiens) CpG-island No: 28466
cgcaattcaaccaaaaatccaaaaccgaaataataaataaacaaaaaaaacaaaaccgtcaaatcttaacaatacctttcccgactccaaaaacaacgtcgaccgatcccacatcaaccccgccgaccaacgcgcacctacccaattcccacgccgaccgaaccgctccgtacctactctaccccgtaaaccgtaacaaactaaataaaatcctcgatacgacgaaaccgtccccatccccgtccaaaacatcgaacacgacttaaaaacgaaaaccgtcctcctaacttcccacgaactcgctcgaaaaaaaataaatctaactaaaatccgaaaaatacgacgaaaacccgaaaccttatccaacgccaactcgcccgccgtaaacgcgaaaaaaaaaaaaaaaacgtaaacctcgccccgcgctcgataaatattactaaacccatacaaacgaaaaaacgcgctctcgaacgcgaacatcccctcgccgacgcgaacgaacgcgcgcgaaacgcccgaactactaaaactaacgctcgaaccctactctatcctcgcccatcttcgcaccgcgcctcaactaccctcgacccgacgacgcgacgaacgcaaacccataacgacgaaacgacctaaaaaaaacgacgaaaatccgaacgacgaataacgaaaaacgaaaaccgaaaaaaccgaaaaacgaaaaccgaaaaaaccgaaaaccgcgaaacctataaaacaaaataaaaaaactaaaaaaactaaaacgcctaaaatacccgaaaaactaacgccgccgccgcccaaaccccgccccccgtcgaacctaacgtcaacacgtcccgacgaaatcccaacccctcgccgacttactataaaaacaaacgccgaatatatcgcgacaatacaacgaccgcgaaaaaatattttactatatatcatattcctcgtttcgccaaaacgaaaatcccgaacttcgaacgcgaaacgcgaaaatactccgaaactacgaataaaaacgtaacgtaacgtccctaacaaaaaacgcgcgaaatccgaccttacttaaaacgtattcccgccgcacaactaccaacgaacgcgaccgctacccacgcataatacgatcgaataaacgacaccgcctaacgaacgaaaaacgcaaaaaaacataaccccctaaaaactaaactcttcgaaaataaaacgttctcacgttaataaaaccaaaaaacgacgcacgcctaactccgcgacccaaaaattacaaataccccaaaattcgcgaaacaaacgccgaaaaaacgacgcctacccgaatcccgcgcgaacccgaaaacgaaaatc

SEQ ID NO: 28467 - DNA, 1347 bp, Artificial Sequence
  chemically treated genomic DNA (Homo sapiens) CpG-island No: 28467
cgtaatttaattagaaatttagggtcgaagtggtgaataagtagaaaaagtaggatcgttaggttttgatagtgtttttttcgattttaggggtagcgtcgatcggttttatattaatttcgtcggttagcgcgtatttgtttagtttttacgtcggtcgggtcgtttcgtatttgttttgtttcgtagatcgtagtaaattggatgaagttttcgatgcgacgaaatcgtttttattttcgtttagggtatcgaatacggtttggaggcgggggtcgtttttttgattttttacgggttcgttcggaagggggtgggtttggttgaggttcgagggatgcggcggggattcgggattttgtttagcgttagttcgttcgtcgtgggcgcggggaagggagagaagacgtagatttcgtttcgcgttcggtgggtgttgttggatttatgtaagcggaaaggcgcgttttcgggcgcgggtattttttcgtcggcgcgggcgggcgcgcgcggggcgttcgggttgttggggttggcgttcgggttttgttttgttttcgtttattttcgtatcgcgttttagttgttttcggttcggcggcgcggcgggcgtaggtttatggcggcggggcggtttagggagggcggcgaggattcgggcggcggatggcgggggacgggggtcgaggaggtcgggggacgggggtcgaggaggtcggaggtcgcggagtttgtgaagtaggatgaggagattaaggaggttgaggcgtttgaggtattcggagaattaacgtcgtcgtcgtttaggtttcgtttttcgtcgggtttgacgttagtacgtttcggcggggttttagtttttcgtcggtttgttgtagaggtaggcgtcgggtgtgtcgcggtagtgtagcggtcgcgaaggggtgttttgttgtatgttatatttttcgtttcgttagagcgggggtttcgagtttcgggcgcgggacgcgggggtgtttcgaggttgcgagtggaagcgtgacgtgacgtttttggtaagaagcgcgcggagttcggttttatttagaacgtgttttcgtcgtatagttattagcgggcgcgatcgttatttacgtatggtgcggtcgagtaaacggtatcgtttggcgagcgagagacgtaaagggatatagttttttaggagttgagtttttcgggggtaaagcgtttttacgttgatgagattaggaggcggcgtacgtttggtttcgcggtttaggggttgtaggtgttttagggttcgcggggtagacgtcgagagggcgacgtttgttcgggtttcgcgcggattcgggggcgagggtt

SEQ ID NO: 28468 - DNA, 1347 bp, Artificial Sequence
  chemically treated genomic DNA (Homo sapiens) CpG-island No: 28468
aaccctcgcccccgaatccgcgcgaaacccgaacaaacgtcgccctctcgacgtctaccccgcgaaccctaaaacacctacaacccctaaaccgcgaaaccaaacgtacgccgcctcctaatctcatcaacgtaaaaacgctttacccccgaaaaactcaactcctaaaaaactatatccctttacgtctctcgctcgccaaacgataccgtttactcgaccgcaccatacgtaaataacgatcgcgcccgctaataactatacgacgaaaacacgttctaaataaaaccgaactccgcgcgcttcttaccaaaaacgtcacgtcacgcttccactcgcaacctcgaaacacccccgcgtcccgcgcccgaaactcgaaacccccgctctaacgaaacgaaaaatataacatacaacaaaacaccccttcgcgaccgctacactaccgcgacacacccgacgcctacctctacaacaaaccgacgaaaaactaaaaccccgccgaaacgtactaacgtcaaacccgacgaaaaacgaaacctaaacgacgacgacgttaattctccgaatacctcaaacgcctcaacctccttaatctcctcatcctacttcacaaactccgcgacctccgacctcctcgacccccgtcccccgacctcctcgacccccgtcccccgccatccgccgcccgaatcctcgccgccctccctaaaccgccccgccgccataaacctacgcccgccgcgccgccgaaccgaaaacaactaaaacgcgatacgaaaataaacgaaaacaaaacaaaacccgaacgccaaccccaacaacccgaacgccccgcgcgcgcccgcccgcgccgacgaaaaaatacccgcgcccgaaaacgcgcctttccgcttacataaatccaacaacacccaccgaacgcgaaacgaaatctacgtcttctctcccttccccgcgcccacgacgaacgaactaacgctaaacaaaatcccgaatccccgccgcatccctcgaacctcaaccaaacccacccccttccgaacgaacccgtaaaaaatcaaaaaaacgacccccgcctccaaaccgtattcgataccctaaacgaaaataaaaacgatttcgtcgcatcgaaaacttcatccaatttactacgatctacgaaacaaaacaaatacgaaacgacccgaccgacgtaaaaactaaacaaatacgcgctaaccgacgaaattaatataaaaccgatcgacgctacccctaaaatcgaaaaaaacactatcaaaacctaacgatcctactttttctacttattcaccacttcgaccctaaatttctaattaaattacg

SEQ ID NO: 28469 - DNA, 624 bp, Artificial Sequence
  chemically treated genomic DNA (Homo sapiens) CpG-island No: 28469
gttttcgtcggtgaaggtttcggtcggtgagggttttttgtcggtgagggttttcggtcggtgagggtttttcgttagtgagggtttcggttagtgagggtttcggtcggtgagggtttcggtcggtgagggtttttgtcggtgagggtttttgtcggtgagggtttcggtcggtgagggtttcggtcggtgagggtttttgtcggtgagggttttttttcggtgagggtttcggtcggtgagggtttcggtcggtgagggtgtttcgtcggtgagggtttcggtcggtgagggtttcggtcggtgagggtttcggtcggtgaggggttcggtcggtgatggtttcggtcggtgaggttttcggtcggtgagggtttcggtcggtgagggttttcggtcggtgagggtttttgttggtgagggtttcggtcggtgagggcgtttcgtcggtgagggtttcggtcggtgagggtttcggtcggtgagggtttttagtcggtgagggtttcggttagtgagggttttcggtcggtgagggttttttgtttttcgagggtttcggtcggtgacggtcgttttgttatataggttttttatgggtgtattttgtggcgggggtaatat

SEQ ID NO: 28470 - DNA, 624 bp, Artificial Sequence
  chemically treated genomic DNA (Homo sapiens) CpG-island No: 28470
atattacccccgccacaaaatacacccataaaaaacctatataacaaaacgaccgtcaccgaccgaaaccctcgaaaaacaaaaaaccctcaccgaccgaaaaccctcactaaccgaaaccctcaccgactaaaaaccctcaccgaccgaaaccctcaccgaccgaaaccctcaccgacgaaacgccctcaccgaccgaaaccctcaccaacaaaaaccctcaccgaccgaaaaccctcaccgaccgaaaccctcaccgaccgaaaacctcaccgaccgaaaccatcaccgaccgaacccctcaccgaccgaaaccctcaccgaccgaaaccctcaccgaccgaaaccctcaccgacgaaacaccctcaccgaccgaaaccctcaccgaccgaaaccctcaccgaaaaaaaaccctcaccgacaaaaaccctcaccgaccgaaaccctcaccgaccgaaaccctcaccgacaaaaaccctcaccgacaaaaaccctcaccgaccgaaaccctcaccgaccgaaaccctcactaaccgaaaccctcactaacgaaaaaccctcaccgaccgaaaaccctcaccgacaaaaaaccctcaccgaccgaaaccttcaccgacgaaaac

SEQ ID NO: 28471 - DNA, 624 bp, Artificial Sequence
  chemically treated genomic DNA (Homo sapiens) CpG-island No: 28471
atgttgttttcgttataggatgtatttatgaggaatttgtgtggtagaacggtcgttatcgatcgggattttcgggggataggggatttttatcgatcggggatttttattgatcgggatttttatcgattggggatttttatcgatcggggtttttatcgatcgggatttttatcgacggggcgtttttatcgatcggggtttttattaataggggtttttatcgatcggggatttttatcgatcggggtttttatcgatcggggattttatcgatcggggttattatcgatcgggttttttatcgatcggggtttttatcgatcgggatttttatcgatcgggatttttatcgacggggtatttttatcgatcggggtttttatcgatcgggatttttatcgaaaggggatttttatcgatagggatttttatcgatcggggtttttatcgatcggggtttttatcgatagggatttttatcgataggggtttttatcgatcgggatttttatcgatcggggtttttattgatcgggatttttattgacggggggtttttatcgatcggggatttttatcggtaggggatttttatcgatcgggatttttatcgacggggat

SEQ ID NO: 28472 - DNA, 624 bp, Artificial Sequence
  chemically treated genomic DNA (Homo sapiens) CpG-island No: 28472
atccccgtcgataaaaatcccgatcgataaaaatcccctaccgataaaaatccccgatcgataaaaaccccccgtcaataaaaatcccgatcaataaaaaccccgatcgataaaaatcccgatcgataaaaacccctatcgataaaaatccctatcgataaaaaccccgatcgataaaaaccccgatcgataaaaatccctatcgataaaaatcccctttcgataaaaatcccgatcgataaaaaccccgatcgataaaaataccccgtcgataaaaatcccgatcgataaaaatcccgatcgataaaaaccccgatcgataaaaaacccgatcgataataaccccgatcgataaaatccccgatcgataaaaaccccgatcgataaaaatccccgatcgataaaaacccctattaataaaaaccccgatcgataaaaacgccccgtcgataaaaatcccgatcgataaaaaccccgatcgataaaaatccccaatcgataaaaatcccgatcaataaaaatccccgatcgataaaaatcccctatcccccgaaaatcccgatcgataacgaccgttctaccacacaaattcctcataaatacatcctataacgaaaacaacat

SEQ ID NO: 28473 - DNA, 875 bp, Artificial Sequence
  chemically treated genomic DNA (Homo sapiens) CpG-island No: 28473
ggtaggattatttttacgacggtaggattttttcgttattttagaaagaattacgtgtttatttaattttcgattttacgtcggggttcgcggacgtagtcgtttcgttcgtttacgtatttgcggtagtcgggttcggtagggacgagggttcggcggcgttttcgggaagagcgcggttcgggttttgggttttcgtttaggaggcgtcgttgtcgtagtgagtacgtcgggtcgggttttgagttcgcgtcggtcgcgtttttcgcgtttcgagttgtggcggtcgcgttttcgggcggaaggtttacgttcggtgacgtcgcgttgttttagaattttagcgattttgtagatttattggtgatttaacggtgcgtttcgtcgtcgtcgggcggaagtttcgtttttgtttcggagaggaagtttcgttttatcgagcgtcgattggtcgtatcgttttagagaggacgcgttcggggttatttcgtcgtttttttcgagggttttgcggaagtaggcggtatagtttgcgaggggttttcgtttttcggatttagtcgtatcgtttcggttcgggcgcgtttgtattttgtcgttcgttcgcgcgttgaaggggcggatataaataacgtggattttcgagtttttgattggcgagcgtgtaggaaaggggcggggttagtagagtcgtgatggatatgtaagcgatttaatggcgtcggcgacggggcgggcgaggataacggcgttgtgggtcgggggcggggcggtcggcggttttgggatttttttgggaggtagtcgtagggaagggaatgattttttttttatagtgagtcgtattagcggtcgtaaatttattagagtaatat

SEQ ID NO: 28474 - DNA, 875 bp, Artificial Sequence
  chemically treated genomic DNA (Homo sapiens) CpG-island No: 28474
atattactctaataaatttacgaccgctaatacgactcactataaaaaaaaaatcattcccttccctacgactacctcccaaaaaaatcccaaaaccgccgaccgccccgcccccgacccacaacgccgttatcctcgcccgccccgtcgccgacgccattaaatcgcttacatatccatcacgactctactaaccccgcccctttcctacacgctcgccaatcaaaaactcgaaaatccacgttatttatatccgccccttcaacgcgcgaacgaacgacaaaatacaaacgcgcccgaaccgaaacgatacgactaaatccgaaaaacgaaaacccctcgcaaactataccgcctacttccgcaaaaccctcgaaaaaaacgacgaaataaccccgaacgcgtcctctctaaaacgatacgaccaatcgacgctcgataaaacgaaacttcctctccgaaacaaaaacgaaacttccgcccgacgacgacgaaacgcaccgttaaatcaccaataaatctacaaaatcgctaaaattctaaaacaacgcgacgtcaccgaacgtaaaccttccgcccgaaaacgcgaccgccacaactcgaaacgcgaaaaacgcgaccgacgcgaactcaaaacccgacccgacgtactcactacgacaacgacgcctcctaaacgaaaacccaaaacccgaaccgcgctcttcccgaaaacgccgccgaaccctcgtccctaccgaacccgactaccgcaaatacgtaaacgaacgaaacgactacgtccgcgaaccccgacgtaaaatcgaaaattaaataaacacgtaattctttctaaaataacgaaaaaatcctaccgtcgtaaaaataatcctacc

SEQ ID NO: 28475 - DNA, 875 bp, Artificial Sequence
  chemically treated genomic DNA (Homo sapiens) CpG-island No: 28475
atattgttttaataaatttgcggtcgttaatacgatttattatagggagaggattatttttttttttgcggttgttttttagagaaattttagagtcgtcggtcgtttcgttttcggtttataacgtcgttgttttcgttcgtttcgtcgtcggcgttattgggtcgtttgtatgtttattacggttttgttaatttcgttttttttttatacgttcgttaattaggggttcggaagtttacgttgtttgtattcgtttttttaacgcgcggacgggcggtaggatgtaggcgcgttcgagtcgaggcgatgcggttgagttcgggaaacgaaagtttttcgtaggttgtgtcgtttgttttcgtagaattttcggagggagcggcggggtggtttcgggcgcgttttttttaaggcggtgcggttaatcggcgttcgatgaggcggaatttttttttcggggtaggggcgggattttcgttcggcggcggcggggcgtatcgttgggttattagtgagtttgtaaagtcgttgaggttttgggatagcgcggcgttatcgagcgtgagtttttcgttcggggacgcggtcgttatagttcgggacgcggggagcgcggtcggcgcgagtttaagattcggttcgacgtgtttattgcggtagcggcgttttttggacggggatttagggttcggatcgcgtttttttcgggggcgtcgtcgagttttcgtttttgtcgggttcggttgtcgtaggtgcgtgggcgagcgaggcggttgcgttcgcgggtttcggcgtggggtcgggggttgagtgggtacgtggttttttttggggtgacgagaaggttttatcgtcgtggggatggttttgtt

SEQ ID NO: 28476 - DNA, 875 bp, Artificial Sequence
  chemically treated genomic DNA (Homo sapiens) CpG-island No: 28476
aacaaaaccatccccacgacgataaaaccttctcgtcaccccaaaaaaaaccacgtacccactcaacccccgaccccacgccgaaacccgcgaacgcaaccgcctcgctcgcccacgcacctacgacaaccgaacccgacaaaaacgaaaactcgacgacgcccccgaaaaaaacgcgatccgaaccctaaatccccgtccaaaaaacgccgctaccgcaataaacacgtcgaaccgaatcttaaactcgcgccgaccgcgctccccgcgtcccgaactataacgaccgcgtccccgaacgaaaaactcacgctcgataacgccgcgctatcccaaaacctcaacgactttacaaactcactaataacccaacgatacgccccgccgccgccgaacgaaaatcccgcccctaccccgaaaaaaaaattccgcctcatcgaacgccgattaaccgcaccgccttaaaaaaaacgcgcccgaaaccaccccgccgctccctccgaaaattctacgaaaacaaacgacacaacctacgaaaaactttcgtttcccgaactcaaccgcatcgcctcgactcgaacgcgcctacatcctaccgcccgtccgcgcgttaaaaaaacgaatacaaacaacgtaaacttccgaacccctaattaacgaacgtataaaaaaaaaacgaaattaacaaaaccgtaataaacatacaaacgacccaataacgccgacgacgaaacgaacgaaaacaacgacgttataaaccgaaaacgaaacgaccgacgactctaaaatttctctaaaaaacaaccgcaaaaaaaaaaataatcctctccctataataaatcgtattaacgaccgcaaatttattaaaacaatat

SEQ ID NO: 28477 - DNA, 540 bp, Artificial Sequence
  chemically treated genomic DNA (Homo sapiens) CpG-island No: 28477
acgcggttgttttgggcgtggtttcgggaaacgtagcggcgtcgattttgggtttcgtatattttttacgttcgttcgtagcgttattcggattttcgtcgttatttttgtgggtttttcggcgacgttttttgtttcgtttttaagtcgggaaggttttttgcggttcgcggcgtgtcggacgtgataaacggaagtcgtacgttttattagtattttcgtagacggatagcgttagggagtaatggtagcgcgtcgatcgcgatgggttgtggttaatagcggttgtttagtagggcgcgtcgagagtagcggtcgggaaggggcggtgcgggaggcggggtgtggggcggtagtgtgggttttgtttttgttcgcgcggtgtttcgtattttgtaagttttcggagcgtacgtcggtagtcggttttttcgttgatcgaattatcgatttttttttttagttgtatttttaaaatgtcgttttttaataagttgacgttggataagttggacgttaaagggaagcgggtcgttatga

SEQ ID NO: 28478 - DNA, 540 bp, Artificial Sequence
  chemically treated genomic DNA (Homo sapiens) CpG-island No: 28478
tcataacgacccgcttccctttaacgtccaacttatccaacgtcaacttattaaaaaacgacattttaaaaatacaactaaaaaaaaaaatcgataattcgatcaacgaaaaaaccgactaccgacgtacgctccgaaaacttacaaaatacgaaacaccgcgcgaacaaaaacaaaacccacactaccgccccacaccccgcctcccgcaccgccccttcccgaccgctactctcgacgcgccctactaaacaaccgctattaaccacaacccatcgcgatcgacgcgctaccattactccctaacgctatccgtctacgaaaatactaataaaacgtacgacttccgtttatcacgtccgacacgccgcgaaccgcaaaaaaccttcccgacttaaaaacgaaacaaaaaacgtcgccgaaaaacccacaaaaataacgacgaaaatccgaataacgctacgaacgaacgtaaaaaatatacgaaacccaaaatcgacgccgctacgtttcccgaaaccacgcccaaaacaaccgcgt

SEQ ID NO: 28479 - DNA, 540 bp, Artificial Sequence
  chemically treated genomic DNA (Homo sapiens) CpG-island No: 28479
ttataacgattcgtttttttttaacgtttagtttgtttagcgttagtttgttagaaagcgatattttggaaatatagttggggagagaggtcggtgattcggttaacgagggagtcgattgtcgacgtgcgtttcggaggtttgtagaatgcggaatatcgcgcgggtaggaatagggtttatattatcgttttatatttcgtttttcgtatcgttttttttcggtcgttgttttcggcgcgttttgttgagtagtcgttattggttatagtttatcgcggtcggcgcgttgttattgttttttggcgttgttcgtttgcgagggtattagtgagacgtgcggttttcgtttgttacgttcggtacgtcgcgaatcgtaaggaattttttcgatttaggggcggagtaggaagcgtcgtcggggggtttataagggtagcggcgaagattcgggtgacgttgcgaacggacgtgaagaatgtgcgagatttagggtcggcgtcgttgcgtttttcggaattacgtttagagtagtcgcgt

SEQ ID NO: 28480 - DNA, 540 bp, Artificial Sequence
  chemically treated genomic DNA (Homo sapiens) CpG-island No: 28480
acgcgactactctaaacgtaattccgaaaaacgcaacgacgccgaccctaaatctcgcacattcttcacgtccgttcgcaacgtcacccgaatcttcgccgctacccttataaaccccccgacgacgcttcctactccgcccctaaatcgaaaaaattccttacgattcgcgacgtaccgaacgtaacaaacgaaaaccgcacgtctcactaataccctcgcaaacgaacaacgccaaaaaacaataacaacgcgccgaccgcgataaactataaccaataacgactactcaacaaaacgcgccgaaaacaacgaccgaaaaaaaacgatacgaaaaacgaaatataaaacgataatataaaccctattcctacccgcgcgatattccgcattctacaaacctccgaaacgcacgtcgacaatcgactccctcgttaaccgaatcaccgacctctctccccaactatatttccaaaatatcgctttctaacaaactaacgctaaacaaactaaacgttaaaaaaaaacgaatcgttataa

SEQ ID NO: 28481 - DNA, 686 bp, Artificial Sequence
  chemically treated genomic DNA (Homo sapiens) CpG-island No: 28481
gcgcgcggtgtgttttttattaggtttttttttttttttattttttttttcgttaggttttgttatggagttgcgttcggagttgtttagcgtgttcggcgcggcgacggcggcggcggtaatagcgacggggtcgtttgtggcgtcggtggcgtcggtggcggtagtcgcggcggtcgttgtatcgttatcggtgagcgtggtaggcggtttgttgcgggggtcgttattgttgttgcgggtagtcgagaagtattcgcggatttttaagtgcgcgcgttgtcgtaattatggcgtggtgtcggtttttaagggttataaacgttattgtcgttggaaggattgtttgtgcgttaagtgtacgtttatcgcggagcgttagcgtgttatggcggcgtagtggcgttgcgtaggtagtaggcgtaggaggagaacgaggcgcgcgagttgtagttgttttacggtattgtcgaggggttggcgttggtcgtcgttaacggtattattttttcgaggttcgtttacgaggttttcggtttagtgtgcgtcgtcgacggcgggggatttggagcgggagcgttcgcggggatcggaggcggagtagttggcgtagggggtttaggtgagagcgcggttaggtcgtaggtaggggtagtaggatcgtagttttggggtacggggtttag

SEQ ID NO: 28482 - DNA, 686 bp, Artificial Sequence
  chemically treated genomic DNA (Homo sapiens) CpG-island No: 28482
ctaaaccccgtaccccaaaactacgatcctactacccctacctacgacctaaccgcgctctcacctaaaccccctacgccaactactccgcctccgatccccgcgaacgctcccgctccaaatcccccgccgtcgacgacgcacactaaaccgaaaacctcgtaaacgaacctcgaaaaaataataccgttaacgacgaccaacgccaacccctcgacaataccgtaaaacaactacaactcgcgcgcctcgttctcctcctacgcctactacctacgcaacgccactacgccgccataacacgctaacgctccgcgataaacgtacacttaacgcacaaacaatccttccaacgacaataacgtttataacccttaaaaaccgacaccacgccataattacgacaacgcgcgcacttaaaaatccgcgaatacttctcgactacccgcaacaacaataacgacccccgcaacaaaccgcctaccacgctcaccgataacgatacaacgaccgccgcgactaccgccaccgacgccaccgacgccacaaacgaccccgtcgctattaccgccgccgccgtcgccgcgccgaacacgctaaacaactccgaacgcaactccataacaaaacctaacgaaaaaaaaaataaaaaaaaaaaaaaacctaataaaaaacacaccgcgcgc

SEQ ID NO: 28483 - DNA, 686 bp, Artificial Sequence
  chemically treated genomic DNA (Homo sapiens) CpG-island No: 28483
ttgggtttcgtgttttagagttacgattttgttgtttttatttgcggtttggtcgcgtttttatttgagttttttgcgttagttgtttcgttttcggttttcgcgggcgttttcgttttaggtttttcgtcgtcggcggcgtatattgaatcgaagatttcgtaggcgggtttcggggggatgatgtcgttggcggcggttagcgttagtttttcggtagtgtcgtagagtagttgtagttcgcgcgtttcgttttttttttgcgtttgttgtttgcgtagcgttattgcgtcgttatgatacgttggcgtttcgcgatgagcgtgtatttggcgtataggtagtttttttagcgatagtagcgtttgtggtttttgagggtcgatattacgttatggttgcgatagcgcgcgtatttgggggttcgcgggtatttttcggttgttcgtagtaatagtggcggttttcgtagtaagtcgtttgttacgtttatcggtagcgatgtagcggtcgtcgcggttgtcgttatcgacgttatcgacgttataggcggtttcgtcgttgttgtcgtcgtcgtcgtcgtcgcgtcgggtacgttgggtagtttcgagcgtagttttatgataggatttgacgggaaagaaggtgggagaggggagagatttggtgaggagtatatcgcgcgt

SEQ ID NO: 28484 - DNA, 686 bp, Artificial Sequence
  chemically treated genomic DNA (Homo sapiens) CpG-island No: 28484
acgcgcgatatactcctcaccaaatctctcccctctcccaccttctttcccgtcaaatcctatcataaaactacgctcgaaactacccaacgtacccgacgcgacgacgacgacgacgacaacaacgacgaaaccgcctataacgtcgataacgtcgataacgacaaccgcgacgaccgctacatcgctaccgataaacgtaacaaacgacttactacgaaaaccgccactattactacgaacaaccgaaaaatacccgcgaacccccaaatacgcgcgctatcgcaaccataacgtaatatcgaccctcaaaaaccacaaacgctactatcgctaaaaaaactacctatacgccaaatacacgctcatcgcgaaacgccaacgtatcataacgacgcaataacgctacgcaaacaacaaacgcaaaaaaaaaacgaaacgcgcgaactacaactactctacgacactaccgaaaaactaacgctaaccgccgccaacgacatcatccccccgaaacccgcctacgaaatcttcgattcaatatacgccgccgacgacgaaaaacctaaaacgaaaacgcccgcgaaaaccgaaaacgaaacaactaacgcaaaaaactcaaataaaaacgcgaccaaaccgcaaataaaaacaacaaaatcgtaactctaaaacacgaaacccaa

SEQ ID NO: 28485 - DNA, 763 bp, Artificial Sequence
  chemically treated genomic DNA (Homo sapiens) CpG-island No: 28485
gacgaggaagtcggagatggcgaggttgagtaggaagaagttgttttgggtgcggaggttcgagtcggttacgaaggcgagtatgattagcgcgttgtttagtatcgtggttacgatgagtagcgttatgagcgcggttagtatcgcggtttaggttgtcgagaagtcgcgcgtttcgttcgtcgtcgtcgtttcgttcgttagcgttttcgaagcgtttagcggttcgtcgggcggcgcgcgttttatggtttcgtaggtttacgcggtttcgggacgcggggtagggcgtcggtcgagagttgggcggtcgggaggggtttcggttcgggagtttcgtttttgcgggtttttggtcgggtcgggtttttttgggggcgtttagcgtatggttcgcggggtcggggtcggggttagagtaggcggtgtcgagggggtcggggtcggattcgagtttagtggggtcggtagcgcggttgttgtagcgggagaggagtcggagtttgagtcgttgtcggtgcgatcgtgtagtcggagcgtaacgcgtagtcgagtgcgtttcgcgtttagtttatcgtttcgcgcgtttcgcgtagcgttttcgttattggttgtcgttttcgtttcgtttttttttcgttttcgtttcgttcggcgtcggtagtattacggatagcgtcgcgtgttcgttaggttgtttggagtttagtttttgcgtttatagtagttggttgggagttcggtcggggtttgatcgggtttg

SEQ ID NO: 28486 - DNA, 763 bp, Artificial Sequence
  chemically treated genomic DNA (Homo sapiens) CpG-island No: 28486
caaacccgatcaaaccccgaccgaactcccaaccaactactataaacgcaaaaactaaactccaaacaacctaacgaacacgcgacgctatccgtaatactaccgacgccgaacgaaacgaaaacgaaaaaaaaacgaaacgaaaacgacaaccaataacgaaaacgctacgcgaaacgcgcgaaacgataaactaaacgcgaaacgcactcgactacgcgttacgctccgactacacgatcgcaccgacaacgactcaaactccgactcctctcccgctacaacaaccgcgctaccgaccccactaaactcgaatccgaccccgaccccctcgacaccgcctactctaaccccgaccccgaccccgcgaaccatacgctaaacgcccccaaaaaaacccgacccgaccaaaaacccgcaaaaacgaaactcccgaaccgaaacccctcccgaccgcccaactctcgaccgacgccctaccccgcgtcccgaaaccgcgtaaacctacgaaaccataaaacgcgcgccgcccgacgaaccgctaaacgcttcgaaaacgctaacgaacgaaacgacgacgacgaacgaaacgcgcgacttctcgacaacctaaaccgcgatactaaccgcgctcataacgctactcatcgtaaccacgatactaaacaacgcgctaatcatactcgccttcgtaaccgactcgaacctccgcacccaaaacaacttcttcctactcaacctcgccatctccgacttcctcgtc

SEQ ID NO: 28487 - DNA, 763 bp, Artificial Sequence
  chemically treated genomic DNA (Homo sapiens) CpG-island No: 28487
tagattcggttaagtttcggtcgggtttttagttagttgttgtgagcgtaggggttgggttttaggtagtttggcgggtacgcggcgttgttcgtggtgttgtcggcgtcgggcggggcgggggcggggagggggcggggcgagggcggtagttaatggcgggggcgttgcgcggggcgcgcggggcggtgggttgggcgcggggcgtattcggttgcgcgttgcgtttcggttgtacggtcgtatcggtagcggtttaggtttcggtttttttttcgttgtagtagtcgcgttgtcggttttattgggttcggattcggtttcggttttttcggtatcgtttgttttggtttcggtttcggtttcgcggattatgcgttgggcgtttttaggggaattcgattcggttaagggttcgtaaagacgaggttttcgggtcggggtttttttcggtcgtttagttttcggtcggcgttttgtttcgcgtttcggagtcgcgtgagtttgcggggttatggagcgcgcgtcgttcgacgggtcgttgaacgtttcgggggcgttggcgggcgaggcggcggcggcgggcggggcgcgcggtttttcggtagtttggatcgcggtgttggtcgcgtttatggcgttgtttatcgtggttacggtgttgggtaacgcgttggttatgttcgttttcgtggtcgattcgagttttcgtatttagaataatttttttttgtttaatttcgttattttcgattttttcgtt

SEQ ID NO: 28488 - DNA, 763 bp, Artificial Sequence
  chemically treated genomic DNA (Homo sapiens) CpG-island No: 28488
aacgaaaaaatcgaaaataacgaaattaaacaaaaaaaaattattctaaatacgaaaactcgaatcgaccacgaaaacgaacataaccaacgcgttacccaacaccgtaaccacgataaacaacgccataaacgcgaccaacaccgcgatccaaactaccgaaaaaccgcgcgccccgcccgccgccgccgcctcgcccgccaacgcccccgaaacgttcaacgacccgtcgaacgacgcgcgctccataaccccgcaaactcacgcgactccgaaacgcgaaacaaaacgccgaccgaaaactaaacgaccgaaaaaaaccccgacccgaaaacctcgtctttacgaacccttaaccgaatcgaattcccctaaaaacgcccaacgcataatccgcgaaaccgaaaccgaaaccaaaacaaacgataccgaaaaaaccgaaaccgaatccgaacccaataaaaccgacaacgcgactactacaacgaaaaaaaaaccgaaacctaaaccgctaccgatacgaccgtacaaccgaaacgcaacgcgcaaccgaatacgccccgcgcccaacccaccgccccgcgcgccccgcgcaacgcccccgccattaactaccgccctcgccccgccccctccccgcccccgccccgcccgacgccgacaacaccacgaacaacgccgcgtacccgccaaactacctaaaacccaacccctacgctcacaacaactaactaaaaacccgaccgaaacttaaccgaatcta

SEQ ID NO: 28489 - DNA, 1875 bp, Artificial Sequence
  chemically treated genomic DNA (Homo sapiens) CpG-island No: 28489
gagcgtacggtttatttttcgcgtttcgcggtttagagcggttttcgttcggtttttgttcgtcggggcggcggcgcgatttacgcgttcggtcggggttaggggtgtttaagatggcgtcgttacggttttcgtgttcggggttttacgcgaggtcgggttttaagcgaggcgttgagtggggagaacgagcgttcgcggtttacgttaaacgtcgtttttgtaggtattcgtggagatcggtagcggggttcgcgtttagttatagttttgatcgttcgcgtcgttgtttcgcgtacgttcgcgggcgtttatagcgtcgcgttcggtttcggttttttttgggttttttagttttattttcgttcgcgttttcggtttcgcgtaggtttcgtcgttttatcgcggtcgagttttttttgacggttttttgcgcgtattttatttggaagaggtggtcgtcgggcgagaagacggtgatggcgcggtcgtagtttatgtcggcgggcggcggtcgggtttttttcgtcgcgatttttaaaagcgtatatttacggttcgcgcgtattcgcgattttcggcgttattacgttcgcgttttattttcggcgtcgtgttttgcgttgtcggcgacgggcggcgttaggcggcgacgggtagcgttaggcggcgtcgggcggacgtgatggcgcgcgtcggggcggggttaggtcgaattatcggtggtcgggggtgggaggcggtgtttcggcgagggtcgggcgttgggtgcgagggggtcgtcgggggttatcgttcggtattgggtcgtagatcgttttgtagggcggagcggcggcgtcgcgggttcggaggcgcggcgacggcgacggggcggacgagtttacgacgcggcgtttttcgcgttttcgttttttttttttttttcgcgattgcggataatgagcgtttcgggtcgtttagcgtagtcggagtatttatttcgatgattacgggttgagtttcgcgtcgttattatgttcgtggttttcgcgtttgttcggttaagaggtaaaggggaggttacgtagtaaattatttagaaggtgggtcgggtcggagcggcggcgtttggcggcgggtttgcgggcgggcgcgcgcggggacggggcgcgggtagttggcgggcgcggggcgcgaataaagtcggggcgtagtcgggcggtcgcgagtttcgacggcggatttttgttttttttcgcgttttacgtttgcgcgtcggcgggtattcggtcgtgtggggggcggttttcggagagtttgcgttaattttgttggggcgcgcgggtttttcgggtcggggtattgggcggtgggggtcgggcggacgttggaggttgtcggttttcgagcgcgttgtttttcgagttcgcggcgcgcgttgggaattgttttgtgttatgtcgggcgtacggggatttttcggggtcggagtcgcggcgagggtttgtcgcgtttcgtagttagtttcggtggcgacggcgggcggtattcgttttttgcgtttattttggttagtggtgaggggttcgggtcggttttcgggcgtatttgcgatcgcggggattgtggtcggggttgttttttttgtttttggagcgaggcgcgaacgatggaggtacggaaggacgcgtttcgatttttatttgcggggtatcgttacgtagttcggtttcgtagggagcgtatcgtttttttcgtattttcgcggttacgtcgggttttagcgtgatattttcgttagtcgtttcgtttaataaatttgacggatttgttttataattttttttttagtttcgtaagttcggttttgtggtttttaagagatagcgttta

SEQ ID NO: 28490 - DNA, 1875 bp, Artificial Sequence
  chemically treated genomic DNA (Homo sapiens) CpG-island No: 28490
taaacgctatctcttaaaaaccacaaaaccgaacttacgaaactaaaaaaaaaattataaaacaaatccgtcaaatttattaaacgaaacgactaacgaaaatatcacgctaaaacccgacgtaaccgcgaaaatacgaaaaaaacgatacgctccctacgaaaccgaactacgtaacgataccccgcaaataaaaatcgaaacgcgtccttccgtacctccatcgttcgcgcctcgctccaaaaacaaaaaaaacaaccccgaccacaatccccgcgatcgcaaatacgcccgaaaaccgacccgaacccctcaccactaaccaaaataaacgcaaaaaacgaataccgcccgccgtcgccaccgaaactaactacgaaacgcgacaaaccctcgccgcgactccgaccccgaaaaatccccgtacgcccgacataacacaaaacaattcccaacgcgcgccgcgaactcgaaaaacaacgcgctcgaaaaccgacaacctccaacgtccgcccgacccccaccgcccaataccccgacccgaaaaacccgcgcgccccaacaaaattaacgcaaactctccgaaaaccgccccccacacgaccgaatacccgccgacgcgcaaacgtaaaacgcgaaaaaaaacaaaaatccgccgtcgaaactcgcgaccgcccgactacgccccgactttattcgcgccccgcgcccgccaactacccgcgccccgtccccgcgcgcgcccgcccgcaaacccgccgccaaacgccgccgctccgacccgacccaccttctaaataatttactacgtaacctcccctttacctcttaaccgaacaaacgcgaaaaccacgaacataataacgacgcgaaactcaacccgtaatcatcgaaataaatactccgactacgctaaacgacccgaaacgctcattatccgcaatcgcgaaaaaaaaaaaaaaaacgaaaacgcgaaaaacgccgcgtcgtaaactcgtccgccccgtcgccgtcgccgcgcctccgaacccgcgacgccgccgctccgccctacaaaacgatctacgacccaataccgaacgataacccccgacgaccccctcgcacccaacgcccgaccctcgccgaaacaccgcctcccacccccgaccaccgataattcgacctaaccccgccccgacgcgcgccatcacgtccgcccgacgccgcctaacgctacccgtcgccgcctaacgccgcccgtcgccgacaacgcaaaacacgacgccgaaaataaaacgcgaacgtaataacgccgaaaatcgcgaatacgcgcgaaccgtaaatatacgcttttaaaaatcgcgacgaaaaaaacccgaccgccgcccgccgacataaactacgaccgcgccatcaccgtcttctcgcccgacgaccacctcttccaaataaaatacgcgcaaaaaaccgtcaaaaaaaactcgaccgcgataaaacgacgaaacctacgcgaaaccgaaaacgcgaacgaaaataaaactaaaaaacccaaaaaaaaccgaaaccgaacgcgacgctataaacgcccgcgaacgtacgcgaaacaacgacgcgaacgatcaaaactataactaaacgcgaaccccgctaccgatctccacgaatacctacaaaaacgacgtttaacgtaaaccgcgaacgctcgttctccccactcaacgcctcgcttaaaacccgacctcgcgtaaaaccccgaacacgaaaaccgtaacgacgccatcttaaacacccctaaccccgaccgaacgcgtaaatcgcgccgccgccccgacgaacaaaaaccgaacgaaaaccgctctaaaccgcgaaacgcgaaaaataaaccgtacgctc

SEQ ID NO: 28491 - DNA, 1875 bp, Artificial Sequence
  chemically treated genomic DNA (Homo sapiens) CpG-island No: 28491
taaacgttgttttttgaaaattataaggtcgaatttacggagttagaagaaaggttgtggagtaaattcgttaagtttgttaggcgaggcggttggcgagggtgttacgttgaaattcggcgtagtcgcgaggatacggagggggcggtgcgttttttacggggtcgggttgcgtaacgatgtttcgtaaatggggatcgggacgcgttttttcgtgtttttatcgttcgcgtttcgttttaggagtaagaggggtagtttcggttatagttttcgcggtcgtaagtgcgttcggaggtcgattcgggttttttattattaattaaaatgagcgtagaaaacgagtatcgttcgtcgtcgttatcgaagttggttgcggagcgcgataagttttcgtcgcggtttcggtttcgaggggttttcgtgcgttcggtatagtataggatagtttttagcgcgcgtcgcggattcgggggatagcgcgttcgggggtcggtagtttttagcgttcgttcggtttttatcgtttagtgtttcggttcgagggattcgcgcgttttaataaagttggcgtaggtttttcggggatcgttttttatacggtcgggtgttcgtcggcgcgtaggcgtgggacgcggggaagggtaaaggttcgtcgtcggggttcgcggtcgttcggttgcgtttcggttttgttcgcgtttcgcgttcgttagttgttcgcgtttcgttttcgcgcgcgttcgttcgtagattcgtcgttaagcgtcgtcgtttcggttcggtttattttttggatggtttgttgcgtaattttttttttgttttttggtcgggtagacgcgaaggttacggatatggtggcggcgcggggtttagttcgtggttatcgaggtggatatttcggttgcgttgggcggttcgaggcgtttattattcgtagtcgcggagggggggaagggggcgggagcgcggggggcgtcgcgtcgtgggttcgttcgtttcgtcgtcgtcgtcgcgttttcgggttcgcggcgtcgtcgtttcgttttgtagaacggtttgcggtttagtgtcgaacggtggttttcggcgattttttcgtatttagcgttcggttttcgtcggagtatcgttttttattttcggttatcggtggttcggtttgatttcgtttcggcgcgcgttattacgttcgttcgacgtcgtttgacgttgttcgtcgtcgtttgacgtcgttcgtcgtcggtagcgtaggatacggcgtcgagggtggggcgcgggcgtagtggcgtcgggagtcgcgggtgcgcgcgggtcgtgagtgtgcgtttttgagagtcgcggcggaaggagttcggtcgtcgttcgtcggtatgagttacgatcgcgttattatcgttttttcgttcgacggttattttttttaagtggagtacgcgtaggaggtcgttaagaagggttcgatcgcggtgaggcggcggggtttgcgcggggtcggggacgcgggcggaagtggggttggggagtttagagagggtcggggtcgggcgcggcgttgtgggcgttcgcgggcgtgcgcggggtagcggcgcgggcggttagggttgtagttgagcgcgggtttcgttgtcggtttttacgagtgtttgtagaggcggcgtttggcgtgagtcgcgagcgttcgttttttttatttagcgtttcgtttggggttcggtttcgcgtggggtttcgggtacgggggtcgtgacgacgttattttgagtatttttggtttcggtcgggcgcgtgggtcgcgtcgtcgtttcggcgagtagaggtcgggcgagggtcgttttgggtcgcggagcgcggggggtaggtcgtgcgttt

SEQ ID NO: 28492 - DNA, 1875 bp, Artificial Sequence
  chemically treated genomic DNA (Homo sapiens) CpG-island No: 28492
aaacgcacgacctaccccccgcgctccgcgacccaaaacgaccctcgcccgacctctactcgccgaaacgacgacgcgacccacgcgcccgaccgaaaccaaaaatactcaaaataacgtcgtcacgacccccgtacccgaaaccccacgcgaaaccgaaccccaaacgaaacgctaaataaaaaaaacgaacgctcgcgactcacgccaaacgccgcctctacaaacactcgtaaaaaccgacaacgaaacccgcgctcaactacaaccctaaccgcccgcgccgctaccccgcgcacgcccgcgaacgcccacaacgccgcgcccgaccccgaccctctctaaactccccaaccccacttccgcccgcgtccccgaccccgcgcaaaccccgccgcctcaccgcgatcgaacccttcttaacgacctcctacgcgtactccacttaaaaaaaataaccgtcgaacgaaaaaacgataataacgcgatcgtaactcataccgacgaacgacgaccgaactccttccgccgcgactctcaaaaacgcacactcacgacccgcgcgcacccgcgactcccgacgccactacgcccgcgccccaccctcgacgccgtatcctacgctaccgacgacgaacgacgtcaaacgacgacgaacaacgtcaaacgacgtcgaacgaacgtaataacgcgcgccgaaacgaaatcaaaccgaaccaccgataaccgaaaataaaaaacgatactccgacgaaaaccgaacgctaaatacgaaaaaatcgccgaaaaccaccgttcgacactaaaccgcaaaccgttctacaaaacgaaacgacgacgccgcgaacccgaaaacgcgacgacgacgacgaaacgaacgaacccacgacgcgacgccccccgcgctcccgcccccttccccccctccgcgactacgaataataaacgcctcgaaccgcccaacgcaaccgaaatatccacctcgataaccacgaactaaaccccgcgccgccaccatatccgtaaccttcgcgtctacccgaccaaaaaacaaaaaaaaaattacgcaacaaaccatccaaaaaataaaccgaaccgaaacgacgacgcttaacgacgaatctacgaacgaacgcgcgcgaaaacgaaacgcgaacaactaacgaacgcgaaacgcgaacaaaaccgaaacgcaaccgaacgaccgcgaaccccgacgacgaacctttacccttccccgcgtcccacgcctacgcgccgacgaacacccgaccgtataaaaaacgatccccgaaaaacctacgccaactttattaaaacgcgcgaatccctcgaaccgaaacactaaacgataaaaaccgaacgaacgctaaaaactaccgacccccgaacgcgctatcccccgaatccgcgacgcgcgctaaaaactatcctatactataccgaacgcacgaaaacccctcgaaaccgaaaccgcgacgaaaacttatcgcgctccgcaaccaacttcgataacgacgacgaacgatactcgttttctacgctcattttaattaataataaaaaacccgaatcgacctccgaacgcacttacgaccgcgaaaactataaccgaaactacccctcttactcctaaaacgaaacgcgaacgataaaaacacgaaaaaacgcgtcccgatccccatttacgaaacatcgttacgcaacccgaccccgtaaaaaacgcaccgccccctccgtatcctcgcgactacgccgaatttcaacgtaacaccctcgccaaccgcctcgcctaacaaacttaacgaatttactccacaacctttcttctaactccgtaaattcgaccttataattttcaaaaaacaacgttta

SEQ ID NO: 28493 - DNA, 820 bp, Artificial Sequence
  chemically treated genomic DNA (Homo sapiens) CpG-island No: 28493
gcgttcgtatcggatttttcgcggcggtaaggcgaagttagggtaagggcggtggggacggcgtttcggggttgttttgcggtttttattgtttgttttgcgttgtttcgtagttttttcgggtaacggcggtgttttcgttagattcgggaggtttcgtaaacgtcggaggggttagagaagttgggggattttgggtatcgggtggaacgggcggggcggttgtttttgtgttcgggtagcgagggcgtcggcgagaagcgcggttgtagttgagcgtttcgtattttttttgtcgttgtttttgttttcgttattagggataaggtcgtttttcggttcgtcggcgtgttttttgtatttgcgtattgggtaagttttgggttttcggagttaaaaggtttcggaagtggtcggtcgtttgcgacgtttcggaagtgacgtgttttttcgagtcggtgagtgcgggagcggggagcggggagcgtgggtttggggggtggtcgcggttcgggcgtaaggaggggtttcggtttgggtcgcggggtatcggggcgttgggagcgggagaggtttcggtttaggagttgagaggtttggagggttgtcgggttgcgaatttcggcgggatcgagcgttgcggttttggagtagcgagcgttcgggcggtggggagcggcgttttgtttttcggttttgttttatttttttcgtagaatcgcgttttggggttagaagttttgttagttatttcggtggtgttttgttacgggatgggtgtcgtgtgtgagtttcgagttaagttgttaggaatttgttt

SEQ ID NO: 28494 - DNA, 820 bp, Artificial Sequence
  chemically treated genomic DNA (Homo sapiens) CpG-island No: 28494
aaacaaattcctaacaacttaactcgaaactcacacacgacacccatcccgtaacaaaacaccaccgaaataactaacaaaacttctaaccccaaaacgcgattctacgaaaaaaataaaacaaaaccgaaaaacaaaacgccgctccccaccgcccgaacgctcgctactccaaaaccgcaacgctcgatcccgccgaaattcgcaacccgacaaccctccaaacctctcaactcctaaaccgaaacctctcccgctcccaacgccccgataccccgcgacccaaaccgaaacccctccttacgcccgaaccgcgaccaccccccaaacccacgctccccgctccccgctcccgcactcaccgactcgaaaaaacacgtcacttccgaaacgtcgcaaacgaccgaccacttccgaaaccttttaactccgaaaacccaaaacttacccaatacgcaaatacaaaaaacacgccgacgaaccgaaaaacgaccttatccctaataacgaaaacaaaaacaacgacaaaaaaaatacgaaacgctcaactacaaccgcgcttctcgccgacgccctcgctacccgaacacaaaaacaaccgccccgcccgttccacccgatacccaaaatcccccaacttctctaacccctccgacgtttacgaaacctcccgaatctaacgaaaacaccgccgttacccgaaaaaactacgaaacaacgcaaaacaaacaataaaaaccgcaaaacaaccccgaaacgccgtccccaccgcccttaccctaacttcgccttaccgccgcgaaaaatccgatacgaacgc

SEQ ID NO: 28495 - DNA, 820 bp, Artificial Sequence
  chemically treated genomic DNA (Homo sapiens) CpG-island No: 28495
aggtaaatttttaataatttgattcggaatttatatacggtatttatttcgtgatagagtattatcggggtggttgataagatttttgattttaaaacgcggttttgcggagagagtggggtaggatcggggagtaaggcgtcgttttttatcgttcgagcgttcgttattttagggtcgtagcgttcggtttcgtcggggttcgtagttcggtagttttttaggttttttagtttttaggtcggggtttttttcgtttttagcgtttcggtatttcgcggtttaagtcgaggtttttttttgcgttcgggtcgcgattattttttaggtttacgtttttcgtttttcgttttcgtatttatcggttcgggaaagtacgttattttcggagcgtcgtaagcggtcgattattttcggggttttttggtttcggaagtttaaggtttgtttagtgcgtaggtgtagaaaatacgtcgacggatcgagaggcgattttgtttttggtagcggaagtaggagtaacggtaggagggatgcggagcgtttagttgtagtcgcgtttttcgtcggcgttttcgttgttcgagtataaggatagtcgtttcgttcgttttattcggtgtttaaggttttttagtttttttgattttttcggcgtttgcggaatttttcgggtttgacgaggatatcgtcgttgttcgaggaggttacggggtaacgtagagtaggtagtggggatcgtagggtagtttcggggcgtcgtttttatcgtttttattttggtttcgttttgtcgtcgcggggaattcggtgcggacgt

SEQ ID NO: 28496 - DNA, 820 bp, Artificial Sequence
  chemically treated genomic DNA (Homo sapiens) CpG-island No: 28496
acgtccgcaccgaattccccgcgacgacaaaacgaaaccaaaataaaaacgataaaaacgacgccccgaaactaccctacgatccccactacctactctacgttaccccgtaacctcctcgaacaacgacgatatcctcgtcaaacccgaaaaattccgcaaacgccgaaaaaatcaaaaaaactaaaaaaccttaaacaccgaataaaacgaacgaaacgactatccttatactcgaacaacgaaaacgccgacgaaaaacgcgactacaactaaacgctccgcatccctcctaccgttactcctacttccgctaccaaaaacaaaatcgcctctcgatccgtcgacgtattttctacacctacgcactaaacaaaccttaaacttccgaaaccaaaaaaccccgaaaataatcgaccgcttacgacgctccgaaaataacgtactttcccgaaccgataaatacgaaaacgaaaaacgaaaaacgtaaacctaaaaaataatcgcgacccgaacgcaaaaaaaaacctcgacttaaaccgcgaaataccgaaacgctaaaaacgaaaaaaaccccgacctaaaaactaaaaaacctaaaaaactaccgaactacgaaccccgacgaaaccgaacgctacgaccctaaaataacgaacgctcgaacgataaaaaacgacgccttactccccgatcctaccccactctctccgcaaaaccgcgttttaaaatcaaaaatcttatcaaccaccccgataatactctatcacgaaataaataccgtatataaattccgaatcaaattattaaaaatttacct

SEQ ID NO: 28497 - DNA, 533 bp, Artificial Sequence
  chemically treated genomic DNA (Homo sapiens) CpG-island No: 28497
tatcgtcggatttagtagttcgttgtcgatcggttgttaagtgacgttagcgcgtagtggcgcgtgcgcggttacggcggagtgcgtgaaagcggacgcgcgtcgtagtagtcggggcggcggcgaggacggcggttacggaagcggttaagggggcggtggcgtagagaggggtgcggagcgggcggaagaggcgtttgtgtcgtagtttggttttagaggagtatcgttggggtgagtagtcgggtttttgtaggggaggtggggtttggtcgtatttgcggcgcggggacgcgcgtttcgtcgtattcgcgcgtattcgttttcgttttttcgtcgtttttttcgggggcggggaggagttgggacggggtttgacgagggttattttttgggttcgggtgttttgggagagcggtagtcgtttcgttcgtagtttacgaaggtgtagtgggaagtagacgtttcggggattcggggtggttttattagttttttaaagagaggagttcgaattaggggtagtttaggtt

SEQ ID NO: 28498 - DNA, 533 bp, Artificial Sequence
  chemically treated genomic DNA (Homo sapiens) CpG-island No: 28498
aacctaaactacccctaattcgaactcctctctttaaaaaactaataaaaccaccccgaatccccgaaacgtctacttcccactacaccttcgtaaactacgaacgaaacgactaccgctctcccaaaacacccgaacccaaaaaataaccctcgtcaaaccccgtcccaactcctccccgcccccgaaaaaaacgacgaaaaaacgaaaacgaatacgcgcgaatacgacgaaacgcgcgtccccgcgccgcaaatacgaccaaaccccacctcccctacaaaaacccgactactcaccccaacgatactcctctaaaaccaaactacgacacaaacgcctcttccgcccgctccgcacccctctctacgccaccgcccccttaaccgcttccgtaaccgccgtcctcgccgccgccccgactactacgacgcgcgtccgctttcacgcactccgccgtaaccgcgcacgcgccactacgcgctaacgtcacttaacaaccgatcgacaacgaactactaaatccgacgata

SEQ ID NO: 28499 - DNA, 533 bp, Artificial Sequence
  chemically treated genomic DNA (Homo sapiens) CpG-island No: 28499
aatttgggttgtttttgattcgaatttttttttttgggaggttggtagagttatttcgaattttcgaaacgtttattttttattatattttcgtggattgcgaacgggacggttatcgtttttttagagtattcgggtttaagaaatgattttcgttaggtttcgttttagttttttttcgttttcggaaaaagcggcggaggggcgggggcgggtgcgcgcggatacggcggggcgcgcgttttcgcgtcgtaggtgcggttaggttttattttttttgtaaggattcggttatttattttagcgatgtttttttgagattaagttgcgatatagacgtttttttcgttcgtttcgtatttttttttgcgttatcgtttttttggtcgttttcgtggtcgtcgttttcgtcgtcgtttcggttgttgcggcgcgcgttcgtttttacgtatttcgtcgtggtcgcgtacgcgttattgcgcgttggcgttatttagtaatcgatcgatagcgggttgttgggttcggcgatg

SEQ ID NO: 28500 - DNA, 533 bp, Artificial Sequence
  chemically treated genomic DNA (Homo sapiens) CpG-island No: 28500
catcgccgaacccaacaacccgctatcgatcgattactaaataacgccaacgcgcaataacgcgtacgcgaccacgacgaaatacgtaaaaacgaacgcgcgccgcaacaaccgaaacgacgacgaaaacgacgaccacgaaaacgaccaaaaaaacgataacgcaaaaaaaaatacgaaacgaacgaaaaaaacgtctatatcgcaacttaatctcaaaaaaacatcgctaaaataaataaccgaatccttacaaaaaaaataaaacctaaccgcacctacgacgcgaaaacgcgcgccccgccgtatccgcgcgcacccgcccccgcccctccgccgctttttccgaaaacgaaaaaaaactaaaacgaaacctaacgaaaatcatttcttaaacccgaatactctaaaaaaacgataaccgtcccgttcgcaatccacgaaaatataataaaaaataaacgtttcgaaaattcgaaataactctaccaacctcccaaaaaaaaaaattcgaatcaaaaacaacccaaatt

SEQ ID NO: 28501 - DNA, 659 bp, Artificial Sequence
  chemically treated genomic DNA (Homo sapiens) CpG-island No: 28501
gttttggaaagggaaaagttgagcggagatatcgggaaagcgacgttttagaaatatcggggtcgtagaagtaatagagggcgagcgggcggacgtcgaggcgggattttcgtagaggtagatgtagtttattttttttttttattgcggttttcgagtttttcgcgggaatgtacgtggggttttttgtcgagttttttcgttttattttagttttgtcgtttagtatttattcggtagaattttttagtatgcgtcgtcgtagtagtcgtagtcgtttgagtcgttttaggggtttcggtcggtcgttttgattggttaggtgaggggtagggtcgggacgtttggtgagcgttattcggcgattcgaagtgttagttttagcgtgggggcgggattaagagcggagttatataatcgattggttaattttcgaggtcggtgcggaggtcgatttttggaatggggcgggtttcggaagggcgagtttcgattggttagttgcgggattggatacgttgagtttagtagcggtagttttagttaggttgggcggtttaggttcggcgtaggcggtagttcggaacggcggggtaggtggggtaggcggttggttatttattgtatttatcgttttatattttttttttttttttttt

SEQ ID NO: 28502 - DNA, 659 bp, Artificial Sequence
  chemically treated genomic DNA (Homo sapiens) CpG-island No: 28502
aaaaaaaaaaaaaaaaaaatataaaacgataaatacaataaataaccaaccgcctaccccacctaccccgccgttccgaactaccgcctacgccgaacctaaaccgcccaacctaactaaaactaccgctactaaactcaacgtatccaatcccgcaactaaccaatcgaaactcgcccttccgaaacccgccccattccaaaaatcgacctccgcaccgacctcgaaaattaaccaatcgattatataactccgctcttaatcccgcccccacgctaaaactaacacttcgaatcgccgaataacgctcaccaaacgtcccgaccctacccctcacctaaccaatcaaaacgaccgaccgaaacccctaaaacgactcaaacgactacgactactacgacgacgcatactaaaaaattctaccgaataaatactaaacgacaaaactaaaataaaacgaaaaaactcgacaaaaaaccccacgtacattcccgcgaaaaactcgaaaaccgcaataaaaaaaaaaaataaactacatctacctctacgaaaatcccgcctcgacgtccgcccgctcgccctctattacttctacgaccccgatatttctaaaacgtcgctttcccgatatctccgctcaacttttccctttccaaaac

SEQ ID NO: 28503 - DNA, 659 bp, Artificial Sequence
  chemically treated genomic DNA (Homo sapiens) CpG-island No: 28503
aaaaaaaaaaaaagaaaagtatgaaacgatgagtataatgagtagttagtcgtttgttttatttatttcgtcgtttcggattgtcgtttgcgtcgagtttaggtcgtttagtttgattgaaattgtcgttgttgaatttagcgtatttagtttcgtagttgattaatcggagttcgttttttcggggttcgttttattttaggaatcgattttcgtatcggtttcgaaaattgattaatcggttgtgtagtttcgtttttagtttcgtttttacgttgaaattgatatttcggatcgtcgagtaacgtttattagacgtttcggttttgttttttatttgattaattaagacggtcggtcgaggtttttggaacggtttaggcggttgcggttgttacggcggcgtatgttaggggattttgtcgggtgagtgttgggcggtaggattggggtggggcggaagggttcggtaggaggttttacgtgtattttcgcgaggggttcgggggtcgtagtggaaaagaagggtaggttgtatttgtttttgcgggggtttcgtttcggcgttcgttcgttcgttttttgttatttttgcggtttcggtgtttttggagcgtcgttttttcggtgttttcgtttagtttttttttttttaaagt

SEQ ID NO: 28504 - DNA, 659 bp, Artificial Sequence
  chemically treated genomic DNA (Homo sapiens) CpG-island No: 28504
actttaaaaaaaaaaaaactaaacgaaaacaccgaaaaaacgacgctccaaaaacaccgaaaccgcaaaaataacaaaaaacgaacgaacgaacgccgaaacgaaacccccgcaaaaacaaatacaacctacccttcttttccactacgacccccgaacccctcgcgaaaatacacgtaaaacctcctaccgaacccttccgccccaccccaatcctaccgcccaacactcacccgacaaaatcccctaacatacgccgccgtaacaaccgcaaccgcctaaaccgttccaaaaacctcgaccgaccgtcttaattaatcaaataaaaaacaaaaccgaaacgtctaataaacgttactcgacgatccgaaatatcaatttcaacgtaaaaacgaaactaaaaacgaaactacacaaccgattaatcaattttcgaaaccgatacgaaaatcgattcctaaaataaaacgaaccccgaaaaaacgaactccgattaatcaactacgaaactaaatacgctaaattcaacaacgacaatttcaatcaaactaaacgacctaaactcgacgcaaacgacaatccgaaacgacgaaataaataaaacaaacgactaactactcattatactcatcgtttcatacttttcttttttttttttt

SEQ ID NO: 28505 - DNA, 1215 bp, Artificial Sequence
  chemically treated genomic DNA (Homo sapiens) CpG-island No: 28505
cgttcgtcgttttatcggggcgtatcgcgttggttttttttcgttagtttttcgagtttcggttatttatttttagcgtagagtagcgttggtagtcggcgtcgcgatggaggaagagttgaagtgtttcgtgtgcggttttttgtttcgggagtttattattttgttttgtttttataatgtttgtttgttttgcgttcgtattatcgcggtgtagatttcggacggtgagtagtatttgttttagtcgtttttgttttttcggggatcggggttgtaggcgggcgtcgtcgtcgttgtttttttggagtacgacgttgcggttggttcggtttgcggcggtgtaggcgggagtgtagttggcggtttcggcggcggtgcgggaggtggcggagattacgcggataagtttagtttgtatagcgagatagatagcggttacgggttttatatttcgagttttaagttttttaacggggttcgcgtgttgtttatggtgttcgtattattcggtttttcggttgcggcggttcggggtgtcgtttgtttttcgttgttttcgttttcgagttttattacgtgttcgtagtgttatcgtagcgtatttttggattatcgcggtttgcgcggtttttagcgtaatcggttgttcgaggttatcgtgtagcggtattagtagggtcgcggggtcgtgtcggggacgtttgtagtcgcggcggtggttatttgttagttgtgcgatcgtatttcgttagagttagtagttacgttttgcgagtagtgcgacgttttttattgttttgtttgttagtttaagtgttatttatttcggggatttttcgttaagtatcgtttggtgtagtcgtcgtcgtcgtcgtcgtcgttcgtcgaggtagttttcgggtttattggtatcgtttagggcgtttttagcggaggcggcggttgtaagagttcgggaggcgcgggggcgggggcgattgggggtagtacggttcgtaagttttttacgtgtttcgagtatgaaatggagaattatagtatgtattgcgtgagttgtcgaatttcggtgtgttatttgtgtttggaggagggtcggtacgttaagtacgaggtgaagtcgttgggggttatgtggaagtagtataaggtgagttcgcgggacgcgggagtgtaggtgttagggaagagggtacgaggagaaaggtttttggt

SEQ ID NO: 28506 - DNA, 1215 bp, Artificial Sequence
  chemically treated genomic DNA (Homo sapiens) CpG-island No: 28506
accaaaaacctttctcctcgtaccctcttccctaacacctacactcccgcgtcccgcgaactcaccttatactacttccacataacccccaacgacttcacctcgtacttaacgtaccgaccctcctccaaacacaaataacacaccgaaattcgacaactcacgcaatacatactataattctccatttcatactcgaaacacgtaaaaaacttacgaaccgtactacccccaatcgcccccgcccccgcgcctcccgaactcttacaaccgccgcctccgctaaaaacgccctaaacgataccaataaacccgaaaactacctcgacgaacgacgacgacgacgacgacgactacaccaaacgatacttaacgaaaaatccccgaaataaataacacttaaactaacaaacaaaacaataaaaaacgtcgcactactcgcaaaacgtaactactaactctaacgaaatacgatcgcacaactaacaaataaccaccgccgcgactacaaacgtccccgacacgaccccgcgaccctactaataccgctacacgataacctcgaacaaccgattacgctaaaaaccgcgcaaaccgcgataatccaaaaatacgctacgataacactacgaacacgtaataaaactcgaaaacgaaaacaacgaaaaacaaacgacaccccgaaccgccgcaaccgaaaaaccgaataatacgaacaccataaacaacacgcgaaccccgttaaaaaacttaaaactcgaaatataaaacccgtaaccgctatctatctcgctatacaaactaaacttatccgcgtaatctccgccacctcccgcaccgccgccgaaaccgccaactacactcccgcctacaccgccgcaaaccgaaccaaccgcaacgtcgtactccaaaaaaacaacgacgacgacgcccgcctacaaccccgatccccgaaaaaacaaaaacgactaaaacaaatactactcaccgtccgaaatctacaccgcgataatacgaacgcaaaacaaacaaacattataaaaacaaaacaaaataataaactcccgaaacaaaaaaccgcacacgaaacacttcaactcttcctccatcgcgacgccgactaccaacgctactctacgctaaaaataaataaccgaaactcgaaaaactaacgaaaaaaaaccaacgcgatacgccccgataaaacgacgaacg

SEQ ID NO: 28507 - DNA, 1215 bp, Artificial Sequence
  chemically treated genomic DNA (Homo sapiens) CpG-island No: 28507
gttaaaagttttttttttcgtatttttttttttggtatttgtattttcgcgtttcgcgggtttattttgtgttgtttttatatggtttttagcggttttatttcgtgtttggcgtgtcggtttttttttaggtatagataatatatcggggttcgatagtttacgtagtatatgttgtagttttttattttatgttcgggatacgtggggaatttgcgggtcgtgttgtttttagtcgttttcgttttcgcgtttttcgggtttttgtagtcgtcgttttcgttgggggcgttttgggcggtgttagtgggttcggaggttgtttcggcgggcggcggcggcggcggcggcggttgtattaggcgatgtttggcgaagggttttcgggatggatggtatttgagttggtaggtagagtagtagaggacgtcgtattgttcgtagagcgtggttgttggttttggcggggtgcggtcgtatagttggtagatggttatcgtcgcggttgtagacgttttcggtacggtttcgcggttttgttggtatcgttgtacgatggtttcgagtagtcggttgcgttggaagtcgcgtaggtcgcggtggtttagggatgcgttgcggtggtattgcgggtacgtgatggagttcgaagacgaggatagcgaggagtaggcggtatttcgagtcgtcgtagtcgaggagtcgggtggtgcgggtattatgggtagtacgcgaatttcgttgggggatttgaggttcggggtgtaggattcgtagtcgttgtttgtttcgttgtataagttgagtttgttcgcgtggttttcgttatttttcgtatcgtcgtcgaggtcgttagttgtattttcgtttgtatcgtcgtaggtcgggttagtcgtagcgtcgtgttttagagaggtagcggcggcggcgttcgtttgtagtttcgattttcgggaaagtaggagcggttggggtaggtgttgtttatcgttcggggtttgtatcgcgatggtgcgagcgtaaggtaggtagatattgtgggaatagggtaggatgataggttttcgaaatagagagtcgtatacgggatattttagttttttttttatcgcggcgtcggttgttagcgttgttttgcgttggggatgaatggtcggagttcgggagattggcggaggaggattagcgcggtgcgtttcggtgagacgacgggcg

SEQ ID NO: 28508 - DNA, 1215 bp, Artificial Sequence
  chemically treated genomic DNA (Homo sapiens) CpG-island No: 28508
cgcccgtcgtctcaccgaaacgcaccgcgctaatcctcctccgccaatctcccgaactccgaccattcatccccaacgcaaaacaacgctaacaaccgacgccgcgataaaaaaaaaactaaaatatcccgtatacgactctctatttcgaaaacctatcatcctaccctattcccacaatatctacctaccttacgctcgcaccatcgcgatacaaaccccgaacgataaacaacacctaccccaaccgctcctactttcccgaaaatcgaaactacaaacgaacgccgccgccgctacctctctaaaacacgacgctacgactaacccgacctacgacgatacaaacgaaaatacaactaacgacctcgacgacgatacgaaaaataacgaaaaccacgcgaacaaactcaacttatacaacgaaacaaacaacgactacgaatcctacaccccgaacctcaaatcccccaacgaaattcgcgtactacccataatacccgcaccacccgactcctcgactacgacgactcgaaataccgcctactcctcgctatcctcgtcttcgaactccatcacgtacccgcaataccaccgcaacgcatccctaaaccaccgcgacctacgcgacttccaacgcaaccgactactcgaaaccatcgtacaacgataccaacaaaaccgcgaaaccgtaccgaaaacgtctacaaccgcgacgataaccatctaccaactatacgaccgcaccccgccaaaaccaacaaccacgctctacgaacaatacgacgtcctctactactctacctaccaactcaaataccatccatcccgaaaacccttcgccaaacatcgcctaatacaaccgccgccgccgccgccgccgcccgccgaaacaacctccgaacccactaacaccgcccaaaacgcccccaacgaaaacgacgactacaaaaacccgaaaaacgcgaaaacgaaaacgactaaaaacaacacgacccgcaaattccccacgtatcccgaacataaaataaaaaactacaacatatactacgtaaactatcgaaccccgatatattatctatacctaaaaaaaaaccgacacgccaaacacgaaataaaaccgctaaaaaccatataaaaacaacacaaaataaacccgcgaaacgcgaaaatacaaataccaaaaaaaaaaatacgaaaaaaaaaacttttaac

SEQ ID NO: 28509 - DNA, 585 bp, Artificial Sequence
  chemically treated genomic DNA (Homo sapiens) CpG-island No: 28509
tttgcgtcgcgggcggggcgatttcgggggtcgcgcgttttttttcggagcgcgttttttttttcggagcgcgcgttcgacggtttgtcgcggtttcggcgttttcgttttttcgggcgtttcgtagtcgtgacgtgtacgtcgtagtgtcggggattcggcggggcgtcggtcggcgggcggagatcgattcgggatttgttcgagtaggaagttagttttagttcggtcgttgtcgtcgttttgttttggtgttcgttcgcgtcgtcgttttttttattggtttttattattttttatcgcgttttttagttttattcgtataggtagtttcgtcgtcgcgtatttgttttcgttttcgtatcggtgagtgttttagagatttattgcggggcgtcggcgtcggggtttcgcgttttttggttcggttttgttttcgggttttttcgagtagtttcggggtcgacgtttttgtttattgttcgaggacgcgggtgggagaagtaggtgatggatgggtgggttttgggtagtagtggggtcggcggtggttttcgtttttatcgaaagataattagttttttt

SEQ ID NO: 28510 - DNA, 585 bp, Artificial Sequence
  chemically treated genomic DNA (Homo sapiens) CpG-island No: 28510
aaaaaaactaattatctttcgataaaaacgaaaaccaccgccgaccccactactacccaaaacccacccatccatcacctacttctcccacccgcgtcctcgaacaataaacaaaaacgtcgaccccgaaactactcgaaaaaacccgaaaacaaaaccgaaccaaaaaacgcgaaaccccgacgccgacgccccgcaataaatctctaaaacactcaccgatacgaaaacgaaaacaaatacgcgacgacgaaactacctatacgaataaaactaaaaaacgcgataaaaaataataaaaaccaataaaaaaaacgacgacgcgaacgaacaccaaaacaaaacgacgacaacgaccgaactaaaactaacttcctactcgaacaaatcccgaatcgatctccgcccgccgaccgacgccccgccgaatccccgacactacgacgtacacgtcacgactacgaaacgcccgaaaaaacgaaaacgccgaaaccgcgacaaaccgtcgaacgcgcgctccgaaaaaaaaaacgcgctccgaaaaaaaacgcgcgacccccgaaatcgccccgcccgcgacgcaaa

SEQ ID NO: 28511 - DNA, 585 bp, Artificial Sequence
  chemically treated genomic DNA (Homo sapiens) CpG-island No: 28511
aaggagattgattgtttttcggtggaaacgagaattatcgtcggttttattgttgtttagggtttatttatttattatttgttttttttattcgcgttttcgggtagtgaatagaagcgtcggtttcggagttgttcgaggaggttcgggagtaaggtcgggttagggaacgcgagatttcggcgtcgacgtttcgtagtgggtttttgggatatttatcggtgcgggagcgaaggtaggtgcgcggcggcggggttatttgtacgggtgaagttggagggcgcggtgagaagtgatgagggttagtgaagagggcgacgacgcggacgggtattaggatagggcggcgatagcggtcgggttgaggttggttttttgttcggatagatttcgagtcggttttcgttcgtcggtcggcgtttcgtcgagttttcggtattgcggcgtgtacgttacggttacggagcgttcgaaggggcgggggcgtcggggtcgcggtaggtcgtcgggcgcgcgtttcgggagggagggcgcgtttcgggagagggcgcgcgattttcggggtcgtttcgttcgcggcgtaga

SEQ ID NO: 28512 - DNA, 585 bp, Artificial Sequence
  chemically treated genomic DNA (Homo sapiens) CpG-island No: 28512
tctacgccgcgaacgaaacgaccccgaaaatcgcgcgccctctcccgaaacgcgccctccctcccgaaacgcgcgcccgacgacctaccgcgaccccgacgcccccgccccttcgaacgctccgtaaccgtaacgtacacgccgcaataccgaaaactcgacgaaacgccgaccgacgaacgaaaaccgactcgaaatctatccgaacaaaaaaccaacctcaacccgaccgctatcgccgccctatcctaatacccgtccgcgtcgtcgccctcttcactaaccctcatcacttctcaccgcgccctccaacttcacccgtacaaataaccccgccgccgcgcacctaccttcgctcccgcaccgataaatatcccaaaaacccactacgaaacgtcgacgccgaaatctcgcgttccctaacccgaccttactcccgaacctcctcgaacaactccgaaaccgacgcttctattcactacccgaaaacgcgaataaaaaaaacaaataataaataaataaaccctaaacaacaataaaaccgacgataattctcgtttccaccgaaaaacaatcaatctcctt

SEQ ID NO: 28513 - DNA, 625 bp, Artificial Sequence
  chemically treated genomic DNA (Homo sapiens) CpG-island No: 28513
tacgttgcggtagcgaaggaaggaaatttagataaggggtaaatattcgatggtgggtacgttttgttattcgggggttggggggataggggcgagaaggaaagaaatgagggtgtacggagcgcggaggtatagcggtagttgtagtttgagcgttcgtcgacgggtatttgttcgcgggatatttaggtcggtagtgtttaagttttagttgcggtgtagaggaatttgtgtcgcgttcggggttgtcgtttgggggttttcgtcgtaagcgaggcgaacgtagtatcgtttcgggagaaggtgacggggtgtcgagggtaatagagaggggcgtgcgtttatacgtgcgcgagttgtaggtgtttaggggcggcgcgtgtacgtcggagtgcgcgcgagtgtgcgcgtgtgtatatacggatatcggagggaggcggtatcggtcgggagggcgcgaggcgggagttcgggcggagggcgtcgcggtatatatagtttgattttcgtttttattttaatttttatcgttcgtatttttaggattcgacgggtcggtatattttttttttttttttatatttttttttttttgttgttggggtatatgttgtcgtgggggtgg

SEQ ID NO: 28514 - DNA, 625 bp, Artificial Sequence
  chemically treated genomic DNA (Homo sapiens) CpG-island No: 28514
ccacccccacgacaacatataccccaacaacaaaaaaaaaaaaatataaaaaaaaaaaaaaaatataccgacccgtcgaatcctaaaaatacgaacgataaaaattaaaataaaaacgaaaatcaaactatatataccgcgacgccctccgcccgaactcccgcctcgcgccctcccgaccgataccgcctccctccgatatccgtatatacacacgcgcacactcgcgcgcactccgacgtacacgcgccgcccctaaacacctacaactcgcgcacgtataaacgcacgcccctctctattaccctcgacaccccgtcaccttctcccgaaacgatactacgttcgcctcgcttacgacgaaaacccccaaacgacaaccccgaacgcgacacaaattcctctacaccgcaactaaaacttaaacactaccgacctaaatatcccgcgaacaaatacccgtcgacgaacgctcaaactacaactaccgctatacctccgcgctccgtacaccctcatttctttccttctcgcccctatccccccaacccccgaataacaaaacgtacccaccatcgaatatttaccccttatctaaatttccttccttcgctaccgcaacgta

SEQ ID NO: 28515 - DNA, 625 bp, Artificial Sequence
  chemically treated genomic DNA (Homo sapiens) CpG-island No: 28515
ttatttttacggtaatatgtattttagtaataagaagaaaaaggtgtggagagaggagaaaggtatatcggttcgtcgagttttgggggtgcgggcggtgggggttagggtgaggacgggggttaggttgtgtgtgtcgcggcgtttttcgttcgagttttcgtttcgcgttttttcggtcggtgtcgttttttttcggtgttcgtgtgtatatacgcgtatattcgcgcgtatttcggcgtgtacgcgtcgtttttgggtatttgtagttcgcgtacgtgtgggcgtacgtttttttttgttgttttcggtatttcgttattttttttcgaggcggtgttgcgttcgtttcgtttgcggcggggatttttaggcggtagtttcgggcgcggtataagtttttttgtatcgtagttgggatttgggtattgtcggtttgggtgtttcgcggataggtgttcgtcggcgggcgtttaggttgtagttgtcgttgtgttttcgcgtttcgtgtatttttatttttttttttttcgtttttgtttttttagttttcgaatggtaaagcgtatttattatcgggtgtttattttttgtttaggtttttttttttcgttgtcgtagcgtg

SEQ ID NO: 28516 - DNA, 625 bp, Artificial Sequence
  chemically treated genomic DNA (Homo sapiens) CpG-island No: 28516
cacgctacgacaacgaaaaaaaaaaacctaaacaaaaaataaacacccgataataaatacgctttaccattcgaaaactaaaaaaacaaaaacgaaaaaaaaaaaaataaaaatacacgaaacgcgaaaacacaacgacaactacaacctaaacgcccgccgacgaacacctatccgcgaaacacccaaaccgacaatacccaaatcccaactacgatacaaaaaaacttataccgcgcccgaaactaccgcctaaaaatccccgccgcaaacgaaacgaacgcaacaccgcctcgaaaaaaaataacgaaataccgaaaacaacaaaaaaaaacgtacgcccacacgtacgcgaactacaaatacccaaaaacgacgcgtacacgccgaaatacgcgcgaatatacgcgtatatacacacgaacaccgaaaaaaaacgacaccgaccgaaaaaacgcgaaacgaaaactcgaacgaaaaacgccgcgacacacacaacctaacccccgtcctcaccctaacccccaccgcccgcacccccaaaactcgacgaaccgatatacctttctcctctctccacacctttttcttcttattactaaaatacatattaccgtaaaaataa

SEQ ID NO: 28517 - DNA, 588 bp, Artificial Sequence
  chemically treated genomic DNA (Homo sapiens) CpG-island No: 28517
gttcgtcgttttttagtcgtcgttttttttttttagttcgcgttcggtttcggtttttattcgttttagtttcgcggacgtcgttatagtagtattttagagtttgttaattaggttacgtttcgcgttaatttaatattcgcgtaggtatcgtttattagtcgttaggtagcgtcgttttttattggttgtattgttcgtcgtttttcgtgttttagttacggcgcgttttaatttgggttttagggcgtacgcgtaggcgtaggttcgggttcgacgtcgacgacgttagggagttggagggggcggagttagggagcgagggggcggagttagggagcgagggggttggagttgttttcgagacgtgggcgcggcgtgaagtcgacgtttagtgggagagggaggtggatcgcgtttatcgttggttttttggaagatttgagggcgtggtttgtagagttaggtgcgttaagtgataggcgagttagcggaaagtcgttttagggatttggaggatgtagaagtgggaggagatcgagggttaatacgaattgttcgtgtttattttaattgttttgttgagga

SEQ ID NO: 28518 - DNA, 588 bp, Artificial Sequence
  chemically treated genomic DNA (Homo sapiens) CpG-island No: 28518
tcctcaacaaaacaattaaaataaacacgaacaattcgtattaaccctcgatctcctcccacttctacatcctccaaatccctaaaacgactttccgctaactcgcctatcacttaacgcacctaactctacaaaccacgccctcaaatcttccaaaaaaccaacgataaacgcgatccacctccctctcccactaaacgtcgacttcacgccgcgcccacgtctcgaaaacaactccaaccccctcgctccctaactccgccccctcgctccctaactccgccccctccaactccctaacgtcgtcgacgtcgaacccgaacctacgcctacgcgtacgccctaaaacccaaattaaaacgcgccgtaactaaaacacgaaaaacgacgaacaatacaaccaataaaaaacgacgctacctaacgactaataaacgatacctacgcgaatattaaattaacgcgaaacgtaacctaattaacaaactctaaaatactactataacgacgtccgcgaaactaaaacgaataaaaaccgaaaccgaacgcgaactaaaaaaaaaaaacgacgactaaaaaacgacgaac

SEQ ID NO: 28519 - DNA, 588 bp, Artificial Sequence
  chemically treated genomic DNA (Homo sapiens) CpG-island No: 28519
tttttaatagggtagttggagtgagtacggataattcgtgttgattttcggtttttttttatttttatattttttaagtttttgaggcgatttttcgttagttcgtttgttatttggcgtatttggttttataggttacgtttttaagttttttaagaggttagcggtaagcgcggtttattttttttttttattaggcgtcggttttacgtcgcgtttacgtttcgaggatagttttagttttttcgttttttggtttcgttttttcgttttttggtttcgttttttttagttttttagcgtcgtcggcgtcgagttcgagtttgcgtttgcgcgtgcgttttggggtttaagttggggcgcgtcgtggttagaatacggagagcggcgggtagtgtagttaatgggaggcggcgttgtttagcggttggtaggcggtgtttgcgcgggtgttaggttagcgcgaggcgtgatttagttgataggttttgaggtgttgttgtggcggcgttcgcggggttgaggcgggtgggagtcggagtcgagcgcgggttgagggaggagggcggcgattggagagcggcgagt

SEQ ID NO: 28520 - DNA, 588 bp, Artificial Sequence
  chemically treated genomic DNA (Homo sapiens) CpG-island No: 28520
actcgccgctctccaatcgccgccctcctccctcaacccgcgctcgactccgactcccacccgcctcaaccccgcgaacgccgccacaacaacacctcaaaacctatcaactaaatcacgcctcgcgctaacctaacacccgcgcaaacaccgcctaccaaccgctaaacaacgccgcctcccattaactacactacccgccgctctccgtattctaaccacgacgcgccccaacttaaaccccaaaacgcacgcgcaaacgcaaactcgaactcgacgccgacgacgctaaaaaactaaaaaaaacgaaaccaaaaaacgaaaaaacgaaaccaaaaaacgaaaaaactaaaactatcctcgaaacgtaaacgcgacgtaaaaccgacgcctaataaaaaaaaaaaataaaccgcgcttaccgctaacctcttaaaaaacttaaaaacgtaacctataaaaccaaatacgccaaataacaaacgaactaacgaaaaatcgcctcaaaaacttaaaaaatataaaaataaaaaaaaaccgaaaatcaacacgaattatccgtactcactccaactaccctattaaaaa

SEQ ID NO: 28521 - DNA, 727 bp, Artificial Sequence
  chemically treated genomic DNA (Homo sapiens) CpG-island No: 28521
  misc_feature (271)..(271): n is either a, c, g or t
agtgagggaataaggaggtttcgcgtgcggcgtttttagttattgcgcgtttcgcggagattgggtgttatcgttgttttcgttgttgagttttgttcgtcggtcggttcgttcgttagttcgttttttttcgtttagggggaaaggttagtagcgttttggagtcgtcgtgttatttttcgaaagttatgaattgtagcgagacgtagcgttgcgaatttttttgagtcggtttgttgttcgagttgtattatcggggaatgttagcgtnttgggcgttggttttcgtttagtatgggtatgggggtcgtgtttgattttttcgtgggtcgcgaggtgattagcgttaagggcgacgacgtttatttttatattttgtttattatgattttttacgtttgtttgtcggaggttttttttggtttatattcgtttcgtaagttcgtcgaggttaagacgagcgttttaggtttgcgtcgagtacgaatgggtttcgggaggcgtttgatcgtcgacgtcgaggcgtcgcgggtttttaggtcgaggtcgtcgttagtttgttttcgagggttgttttgttttcgtttagggcgttgagcgggtttaaaattatagttttagattgttggttcgcgttttttttatttcgtttatttttgggcgcgttttttattttttatttttaatttttttttagggttcgttttatttgaggtttagataatgg

SEQ ID NO: 28522 - DNA, 727 bp, Artificial Sequence
  chemically treated genomic DNA (Homo sapiens) CpG-island No: 28522
  misc_feature (457)..(457): n is either a, c, g or t
ccattatctaaacctcaaataaaacgaaccctaaaaaaaaattaaaaataaaaaataaaaaacgcgcccaaaaataaacgaaataaaaaaaacgcgaaccaacaatctaaaactataattttaaacccgctcaacgccctaaacgaaaacaaaacaaccctcgaaaacaaactaacgacgacctcgacctaaaaacccgcgacgcctcgacgtcgacgatcaaacgcctcccgaaacccattcgtactcgacgcaaacctaaaacgctcgtcttaacctcgacgaacttacgaaacgaatataaaccaaaaaaaacctccgacaaacaaacgtaaaaaatcataataaacaaaatataaaaataaacgtcgtcgcccttaacgctaatcacctcgcgacccacgaaaaaatcaaacacgacccccatacccatactaaacgaaaaccaacgcccaanacgctaacattccccgataatacaactcgaacaacaaaccgactcaaaaaaattcgcaacgctacgtctcgctacaattcataactttcgaaaaataacacgacgactccaaaacgctactaacctttccccctaaacgaaaaaaaacgaactaacgaacgaaccgaccgacgaacaaaactcaacaacgaaaacaacgataacacccaatctccgcgaaacgcgcaataactaaaaacgccgcacgcgaaacctccttattccctcact

SEQ ID NO: 28523 - DNA, 727 bp, Artificial Sequence
  chemically treated genomic DNA (Homo sapiens) CpG-island No: 28523
  misc_feature (457)..(457): n is either a, c, g or t
ttattatttgggttttagatgaggcgaattttggaagggagttgggggtggaaggtgggaggcgcgtttagggatgagcgagatgaggagggcgcgaattagtaatttggggttgtggttttagattcgtttagcgttttgggcgaaggtagggtagttttcggaggtaagttggcggcggtttcggtttgggagttcgcggcgtttcggcgtcggcggttaggcgtttttcggggtttattcgtgttcggcgtaagtttgggacgttcgttttggtttcgacgagtttacggagcgggtgtaggttaggagaggttttcggtaagtaggcgtagaagattatgatgagtaggatgtagagataggcgtcgtcgtttttggcgttggttatttcgcggtttacgaaaaggttaggtacgatttttatgtttatgttggacgaaggttagcgtttaangcgttggtatttttcggtggtgtagttcgagtaataggtcggtttagaagggttcgtagcgttgcgtttcgttgtagtttatggttttcggggagtgatacggcggttttaggacgttgttgatttttttttttgggcgaggggaagcgagttagcgagcgggtcggtcggcgggtagggtttagtagcggaaatagcggtagtatttagttttcgcggagcgcgtagtggttgggggcgtcgtacgcggggtttttttatttttttatt

SEQ ID NO: 28524 - DNA, 727 bp, Artificial Sequence
  chemically treated genomic DNA (Homo sapiens) CpG-island No: 28524
  misc_feature (271)..(271): n is either a, c, g or t
aataaaaaaataaaaaaaccccgcgtacgacgcccccaaccactacgcgctccgcgaaaactaaatactaccgctatttccgctactaaaccctacccgccgaccgacccgctcgctaactcgcttcccctcgcccaaaaaaaaaaatcaacaacgtcctaaaaccgccgtatcactccccgaaaaccataaactacaacgaaacgcaacgctacgaacccttctaaaccgacctattactcgaactacaccaccgaaaaataccaacgcnttaaacgctaaccttcgtccaacataaacataaaaatcgtacctaaccttttcgtaaaccgcgaaataaccaacgccaaaaacgacgacgcctatctctacatcctactcatcataatcttctacgcctacttaccgaaaacctctcctaacctacacccgctccgtaaactcgtcgaaaccaaaacgaacgtcccaaacttacgccgaacacgaataaaccccgaaaaacgcctaaccgccgacgccgaaacgccgcgaactcccaaaccgaaaccgccgccaacttacctccgaaaactaccctaccttcgcccaaaacgctaaacgaatctaaaaccacaaccccaaattactaattcgcgccctcctcatctcgctcatccctaaacgcgcctcccaccttccacccccaactcccttccaaaattcgcctcatctaaaacccaaataataa

SEQ ID NO: 28525 - DNA, 653 bp, Artificial Sequence
  chemically treated genomic DNA (Homo sapiens) CpG-island No: 28525
ggttgtcgaattacgggttttttatgttcgtcgcgcggttttgtggggtttgtagttcgcgacgcgcggttttgtggggtttgtagttcgcgacgcgcggttttgtggggtttgtagttcgcgacgcgcggttttgtggggtttgtagttcgcgacgcgcggttttgtggggtttgtagttcgcggtgggtaagagagggattcgttagttttcggcggtttatgcgcgtcgttcggttaggttcgtaaagaggttttcgagcgttatggttgcgttttcggttcgcgcggacgttgatttttcgtttacgtcgttatttacggttcgagatatattaggtcggtaggttgagaaaagcgagatcgcgtgcgaggatcggtaggcgtgggtttcgtttttattttattggcgagcgggaaggggttgtagattcggtcgagttgggcgggtggttcgttttcgtcgcgagtttaagttttttattttcggaggttaggcggcggcgtttcgtttttttacgtgtcgggtggaatttcgcgggtttgaagcggtcgggaggacggatttggtttaagtcggtaggtttttcggggttcggggaaggagttcgggtgcgtatttttagcgttgattttggtttttgttttcggtg

SEQ ID NO: 28526 - DNA, 653 bp, Artificial Sequence
  chemically treated genomic DNA (Homo sapiens) CpG-island No: 28526
caccgaaaacaaaaaccaaaatcaacgctaaaaatacgcacccgaactccttccccgaaccccgaaaaacctaccgacttaaaccaaatccgtcctcccgaccgcttcaaacccgcgaaattccacccgacacgtaaaaaaacgaaacgccgccgcctaacctccgaaaataaaaaacttaaactcgcgacgaaaacgaaccacccgcccaactcgaccgaatctacaaccccttcccgctcgccaataaaataaaaacgaaacccacgcctaccgatcctcgcacgcgatctcgcttttctcaacctaccgacctaatatatctcgaaccgtaaataacgacgtaaacgaaaaatcaacgtccgcgcgaaccgaaaacgcaaccataacgctcgaaaacctctttacgaacctaaccgaacgacgcgcataaaccgccgaaaactaacgaatccctctcttacccaccgcgaactacaaaccccacaaaaccgcgcgtcgcgaactacaaaccccacaaaaccgcgcgtcgcgaactacaaaccccacaaaaccgcgcgtcgcgaactacaaaccccacaaaaccgcgcgtcgcgaactacaaaccccacaaaaccgcgcgacgaacataaaaaacccgtaattcgacaacc

SEQ ID NO: 28527 - DNA, 653 bp, Artificial Sequence
  chemically treated genomic DNA (Homo sapiens) CpG-island No: 28527
tatcgggggtagagattaaggttaacgttgggggtgcgtattcggatttttttttcgagtttcgaggagtttgtcggtttgggttaggttcgttttttcggtcgttttaagttcgcggggttttattcggtacgtgggagaacggggcgtcgtcgtttggttttcgggagtgggggatttgggttcgcggcggggacggattattcgtttagttcggtcggatttgtagttttttttcgttcgttagtggagtggaggcgaggtttacgtttatcggttttcgtacgcggtttcgttttttttagtttgtcggtttggtgtgtttcgggtcgtaggtggcgacgtgggcgaaggattagcgttcgcgcgggtcgggggcgtagttatggcgttcggaggtttttttgcgggtttggtcgggcggcgcgtatgggtcgtcgggagttggcgggttttttttttgtttatcgcggattataagttttataaggtcgcgcgtcgcggattataagttttataaggtcgcgcgtcgcggattataagttttataaggtcgcgcgtcgcggattataagttttataaggtcgcgcgtcgcggattataagttttataaggtcgcgcggcgggtatgggggattcgtagttcggtagtt

SEQ ID NO: 28528 - DNA, 653 bp, Artificial Sequence
  chemically treated genomic DNA (Homo sapiens) CpG-island No: 28528
aactaccgaactacgaatcccccatacccgccgcgcgaccttataaaacttataatccgcgacgcgcgaccttataaaacttataatccgcgacgcgcgaccttataaaacttataatccgcgacgcgcgaccttataaaacttataatccgcgacgcgcgaccttataaaacttataatccgcgataaacaaaaaaaaaacccgccaactcccgacgacccatacgcgccgcccgaccaaacccgcaaaaaaacctccgaacgccataactacgcccccgacccgcgcgaacgctaatccttcgcccacgtcgccacctacgacccgaaacacaccaaaccgacaaactaaaaaaaacgaaaccgcgtacgaaaaccgataaacgtaaacctcgcctccactccactaacgaacgaaaaaaaactacaaatccgaccgaactaaacgaataatccgtccccgccgcgaacccaaatcccccactcccgaaaaccaaacgacgacgccccgttctcccacgtaccgaataaaaccccgcgaacttaaaacgaccgaaaaaacgaacctaacccaaaccgacaaactcctcgaaactcgaaaaaaaaatccgaatacgcacccccaacgttaaccttaatctctacccccgata

SEQ ID NO: 28529 - DNA, 585 bp, Artificial Sequence
  chemically treated genomic DNA (Homo sapiens) CpG-island No: 28529
ggagtcgtgtttaggggcgtacggacgtttttcgttttggcggatagttttggtgtacgtaggttcgcgcgtcgtcgatatatttcggagttttcggagcgcgttcggtatatagggttcggcggtaggtgtttcgtcgcgtatattcgcgggtcgcggggatcggttcgggcgcggggtcggttggggcggggcggggcggcggcgcgcgtttttcgtcggttatatcggtcgttttgtattcggcgaggggcgtgtgcgcgggtttggtattcgcgggttttatgtttatcgagttgaggtttaagttgagtttttcgcgtggtcgcgtcggggtcgtgcgcgcgggtttcggggagcgtcgggatgtggacggtgagcggggttggattggggagcggggatttttcgggcgggggttttagggatttagaggtacgggggcggggcgggattcggcgggtttcgagcggcggtggttgggggtattcggcggatgtttcggtttaacggggtttcgtagtttttgttttgttttagggggtagttagttttaggttttgggggttagcgcgtttttggttt

SEQ ID NO: 28530 - DNA, 585 bp, Artificial Sequence
  chemically treated genomic DNA (Homo sapiens) CpG-island No: 28530
aaaccaaaaacgcgctaacccccaaaacctaaaactaactaccccctaaaacaaaacaaaaactacgaaaccccgttaaaccgaaacatccgccgaatacccccaaccaccgccgctcgaaacccgccgaatcccgccccgcccccgtacctctaaatccctaaaacccccgcccgaaaaatccccgctccccaatccaaccccgctcaccgtccacatcccgacgctccccgaaacccgcgcgcacgaccccgacgcgaccacgcgaaaaactcaacttaaacctcaactcgataaacataaaacccgcgaataccaaacccgcgcacacgcccctcgccgaatacaaaacgaccgatataaccgacgaaaaacgcgcgccgccgccccgccccgccccaaccgaccccgcgcccgaaccgatccccgcgacccgcgaatatacgcgacgaaacacctaccgccgaaccctatataccgaacgcgctccgaaaactccgaaatatatcgacgacgcgcgaacctacgtacaccaaaactatccgccaaaacgaaaaacgtccgtacgcccctaaacacgactcc

SEQ ID NO: 28531 - DNA, 585 bp, Artificial Sequence
  chemically treated genomic DNA (Homo sapiens) CpG-island No: 28531
aagttaagggcgcgttgatttttaaggtttgaggttggttgttttttaaagtaggataaaggttacgggatttcgttgagtcgagatattcgtcgaatatttttagttatcgtcgttcgaagttcgtcgggtttcgtttcgttttcgtgtttttgggtttttgagattttcgttcgagaaattttcgttttttaatttagtttcgtttatcgtttatatttcggcgtttttcgaagttcgcgcgtacggtttcggcgcggttacgcggggggtttagtttggattttagttcggtgaatatggggttcgcgggtgttaggttcgcgtatacgtttttcgtcgagtgtagggcggtcggtgtggtcggcggggaacgcgcgtcgtcgtttcgtttcgttttagtcggtttcgcgttcgagtcggttttcgcggttcgcgagtgtgcgcgacgaggtatttgtcgtcgagttttgtgtgtcgggcgcgtttcgggagtttcgaggtgtgtcggcggcgcgcgggtttgcgtgtattaaggttgttcgttagggcgaggggcgttcgtgcgtttttgggtacggtttt

SEQ ID NO: 28532 - DNA, 585 bp, Artificial Sequence
  chemically treated genomic DNA (Homo sapiens) CpG-island No: 28532
aaaaccgtacccaaaaacgcacgaacgcccctcgccctaacgaacaaccttaatacacgcaaacccgcgcgccgccgacacacctcgaaactcccgaaacgcgcccgacacacaaaactcgacgacaaatacctcgtcgcgcacactcgcgaaccgcgaaaaccgactcgaacgcgaaaccgactaaaacgaaacgaaacgacgacgcgcgttccccgccgaccacaccgaccgccctacactcgacgaaaaacgtatacgcgaacctaacacccgcgaaccccatattcaccgaactaaaatccaaactaaaccccccgcgtaaccgcgccgaaaccgtacgcgcgaacttcgaaaaacgccgaaatataaacgataaacgaaactaaattaaaaaacgaaaatttctcgaacgaaaatctcaaaaacccaaaaacacgaaaacgaaacgaaacccgacgaacttcgaacgacgataactaaaaatattcgacgaatatctcgactcaacgaaatcccgtaacctttatcctactttaaaaaacaaccaacctcaaaccttaaaaatcaacgcgcccttaactt

SEQ ID NO: 28533 - DNA, 725 bp, Artificial Sequence
  chemically treated genomic DNA (Homo sapiens) CpG-island No: 28533
ttttcgtcgaattacgttttttttttttggttcgttcgtagtttcggtttattaggttgagtcgggtaaattaggacgggttaagcggtatttttattggatattattggtgggggcgggaagaaggcggagtacgtgttcgggcggaagtagtcgtcgtatcgcggattacgaaacgtcgcggagttgaggtagtttcgttggttagtgtgtacgcggcgagtttttttcggcgtcgttcgttcggtttttatagcgttcgcgatagcggttcggacgtcgttcgaatatggatttcgtcggttaaggtatttgtcgggttcggttttttcgtcgtagatgggtttaggttgttcgttgtttttcgtttttcggggtcgcgtttgcgattttttgttttttcggtttcggtttatttatttcgcggtttttttttagttttcggggttattgatttcgaagtttatgatggtcgtggtgtgttttttgttcgcggtttagatcgttttttgggttttttttagtcgtttttttggttttttttgggatcgtttcgaggtgtggttttttggcgttcgtcgttgttttcgtagtttgggttttgtcgtttttagtaggtttcgtttatgtcgtttatttcgtgttttgtttttgtttgttttgttatttttcggtttttgcgcggggttttcgggtttacgttgtttggttttggatttagttcg

SEQ ID NO: 28534 - DNA, 725 bp, Artificial Sequence
  chemically treated genomic DNA (Homo sapiens) CpG-island No: 28534
cgaactaaatccaaaaccaaacaacgtaaacccgaaaaccccgcgcaaaaaccgaaaaataacaaaacaaacaaaaacaaaacacgaaataaacgacataaacgaaacctactaaaaacgacaaaacccaaactacgaaaacaacgacgaacgccaaaaaaccacacctcgaaacgatcccaaaaaaaaccaaaaaaacgactaaaaaaaacccaaaaaacgatctaaaccgcgaacaaaaaacacaccacgaccatcataaacttcgaaatcaataaccccgaaaactaaaaaaaaaccgcgaaataaataaaccgaaaccgaaaaaacaaaaaatcgcaaacgcgaccccgaaaaacgaaaaacaacgaacaacctaaacccatctacgacgaaaaaaccgaacccgacaaataccttaaccgacgaaatccatattcgaacgacgtccgaaccgctatcgcgaacgctataaaaaccgaacgaacgacgccgaaaaaaactcgccgcgtacacactaaccaacgaaactacctcaactccgcgacgtttcgtaatccgcgatacgacgactacttccgcccgaacacgtactccgccttcttcccgcccccaccaataatatccaataaaaataccgcttaacccgtcctaatttacccgactcaacctaataaaccgaaactacgaacgaaccaaaaaaaaaaaacgtaattcgacgaaaa

SEQ ID NO: 28535 - DNA, 725 bp, Artificial Sequence
  chemically treated genomic DNA (Homo sapiens) CpG-island No: 28535
cggattgggtttagggttagatagcgtgaattcgagggtttcgcgtagggatcggggggtggtagagtaagtaagagtagggtacggggtgggcggtataagcgagatttgttgggagcgatagaatttaaattacgggagtaacggcgggcgttagggaattatatttcggaacggttttaggggagattaggagggcggttggagagagtttaggaagcggtttgggtcgcgggtaaaaaatatattacgattattataagtttcgaggttagtggtttcgggagttgaagaggggtcgcggggtgggtgaatcgagatcgagaggatagagagtcgtagacgcgatttcgggagacggagaataacgggtagtttgggtttatttgcggcgaaggggtcgggttcggtaggtattttggtcggcggagtttatgttcgggcggcgttcggatcgttgtcgcgggcgttatgggagtcgagcgggcggcgtcgggagaagttcgtcgcgtatatattagttagcggaattgttttagtttcgcggcgtttcgtaattcgcgatgcgacggttattttcgttcgggtacgtgtttcgtttttttttcgtttttattagtgatatttaatgagagtgtcgtttggttcgttttggtttattcgatttaatttgataggtcgaaattgcgggcgaattaggaaagggaggcgtggttcggcgggaa

SEQ ID NO: 28536 - DNA, 725 bp, Artificial Sequence
  chemically treated genomic DNA (Homo sapiens) CpG-island No: 28536
ttcccgccgaaccacgcctccctttcctaattcgcccgcaatttcgacctatcaaattaaatcgaataaaccaaaacgaaccaaacgacactctcattaaatatcactaataaaaacgaaaaaaaaacgaaacacgtacccgaacgaaaataaccgtcgcatcgcgaattacgaaacgccgcgaaactaaaacaattccgctaactaatatatacgcgacgaacttctcccgacgccgcccgctcgactcccataacgcccgcgacaacgatccgaacgccgcccgaacataaactccgccgaccaaaatacctaccgaacccgaccccttcgccgcaaataaacccaaactacccgttattctccgtctcccgaaatcgcgtctacgactctctatcctctcgatctcgattcacccaccccgcgacccctcttcaactcccgaaaccactaacctcgaaacttataataatcgtaatatattttttacccgcgacccaaaccgcttcctaaactctctccaaccgccctcctaatctcccctaaaaccgttccgaaatataattccctaacgcccgccgttactcccgtaatttaaattctatcgctcccaacaaatctcgcttataccgcccaccccgtaccctactcttacttactctaccaccccccgatccctacgcgaaaccctcgaattcacgctatctaaccctaaacccaatccg

SEQ ID NO: 28537 - DNA, 833 bp, Artificial Sequence
  chemically treated genomic DNA (Homo sapiens) CpG-island No: 28537
tttcggtttagcggttgggcgttagggttatcgtttatgtgcgttatttgtttcgtgaaggcgttggtgcgcgtgtttaagatttatttgatcgttagttatatttatttatttcgcggttggttcgtggtttttcgttgggatgacgtgcgcgtcgtgggtcggagtagtagttatcgggcgttgatttgcgcggtagtcgcggcgggcgtgtggttgttgcgggacgagacgttgggcggggatgcgttggggcggtttttacgtggggcgcgtagttaggcgtagtgttttttgtagtagtttcgcgagttgttcggttagttcgttagttacgcgttggtttattcgttgggtcgttggttcgtgtatttcggtttcgtgtttttgatgacgcgcgcgttgttgtcgttgttgtagtagggttaagagcgtttcgtggagcgttattacggtcggcgcgttaagttggtggtttgtgacggtaacgagatcgatattatgtttatggatcgtcgttagtattcgggtagttacgtgtacgggtcgcgtttcgttatttgttgcgaaggtaacgcgggtttttacgagatgggttgtttgtttgtatcgttcgaggtcggttatttcgtgttgggttggaattatttcggtttcggtagtagtattggcgtgttttttttttagtacgacgttaacgttatggacgtggtggtcgagtacgtattgtatcgtttgtatttttcgttcgcgtatttggtggtttacggttggtttgttggcggttttacggttatttgggttattatgatttattcggagttgggtgtatt

SEQ ID NO: 28538 - DNA, 833 bp, Artificial Sequence
  chemically treated genomic DNA (Homo sapiens) CpG-island No: 28538
aatacacccaactccgaataaatcataataacccaaataaccgtaaaaccgccaacaaaccaaccgtaaaccaccaaatacgcgaacgaaaaatacaaacgatacaatacgtactcgaccaccacgtccataacgttaacgtcgtactaaaaaaaaaacacgccaatactactaccgaaaccgaaataattccaacccaacacgaaataaccgacctcgaacgatacaaacaaacaacccatctcgtaaaaacccgcgttaccttcgcaacaaataacgaaacgcgacccgtacacgtaactacccgaatactaacgacgatccataaacataatatcgatctcgttaccgtcacaaaccaccaacttaacgcgccgaccgtaataacgctccacgaaacgctcttaaccctactacaacaacgacaacaacgcgcgcgtcatcaaaaacacgaaaccgaaatacacgaaccaacgacccaacgaataaaccaacgcgtaactaacgaactaaccgaacaactcgcgaaactactacaaaaaacactacgcctaactacgcgccccacgtaaaaaccgccccaacgcatccccgcccaacgtctcgtcccgcaacaaccacacgcccgccgcgactaccgcgcaaatcaacgcccgataactactactccgacccacgacgcgcacgtcatcccaacgaaaaaccacgaaccaaccgcgaaataaataaatataactaacgatcaaataaatcttaaacacgcgcaccaacgccttcacgaaacaaataacgcacataaacgataaccctaacgcccaaccgctaaaccgaaa

SEQ ID NO: 28539 - DNA, 833 bp, Artificial Sequence
  chemically treated genomic DNA (Homo sapiens) CpG-island No: 28539
agtgtatttagtttcgggtaggttatggtggtttaggtggtcgtgaagtcgttaatagattagtcgtagattattaggtgcgcgggcgggaagtgtaggcggtgtagtgcgtattcgattattacgtttatggcgttggcgtcgtgttgagggaagggtacgttagtgttgttgtcgaagtcggggtggttttagtttagtacggagtagtcggtttcgagcggtgtagatagatagtttatttcgtagaagttcgcgttgttttcgtagtagatgacgaggcgcggttcgtgtacgtggttgttcgggtgttggcggcggtttatgaatatagtgtcgatttcgttgtcgttataggttattagtttggcgcgtcggtcgtggtagcgttttacgaggcgtttttggttttgttgtagtagcggtagtagcgcgcgcgttattagggatacggagtcggggtatacgagttagcggtttagcgagtgggttagcgcgtagttagcgagttggtcgggtagttcgcggagttgttgtaagaggtattgcgtttggttgcgcgttttacgtggaggtcgttttagcgtattttcgtttagcgtttcgtttcgtagtaattatacgttcgtcgcggttgtcgcgtaggttagcgttcggtggttgttgtttcggtttacggcgcgtacgttattttagcggaaggttacgggttagtcgcggaatgggtaggtgtagttggcggttaggtagattttgaatacgcgtattagcgtttttacgaagtagatgacgtatatgagcggtggttttaacgtttagtcgttgggtcggga

SEQ ID NO: 28540 - DNA, 833 bp, Artificial Sequence
  chemically treated genomic DNA (Homo sapiens) CpG-island No: 28540
tcccgacccaacgactaaacgttaaaaccaccgctcatatacgtcatctacttcgtaaaaacgctaatacgcgtattcaaaatctacctaaccgccaactacacctacccattccgcgactaacccgtaaccttccgctaaaataacgtacgcgccgtaaaccgaaacaacaaccaccgaacgctaacctacgcgacaaccgcgacgaacgtataattactacgaaacgaaacgctaaacgaaaatacgctaaaacgacctccacgtaaaacgcgcaaccaaacgcaatacctcttacaacaactccgcgaactacccgaccaactcgctaactacgcgctaacccactcgctaaaccgctaactcgtataccccgactccgtatccctaataacgcgcgcgctactaccgctactacaacaaaaccaaaaacgcctcgtaaaacgctaccacgaccgacgcgccaaactaataacctataacgacaacgaaatcgacactatattcataaaccgccgccaacacccgaacaaccacgtacacgaaccgcgcctcgtcatctactacgaaaacaacgcgaacttctacgaaataaactatctatctacaccgctcgaaaccgactactccgtactaaactaaaaccaccccgacttcgacaacaacactaacgtacccttccctcaacacgacgccaacgccataaacgtaataatcgaatacgcactacaccgcctacacttcccgcccgcgcacctaataatctacgactaatctattaacgacttcacgaccacctaaaccaccataacctacccgaaactaaatacact

SEQ ID NO: 28541 - DNA, 830 bp, Artificial Sequence
  chemically treated genomic DNA (Homo sapiens) CpG-island No: 28541
  misc_feature (228)..(228): n is either a, c, g or t
tcgttgtcgagcgaagacgtatatttgttatagttttacgttcgtacgtttgcgttagtacgcgatacgtttattacgatcgtacgtgtatttacgcgtagcgcgcgtaggacgattatcgtacgtattgaagagtattgttattcgatcgattgcgtagatatattaattttatatatgcgttttatatagtacgtcgtatataggttacgttagcgcggtgtgttnttgcgaggggtacgttgtgtacgtttttattacgtacgtttttatcgttagtgcgtatttttcgttacgacgcgacgtagttcgcgtttatagcgtatagattttacgtaggcgaggttacggcggttgtttttagtttacgttcggtttttagtatattattattgaacgttaggtttgttgggttcgagcgttcgatcggcgagtcgttaagcggttgtgtttaacgcggtttaggatcgagttttcgtcgaagagttgcgaacgtttcgttttgtattaaataatattataatatcgtagcgtttttacgtatagttgattggcgttatttttagggatacgttttagagcgtatacgaggagaagtttttgagtaagcgttagacggaaagttttcgtagacgtaagcgttggtatattatgaaggtcgatttttggcgataaaagtattttcgcgtattagagaggcgtacgtcgttatacgttttcgtgttttttgttttcgacgtcggtttttttgtttaggacgtatagggtaaatgcgtaatgtgtttggtagtattaaatagtttgttttggtgtgagaggttagtaggttt

SEQ ID NO: 28542 - DNA, 830 bp, Artificial Sequence
  chemically treated genomic DNA (Homo sapiens) CpG-island No: 28542
  misc_feature (603)..(603): n is either a, c, g or t
aaacctactaacctctcacaccaaaacaaactatttaatactaccaaacacattacgcatttaccctatacgtcctaaacaaaaaaaccgacgtcgaaaacaaaaaacacgaaaacgtataacgacgtacgcctctctaatacgcgaaaatacttttatcgccaaaaatcgaccttcataatataccaacgcttacgtctacgaaaactttccgtctaacgcttactcaaaaacttctcctcgtatacgctctaaaacgtatccctaaaaataacgccaatcaactatacgtaaaaacgctacgatattataatattatttaatacaaaacgaaacgttcgcaactcttcgacgaaaactcgatcctaaaccgcgttaaacacaaccgcttaacgactcgccgatcgaacgctcgaacccaacaaacctaacgttcaataataatatactaaaaaccgaacgtaaactaaaaacaaccgccgtaacctcgcctacgtaaaatctatacgctataaacgcgaactacgtcgcgtcgtaacgaaaaatacgcactaacgataaaaacgtacgtaataaaaacgtacacaacgtacccctcgcaanaacacaccgcgctaacgtaacctatatacgacgtactatataaaacgcatatataaaattaatatatctacgcaatcgatcgaataacaatactcttcaatacgtacgataatcgtcctacgcgcgctacgcgtaaatacacgtacgatcgtaataaacgtatcgcgtactaacgcaaacgtacgaacgtaaaactataacaaatatacgtcttcgctcgacaacga

SEQ ID NO: 28543 - DNA, 830 bp, Artificial Sequence
  chemically treated genomic DNA (Homo sapiens) CpG-island No: 28543
  misc_feature (603)..(603): n is either a, c, g or t
gagtttgttggttttttatattagaatagattatttgatattattagatatattacgtatttgttttgtgcgttttgggtagagggatcggcgtcgaagatagaaggtacgggggcgtgtggcgacgtgcgtttttttggtgcgcggaggtgtttttgtcgttaggggtcgatttttatgatgtattagcgtttgcgtttgcggagatttttcgtttggcgtttgtttaggagttttttttcgtgtgcgttttggggcgtgtttttgggagtgacgttagttagttgtgcgtgaggacgttgcggtgttgtggtgttgtttggtataaaacgggacgttcgtaatttttcggcgggggttcgattttgggtcgcgttagatataatcgtttgacgattcgtcggtcggacgttcgggtttaataaatttggcgtttagtgatggtgtgttgaagatcgaacgtgggttgagaataatcgtcgtagtttcgtttgcgtgagatttgtgcgttgtggacgcgaattgcgtcgcgtcgtggcgagagatgcgtattggcgatgagagcgtgcgtgatgggggcgtgtatagcgtgtttttcgtagngatatatcgcgttggcgtagtttgtgtgcgacgtgttgtatggagcgtatgtgtggagttggtgtgtttacgtagtcggtcgagtagtagtgttttttagtgcgtgcggtgatcgttttgcgcgcgttgcgcgtgagtatacgtgcggtcgtgatgagcgtgtcgcgtgttgacgtagacgtacgagcgtaggattgtagtagatgtgcgttttcgttcggtagcgg

SEQ ID NO: 28544 - DNA, 830 bp, Artificial Sequence
  chemically treated genomic DNA (Homo sapiens) CpG-island No: 28544
  misc_feature (228)..(228): n is either a, c, g or t
ccgctaccgaacgaaaacgcacatctactacaatcctacgctcgtacgtctacgtcaacacgcgacacgctcatcacgaccgcacgtatactcacgcgcaacgcgcgcaaaacgatcaccgcacgcactaaaaaacactactactcgaccgactacgtaaacacaccaactccacacatacgctccatacaacacgtcgcacacaaactacgccaacgcgatatatcnctacgaaaaacacgctatacacgcccccatcacgcacgctctcatcgccaatacgcatctctcgccacgacgcgacgcaattcgcgtccacaacgcacaaatctcacgcaaacgaaactacgacgattattctcaacccacgttcgatcttcaacacaccatcactaaacgccaaatttattaaacccgaacgtccgaccgacgaatcgtcaaacgattatatctaacgcgacccaaaatcgaacccccgccgaaaaattacgaacgtcccgttttataccaaacaacaccacaacaccgcaacgtcctcacgcacaactaactaacgtcactcccaaaaacacgccccaaaacgcacacgaaaaaaaactcctaaacaaacgccaaacgaaaaatctccgcaaacgcaaacgctaatacatcataaaaatcgacccctaacgacaaaaacacctccgcgcaccaaaaaaacgcacgtcgccacacgcccccgtaccttctatcttcgacgccgatccctctacccaaaacgcacaaaacaaatacgtaatatatctaataatatcaaataatctattctaatataaaaaaccaacaaactc

SEQ ID NO: 28545 - DNA, 796 bp, Artificial Sequence
  chemically treated genomic DNA (Homo sapiens) CpG-island No: 28545
ttttcgagcgcgttagtgtttttgggagaggtttgtttgggtgagggattggacgtcggttttttcgtaagtcggtcggttgagggtgggggtcgaggcggggtcgggaatagttttcggattagggtttagataatttcgttcggcgtttgttttttcgcgcgtatttgtcgggttcgggggttgttagaagaggtcgtagttcgcgtttttcgggtttttacgtttcgtagcggcgttttttttttcggcggtacggattggttgcggcgtcgttttaagttcgtttcgcgttgtcggcggggggcgtcgcggattagagcgcgttgcgtcgttatcgtcgtcgttatcgtcgtcgtcgtcgtcgtcgttagtagtatagcgcgtttcgggtttcgcgcgtcgttagtttttggttcgttcgtcggtttcgtcgcgttcgttagtttcgtagcggagtttcggttcggtttcgggtcgtcgttattacgtcgcgcgtcgtatttcgcgttaagaatggggcggttaagttgtttaagtcgttcgtcgtcgtcgtcgtcgtcgcggtcgaggcgttcggcgtcggcgcgggtatggagcgttcgtagagtcgttttagtttgttcgtttttttcgaggcgttcgttatttatttttcgtgtatgaattttttcgacgacgaggacgtaggtaagcgcgcggttcgttttttagattttcggggtgtttcgggatttaggttcggtagtttttttttcgattcgtgcgtttttttttttatttttaattttttggg

SEQ ID NO: 28546 - DNA, 796 bp, Artificial Sequence
  chemically treated genomic DNA (Homo sapiens) CpG-island No: 28546
cccaaaaaattaaaaataaaaaaaaaaacgcacgaatcgaaaaaaaaactaccgaacctaaatcccgaaacaccccgaaaatctaaaaaacgaaccgcgcgcttacctacgtcctcgtcgtcgaaaaaattcatacacgaaaaataaataacgaacgcctcgaaaaaaacgaacaaactaaaacgactctacgaacgctccatacccgcgccgacgccgaacgcctcgaccgcgacgacgacgacgacgacgaacgacttaaacaacttaaccgccccattcttaacgcgaaatacgacgcgcgacgtaataacgacgacccgaaaccgaaccgaaactccgctacgaaactaacgaacgcgacgaaaccgacgaacgaaccaaaaactaacgacgcgcgaaacccgaaacgcgctatactactaacgacgacgacgacgacgacgataacgacgacgataacgacgcaacgcgctctaatccgcgacgccccccgccgacaacgcgaaacgaacttaaaacgacgccgcaaccaatccgtaccgccgaaaaaaaaaacgccgctacgaaacgtaaaaacccgaaaaacgcgaactacgacctcttctaacaacccccgaacccgacaaatacgcgcgaaaaaacaaacgccgaacgaaattatctaaaccctaatccgaaaactattcccgaccccgcctcgacccccaccctcaaccgaccgacttacgaaaaaaccgacgtccaatccctcacccaaacaaacctctcccaaaaacactaacgcgctcgaaaa

SEQ ID NO: 28547 - DNA, 796 bp, Artificial Sequence
  chemically treated genomic DNA (Homo sapiens) CpG-island No: 28547
tttaggggattgggggtggggaggagggcgtacgggtcggggagggggttatcggatttggatttcgggatatttcgggggtttggggggcgggtcgcgcgtttatttgcgttttcgtcgtcgaaggagtttatgtacgggaagtagatggcgagcgtttcgaaggaggcggatagattgaggcggttttgcgagcgttttatgttcgcgtcggcgtcgggcgtttcggtcgcggcggcggcggcggcggcgggcggtttgggtagtttggtcgttttatttttgacgcggagtacggcgcgcggcgtggtggcggcggttcggggtcgggtcgaggtttcgttgcggggttggcgggcgcggcggggtcggcgggcgggttaggagttggcggcgcgcggagttcgaggcgcgttgtgttgttggcggcggcggcggcggcggcggtggcggcggcggtggcggcgtagcgcgttttggttcgcggcgtttttcgtcggtagcgcgaggcgggtttggagcggcgtcgtagttaattcgtgtcgtcgggggagggggcgtcgttgcggggcgtgggagttcggagggcgcgggttgcggttttttttagtagttttcgggttcggtaggtgcgcgcggggaggtaggcgtcgggcgaggttgtttgggttttggttcgagggttgttttcgatttcgtttcggtttttatttttagtcggtcgatttgcggagaggtcggcgtttagttttttatttagataggttttttttagagatattggcgcgttcggagg

SEQ ID NO: 28548 - DNA, 796 bp, Artificial Sequence
  chemically treated genomic DNA (Homo sapiens) CpG-island No: 28548
cctccgaacgcgccaatatctctaaaaaaaacctatctaaataaaaaactaaacgccgacctctccgcaaatcgaccgactaaaaataaaaaccgaaacgaaatcgaaaacaaccctcgaaccaaaacccaaacaacctcgcccgacgcctacctccccgcgcgcacctaccgaacccgaaaactactaaaaaaaaccgcaacccgcgccctccgaactcccacgccccgcaacgacgccccctcccccgacgacacgaattaactacgacgccgctccaaacccgcctcgcgctaccgacgaaaaacgccgcgaaccaaaacgcgctacgccgccaccgccgccgccaccgccgccgccgccgccgccgccaacaacacaacgcgcctcgaactccgcgcgccgccaactcctaacccgcccgccgaccccgccgcgcccgccaaccccgcaacgaaacctcgacccgaccccgaaccgccgccaccacgccgcgcgccgtactccgcgtcaaaaataaaacgaccaaactacccaaaccgcccgccgccgccgccgccgccgcgaccgaaacgcccgacgccgacgcgaacataaaacgctcgcaaaaccgcctcaatctatccgcctccttcgaaacgctcgccatctacttcccgtacataaactccttcgacgacgaaaacgcaaataaacgcgcgacccgccccccaaacccccgaaatatcccgaaatccaaatccgataaccccctccccgacccgtacgccctcctccccacccccaatcccctaaa

SEQ ID NO: 28549 - DNA, 528 bp, Artificial Sequence
  chemically treated genomic DNA (Homo sapiens) CpG-island No: 28549
atcgatggtagtgatgacggtgatggcgaagtagaaggagtcggggaatttttattggcggtcggcgcggtggggtttagtttggagcgttaggcgttttagttcgcggtagttttcggtcgagaagtcgaatttttttcggagagcgtttcgtttttggattagtagtcgttggcggtcgtttttcgtttcggattcgagcgcgtcgaagatagtagcgtttattagtaggtaatatagggtgtataggattagttcggtcgcgcgtacgttcggttttcgtatggcgtttcggtttcggtattcgtcgcggttttaatttgtttcgtgtgttcggatcgcgcgtttcgttttttttaatttcggttttacgcggtagggttgtgacgggcgaggcggggcgattgtcgggaatttggaggttgggatcgttacgggtgggggtcggaagaatcgtttttttgttcgttttttattcgtttgttcggggtttatgtgtttgtgaatagtgagatttgaagtaaaggt

SEQ ID NO: 28550 - DNA, 528 bp, Artificial Sequence
  chemically treated genomic DNA (Homo sapiens) CpG-island No: 28550
acctttacttcaaatctcactattcacaaacacataaaccccgaacaaacgaataaaaaacgaacaaaaaaacgattcttccgacccccacccgtaacgatcccaacctccaaattcccgacaatcgccccgcctcgcccgtcacaaccctaccgcgtaaaaccgaaattaaaaaaaacgaaacgcgcgatccgaacacacgaaacaaattaaaaccgcgacgaataccgaaaccgaaacgccatacgaaaaccgaacgtacgcgcgaccgaactaatcctatacaccctatattacctactaataaacgctactatcttcgacgcgctcgaatccgaaacgaaaaacgaccgccaacgactactaatccaaaaacgaaacgctctccgaaaaaaattcgacttctcgaccgaaaactaccgcgaactaaaacgcctaacgctccaaactaaaccccaccgcgccgaccgccaataaaaattccccgactccttctacttcgccatcaccgtcatcactaccatcgat

SEQ ID NO: 28551 - DNA, 528 bp, Artificial Sequence
  chemically treated genomic DNA (Homo sapiens) CpG-island No: 28551
gtttttgttttagattttattatttatagatatatgaatttcgggtaggcgagtgggaggcggataggggagcggttttttcggtttttattcgtggcgattttagtttttaggttttcggtagtcgtttcgtttcgttcgttataattttgtcgcgtggggtcggggttggagggggcggagcgcgcggttcgggtatacggagtaggttgggatcgcggcgggtatcggggtcggggcgttatgcggaggtcgagcgtgcgcgcggtcgggttggttttgtgtattttgtgttatttgttggtgggcgttgttgttttcgacgcgttcgagttcgaggcggaaagcggtcgttagcgattgttggtttagaagcggggcgtttttcggaggaagttcggtttttcggtcgaggattatcgcgagttggagcgtttggcgttttaggttgagttttatcgcgtcggtcgttagtggaagtttttcggttttttttatttcgttattatcgttattattattatcggt

SEQ ID NO: 28552 - DNA, 528 bp, Artificial Sequence
  chemically treated genomic DNA (Homo sapiens) CpG-island No: 28552
accgataataataataacgataataacgaaataaaaaaaaccgaaaaacttccactaacgaccgacgcgataaaactcaacctaaaacgccaaacgctccaactcgcgataatcctcgaccgaaaaaccgaacttcctccgaaaaacgccccgcttctaaaccaacaatcgctaacgaccgctttccgcctcgaactcgaacgcgtcgaaaacaacaacgcccaccaacaaataacacaaaatacacaaaaccaacccgaccgcgcgcacgctcgacctccgcataacgccccgaccccgatacccgccgcgatcccaacctactccgtatacccgaaccgcgcgctccgccccctccaaccccgaccccacgcgacaaaattataacgaacgaaacgaaacgactaccgaaaacctaaaaactaaaatcgccacgaataaaaaccgaaaaaaccgctcccctatccgcctcccactcgcctacccgaaattcatatatctataaataataaaatctaaaacaaaaac

SEQ ID NO: 28553 - DNA, 1555 bp, Artificial Sequence
  chemically treated genomic DNA (Homo sapiens) CpG-island No: 28553
  misc_feature (16)..(16): n is either a, c, g or t
  misc_feature (23)..(23): n is either a, c, g or t
  misc_feature (28)..(28): n is either a, c, g or t
  misc_feature (81)..(81): n is either a, c, g or t
  misc_feature (95)..(96): n is either a, c, g or t
  misc_feature (112)..(112): n is either a, c, g or t
  misc_feature (119)..(119): n is either a, c, g or t
  misc_feature (161)..(161): n is either a, c, g or t
  misc_feature (180)..(180): n is either a, c, g or t
  misc_feature (205)..(205): n is either a, c, g or t
  misc_feature (231)..(231): n is either a, c, g or t
  misc_feature (234)..(234): n is either a, c, g or t
  misc_feature (236)..(236): n is either a, c, g or t
  misc_feature (273)..(273): n is either a, c, g or t
  misc_feature (291)..(291): n is either a, c, g or t
  misc_feature (307)..(307): n is either a, c, g or t
  misc_feature (346)..(346): n is either a, c, g or t
  misc_feature (375)..(375): n is either a, c, g or t
  misc_feature (385)..(385): n is either a, c, g or t
  misc_feature (446)..(446): n is either a, c, g or t
  misc_feature (463)..(463): n is either a, c, g or t
  misc_feature (516)..(516): n is either a, c, g or t
  misc_feature (521)..(521): n is either a, c, g or t
  misc_feature (523)..(523): n is either a, c, g or t
  misc_feature (577)..(577): n is either a, c, g or t
  misc_feature (640)..(640): n is either a, c, g or t
  misc_feature (648)..(648): n is either a, c, g or t
  misc_feature (657)..(657): n is either a, c, g or t
  misc_feature (704)..(704): n is either a, c, g or t
  misc_feature (769)..(769): n is either a, c, g or t
  misc_feature (774)..(774): n is either a, c, g or t
  misc_feature (809)..(809): n is either a, c, g or t
  misc_feature (937)..(937): n is either a, c, g or t
  misc_feature (988)..(988): n is either a, c, g or t
  misc_feature (991)..(991): n is either a, c, g or t
  misc_feature (995)..(995): n is either a, c, g or t
  misc_feature (1005)..(1005): n is either a, c, g or t
  misc_feature (1047)..(1047): n is either a, c, g or t
  misc_feature (1068)..(1068): n is either a, c, g or t
  misc_feature (1088)..(1088): n is either a, c, g or t
  misc_feature (1121)..(1121): n is either a, c, g or t
  misc_feature (1126)..(1126): n is either a, c, g or t
  misc_feature (1281)..(1281): n is either a, c, g or t
  misc_feature (1313)..(1313): n is either a, c, g or t
acgtacgttacgtaanagcgttngagancgttcgtacggacgacgagttacgtaagcgcgtagagcgtattatcgtatcgngatagtagcgtaannacgatcgtatcgtagncgtagtngataagacggacgagtcgagtaataatcgtatatatataggnataatagacgagagagtantaggcgacgtattaacgatttattntagcgaaagacggagtaggacgatanatnanatagacgcgttacgaagcggtaaattatacggggagngagcggaggaggattagnatagttacgtatattntcgcgtaatcgagagatagagagacgcgagcgagcgggntatacgcgttttaattatttcgagagganttagacgttnacgacgaatagtatttatagagtagcgttagtacgcgttacgttaacgttattataagagncgagtagtaggtaagtnatagggataatatagtagaggtacgttagcgacgagttacggaaggattaagnacganangattatattataggattcgacgcgcgcgatattgcgtattataagtagttattnatataacgacgtaacggtgtatagacgaagagacgaagtagtaatagtaacgtatatacgaancgtcgatnatagcgagngacgttagtcgtagcgatttacgcgtcgttatattatagtatattanttatagatcgacggtcgattacgcgcgaagcgatatagatagcgagcgagattacgttatagtangacgngagacgaaatatattatcgtaatagcgtagcgttntattacgacgagttgcgcgtagtaacgtatcgaatacggcgttagtagttagtagacgattacgaggagagtatcgcggagtttaacgagtacgagtatagacgatcgtagtcgagcggagacgttantgagacgtatagtatagaatagagagaacgcgacgagataagtatagcgtnagngtangcgcggatantatacggtatagcggtagagcggacgtaagaatcgaatacgntacgacgcgatataacggatncgttacgtatagatagtaantatagattaagaacgtagataaacgagacgagnatatngcgcgtacgcgatacgcgatacgttatatatttacgtttattcgcgcgacgagacgttagtacggtacgaataacggttagtaatcgtatagtacgtcggcgagtaatatcgtacgtttaggtagtatcgacgagacgcgtatagacgagacgtntagagtacgtaacgcgcgatattatatcggtnaggcgaacgaagattcgtcgtagcggacgcgggataacgataacgcgcgagacgtatagttcgagtagatcgacgcggggcgagtagagtcgatcgggtagtatacgattatcgcggggaattttatttaggtatcgttagacgacgttattcgtaataatttatacgaatacgatttttacggttaacgttatcgacgatttaattcgattaatataatagtagagagatagtcgattatt

SEQ ID NO: 28554 - DNA, 1555 bp, Artificial Sequence
  chemically treated genomic DNA (Homo sapiens) CpG-island No: 28554
  misc_feature (243)..(243): n is either a, c, g or t
  misc_feature (275)..(275): n is either a, c, g or t
  misc_feature (430)..(430): n is either a, c, g or t
  misc_feature (435)..(435): n is either a, c, g or t
  misc_feature (468)..(468): n is either a, c, g or t
  misc_feature (488)..(488): n is either a, c, g or t
  misc_feature (509)..(509): n is either a, c, g or t
  misc_feature (551)..(551): n is either a, c, g or t
  misc_feature (561)..(561): n is either a, c, g or t
  misc_feature (565)..(565): n is either a, c, g or t
  misc_feature (568)..(568): n is either a, c, g or t
  misc_feature (619)..(619): n is either a, c, g or t
  misc_feature (747)..(747): n is either a, c, g or t
  misc_feature (782)..(782): n is either a, c, g or t
  misc_feature (787)..(787): n is either a, c, g or t
  misc_feature (852)..(852): n is either a, c, g or t
  misc_feature (899)..(899): n is either a, c, g or t
  misc_feature (908)..(908): n is either a, c, g or t
  misc_feature (916)..(916): n is either a, c, g or t
  misc_feature (979)..(979): n is either a, c, g or t
  misc_feature (1033)..(1033): n is either a, c, g or t
  misc_feature (1035)..(1035): n is either a, c, g or t
  misc_feature (1040)..(1040): n is either a, c, g or t
  misc_feature (1093)..(1093): n is either a, c, g or t
  misc_feature (1110)..(1110): n is either a, c, g or t
  misc_feature (1171)..(1171): n is either a, c, g or t
  misc_feature (1181)..(1181): n is either a, c, g or t
  misc_feature (1210)..(1210): n is either a, c, g or t
  misc_feature (1249)..(1249): n is either a, c, g or t
  misc_feature (1265)..(1265): n is either a, c, g or t
  misc_feature (1283)..(1283): n is either a, c, g or t
  misc_feature (1320)..(1320): n is either a, c, g or t
  misc_feature (1322)..(1322): n is either a, c, g or t
  misc_feature (1325)..(1325): n is either a, c, g or t
  misc_feature (1351)..(1351): n is either a, c, g or t
  misc_feature (1376)..(1376): n is either a, c, g or t
  misc_feature (1395)..(1395): n is either a, c, g or t
  misc_feature (1437)..(1437): n is either a, c, g or t
  misc_feature (1444)..(1444): n is either a, c, g or t
  misc_feature (1460)..(1461): n is either a, c, g or t
  misc_feature (1475)..(1475): n is either a, c, g or t
  misc_feature (1528)..(1528): n is either a, c, g or t
  misc_feature (1533)..(1533): n is either a, c, g or t
  misc_feature (1540)..(1540): n is either a, c, g or t
aataatcgactatctctctactattatattaatcgaattaaatcgtcgataacgttaaccgtaaaaatcgtattcgtataaattattacgaataacgtcgtctaacgatacctaaataaaattccccgcgataatcgtatactacccgatcgactctactcgccccgcgtcgatctactcgaactatacgtctcgcgcgttatcgttatcccgcgtccgctacgacgaatcttcgttcgcctnaccgatataatatcgcgcgttacgtactctanacgtctcgtctatacgcgtctcgtcgatactacctaaacgtacgatattactcgccgacgtactatacgattactaaccgttattcgtaccgtactaacgtctcgtcgcgcgaataaacgtaaatatataacgtatcgcgtatcgcgtacgcgcnatatnctcgtctcgtttatctacgttcttaatctatanttactatctatacgtaacgnatccgttatatcgcgtcgtancgtattcgattcttacgtccgctctaccgctataccgtatantatccgcgcntacnctnacgctatacttatctcgtcgcgttctctctattctatactatacgtctcantaacgtctccgctcgactacgatcgtctatactcgtactcgttaaactccgcgatactctcctcgtaatcgtctactaactactaacgccgtattcgatacgttactacgcgcaactcgtcgtaatanaacgctacgctattacgataatatatttcgtctcncgtcntactataacgtaatctcgctcgctatctatatcgcttcgcgcgtaatcgaccgtcgatctataantaatatactataatataacgacgcgtaaatcgctacgactaacgtcnctcgctatnatcgacgnttcgtatatacgttactattactacttcgtctcttcgtctatacaccgttacgtcgttatatnaataactacttataatacgcaatatcgcgcgcgtcgaatcctataatataatcntntcgtncttaatccttccgtaactcgtcgctaacgtacctctactatattatccctatnacttacctactactcgnctcttataataacgttaacgtaacgcgtactaacgctactctataaatactattcgtcgtnaacgtctaantcctctcgaaataattaaaacgcgtatancccgctcgctcgcgtctctctatctctcgattacgcganaatatacgtaactatnctaatcctcctccgctcnctccccgtataatttaccgcttcgtaacgcgtctatntnatntatcgtcctactccgtctttcgctanaataaatcgttaatacgtcgcctantactctctcgtctattatncctatatatatacgattattactcgactcgtccgtcttatcnactacgnctacgatacgatcgtnnttacgctactatcncgatacgataatacgctctacgcgcttacgtaactcgtcgtccgtacgaacgntctcnaacgctnttacgtaacgtacgt

SEQ ID NO: 28555 - DNA, 1555 bp, Artificial Sequence
  chemically treated genomic DNA (Homo sapiens) CpG-island No: 28555
  misc_feature (243)..(243): n is either a, c, g or t
  misc_feature (275)..(275): n is either a, c, g or t
  misc_feature (430)..(430): n is either a, c, g or t
  misc_feature (435)..(435): n is either a, c, g or t
  misc_feature (468)..(468): n is either a, c, g or t
  misc_feature (488)..(488): n is either a, c, g or t
  misc_feature (509)..(509): n is either a, c, g or t
  misc_feature (551)..(551): n is either a, c, g or t
  misc_feature (561)..(561): n is either a, c, g or t
  misc_feature (565)..(565): n is either a, c, g or t
  misc_feature (568)..(568): n is either a, c, g or t
  misc_feature (619)..(619): n is either a, c, g or t
  misc_feature (747)..(747): n is either a, c, g or t
  misc_feature (782)..(782): n is either a, c, g or t
  misc_feature (787)..(787): n is either a, c, g or t
  misc_feature (852)..(852): n is either a, c, g or t
  misc_feature (899)..(899): n is either a, c, g or t
  misc_feature (908)..(908): n is either a, c, g or t
  misc_feature (916)..(916): n is either a, c, g or t
  misc_feature (979)..(979): n is either a, c, g or t
  misc_feature (1033)..(1033): n is either a, c, g or t
  misc_feature (1035)..(1035): n is either a, c, g or t
  misc_feature (1040)..(1040): n is either a, c, g or t
  misc_feature (1093)..(1093): n is either a, c, g or t
  misc_feature (1110)..(1110): n is either a, c, g or t
  misc_feature (1171)..(1171): n is either a, c, g or t
  misc_feature (1181)..(1181): n is either a, c, g or t
  misc_feature (1210)..(1210): n is either a, c, g or t
  misc_feature (1249)..(1249): n is either a, c, g or t
  misc_feature (1265)..(1265): n is either a, c, g or t
  misc_feature (1283)..(1283): n is either a, c, g or t
  misc_feature (1320)..(1320): n is either a, c, g or t
  misc_feature (1322)..(1322): n is either a, c, g or t
  misc_feature (1325)..(1325): n is either a, c, g or t
  misc_feature (1351)..(1351): n is either a, c, g or t
  misc_feature (1376)..(1376): n is either a, c, g or t
  misc_feature (1395)..(1395): n is either a, c, g or t
  misc_feature (1437)..(1437): n is either a, c, g or t
  misc_feature (1444)..(1444): n is either a, c, g or t
  misc_feature (1460)..(1461): n is either a, c, g or t
  misc_feature (1475)..(1475): n is either a, c, g or t
  misc_feature (1528)..(1528): n is either a, c, g or t
  misc_feature (1533)..(1533): n is either a, c, g or t
  misc_feature (1540)..(1540): n is either a, c, g or t
ggtggtcggttgtttttttgttattgtgttagtcgggttgggtcgtcggtggcgttggtcgtgggggtcgtgttcgtgtgggttgttgcgggtggcgtcgtttggcggtgtttgggtggggtttttcgcggtggtcgtgtgttgttcggtcggttttgttcgtttcgcgtcggtttgttcgggttgtgcgtttcgcgcgttgtcgttgtttcgcgttcgttgcgacggattttcgttcgtttngtcgatgtggtgtcgcgcgttgcgtattttgngcgtttcgtttgtgcgcgtttcgtcggtgttgtttgggcgtgcggtgttgttcgtcggcgtgttgtgcggttgttgatcgttgttcgtgtcgtgttggcgtttcgtcgcgcgggtgagcgtgggtgtgtagcgtgtcgcgtgtcgcgtgcgcgtngtgtnttcgtttcgtttgtttgcgtttttgatttgtgnttgttatttgtgcgtagcgngttcgttgtatcgcgtcgtgncgtgttcggtttttgcgttcgttttgtcgttgtgtcgtgtgntgttcgcgtntgtnttngcgttgtgtttgtttcgtcgcgttttttttgttttatgttgtgcgttttantggcgttttcgttcggttgcggtcgtttgtgttcgtgttcgttgagtttcgcggtgtttttttcgtggtcgtttgttggttgttggcgtcgtattcggtgcgttgttgcgcgtagttcgtcgtggtgnggcgttgcgttgttgcggtggtgtgtttcgttttncgttntgttgtggcgtggtttcgttcgttgtttgtgtcgtttcgcgcgtagtcggtcgtcgatttgtggntagtgtgttgtggtgtggcggcgcgtgagtcgttacggttgacgttnttcgttgtngtcggcgnttcgtgtatgcgttgttgttgttgtttcgttttttcgtttgtgtatcgttgcgtcgttgtgtnggtggttgtttgtggtgcgtagtatcgcgcgcgtcgggttttgtggtgtggttntntcgtntttggttttttcgtggttcgtcgttggcgtgtttttgttgtgttgtttttgtngtttgtttgttgttcgntttttgtggtggcgttggcgtggcgcgtgttggcgttgttttgtgggtgttgttcgtcgtnggcgtttggnttttttcggggtggttggggcgcgtgtgnttcgttcgttcgcgtttttttgtttttcggttgcgcggnggtgtgcgtggttgtnttggttttttttcgtttntttttcgtgtggtttgtcgtttcgtggcgcgtttgtntngtntgtcgttttgtttcgtttttcgttgnggtgggtcgttggtgcgtcgtttgntgttttttcgtttgttgtntttgtgtgtgtgcggttgttgttcggttcgttcgttttgttngttgcgnttgcggtgcggtcgtnnttgcgttgttgttncggtgcggtggtgcgttttgcgcgtttgcgtggttcgtcgttcgtgcgggcgnttttnggcgttnttgcgtggcgtgcgt

SEQ ID NO: 28556 - DNA, 1555 bp, Artificial Sequence
  chemically treated genomic DNA (Homo sapiens) CpG-island No: 28556
  misc_feature (16)..(16): n is either a, c, g or t
  misc_feature (23)..(23): n is either a, c, g or t
  misc_feature (28)..(28): n is either a, c, g or t
  misc_feature (81)..(81): n is either a, c, g or t
  misc_feature (95)..(96): n is either a, c, g or t
  misc_feature (112)..(112): n is either a, c, g or t
  misc_feature (119)..(119): n is either a, c, g or t
  misc_feature (161)..(161): n is either a, c, g or t
  misc_feature (180)..(180): n is either a, c, g or t
  misc_feature (205)..(205): n is either a, c, g or t
  misc_feature (231)..(231): n is either a, c, g or t
  misc_feature (234)..(234): n is either a, c, g or t
  misc_feature (236)..(236): n is either a, c, g or t
  misc_feature (273)..(273): n is either a, c, g or t
  misc_feature (291)..(291): n is either a, c, g or t
  misc_feature (307)..(307): n is either a, c, g or t
  misc_feature (346)..(346): n is either a, c, g or t
  misc_feature (375)..(375): n is either a, c, g or t
  misc_feature (385)..(385): n is either a, c, g or t
  misc_feature (446)..(446): n is either a, c, g or t
  misc_feature (463)..(463): n is either a, c, g or t
  misc_feature (516)..(516): n is either a, c, g or t
  misc_feature (521)..(521): n is either a, c, g or t
  misc_feature (523)..(523): n is either a, c, g or t
  misc_feature (577)..(577): n is either a, c, g or t
  misc_feature (640)..(640): n is either a, c, g or t
  misc_feature (648)..(648): n is either a, c, g or t
  misc_feature (657)..(657): n is either a, c, g or t
  misc_feature (704)..(704): n is either a, c, g or t
  misc_feature (769)..(769): n is either a, c, g or t
  misc_feature (774)..(774): n is either a, c, g or t
  misc_feature (809)..(809): n is either a, c, g or t
  misc_feature (937)..(937): n is either a, c, g or t
  misc_feature (988)..(988): n is either a, c, g or t
  misc_feature (991)..(991): n is either a, c, g or t
  misc_feature (995)..(995): n is either a, c, g or t
  misc_feature (1005)..(1005): n is either a, c, g or t
  misc_feature (1047)..(1047): n is either a, c, g or t
  misc_feature (1068)..(1068): n is either a, c, g or t
  misc_feature (1088)..(1088): n is either a, c, g or t
  misc_feature (1121)..(1121): n is either a, c, g or t
  misc_feature (1126)..(1126): n is either a, c, g or t
  misc_feature (1281)..(1281): n is either a, c, g or t
  misc_feature (1313)..(1313): n is either a, c, g or t
acgcacgccacgcaanaacgccnaaaancgcccgcacgaacgacgaaccacgcaaacgcgcaaaacgcaccaccgcaccgnaacaacaacgcaannacgaccgcaccgcaancgcaacnaacaaaacgaacgaaccgaacaacaaccgcacacacacaaanacaacaaacgaaaaaacancaaacgacgcaccaacgacccaccncaacgaaaaacgaaacaaaacgacanacnanacaaacgcgccacgaaacgacaaaccacacgaaaaanaaacgaaaaaaaaccaanacaaccacgcacaccnccgcgcaaccgaaaaacaaaaaaacgcgaacgaacgaancacacgcgccccaaccaccccgaaaaaanccaaacgccnacgacgaacaacacccacaaaacaacgccaacacgcgccacgccaacgccaccacaaaaancgaacaacaaacaaacnacaaaaacaacacaacaaaaacacgccaacgacgaaccacgaaaaaaccaaanacgananaaccacaccacaaaacccgacgcgcgcgatactacgcaccacaaacaaccaccnacacaacgacgcaacgatacacaaacgaaaaaacgaaacaacaacaacaacgcatacacgaancgccgacnacaacgaanaacgtcaaccgtaacgactcacgcgccgccacaccacaacacactanccacaaatcgacgaccgactacgcgcgaaacgacacaaacaacgaacgaaaccacgccacaacanaacgnaaaacgaaacacaccaccgcaacaacgcaacgccncaccacgacgaactacgcgcaacaacgcaccgaatacgacgccaacaaccaacaaacgaccacgaaaaaaacaccgcgaaactcaacgaacacgaacacaaacgaccgcaaccgaacgaaaacgccantaaaacgcacaacataaaacaaaaaaaacgcgacgaaacaaacacaacgcnaanacanacgcgaacancacacgacacaacgacaaaacgaacgcaaaaaccgaacacgncacgacgcgatacaacgaacncgctacgcacaaataacaancacaaatcaaaaacgcaaacaaacgaaacgaanacacnacgcgcacgcgacacgcgacacgctacacacccacgctcacccgcgcgacgaaacgccaacacgacacgaacaacgatcaacaaccgcacaacacgccgacgaacaacaccgcacgcccaaacaacaccgacgaaacgcgcacaaacgaaacgcncaaaatacgcaacgcgcgacaccacatcgacnaaacgaacgaaaatccgtcgcaacgaacgcgaaacaacgacaacgcgcgaaacgcacaacccgaacaaaccgacgcgaaacgaacaaaaccgaccgaacaacacacgaccaccgcgaaaaaccccacccaaacaccgccaaacgacgccacccgcaacaacccacacgaacacgacccccacgaccaacgccaccgacgacccaacccgactaacacaataacaaaaaaacaaccgaccacc

SEQ ID NO: 28557 - DNA, 1042 bp, Artificial Sequence
  chemically treated genomic DNA (Homo sapiens) CpG-island No: 28557
  misc_feature (497)..(497): n is either a, c, g or t
  misc_feature (892)..(892): n is either a, c, g or t
gattcgatttgttattcgtttttttttttattacgttattttattcgttttttattcgttttatcgtgttttttttttattatatttttttatgtattgcggcggtatttttttttttgttaattacgttcgttcgacgacgtcgcgattttttattgtcgaggtcgtttcgcgattcgcgtgtttgataatttcgttttttattttttacgtttcgtgttacgcgtatattcgcgcgtacgcgacgttttcgcgtgttcgtgatgtatttttatttcgtttacgatacgtttttcgcgtcgttttatgtttttttttatttttatcgttgtttttttgttcgttatttcggcgtttattttagtcgattttttattcgtacgatgcgttcgttcgcgcgcgttagtcgacgttcgcgacggttttgtttttcgtattttttatacgtttcgttttttcgtttgtatcgttttattatattacgcgtgattgtattnttatcgtacgttttattttacgttatcgacggcgtatatttgtttcgacgttgtcgcgtatatttcgtttttttttatgttattattttttgttttttttattcgtatgttttttttttgtatttcgtgtttttatagttttattcgattttcgattttattttttcgtcgttgcggatttacgacgtttcgttttatacgtttggtcgttttatttattttttatcgtattattttattttttttcgtattatattatttttattattcgtattcgatcgattattatgatttattagacgatacgtacgtgttcgttcgcgtcgttattcgtatatttatttttatgacggattattgttcgtattatttcggttttgcgattcgtgttattngagttcgtttatttcgttataggttgtatttgttagtgttgacgatagtattgtcgatcgtattttgatacgttacgatagatacgttacgacgattattatcgttcgtatcgtatatgtttcgttgtattcgattcgttttgttttcga

SEQ ID NO: 28558 - DNA, 1042 bp, Artificial Sequence
  chemically treated genomic DNA (Homo sapiens) CpG-island No: 28558
  misc_feature (151)..(151): n is either a, c, g or t
  misc_feature (546)..(546): n is either a, c, g or t
tcgaaaacaaaacgaatcgaatacaacgaaacatatacgatacgaacgataataatcgtcgtaacgtatctatcgtaacgtatcaaaatacgatcgacaatactatcgtcaacactaacaaatacaacctataacgaaataaacgaactcnaataacacgaatcgcaaaaccgaaataatacgaacaataatccgtcataaaaataaatatacgaataacgacgcgaacgaacacgtacgtatcgtctaataaatcataataatcgatcgaatacgaataataaaaataatataatacgaaaaaaaataaaataatacgataaaaaataaataaaacgaccaaacgtataaaacgaaacgtcgtaaatccgcaacgacgaaaaaataaaatcgaaaatcgaataaaactataaaaacacgaaatacaaaaaaaaaacatacgaataaaaaaaacaaaaaataataacataaaaaaaaacgaaatatacgcgacaacgtcgaaacaaatatacgccgtcgataacgtaaaataaaacgtacgataanaatacaatcacgcgtaatataataaaacgatacaaacgaaaaaacgaaacgtataaaaaatacgaaaaacaaaaccgtcgcgaacgtcgactaacgcgcgcgaacgaacgcatcgtacgaataaaaaatcgactaaaataaacgccgaaataacgaacaaaaaaacaacgataaaaataaaaaaaaacataaaacgacgcgaaaaacgtatcgtaaacgaaataaaaatacatcacgaacacgcgaaaacgtcgcgtacgcgcgaatatacgcgtaacacgaaacgtaaaaaataaaaaacgaaattatcaaacacgcgaatcgcgaaacgacctcgacaataaaaaatcgcgacgtcgtcgaacgaacgtaattaacaaaaaaaaaaataccgccgcaatacataaaaaaatataataaaaaaaaaacacgataaaacgaataaaaaacgaataaaataacgtaataaaaaaaaaaacgaataacaaatcgaatc

SEQ ID NO: 28559 - DNA, 1042 bp, Artificial Sequence
  chemically treated genomic DNA (Homo sapiens) CpG-island No: 28559
  misc_feature (151)..(151): n is either a, c, g or t
  misc_feature (546)..(546): n is either a, c, g or t
tcgagagtagagcgagtcggatgtagcgaagtatgtacggtacggacggtgatggtcgtcgtagcgtgtttgtcgtagcgtattagagtacgatcggtagtgttgtcgttagtattgatagatgtagtttatgacgaggtagacgggtttnagtaatacgagtcgtagaatcgagatgatgcgagtagtagttcgttatgaggatgagtgtacggatggcggcgcggacgagtacgtgcgtatcgtttggtgagttatagtagtcgatcgagtacgaatgatgagagtgatgtagtgcgagagaggatgaggtgatacggtagggagtgagtgaggcgattaggcgtgtgagacgagacgtcgtagattcgtagcgacgagagagtgaggtcgagagtcgagtgagattgtaggagtacggagtgtaggaaggagatatgcgagtagagagagtaggaggtgatagtatgagaggagacggagtgtgcgcgatagcgtcgaggtaggtatgcgtcgtcgatgacgtgaggtagagcgtgcgatggnagtgtagttacgcgtgatgtagtgagacgatgtaggcgagggagcgagacgtgtgagagatgcgaggagtagggtcgtcgcgagcgtcggttggcgcgcgcgagcgagcgtatcgtgcgggtaggaggtcggttgagatgagcgtcgaggtgacgagtaggaggatagcgatagagatgagagagagtatgagacggcgcgaggagcgtgtcgtagacgagatgaggatgtattacgagtacgcggagacgtcgcgtacgcgcggatgtacgcgtagtacgagacgtgagagatagaggacgaggttgttaagtacgcgagtcgcggagcggtttcggtagtagagagtcgcggcgtcgtcgaacgagcgtggttggtagaggaaggggtgtcgtcgtagtgtatggagagatgtggtgagggggaggtacggtgagacgggtgagaggcggatgaagtagcgtgatggaaggagagacgagtagtaggtcggatt

SEQ ID NO: 28560 - DNA, 1042 bp, Artificial Sequence
  chemically treated genomic DNA (Homo sapiens) CpG-island No: 28560
  misc_feature (497)..(497): n is either a, c, g or t
  misc_feature (892)..(892): n is either a, c, g or t
aatccgacctactactcgtctctccttccatcacgctacttcatccgcctctcacccgtctcaccgtacctccccctcaccacatctctccatacactacgacgacaccccttcctctaccaaccacgctcgttcgacgacgccgcgactctctactaccgaaaccgctccgcgactcgcgtacttaacaacctcgtcctctatctctcacgtctcgtactacgcgtacatccgcgcgtacgcgacgtctccgcgtactcgtaatacatcctcatctcgtctacgacacgctcctcgcgccgtctcatactctctctcatctctatcgctatcctcctactcgtcacctcgacgctcatctcaaccgacctcctacccgcacgatacgctcgctcgcgcgcgccaaccgacgctcgcgacgaccctactcctcgcatctctcacacgtctcgctccctcgcctacatcgtctcactacatcacgcgtaactacactnccatcgcacgctctacctcacgtcatcgacgacgcatacctacctcgacgctatcgcgcacactccgtctcctctcatactatcacctcctactctctctactcgcatatctccttcctacactccgtactcctacaatctcactcgactctcgacctcactctctcgtcgctacgaatctacgacgtctcgtctcacacgcctaatcgcctcactcactccctaccgtatcacctcatcctctctcgcactacatcactctcatcattcgtactcgatcgactactataactcaccaaacgatacgcacgtactcgtccgcgccgccatccgtacactcatcctcataacgaactactactcgcatcatctcgattctacgactcgtattactnaaacccgtctacctcgtcataaactacatctatcaatactaacgacaacactaccgatcgtactctaatacgctacgacaaacacgctacgacgaccatcaccgtccgtaccgtacatacttcgctacatccgactcgctctactctcga

SEQ ID NO: 28561 - DNA, 749 bp, Artificial Sequence
  chemically treated genomic DNA (Homo sapiens) CpG-island No: 28561
cgggtagtggttacgttcgttcgtcgggggttaggttttcgtatcgaggtggcggtaggggcggtggcggcggggattcggcggcgtttttagttcgcggcggcggcggtggcgggaaggcgcggttttttggcggcggcgcggttttttgcgagttcgggtgttagtgtcgcgcgtttatggtgagcgtgtttagcgagcgttattcgttttataatcgcgttaagataggttagatcgttaattgcgcgttgttttgttataattttttttttagttaggacgagcgcgtttttatcgttttttggatcggtttgtggtcggtgttttgtttcgtgtttattttcgttatcgtttttattttttttatcgatatggagcgttttaagtattcggagcggtttattatttttttttcggtttgttattttttcgtgtcggtgggttatttagtgcgtttggtggcgggttacgagaaggtggcgtgtagcggtggcgcgtcgggcgcggggggcgttgggggcgcgggcggcgcggcggcgggcgcgggcgcggcgggcgcgggcgcgggcggttcgggcgggcgcggcgagtacgaggagttgggcgcggtggagtagtacgtgcgttacgagattatcggtttcgcgttgtgtatcgtggtttttttgttggtttattttttcggtatggttagttttatttggtgggtgattttgtcgtttatatggtttttggcggtcggtatg

SEQ ID NO: 28562 - DNA, 749 bp, Artificial Sequence
  chemically treated genomic DNA (Homo sapiens) CpG-island No: 28562
cataccgaccgccaaaaaccatataaacgacaaaatcacccaccaaataaaactaaccataccgaaaaaataaaccaacaaaaaaaccacgatacacaacgcgaaaccgataatctcgtaacgcacgtactactccaccgcgcccaactcctcgtactcgccgcgcccgcccgaaccgcccgcgcccgcgcccgccgcgcccgcgcccgccgccgcgccgcccgcgcccccaacgccccccgcgcccgacgcgccaccgctacacgccaccttctcgtaacccgccaccaaacgcactaaataacccaccgacacgaaaaaataacaaaccgaaaaaaaaataataaaccgctccgaatacttaaaacgctccatatcgataaaaaaaataaaaacgataacgaaaataaacacgaaacaaaacaccgaccacaaaccgatccaaaaaacgataaaaacgcgctcgtcctaactaaaaaaaaaattataacaaaacaacgcgcaattaacgatctaacctatcttaacgcgattataaaacgaataacgctcgctaaacacgctcaccataaacgcgcgacactaacacccgaactcgcaaaaaaccgcgccgccgccaaaaaaccgcgccttcccgccaccgccgccgccgcgaactaaaaacgccgccgaatccccgccgccaccgcccctaccgccacctcgatacgaaaacctaacccccgacgaacgaacgtaaccactacccg

SEQ ID NO: 28563 - DNA, 749 bp, Artificial Sequence
  chemically treated genomic DNA (Homo sapiens) CpG-island No: 28563
tatatcggtcgttaggaattatgtgagcgataagattatttattagatggagttggttatgtcgaagaagtagattagtaagaagattacggtgtatagcgcggggtcggtggtttcgtagcgtacgtgttgttttatcgcgtttagtttttcgtattcgtcgcgttcgttcgggtcgttcgcgttcgcgttcgtcgcgttcgcgttcgtcgtcgcgtcgttcgcgtttttagcgtttttcgcgttcggcgcgttatcgttgtacgttattttttcgtggttcgttattaggcgtattaggtagtttatcgatacgaagaggtagtaggtcgagaggaagataatgggtcgtttcgggtatttgaagcgttttatgtcgataaggaaggtggagacggtggcgaaggtggatacgaagtagagtatcgattataggtcgatttagaagacggtgaaggcgcgttcgttttggttgaaaaaggggttgtggtagggtagcgcgtagttagcgatttggtttgttttgacgcggttgtagagcgggtggcgttcgttggatacgtttattataggcgcgcggtattggtattcgggttcgtagggagtcgcgtcgtcgttagggggtcgcgttttttcgttatcgtcgtcgtcgcgagttgggggcgtcgtcgggttttcgtcgttatcgtttttgtcgttatttcggtgcgggggtttggttttcggcgggcggacgtggttattgttcg

SEQ ID NO: 28564 - DNA, 749 bp, Artificial Sequence
  chemically treated genomic DNA (Homo sapiens) CpG-island No: 28564
cgaacaataaccacgtccgcccgccgaaaaccaaacccccgcaccgaaataacgacaaaaacgataacgacgaaaacccgacgacgcccccaactcgcgacgacgacgataacgaaaaaacgcgaccccctaacgacgacgcgactccctacgaacccgaataccaataccgcgcgcctataataaacgtatccaacgaacgccacccgctctacaaccgcgtcaaaacaaaccaaatcgctaactacgcgctaccctaccacaacccctttttcaaccaaaacgaacgcgccttcaccgtcttctaaatcgacctataatcgatactctacttcgtatccaccttcgccaccgtctccaccttccttatcgacataaaacgcttcaaatacccgaaacgacccattatcttcctctcgacctactacctcttcgtatcgataaactacctaatacgcctaataacgaaccacgaaaaaataacgtacaacgataacgcgccgaacgcgaaaaacgctaaaaacgcgaacgacgcgacgacgaacgcgaacgcgacgaacgcgaacgcgaacgacccgaacgaacgcgacgaatacgaaaaactaaacgcgataaaacaacacgtacgctacgaaaccaccgaccccgcgctatacaccgtaatcttcttactaatctacttcttcgacataaccaactccatctaataaataatcttatcgctcacataattcctaacgaccgatata

SEQ ID NO: 28565 - DNA, 556 bp, Artificial Sequence
  chemically treated genomic DNA (Homo sapiens) CpG-island No: 28565
gaagttatcgtcggttattcgtagtatttttatttggtcgcgtggtttgtgtttagcgttaagtttatcgcggtgttggcgtttagttcggtggacggcgattcggtggcgggtatttgttacgtgggtaattagagtttggataatttgcgcggtttcgtgttggcgtcgttggttatttatttttttatcggtattatgtttttgttggtcggtttcgtgtttttttttcgtattcgttcggttattaagtaataggacggttttattaagacgtataagttggagaagttgatgattcgtttgggtttgtttatcgtgttttatatcgtgttcgtcgcggtggtggtcgtttgttttttttacgagtagtataatcgttcgcgttgggaggttacgtataattgttcgtgtttgcgggatttgtagttcgattaggtacgtaggttcgattacgtcgtttttatgtttaagtattttatgtgtttagtggtgggtattatttcgggcgtgtgggtttggttcggtaagacgttggagttttggcgttttttgt

SEQ ID NO: 28566 - DNA, 556 bp, Artificial Sequence
  chemically treated genomic DNA (Homo sapiens) CpG-island No: 28566
acaaaaaacgccaaaactccaacgtcttaccgaaccaaacccacacgcccgaaataatacccaccactaaacacataaaatacttaaacataaaaacgacgtaatcgaacctacgtacctaatcgaactacaaatcccgcaaacacgaacaattatacgtaacctcccaacgcgaacgattatactactcgtaaaaaaaacaaacgaccaccaccgcgacgaacacgatataaaacacgataaacaaacccaaacgaatcatcaacttctccaacttatacgtcttaataaaaccgtcctattacttaataaccgaacgaatacgaaaaaaaaacacgaaaccgaccaacaaaaacataataccgataaaaaaataaataaccaacgacgccaacacgaaaccgcgcaaattatccaaactctaattacccacgtaacaaatacccgccaccgaatcgccgtccaccgaactaaacgccaacaccgcgataaacttaacgctaaacacaaaccacgcgaccaaataaaaatactacgaataaccgacgataacttc

SEQ ID NO: 28567 - DNA, 556 bp, Artificial Sequence
  chemically treated genomic DNA (Homo sapiens) CpG-island No: 28567
atagggagcgttaggattttagcgttttgtcggattagatttatacgttcgaggtgatgtttattattaggtatatgaagtatttgagtatgaagacggcgtagtcgggtttgcgtgtttggtcgggttgtaggtttcgtaggtacgggtagttgtgcgtggttttttagcgcgggcggttgtgttgttcgtagaagaggtaggcgattattatcgcggcgggtacggtgtagagtacggtgaataggtttaggcggattattagtttttttagtttgtgcgttttggtggggtcgttttgttgtttgatgatcgagcggatgcggaagagggatacgaagtcggttagtaggaatatggtgtcgatgaagaggtagatgattagcggcgttagtacgaagtcgcgtaggttgtttaggttttggttgtttacgtagtagatgttcgttatcgggtcgtcgtttatcgagttgagcgttagtatcgcgatggatttgacgttgggtataagttacgcggttaggtggaagtattgcgagtagtcggcgatggtttt

SEQ ID NO: 28568 - DNA, 556 bp, Artificial Sequence
  chemically treated genomic DNA (Homo sapiens) CpG-island No: 28568
aaaaccatcgccgactactcgcaatacttccacctaaccgcgtaacttatacccaacgtcaaatccatcgcgatactaacgctcaactcgataaacgacgacccgataacgaacatctactacgtaaacaaccaaaacctaaacaacctacgcgacttcgtactaacgccgctaatcatctacctcttcatcgacaccatattcctactaaccgacttcgtatccctcttccgcatccgctcgatcatcaaacaacaaaacgaccccaccaaaacgcacaaactaaaaaaactaataatccgcctaaacctattcaccgtactctacaccgtacccgccgcgataataatcgcctacctcttctacgaacaacacaaccgcccgcgctaaaaaaccacgcacaactacccgtacctacgaaacctacaacccgaccaaacacgcaaacccgactacgccgtcttcatactcaaatacttcatatacctaataataaacatcacctcgaacgtataaatctaatccgacaaaacgctaaaatcctaacgctccctat

SEQ ID NO: 28569 - DNA, 767 bp, Artificial Sequence
  chemically treated genomic DNA (Homo sapiens) CpG-island No: 28569
tcgtagagagcgcgtatagtagtgcggatattcggggattgttttaaggaaggttgagttttgggagcgcgtggatttcgttttatcgttcggcgattggttcgcggggttgggggcggagatcgagttcgcgttgtataaatatttatgagtcggtagcgcggcgcgagcggggttggagtcgggaagttgggttaagggcgttgttttcgtcgaggaggaggcggcggttgggcgcgggtcgcgttatttaggtgttcgtttcgtttttcggtttggatttgtttttgggtgtttagtaggaaggagattgtgtgtatttcgttcgattgcggtcggagcgcggcgttgatttttttaggcggcgggggttcgtttgtttcggcggcggacggacgaaggacggacgtcggagaaagagggcggcggtttgggtcgaggcgggtttttaatttcggcggcggcggcggcggtttggttttgggggcgggtatgagttttcgggggtcgagtggtggtcgttagggttgattcggcgcggtaagcggttcggtttagttattttgattgcgtatcgcggttttagaggaaatttgcggcgttttcgttttttttgttcggcggagttatcgtcgttcggcgcggcggggagaagtggtcgggcgcgcggagaggaggcgagcgagcgcgggtcgatgagtcgaggttcggtcgttttgcgtcgcgagggttgagcgcgattcggggttagtagagcggatttacgg

SEQ ID NO: 28570 - DNA, 767 bp, Artificial Sequence
  chemically treated genomic DNA (Homo sapiens) CpG-island No: 28570
ccgtaaatccgctctactaaccccgaatcgcgctcaaccctcgcgacgcaaaacgaccgaacctcgactcatcgacccgcgctcgctcgcctcctctccgcgcgcccgaccacttctccccgccgcgccgaacgacgataactccgccgaacaaaaaaaacgaaaacgccgcaaatttcctctaaaaccgcgatacgcaatcaaaataactaaaccgaaccgcttaccgcgccgaatcaaccctaacgaccaccactcgacccccgaaaactcatacccgcccccaaaaccaaaccgccgccgccgccgccgaaattaaaaacccgcctcgacccaaaccgccgccctctttctccgacgtccgtccttcgtccgtccgccgccgaaacaaacgaacccccgccgcctaaaaaaatcaacgccgcgctccgaccgcaatcgaacgaaatacacacaatctccttcctactaaacacccaaaaacaaatccaaaccgaaaaacgaaacgaacacctaaataacgcgacccgcgcccaaccgccgcctcctcctcgacgaaaacaacgcccttaacccaacttcccgactccaaccccgctcgcgccgcgctaccgactcataaatatttatacaacgcgaactcgatctccgcccccaaccccgcgaaccaatcgccgaacgataaaacgaaatccacgcgctcccaaaactcaaccttccttaaaacaatccccgaatatccgcactactatacgcgctctctacga

SEQ ID NO: 28571 - DNA, 767 bp, Artificial Sequence
  chemically treated genomic DNA (Homo sapiens) CpG-island No: 28571
tcgtaggttcgttttgttggtttcgggtcgcgtttagttttcgcggcgtagagcggtcgggtttcggtttatcggttcgcgttcgttcgtttttttttcgcgcgttcgattattttttttcgtcgcgtcgggcggcggtgatttcgtcggatagagagggcggaggcgtcgtaagttttttttggggtcgcggtgcgtagttaagatggttgggtcgggtcgtttgtcgcgtcgggttagttttggcggttattattcggttttcgggggtttatgttcgtttttaaggttaagtcgtcgtcgtcgtcgtcggagttggggattcgtttcggtttaggtcgtcgtttttttttttcggcgttcgtttttcgttcgttcgtcgtcgggatagacggattttcgtcgtttggaaaagttagcgtcgcgtttcggtcgtagtcgggcgaggtgtatatagttttttttttgttggatatttaggagtaaatttagatcggaaggcggagcggatatttgagtggcgcggttcgcgtttagtcgtcgtttttttttcggcgggagtagcgtttttagtttaatttttcggttttagtttcgttcgcgtcgcgttgtcggtttatgaatatttatatagcgcggattcggttttcgtttttagtttcgcgagttaatcgtcgggcggtagggcggagtttacgcgtttttagggtttagttttttttaaggtagttttcgagtgttcgtattgttgtgcgcgttttttgcgg

SEQ ID NO: 28572 - DNA, 767 bp, Artificial Sequence
  chemically treated genomic DNA (Homo sapiens) CpG-island No: 28572
ccgcaaaaaacgcgcacaacaatacgaacactcgaaaactaccttaaaaaaaactaaaccctaaaaacgcgtaaactccgccctaccgcccgacgattaactcgcgaaactaaaaacgaaaaccgaatccgcgctatataaatattcataaaccgacaacgcgacgcgaacgaaactaaaaccgaaaaattaaactaaaaacgctactcccgccgaaaaaaaaacgacgactaaacgcgaaccgcgccactcaaatatccgctccgccttccgatctaaatttactcctaaatatccaacaaaaaaaaaactatatacacctcgcccgactacgaccgaaacgcgacgctaacttttccaaacgacgaaaatccgtctatcccgacgacgaacgaacgaaaaacgaacgccgaaaaaaaaaaacgacgacctaaaccgaaacgaatccccaactccgacgacgacgacgacgacttaaccttaaaaacgaacataaacccccgaaaaccgaataataaccgccaaaactaacccgacgcgacaaacgacccgacccaaccatcttaactacgcaccgcgaccccaaaaaaaacttacgacgcctccgccctctctatccgacgaaatcaccgccgcccgacgcgacgaaaaaaaataatcgaacgcgcgaaaaaaaaacgaacgaacgcgaaccgataaaccgaaacccgaccgctctacgccgcgaaaactaaacgcgacccgaaaccaacaaaacgaacctacga

SEQ ID NO: 28573 - DNA, 712 bp, Artificial Sequence
  chemically treated genomic DNA (Homo sapiens) CpG-island No: 28573
attcgttgtaaggttgagaaaaaggtgaacgagcgagtgagcgaggaatggatgaggttttattagggggcgacggcgtttcgttacgaagttcggggcggagtaggagacggagaagtcgtttttttagcgtttttttttttgagtttcggcgtcgcgtttcgtagttttatcggggaatcgtttcgtttcgttcgtcgttttcgcgttttagataattgattcgaatcgatgaagcgttgatcgcggcgtttttgtgcgcgtcgtttcggtattgttatggaaagcggggttttttttttcgttttcgtagttggttcggagtcggttcgagttttttggacgggattaggggatttttaagtcggtcggcgtttcgttcgtttgttttttatttttatcgttagttgcggattcggttcggtcgggaagggtgggcgagggttttttgcggcgttttcggggttcgtattttttttttttttgcgtcgttttcgcggggtcgagttgagcgcgcgtttcggatttcggtttacgcggcgggggtgtgtttcggaggcggcggtggagttgtgttttcgttgagggagtaataatagcgggggaagttcgagtacggaagggaattagtggaaaagtttcgtacgtaagtattagttcgtttttaggttttcggagggttttatggaaatataatatttcgtcgggcgcg

SEQ ID NO: 28574 - DNA, 712 bp, Artificial Sequence
  chemically treated genomic DNA (Homo sapiens) CpG-island No: 28574
cgcgcccgacgaaatattatatttccataaaaccctccgaaaacctaaaaacgaactaatacttacgtacgaaacttttccactaattcccttccgtactcgaacttcccccgctattattactccctcaacgaaaacacaactccaccgccgcctccgaaacacacccccgccgcgtaaaccgaaatccgaaacgcgcgctcaactcgaccccgcgaaaacgacgcaaaaaaaaaaaaaatacgaaccccgaaaacgccgcaaaaaaccctcgcccacccttcccgaccgaaccgaatccgcaactaacgataaaaataaaaaacaaacgaacgaaacgccgaccgacttaaaaatcccctaatcccgtccaaaaaactcgaaccgactccgaaccaactacgaaaacgaaaaaaaaaaccccgctttccataacaataccgaaacgacgcgcacaaaaacgccgcgatcaacgcttcatcgattcgaatcaattatctaaaacgcgaaaacgacgaacgaaacgaaacgattccccgataaaactacgaaacgcgacgccgaaactcaaaaaaaaaaacgctaaaaaaacgacttctccgtctcctactccgccccgaacttcgtaacgaaacgccgtcgccccctaataaaacctcatccattcctcgctcactcgctcgttcacctttttctcaaccttacaacgaat

SEQ ID NO: 28575 - DNA, 712 bp, Artificial Sequence
  chemically treated genomic DNA (Homo sapiens) CpG-island No: 28575
cgcgttcggcgggatattatatttttataaggtttttcgggggtttgggaacggattggtgtttgcgtgcggggtttttttattggttttttttcgtattcgggtttttttcgttgttgttatttttttaacgggaatataattttatcgtcgttttcgggatatattttcgtcgcgtgggtcggggttcgggacgcgcgtttagttcggtttcgcgggggcggcgtaggagggaagggggtgcggatttcggaggcgtcgtaggaagttttcgtttatttttttcggtcgggtcgggttcgtagttgacggtgggggtggggagtagacgggcggggcgtcggtcggtttgggggttttttggtttcgtttagggggttcgggtcgatttcgggttagttgcggaggcgggggaggggatttcgttttttatggtagtgtcgaggcggcgcgtataaaggcgtcgcgattagcgttttatcggttcgagttaattatttgaggcgcggaggcggcgggcggggcgaggcgatttttcggtggggttgcggagcgcggcgtcgagatttagaggagggggcgttggggaagcggttttttcgttttttgtttcgtttcgggtttcgtggcgaggcgtcgtcgttttttggtggggttttatttatttttcgtttattcgttcgtttattttttttttaattttatagcgggt

SEQ ID NO: 28576 - DNA, 712 bp, Artificial Sequence
  chemically treated genomic DNA (Homo sapiens) CpG-island No: 28576
acccgctataaaattaaaaaaaaaataaacgaacgaataaacgaaaaataaataaaaccccaccaaaaaacgacgacgcctcgccacgaaacccgaaacgaaacaaaaaacgaaaaaaccgcttccccaacgccccctcctctaaatctcgacgccgcgctccgcaaccccaccgaaaaatcgcctcgccccgcccgccgcctccgcgcctcaaataattaactcgaaccgataaaacgctaatcgcgacgcctttatacgcgccgcctcgacactaccataaaaaacgaaatcccctcccccgcctccgcaactaacccgaaatcgacccgaaccccctaaacgaaaccaaaaaacccccaaaccgaccgacgccccgcccgtctactccccacccccaccgtcaactacgaacccgacccgaccgaaaaaaataaacgaaaacttcctacgacgcctccgaaatccgcacccccttccctcctacgccgcccccgcgaaaccgaactaaacgcgcgtcccgaaccccgacccacgcgacgaaaatatatcccgaaaacgacgataaaattatattcccgttaaaaaaataacaacaacgaaaaaaacccgaatacgaaaaaaaaccaataaaaaaaccccgcacgcaaacaccaatccgttcccaaacccccgaaaaaccttataaaaatataatatcccgccgaacgcg

SEQ ID NO: 28577 - DNA, 534 bp, Artificial Sequence
  chemically treated genomic DNA (Homo sapiens) CpG-island No: 28577
tcgttttttttattttttttttttcgtttttttttgtttttgcgtttttttcgtttttattttttttttttttgtttgtttcgggtttgtttttatcgtcgtcggtttaggggaacgtgtgcggagcgattgttttgggggatatttgatggattagagcgtcgagcggttttattgttaggggattatttgatttttagtttgcgttttatataaagtcggtagtcggagtgttgagcgtagttttcgcgattttttgtttgcgcgtcgtcgtcgttaagttcgagttcgagtcggggtcgtcgttatcggtgtcggtttcgagcggtttttcgcgttttagttcgttgggagttgtttagtgttgaaaattcgcgcggatatagtcgatcgcgttcggtcggtcgttttttcgtatcgagtttcgcgtcggtcgcgttatgtcgcgtttttttttggtaaagaagattaaaggggacggtttttagtgtagcggggtgtcggtttttatttattattttttggagatagttt

SEQ ID NO: 28578 - DNA, 534 bp, Artificial Sequence
  chemically treated genomic DNA (Homo sapiens) CpG-island No: 28578
aaactatctccaaaaaataataaataaaaaccgacaccccgctacactaaaaaccgtcccctttaatcttctttaccaaaaaaaaacgcgacataacgcgaccgacgcgaaactcgatacgaaaaaacgaccgaccgaacgcgatcgactatatccgcgcgaattttcaacactaaacaactcccaacgaactaaaacgcgaaaaaccgctcgaaaccgacaccgataacgacgaccccgactcgaactcgaacttaacgacgacgacgcgcaaacaaaaaatcgcgaaaactacgctcaacactccgactaccgactttatataaaacgcaaactaaaaatcaaataatcccctaacaataaaaccgctcgacgctctaatccatcaaatatcccccaaaacaatcgctccgcacacgttcccctaaaccgacgacgataaaaacaaacccgaaacaaacaaaaaaaaaaaaaataaaaacgaaaaaaacgcaaaaacaaaaaaaaacgaaaaaaaaaaaataaaaaaaacga

SEQ ID NO: 28579 - DNA, 534 bp, Artificial Sequence
  chemically treated genomic DNA (Homo sapiens) CpG-island No: 28579
aggttgtttttaaggggtggtaggtgggggtcggtatttcgttgtattggaagtcgttttttttgattttttttattaggaaggagcgcggtatggcgcggtcggcgcggggttcggtgcggggaggcggtcggtcgggcgcgatcggttgtgttcgcgcgggtttttagtattggatagtttttagcgggttggagcgcgggaggtcgttcggagtcggtatcggtggcggcggtttcggttcgggttcgggtttggcggcggcggcgcgtagataggggatcgcgggagttgcgtttagtatttcggttgtcggttttatatgggacgtaggttggagattaggtggttttttagtaatggaatcgttcggcgttttaatttattaaatgttttttaggataatcgtttcgtatacgtttttttgaatcggcggcggtgggggtaggttcggagtaggtaggaggggagaaagtgagggcgagaaaggcgtagagatagagagggacggagaaaggggagtgaggggggcgg

SEQ ID NO: 28580 - DNA, 534 bp, Artificial Sequence
  chemically treated genomic DNA (Homo sapiens) CpG-island No: 28580
ccgcccccctcactcccctttctccgtccctctctatctctacgcctttctcgccctcactttctcccctcctacctactccgaacctacccccaccgccgccgattcaaaaaaacgtatacgaaacgattatcctaaaaaacatttaataaattaaaacgccgaacgattccattactaaaaaaccacctaatctccaacctacgtcccatataaaaccgacaaccgaaatactaaacgcaactcccgcgatcccctatctacgcgccgccgccgccaaacccgaacccgaaccgaaaccgccgccaccgataccgactccgaacgacctcccgcgctccaacccgctaaaaactatccaatactaaaaacccgcgcgaacacaaccgatcgcgcccgaccgaccgcctccccgcaccgaaccccgcgccgaccgcgccataccgcgctccttcctaataaaaaaaatcaaaaaaaacgacttccaatacaacgaaataccgacccccacctaccaccccttaaaaacaacct

SEQ ID NO: 28581 - DNA, 1269 bp, Artificial Sequence
  chemically treated genomic DNA (Homo sapiens) CpG-island No: 28581
ttaaagcgggaaatttttttcggcgtttttttttatcgtttttttatttttcgttttttttagggtacgtttcgtatcgtttgttttcgagtagttacgatgcggattagaagtcgggtttggagttggtttcggtcgagttcgcgtattcgtcggcggcgtcggaggagtatagcgatttcgaaagttcgtagtcgagtttgtcggcgcgttattttcgaggggaggcggtagtgatcgatagttattttatggacgttttttttatttcggacgggcgttcgcggcggcggcggggcgggggcggcggggacgcggggggttcgggagacgcggggggcgtcggggggcgcgcggggcgcgcgggggcgtaggcgggcggcgggtatcggtacgcgtgcgtcgagtgcggtaagatttacgttacgtcgtcgaatttgagtcgttataagtagacgtatcgtagtttggatagttagttggcgcgtaaatgttcgacgtgcggtaaggtttacgtgtttatgttcgcgttcgttatgtatttgtttacgtataatttgcgttataagtgcggcgtttgcggtaaggttttttcgcggttttggttgttgtagggttatatgcgttcgtatatcggcgaaaagtcgttcggttgcgcgtattgcggtaaggttttcgtcgatcgttttaatttgcgcgcgtatatgtagacgtattcggtttttaagtattatcgttgtcgttagtgcgataagagtttcgcgtttaagttttatttttataagtattgcgaggcggtttgcgttaaggcggtcgagttattttcgtcgattttcgtcggttcggttagttgagtttttcgtttcgttttcgcgttcggaattcgttttttacgcgtttcgggttttttatttgcgttcgtagcgttttcgtttagtttcggttgcgtttttttgtttatgattttttcgtggggattttcggttcggttcggaatttttttttttaatttttaaatttacgatttatttttatatcgttttttttagcgtttttcgatttattttatttttttcggttatttttcggattttgatttttttgttcgcgtttttaaggtttttaatttaggtattaggttcgtatttttttcgcgttttagagtcggaaattttttttttttagatttcgcgttgtttttttaatttttagattttttttttcgttttttagttgaatttttttgattatttttttattggagttttt

SEQ ID NO: 28582 - DNA, 1269 bp, Artificial Sequence
  chemically treated genomic DNA (Homo sapiens) CpG-island No: 28582
aaaaactccaataaaaaaataatcaaaaaaattcaactaaaaaacgaaaaaaaaaatctaaaaattaaaaaaacaacgcgaaatctaaaaaaaaaaaatttccgactctaaaacgcgaaaaaaatacgaacctaatacctaaattaaaaaccttaaaaacgcgaacaaaaaaatcaaaatccgaaaaataaccgaaaaaaataaaataaatcgaaaaacgctaaaaaaaacgatataaaaataaatcgtaaatttaaaaattaaaaaaaaaaattccgaaccgaaccgaaaatccccacgaaaaaatcataaacaaaaaaacgcaaccgaaactaaacgaaaacgctacgaacgcaaataaaaaacccgaaacgcgtaaaaaacgaattccgaacgcgaaaacgaaacgaaaaactcaactaaccgaaccgacgaaaatcgacgaaaataactcgaccgccttaacgcaaaccgcctcgcaatacttataaaaataaaacttaaacgcgaaactcttatcgcactaacgacaacgataatacttaaaaaccgaatacgtctacatatacgcgcgcaaattaaaacgatcgacgaaaaccttaccgcaatacgcgcaaccgaacgacttttcgccgatatacgaacgcatataaccctacaacaaccaaaaccgcgaaaaaaccttaccgcaaacgccgcacttataacgcaaattatacgtaaacaaatacataacgaacgcgaacataaacacgtaaaccttaccgcacgtcgaacatttacgcgccaactaactatccaaactacgatacgtctacttataacgactcaaattcgacgacgtaacgtaaatcttaccgcactcgacgcacgcgtaccgatacccgccgcccgcctacgcccccgcgcgccccgcgcgccccccgacgccccccgcgtctcccgaaccccccgcgtccccgccgcccccgccccgccgccgccgcgaacgcccgtccgaaataaaaaaaacgtccataaaataactatcgatcactaccgcctcccctcgaaaataacgcgccgacaaactcgactacgaactttcgaaatcgctatactcctccgacgccgccgacgaatacgcgaactcgaccgaaaccaactccaaacccgacttctaatccgcatcgtaactactcgaaaacaaacgatacgaaacgtaccctaaaaaaaacgaaaaataaaaaaacgataaaaaaaaacgccgaaaaaaatttcccgctttaa

SEQ ID NO: 28583 - DNA, 1269 bp, Artificial Sequence
  chemically treated genomic DNA (Homo sapiens) CpG-island No: 28583
gggggttttagtagaggaatggttagagagatttagttgagaagcgagagaaaagatttagaagttagaagagtagcgcggggtttgggagggagaaattttcggttttggggcgcgggagaggtgcggatttggtgtttgagttgggagttttgaaggcgcggataggggggttaaggttcgagggatggtcggaaaggatgaagtgggtcgggggacgttggggaagacggtgtggaagtgagtcgtgggtttgggggttggggagaaaagtttcgggtcgggtcgggggtttttacgagagggttatgggtagggaaacgtagtcggggttgggcgagggcgttgcgggcgtaggtagggggttcggggcgcgtggagagcgagtttcgggcgcgagggcgaggcggaaggtttagttggtcgggtcggcgggggtcggcgggggtggttcggtcgttttggcgtaggtcgtttcgtagtgtttgtggaggtaggatttgagcgcgaagtttttgtcgtattggcggtagcggtagtgtttgaaggtcgagtgcgtttgtatgtgcgcgcgtaggttggagcggtcggcgaaggttttgtcgtagtgcgcgtagtcgaacggtttttcgtcggtgtgcgagcgtatgtgattttgtagtagttagggtcgcgagaaggttttgtcgtagacgtcgtatttgtggcgtaggttgtgcgtgagtaggtgtatggcgagcgcgggtatggatacgtaggttttgtcgtacgtcgggtatttgcgcgttagttggttgtttaggttgcggtgcgtttgtttgtggcggtttaggttcgacgacgtggcgtaggttttgtcgtattcggcgtacgcgtgtcggtgttcgtcgttcgtttgcgttttcgcgcgtttcgcgcgtttttcggcgtttttcgcgtttttcgagtttttcgcgttttcgtcgttttcgtttcgtcgtcgtcgcgagcgttcgttcgagatgaagaaggcgtttatggagtagttgtcggttattgtcgttttttttcggaagtagcgcgtcgataggttcgattgcgggttttcggggtcgttgtattttttcggcgtcgtcggcgggtacgcgggttcggtcggggttagttttaggttcggtttttggttcgtatcgtagttgttcgggggtaggcggtgcggggcgtattttggagggggcgagaagtggaggggcggtgagaggaggcgtcgaagagggtttttcgttttga

SEQ ID NO: 28584 - DNA, 1269 bp, Artificial Sequence
  chemically treated genomic DNA (Homo sapiens) CpG-island No: 28584
tcaaaacgaaaaaccctcttcgacgcctcctctcaccgcccctccacttctcgccccctccaaaatacgccccgcaccgcctacccccgaacaactacgatacgaaccaaaaaccgaacctaaaactaaccccgaccgaacccgcgtacccgccgacgacgccgaaaaaatacaacgaccccgaaaacccgcaatcgaacctatcgacgcgctacttccgaaaaaaaacgacaataaccgacaactactccataaacgccttcttcatctcgaacgaacgctcgcgacgacgacgaaacgaaaacgacgaaaacgcgaaaaactcgaaaaacgcgaaaaacgccgaaaaacgcgcgaaacgcgcgaaaacgcaaacgaacgacgaacaccgacacgcgtacgccgaatacgacaaaacctacgccacgtcgtcgaacctaaaccgccacaaacaaacgcaccgcaacctaaacaaccaactaacgcgcaaatacccgacgtacgacaaaacctacgtatccatacccgcgctcgccatacacctactcacgcacaacctacgccacaaatacgacgtctacgacaaaaccttctcgcgaccctaactactacaaaatcacatacgctcgcacaccgacgaaaaaccgttcgactacgcgcactacgacaaaaccttcgccgaccgctccaacctacgcgcgcacatacaaacgcactcgaccttcaaacactaccgctaccgccaatacgacaaaaacttcgcgctcaaatcctacctccacaaacactacgaaacgacctacgccaaaacgaccgaaccacccccgccgacccccgccgacccgaccaactaaaccttccgcctcgccctcgcgcccgaaactcgctctccacgcgccccgaaccccctacctacgcccgcaacgccctcgcccaaccccgactacgtttccctacccataaccctctcgtaaaaacccccgacccgacccgaaacttttctccccaacccccaaacccacgactcacttccacaccgtcttccccaacgtcccccgacccacttcatcctttccgaccatccctcgaaccttaacccccctatccgcgccttcaaaactcccaactcaaacaccaaatccgcacctctcccgcgccccaaaaccgaaaatttctccctcccaaaccccgcgctactcttctaacttctaaatcttttctctcgcttctcaactaaatctctctaaccattcctctactaaaaccccc

SEQ ID NO: 28585 - DNA, 746 bp, Artificial Sequence
  chemically treated genomic DNA (Homo sapiens) CpG-island No: 28585
ggtagtagcgtatcgcgggttttgtcgatttattttggttgggtaggttcgtcgcgttttttttcgttttcgttttcgcggtttaagtcggttcggtcggtgcgttattcgcgtttttttcgtttcgcgatttgtaaatttattttgagttagttcgttcgggcgtttttatttttcggacgtcgcgcggcgtaggggaggcgagaggcgtttttcggtggagagtttgagtttcgcgcgagtttggcggtatttggcgagcggagtcggagtcgggttggggatcgcggggtcgaggtcggatcgcggcggggtcgggggagaaacgcgcgttgttttggtacgggttttttttttcggtcgcgcggaatggtatggttcggtcggagttaaggtcggggggaggcggcgagtttcgcggcggcggcgacgatggggttgcgtgtaggaggaacgttgggtagggtcggcgcgggtcggggggcgttcgaggggttcgggtcgagcggcggcgcgtagggcggtagtatttattcgggtcgtatcgtcgcggtgtataacgtgtcgttgagcgtgtttattcggtcgttgtcgttcgtgttggatttcgttaaggtgtagagtttcgtggatacgattcgggtgaggtttcggggagtttagttaatcggagggagggtttcggaggagggaggttgtcggaggagggaggtcgttgcgatggacgcgagacggattggtttcgg

SEQ ID NO: 28586 - DNA, 746 bp, Artificial Sequence
  chemically treated genomic DNA (Homo sapiens) CpG-island No: 28586
ccgaaaccaatccgtctcgcgtccatcgcaacgacctccctcctccgacaacctccctcctccgaaaccctccctccgattaactaaactccccgaaacctcacccgaatcgtatccacgaaactctacaccttaacgaaatccaacacgaacgacaacgaccgaataaacacgctcaacgacacgttatacaccgcgacgatacgacccgaataaatactaccgccctacgcgccgccgctcgacccgaacccctcgaacgccccccgacccgcgccgaccctacccaacgttcctcctacacgcaaccccatcgtcgccgccgccgcgaaactcgccgcctccccccgaccttaactccgaccgaaccataccattccgcgcgaccgaaaaaaaaaacccgtaccaaaacaacgcgcgtttctcccccgaccccgccgcgatccgacctcgaccccgcgatccccaacccgactccgactccgctcgccaaataccgccaaactcgcgcgaaactcaaactctccaccgaaaaacgcctctcgcctcccctacgccgcgcgacgtccgaaaaataaaaacgcccgaacgaactaactcaaaataaatttacaaatcgcgaaacgaaaaaaacgcgaataacgcaccgaccgaaccgacttaaaccgcgaaaacgaaaacgaaaaaaaacgcgacgaacctacccaaccaaaataaatcgacaaaacccgcgatacgctactacc

SEQ ID NO: 28587 - DNA, 746 bp, Artificial Sequence
  chemically treated genomic DNA (Homo sapiens) CpG-island No: 28587
tcggaattagttcgtttcgcgtttatcgtagcgatttttttttttcggtaatttttttttttcgaagtttttttttcggttggttggatttttcgaggttttattcggatcgtgtttacgaggttttgtattttggcggggtttaatacggacggtagcggtcggatgagtacgtttagcggtacgttgtgtatcgcggcgatgcggttcgagtggatgttgtcgttttgcgcgtcgtcgttcggttcgggtttttcgggcgtttttcgattcgcgtcggttttgtttagcgttttttttgtacgtagttttatcgtcgtcgtcgtcgcgggattcgtcgttttttttcggttttaatttcggtcgggttatattatttcgcgcggtcgggggggggggttcgtgttagggtagcgcgcgtttttttttcgatttcgtcgcggttcggtttcgatttcgcggtttttagttcgatttcggtttcgttcgttaggtgtcgttagattcgcgcggggtttaggttttttatcggggggcgtttttcgttttttttgcgtcgcgcggcgttcggggagtggaaacgttcgggcgggttgatttagggtgagtttgtaggtcgcggggcgggaggggcgcgggtgacgtatcggtcgggtcgatttaggtcgcgggggcgggggcgggggagagcgcggcggatttgtttagttagggtgagtcggtaaagttcgcggtgcgttgttgtt

SEQ ID NO: 28588 - DNA, 746 bp, Artificial Sequence
  chemically treated genomic DNA (Homo sapiens) CpG-island No: 28588
aacaacaacgcaccgcgaactttaccgactcaccctaactaaacaaatccgccgcgctctcccccgcccccgcccccgcgacctaaatcgacccgaccgatacgtcacccgcgcccctcccgccccgcgacctacaaactcaccctaaatcaacccgcccgaacgtttccactccccgaacgccgcgcgacgcaaaaaaaacgaaaaacgccccccgataaaaaacctaaaccccgcgcgaatctaacgacacctaacgaacgaaaccgaaatcgaactaaaaaccgcgaaatcgaaaccgaaccgcgacgaaatcgaaaaaaaaacgcgcgctaccctaacacgaacccccccccccgaccgcgcgaaataatataacccgaccgaaattaaaaccgaaaaaaaacgacgaatcccgcgacgacgacgacgataaaactacgtacaaaaaaaacgctaaacaaaaccgacgcgaatcgaaaaacgcccgaaaaacccgaaccgaacgacgacgcgcaaaacgacaacatccactcgaaccgcatcgccgcgatacacaacgtaccgctaaacgtactcatccgaccgctaccgtccgtattaaaccccgccaaaatacaaaacctcgtaaacacgatccgaataaaacctcgaaaaatccaaccaaccgaaaaaaaaacttcgaaaaaaaaaaattaccgaaaaaaaaaaatcgctacgataaacgcgaaacgaactaattccga

SEQ ID NO: 28589 - DNA, 996 bp, Artificial Sequence
  chemically treated genomic DNA (Homo sapiens) CpG-island No: 28589
aagtttaatttaaaaaagcggagcgcgttagtatcgttgaggttaacggattcgatcggttttttgtcgtttacgtgcgggtaggggttatttgatacgcggtaacgtttttttttatttcgttttggggttgatcgggattggacggggtgtttttcgttgcggttttgtcgttagtattcggatttatgggatgtttttttgaaaatgttcggtgtggtcggacgtcgtatcgatgagggttagaagttgatagcgatcggatcgtagattagggcggcgaggtaggtattgacgcggttcgggatgattagcggcgcggattgtattatgatgatgcgttgggtaggatcgttgtttagttaagttttcggcgcgtatgttatcggtttgtagttgaaggtcgggtcgacgattagatcgaacgcgcgggtgtttatgaggtcgggttcggatatgatgattatatcgttcgggagtataggttgttcgatatcgttcggatcgatatattagtcgttgtaaagttatagatcgtattggttttatttgtttttgtagatcgcgtcgattttgatttggttgttcgggtttagcgagttgtcgtcgatcgtaagggtgggatattgaattgtattttggacgtttttagtagtgaggaatttggtttatgtcgagttggtgaagacgatgtcggtggcgatcgcgttagacgtttttaggattcgcgcgtcgaatgtatcgatttgttcgataatgttggtattacggttttgcgcgttgagggtggtattttatttattcgtatcggtgagcgcgatcgttagggtcgtcgagcgatcgaagtcgattagagtggtagggaattttttatcggcgatggtgatcgtgtcggtggttagcgtcgacgacgttatttattcgaggcgacggtttattatgtcgatttggtcggttattttcgtttcgaggttgattatttggcgttaattaggg

SEQ ID NO: 28590 - DNA, 996 bp, Artificial Sequence
  chemically treated genomic DNA (Homo sapiens) CpG-island No: 28590
ccctaattaacgccaaataatcaacctcgaaacgaaaataaccgaccaaatcgacataataaaccgtcgcctcgaataaataacgtcgtcgacgctaaccaccgacacgatcaccatcgccgataaaaaattccctaccactctaatcgacttcgatcgctcgacgaccctaacgatcgcgctcaccgatacgaataaataaaataccaccctcaacgcgcaaaaccgtaataccaacattatcgaacaaatcgatacattcgacgcgcgaatcctaaaaacgtctaacgcgatcgccaccgacatcgtcttcaccaactcgacataaaccaaattcctcactactaaaaacgtccaaaatacaattcaatatcccacccttacgatcgacgacaactcgctaaacccgaacaaccaaatcaaaatcgacgcgatctacaaaaacaaataaaaccaatacgatctataactttacaacgactaatatatcgatccgaacgatatcgaacaacctatactcccgaacgatataatcatcatatccgaacccgacctcataaacacccgcgcgttcgatctaatcgtcgacccgaccttcaactacaaaccgataacatacgcgccgaaaacttaactaaacaacgatcctacccaacgcatcatcataatacaatccgcgccgctaatcatcccgaaccgcgtcaatacctacctcgccgccctaatctacgatccgatcgctatcaacttctaaccctcatcgatacgacgtccgaccacaccgaacattttcaaaaaaacatcccataaatccgaatactaacgacaaaaccgcaacgaaaaacaccccgtccaatcccgatcaaccccaaaacgaaataaaaaaaaacgttaccgcgtatcaaataacccctacccgcacgtaaacgacaaaaaaccgatcgaatccgttaacctcaacgatactaacgcgctccgcttttttaaattaaactt

SEQ ID NO: 28591 - DNA, 996 bp, Artificial Sequence
  chemically treated genomic DNA (Homo sapiens) CpG-island No: 28591
ttttgattaacgttagatggttaatttcggggcggagatgatcgattaagtcgatatggtgaatcgtcgtttcgagtggatggcgtcgtcggcgttgattatcggtacgattattatcgtcggtgagggattttttattattttgatcgatttcggtcgttcggcgattttgacgatcgcgtttatcggtgcgaataagtggggtgttatttttaacgcgtagggtcgtgatattaatattgtcgggtagatcgatgtattcggcgcgcgaattttgaaggcgtttggcgcggtcgttatcgatatcgtttttattaattcggtatgggttaagttttttattgttgagggcgtttaaggtgtaatttagtattttatttttgcggtcgacggtaattcgttgaattcgggtagttaggttaaagtcggcgcgatttataagggtaagtggggttagtacgatttgtggttttataacgattggtatatcgattcggacggtgtcgagtagtttatgttttcggacggtatgattattatgttcgggttcgattttatgggtattcgcgcgttcggtttgatcgtcgattcggtttttaattataagtcgatggtatacgcgtcgaagatttggttgaataacgattttgtttagcgtattattatgatgtagttcgcgtcgttggttatttcgagtcgcgttaatgtttgtttcgtcgttttggtttgcgattcgatcgttattagtttttaatttttatcggtgcggcgttcgattatatcgaatatttttaagggagtattttatggattcgaatgttggcggtaaagtcgtaacgaaaaatatttcgtttaatttcgattagttttagagcgaagtagagaaaggcgttatcgcgtattaggtggtttttgttcgtacgtgggcggtaaggggtcggtcgagttcgttgattttaacgatattgacgcgtttcgtttttttgagttgggttt

SEQ ID NO: 28592 - DNA, 996 bp, Artificial Sequence
  chemically treated genomic DNA (Homo sapiens) CpG-island No: 28592
aaacccaactcaaaaaaacgaaacgcgtcaatatcgttaaaatcaacgaactcgaccgaccccttaccgcccacgtacgaacaaaaaccacctaatacgcgataacgcctttctctacttcgctctaaaactaatcgaaattaaacgaaatatttttcgttacgactttaccgccaacattcgaatccataaaatactcccttaaaaatattcgatataatcgaacgccgcaccgataaaaattaaaaactaataacgatcgaatcgcaaaccaaaacgacgaaacaaacattaacgcgactcgaaataaccaacgacgcgaactacatcataataatacgctaaacaaaatcgttattcaaccaaatcttcgacgcgtataccatcgacttataattaaaaaccgaatcgacgatcaaaccgaacgcgcgaatacccataaaatcgaacccgaacataataatcataccgtccgaaaacataaactactcgacaccgtccgaatcgatataccaatcgttataaaaccacaaatcgtactaaccccacttacccttataaatcgcgccgactttaacctaactacccgaattcaacgaattaccgtcgaccgcaaaaataaaatactaaattacaccttaaacgccctcaacaataaaaaacttaacccataccgaattaataaaaacgatatcgataacgaccgcgccaaacgccttcaaaattcgcgcgccgaatacatcgatctacccgacaatattaatatcacgaccctacgcgttaaaaataacaccccacttattcgcaccgataaacgcgatcgtcaaaatcgccgaacgaccgaaatcgatcaaaataataaaaaatccctcaccgacgataataatcgtaccgataatcaacgccgacgacgccatccactcgaaacgacgattcaccatatcgacttaatcgatcatctccgccccgaaattaaccatctaacgttaatcaaaa

SEQ ID NO: 28593 - DNA, 1111 bp, Artificial Sequence
  chemically treated genomic DNA (Homo sapiens) CpG-island No: 28593
gcggtttaggtaaaatcgttagttgttcgattcggcgtttttgagttgtagtaaaaagtcgatgtcgggggcgggggatatcgttatttcgatgtttacgttggatatgtcgggcgtcgtcgcgttcgtttcggcggcgatcgtgtcgttttagataggaattgtattatcgtgttattcggcgcgattagggaaacgtcgtcggcggggtcgttttggatgtcgttgatcggataacggaaggttatcgcgttaaattcggtgttttcgatatagagcgtgttagataaatgggggggtatatagatcggtttcgcgttaggcgtgtgggtgtcggtgtatagaattagtttatagttcgataggtcggtgttcggcgtatcggagatttcgatcgttttatcgatatcggtatcgttattatcgtagtgaattttattgatgaatatattcgtcggcgggacgggcggcgcggtatcgtcgttggtgatcgttttcgtcgcgatcgtacgggttagcgtcgcgtcgttttgcggatcggtgagcgtgacggagaaggtttcgttggtttcgaatatcgtgtcgtttagtacgggtagtcgaatttcggcggtggtcgcgttcgcggcgaacgttatcgtgtcggtgcgtattagattcgtggcgaagtcgttttcgtcggttatagcggtgtcgttgtttaggtttagcgtttaggtcgtcgatatttcgttcgtcgtgtcgtcgttgcgcgttacggtgaagacgatgttacgcgtatcgttgtttttttcggcgatggtggcgtcggcgatggttagcgtgtttggcgtcggggtcggcgtcgcgttgtcgaacgtttggttcgtgttcgtcgcgtcggcggtcgtcgtgttgattagcgtttaatgaaagtttttcgtcgtcgtgtcggtgtcgattaggtttagcgcggtgtcgttttgcgtttcgtttttatagacgtcgatattgacgttcgttatgtttttggtcggtttatcggcggtaacgaagttgtttttatagttgagaaattggacgatatttttcgtcgtatcgattagcgcgaggttatcgggtttttcggcgg

SEQ ID NO: 28594 - DNA, 1111 bp, Artificial Sequence
  chemically treated genomic DNA (Homo sapiens) CpG-island No: 28594
ccgccgaaaaacccgataacctcgcgctaatcgatacgacgaaaaatatcgtccaatttctcaactataaaaacaacttcgttaccgccgataaaccgaccaaaaacataacgaacgtcaatatcgacgtctataaaaacgaaacgcaaaacgacaccgcgctaaacctaatcgacaccgacacgacgacgaaaaactttcattaaacgctaatcaacacgacgaccgccgacgcgacgaacacgaaccaaacgttcgacaacgcgacgccgaccccgacgccaaacacgctaaccatcgccgacgccaccatcgccgaaaaaaacaacgatacgcgtaacatcgtcttcaccgtaacgcgcaacgacgacacgacgaacgaaatatcgacgacctaaacgctaaacctaaacaacgacaccgctataaccgacgaaaacgacttcgccacgaatctaatacgcaccgacacgataacgttcgccgcgaacgcgaccaccgccgaaattcgactacccgtactaaacgacacgatattcgaaaccaacgaaaccttctccgtcacgctcaccgatccgcaaaacgacgcgacgctaacccgtacgatcgcgacgaaaacgatcaccaacgacgataccgcgccgcccgtcccgccgacgaatatattcatcaataaaattcactacgataataacgataccgatatcgataaaacgatcgaaatctccgatacgccgaacaccgacctatcgaactataaactaattctatacaccgacacccacacgcctaacgcgaaaccgatctatatacccccccatttatctaacacgctctatatcgaaaacaccgaatttaacgcgataaccttccgttatccgatcaacgacatccaaaacgaccccgccgacgacgtttccctaatcgcgccgaataacacgataatacaattcctatctaaaacgacacgatcgccgccgaaacgaacgcgacgacgcccgacatatccaacgtaaacatcgaaataacgatatcccccgcccccgacatcgactttttactacaactcaaaaacgccgaatcgaacaactaacgattttacctaaaccgc

SEQ ID NO: 28595 - DNA, 1111 bp, Artificial Sequence
  chemically treated genomic DNA (Homo sapiens) CpG-island No: 28595
tcgtcggggagttcgatggtttcgcgttggtcgatgcggcggggaatgtcgtttagttttttagttatgagggtagtttcgttgtcgtcgatggatcggttaagggtatgacgagcgttaatatcggcgtttatgaggacgggacgtagaacggtatcgcgttgggtttggtcggtatcggtacgacggcggaagatttttattgggcgttgattaatacggcgatcgtcggcgcgacgaatacgggttagacgttcggtagcgcggcgtcgatttcgacgttaggtacgttggttatcgtcgacgttattatcgtcgagggggatagcggtacgcgtgatatcgtttttatcgtgacgcgtagcgacggtacggcgggcgaggtgtcggcgatttggacgttgaatttgggtaacggtatcgttatggtcgacgagagcgatttcgttacgggtttggtgcgtatcggtacggtgacgttcgtcgcgggcgcgattatcgtcgagattcggttgttcgtgttgggcgatacggtgttcgaggttaacgaaatttttttcgttacgtttatcgattcgtagggcggcgcgacgttgattcgtgcggtcgcgacggggacgattattaacgacgatgtcgcgtcgttcgtttcgtcggcgaatgtgtttattaatgagatttattacgataatagcggtgtcgatgtcggtgaggcgatcgagattttcggtgcgtcgggtatcgatttgtcgggttataagttggttttgtgtatcggtatttatacgtttgacgcggggtcggtttatgtgtttttttatttgtttggtacgttttatatcgaagatatcgggtttggcgcggtggtttttcgttattcggttaacggtatttagaacggtttcgtcgacggcgtttttttggtcgcgtcggatggtacggtggtgtagtttttgtttaaggcggtacgatcgtcgtcgggacgggcgcggcggcgttcggtatgtttagcgtggatatcggggtggcggtatttttcgttttcggtatcggttttttgttgtagtttaaaggcgtcgggtcgagtagttggcgattttatttggatcgt

SEQ ID NO: 28596 - DNA, 1111 bp, Artificial Sequence
  chemically treated genomic DNA (Homo sapiens) CpG-island No: 28596
acgatccaaataaaatcgccaactactcgacccgacgcctttaaactacaacaaaaaaccgataccgaaaacgaaaaataccgccaccccgatatccacgctaaacataccgaacgccgccgcgcccgtcccgacgacgatcgtaccgccttaaacaaaaactacaccaccgtaccatccgacgcgaccaaaaaaacgccgtcgacgaaaccgttctaaataccgttaaccgaataacgaaaaaccaccgcgccaaacccgatatcttcgatataaaacgtaccaaacaaataaaaaaacacataaaccgaccccgcgtcaaacgtataaataccgatacacaaaaccaacttataacccgacaaatcgatacccgacgcaccgaaaatctcgatcgcctcaccgacatcgacaccgctattatcgtaataaatctcattaataaacacattcgccgacgaaacgaacgacgcgacatcgtcgttaataatcgtccccgtcgcgaccgcacgaatcaacgtcgcgccgccctacgaatcgataaacgtaacgaaaaaaatttcgttaacctcgaacaccgtatcgcccaacacgaacaaccgaatctcgacgataatcgcgcccgcgacgaacgtcaccgtaccgatacgcaccaaacccgtaacgaaatcgctctcgtcgaccataacgataccgttacccaaattcaacgtccaaatcgccgacacctcgcccgccgtaccgtcgctacgcgtcacgataaaaacgatatcacgcgtaccgctatccccctcgacgataataacgtcgacgataaccaacgtacctaacgtcgaaatcgacgccgcgctaccgaacgtctaacccgtattcgtcgcgccgacgatcgccgtattaatcaacgcccaataaaaatcttccgccgtcgtaccgataccgaccaaacccaacgcgataccgttctacgtcccgtcctcataaacgccgatattaacgctcgtcatacccttaaccgatccatcgacgacaacgaaactaccctcataactaaaaaactaaacgacattccccgccgcatcgaccaacgcgaaaccatcgaactccccgacga

SEQ ID NO: 28597 - DNA, 633 bp, Artificial Sequence
  chemically treated genomic DNA (Homo sapiens) CpG-island No: 28597
tcgtcggcggtcgttattcggtatagatcgaacgttcgtttcgaattcgagtgcgattatggacgttacggtgaggcgataggtgattcgttttaggttcgatatgttcgtgtcggttttttcggtattcgcgttaaggcggtttaattgttttcggcgtcgattatgaatattatcggtttgtcgcgggatatcggattttagtcggtcgatacggcggagcgtacgtatcgcgtgatcgtcgcgtcgtcgagttggagtcgatcgcgcggtagtttttttaatagtcgtttgggcgtcgggaattcgacgagcgtttcgcgtttggtattttgttgaaggagcgaaatcgttatgtttttttatttttcgttattcgattgatgaggttcgttgtgaaggtgttaattataggttattttatcgatagtgacggtttcggcgtgtatgtgcgatttcgatatatgcggggttttagtacgataaattcgtagaagtataaattaggtaggcgtttttttcggcgtcggtagcgattagtcggttaaggtagtaatttttagcgttcgtatatttttcggtacgatgaaggtatcgtagatcgtttttaggagtaggtttacgatatgtcgt

SEQ ID NO: 28598 - DNA, 633 bp, Artificial Sequence
  chemically treated genomic DNA (Homo sapiens) CpG-island No: 28598
acgacatatcgtaaacctactcctaaaaacgatctacgataccttcatcgtaccgaaaaatatacgaacgctaaaaattactaccttaaccgactaatcgctaccgacgccgaaaaaaacgcctacctaatttatacttctacgaatttatcgtactaaaaccccgcatatatcgaaatcgcacatacacgccgaaaccgtcactatcgataaaataacctataattaacaccttcacaacgaacctcatcaatcgaataacgaaaaataaaaaaacataacgatttcgctccttcaacaaaataccaaacgcgaaacgctcgtcgaattcccgacgcccaaacgactattaaaaaaactaccgcgcgatcgactccaactcgacgacgcgacgatcacgcgatacgtacgctccgccgtatcgaccgactaaaatccgatatcccgcgacaaaccgataatattcataatcgacgccgaaaacaattaaaccgccttaacgcgaataccgaaaaaaccgacacgaacatatcgaacctaaaacgaatcacctatcgcctcaccgtaacgtccataatcgcactcgaattcgaaacgaacgttcgatctataccgaataacgaccgccgacga

SEQ ID NO: 28599 - DNA, 633 bp, Artificial Sequence
  chemically treated genomic DNA (Homo sapiens) CpG-island No: 28599
gcgatatgtcgtagatttgtttttgggggcggtttgcgatgtttttatcgtgtcggaagatgtgcgggcgttggggattgttgttttgatcggttggtcgttgtcggcgtcgggaaaagcgtttgtttgatttgtgtttttgcggatttgtcgtgttagagtttcgtatatgtcgaaatcgtatatgtacgtcggaatcgttattgtcgatggagtggtttatgattggtatttttatagcgaattttattagtcggatgacgaggggtggaagggtatgacgatttcgtttttttagtaggatgttaagcgcgaagcgttcgtcgaattttcggcgtttaagcggttgttgaaaggattgtcgcgcggtcggttttaattcgacgacgcgacgattacgcgatgcgtgcgtttcgtcgtgtcggtcggttgggattcgatgtttcgcggtaagtcggtggtatttatggtcgacgtcgaaggtaattgagtcgttttaacgcgggtgtcgaaaagatcggtacggatatgtcggatttaaggcggattatttgtcgttttatcgtggcgtttatggtcgtattcgggttcgagacggacgttcgatttgtgtcggatggcggtcgtcgacgg

SEQ ID NO: 28600 - DNA, 633 bp, Artificial Sequence
  chemically treated genomic DNA (Homo sapiens) CpG-island No: 28600
ccgtcgacgaccgccatccgacacaaatcgaacgtccgtctcgaacccgaatacgaccataaacgccacgataaaacgacaaataatccgccttaaatccgacatatccgtaccgatcttttcgacacccgcgttaaaacgactcaattaccttcgacgtcgaccataaataccaccgacttaccgcgaaacatcgaatcccaaccgaccgacacgacgaaacgcacgcatcgcgtaatcgtcgcgtcgtcgaattaaaaccgaccgcgcgacaatcctttcaacaaccgcttaaacgccgaaaattcgacgaacgcttcgcgcttaacatcctactaaaaaaacgaaatcgtcatacccttccacccctcgtcatccgactaataaaattcgctataaaaataccaatcataaaccactccatcgacaataacgattccgacgtacatatacgatttcgacatatacgaaactctaacacgacaaatccgcaaaaacacaaatcaaacaaacgcttttcccgacgccgacaacgaccaaccgatcaaaacaacaatccccaacgcccgcacatcttccgacacgataaaaacatcgcaaaccgcccccaaaaacaaatctacgacatatcgc

SEQ ID NO: 28601 - DNA, 993 bp, Artificial Sequence
  chemically treated genomic DNA (Homo sapiens) CpG-island No: 28601
cggtgttcggtgttacgttttcgatatggtttttgatttcgatatcgggtagcgtatttatttcgatttttatcggttggtcggggcgtattaggtttagttgcgtttttttgaagttcgtttcgatataaagttggttgacgggtacgatcgatatggtacgggtgtcggtttgtacgaattggtcgatacgtatcgttttgttgtcgatacggttcgcgatcgaggcgcggattagggtcgaatttagattgatttcggcggtatcgagttgcgttttggcggtttggttttgcgagcgggtttgttgtatttgggtatttagtgtgtcgacgcggcgttgcgtagcggcgagcgcggcggaggtattggcgacgcgggtattggtttgtcgtgtttggttttgaagttgcgataggcgttcgcggtttttcgtttttaagtcggcgagcggagtgtagcgcgttatttcggtttgggcgaagcgggtatcgttttgcgcggcgcgaagtttcgcgcgggcgcggtcgatcgcggtttgttgttcgcggatttgcgtttgaacgttttcggattggcgcgtgcgacgtcgatttgcgtttgaatttgcgcggtttgcgcgttataatcgcgcgtgtcgatttgaagtagcggttgggcggttttgacgttttgattttcgtcgacgaatattttgtcgatatagtcggatattttcggcgttacggttattgcgttcgtttggatgaaggcgtcgttggtcgattgtatatattggttaacgtttttgtagcgcgtatattagaatatttcgtcgataatcgcgatggcggttacgataagtagaatgattcggatacgtcgttttttttgcggcgatgcgatttcggtcgtatcgttttgcggtacgtgggttgcggcgtttttttggtcgttatttatttggttagcgtcgattatgtttttttttttgtcgatggaattaataggatt

SEQ ID NO: 28602 - DNA, 993 bp, Artificial Sequence
  chemically treated genomic DNA (Homo sapiens) CpG-island No: 28602
aatcctattaattccatcgacaaaaaaaaaaacataatcgacgctaaccaaataaataacgaccaaaaaaacgccgcaacccacgtaccgcaaaacgatacgaccgaaatcgcatcgccgcaaaaaaaacgacgtatccgaatcattctacttatcgtaaccgccatcgcgattatcgacgaaatattctaatatacgcgctacaaaaacgttaaccaatatatacaatcgaccaacgacgccttcatccaaacgaacgcaataaccgtaacgccgaaaatatccgactatatcgacaaaatattcgtcgacgaaaatcaaaacgtcaaaaccgcccaaccgctacttcaaatcgacacgcgcgattataacgcgcaaaccgcgcaaattcaaacgcaaatcgacgtcgcacgcgccaatccgaaaacgttcaaacgcaaatccgcgaacaacaaaccgcgatcgaccgcgcccgcgcgaaacttcgcgccgcgcaaaacgatacccgcttcgcccaaaccgaaataacgcgctacactccgctcgccgacttaaaaacgaaaaaccgcgaacgcctatcgcaacttcaaaaccaaacacgacaaaccaatacccgcgtcgccaatacctccgccgcgctcgccgctacgcaacgccgcgtcgacacactaaatacccaaatacaacaaacccgctcgcaaaaccaaaccgccaaaacgcaactcgataccgccgaaatcaatctaaattcgaccctaatccgcgcctcgatcgcgaaccgtatcgacaacaaaacgatacgtatcgaccaattcgtacaaaccgacacccgtaccatatcgatcgtacccgtcaaccaactttatatcgaaacgaacttcaaaaaaacgcaactaaacctaatacgccccgaccaaccgataaaaatcgaaataaatacgctacccgatatcgaaatcaaaaaccatatcgaaaacgtaacaccgaacaccg

SEQ ID NO: 28603 - DNA, 993 bp, Artificial Sequence
  chemically treated genomic DNA (Homo sapiens) CpG-island No: 28603
agttttattgattttatcgatagggaggggggtatggtcgacgttaattaagtaaatgacggttaggaagacgtcgtaatttacgtgtcgtaggacgatgcggtcgaggtcgtatcgtcgtagaagaagcggcgtattcgggttattttgtttgtcgtggtcgttatcgcgattatcggcggggtgttttggtatgcgcgttataagagcgttggttagtatatgtagtcgattaacgacgtttttatttaggcggacgtagtgatcgtggcgtcgaaggtgttcggttatgtcgataaggtgttcgtcggcgagaattaggacgttaaggtcgtttagtcgttgttttagatcgatacgcgcgattatagcgcgtagatcgcgtagatttaggcgtagatcggcgtcgtacgcgttaattcgagggcgtttaggcgtagattcgcgagtagtaagtcgcgatcgatcgcgttcgcgcggagtttcgcgtcgcgtagagcgatgttcgtttcgtttaggtcgaagtgacgcgttatatttcgttcgtcggtttgggggcggagagtcgcgagcgtttgtcgtagttttagaattaggtacggtaggttaatgttcgcgtcgttagtgttttcgtcgcgttcgtcgttgcgtagcgtcgcgtcggtatattgaatgtttaggtgtagtaggttcgttcgtagggttaggtcgttaaggcgtagttcgatgtcgtcgaggttaatttgggttcgattttgattcgcgtttcgatcgcgggtcgtgtcggtaataagacggtgcgtgtcggttagttcgtataggtcggtattcgtattatgtcgatcgtgttcgttagttagttttatatcgaggcgaattttaaggaaacgtaattgggtttgatgcgtttcggttagtcggtgaagatcgaggtggatgcgttgttcgatgtcgagattaagggttatgtcgaaagcgtggtatcgggtatcg

SEQ ID NO: 28604 - DNA, 993 bp, Artificial Sequence
  chemically treated genomic DNA (Homo sapiens) CpG-island No: 28604
cgatacccgataccacgctttcgacataacccttaatctcgacatcgaacaacgcatccacctcgatcttcaccgactaaccgaaacgcatcaaacccaattacgtttccttaaaattcgcctcgatataaaactaactaacgaacacgatcgacataatacgaataccgacctatacgaactaaccgacacgcaccgtcttattaccgacacgacccgcgatcgaaacgcgaatcaaaatcgaacccaaattaacctcgacgacatcgaactacgccttaacgacctaaccctacgaacgaacctactacacctaaacattcaatataccgacgcgacgctacgcaacgacgaacgcgacgaaaacactaacgacgcgaacattaacctaccgtacctaattctaaaactacgacaaacgctcgcgactctccgcccccaaaccgacgaacgaaatataacgcgtcacttcgacctaaacgaaacgaacatcgctctacgcgacgcgaaactccgcgcgaacgcgatcgatcgcgacttactactcgcgaatctacgcctaaacgccctcgaattaacgcgtacgacgccgatctacgcctaaatctacgcgatctacgcgctataatcgcgcgtatcgatctaaaacaacgactaaacgaccttaacgtcctaattctcgccgacgaacaccttatcgacataaccgaacaccttcgacgccacgatcactacgtccgcctaaataaaaacgtcgttaatcgactacatatactaaccaacgctcttataacgcgcataccaaaacaccccgccgataatcgcgataacgaccacgacaaacaaaataacccgaatacgccgcttcttctacgacgatacgacctcgaccgcatcgtcctacgacacgtaaattacgacgtcttcctaaccgtcatttacttaattaacgtcgaccatacccccctccctatcgataaaatcaataaaact

SEQ ID NO: 28605 - DNA, 971 bp, Artificial Sequence
  chemically treated genomic DNA (Homo sapiens) CpG-island No: 28605
cggtatgtcgtcgtttggatcggtttttttagttatttcgaattatgggaagaggatttggagtttgcgcgtgaggaggtgttggtttttgcgcgtgcggtttatgtcgatggtcggggcgaacgggtgattttggtcgtcgtcgatggcgaggcggcggatgcggcgcgcgttatggcgggtaatgtggcggacgtggtggtatagtcgttcggcgatataaggttgcgcgatatcgggtcgatcgttatcggcgacggttcggttcggttgttttagtttaacggttggggcgcgaagatatatttgttttgcgacgatacggtcgcgggcgtttggtcgaagatcgagttttcggcgttacggtatgcgattgggtgttggaaaggggcgcgatcgatgtcgacggtatcggtttggtcgtgattacgcgttagtgtttgttttattttaatcgtaatttcgagttggacgaagttacgatcgagtagcggttgggtcgaggatttggggtgattcgcgtggtttggttgggcgacgggatgtttaacgattatatcgacggttatgtcgataatttggcgcgtttcgtcgggtcgaatcgcgtcgcgattttcgaggcggcggagagcgattttaattggtaggtttatgttatcgtttagcgtaacgttaaggcggtcgggttgaacgtgtagacgatttagtcgtcgggttgtgttttgcgcgatgaagagatcgtttcgattagtaatatgaatttttatatcggtaatgcggcggtggtcgtgtttatttatggtatcgataatgacgaggtcggcgtcgcggcgatttaggcgatttttttcgatcgttaggtggtgggtttgcgcgtcgatacgattttgatcggcggcggtagtttttattgtatttcgtagtagatttcggttttttcgttgtttttgatttaaagtaagcgttttttt

SEQ ID NO: 28606 - DNA, 971 bp, Artificial Sequence
  chemically treated genomic DNA (Homo sapiens) CpG-island No: 28606
aaaaaaacgcttactttaaatcaaaaacaacgaaaaaaccgaaatctactacgaaatacaataaaaactaccgccgccgatcaaaatcgtatcgacgcgcaaacccaccacctaacgatcgaaaaaaatcgcctaaatcgccgcgacgccgacctcgtcattatcgataccataaataaacacgaccaccgccgcattaccgatataaaaattcatattactaatcgaaacgatctcttcatcgcgcaaaacacaacccgacgactaaatcgtctacacgttcaacccgaccgccttaacgttacgctaaacgataacataaacctaccaattaaaatcgctctccgccgcctcgaaaatcgcgacgcgattcgacccgacgaaacgcgccaaattatcgacataaccgtcgatataatcgttaaacatcccgtcgcccaaccaaaccacgcgaatcaccccaaatcctcgacccaaccgctactcgatcgtaacttcgtccaactcgaaattacgattaaaataaaacaaacactaacgcgtaatcacgaccaaaccgataccgtcgacatcgatcgcgcccctttccaacacccaatcgcataccgtaacgccgaaaactcgatcttcgaccaaacgcccgcgaccgtatcgtcgcaaaacaaatatatcttcgcgccccaaccgttaaactaaaacaaccgaaccgaaccgtcgccgataacgatcgacccgatatcgcgcaaccttatatcgccgaacgactataccaccacgtccgccacattacccgccataacgcgcgccgcatccgccgcctcgccatcgacgacgaccaaaatcacccgttcgccccgaccatcgacataaaccgcacgcgcaaaaaccaacacctcctcacgcgcaaactccaaatcctcttcccataattcgaaataactaaaaaaaccgatccaaacgacgacataccg

SEQ ID NO: 28607 - DNA, 971 bp, Artificial Sequence
  chemically treated genomic DNA (Homo sapiens) CpG-island No: 28607
ggggaagcgtttgttttggattagaggtagcgaggaggtcggaatttgttgcgaaatatagtgaaagttgtcgtcgtcggttaggatcgtatcggcgcgtaggtttattatttgacgatcggggaagatcgtttggatcgtcgcgacgtcggtttcgttattgtcggtgttatagatgggtacgattatcgtcgtattgtcgatatagaagtttatattgttggtcggaacgatttttttatcgcgtaggatatagttcggcgattggatcgtttatacgtttaattcggtcgttttggcgttgcgttgggcggtggtatagatttgttaattggggtcgtttttcgtcgtttcggagatcgcgacgcggttcggttcgacgaagcgcgttagattgtcgatatggtcgtcggtatgatcgttaagtatttcgtcgtttagttagattacgcgggttattttaaattttcggtttagtcgttgttcgatcgtggtttcgtttagttcggggttgcggttgaggtagaataggtattggcgcgtggttacgattagatcggtgtcgtcggtatcgatcgcgtttttttttagtatttagtcgtatgtcgtggcgtcgaagattcgattttcggttaggcgttcgcgatcgtgtcgtcgtagggtagatgtattttcgcgttttagtcgttgaattggaatagtcgggtcgagtcgtcgtcggtgacgatcggttcggtatcgcgtagttttatgtcgtcgaacggttgtattattacgttcgttatattgttcgttatggcgcgcgtcgtattcgtcgtttcgttatcggcggcgattaggattattcgttcgtttcggttatcggtatgaatcgtacgcgtaaaggttaatatttttttacgcgtaggttttagattttttttttataattcgggatggttggggaaatcgatttagacggcggtatgtcg

SEQ ID NO: 28608 - DNA, 971 bp, Artificial Sequence
  chemically treated genomic DNA (Homo sapiens) CpG-island No: 28608
cgacataccgccgtctaaatcgatttccccaaccatcccgaattataaaaaaaaaatctaaaacctacgcgtaaaaaaatattaacctttacgcgtacgattcataccgataaccgaaacgaacgaataatcctaatcgccgccgataacgaaacgacgaatacgacgcgcgccataacgaacaatataacgaacgtaataatacaaccgttcgacgacataaaactacgcgataccgaaccgatcgtcaccgacgacgactcgacccgactattccaattcaacgactaaaacgcgaaaatacatctaccctacgacgacacgatcgcgaacgcctaaccgaaaatcgaatcttcgacgccacgacatacgactaaatactaaaaaaaaacgcgatcgataccgacgacaccgatctaatcgtaaccacgcgccaatacctattctacctcaaccgcaaccccgaactaaacgaaaccacgatcgaacaacgactaaaccgaaaatttaaaataacccgcgtaatctaactaaacgacgaaatacttaacgatcataccgacgaccatatcgacaatctaacgcgcttcgtcgaaccgaaccgcgtcgcgatctccgaaacgacgaaaaacgaccccaattaacaaatctataccaccgcccaacgcaacgccaaaacgaccgaattaaacgtataaacgatccaatcgccgaactatatcctacgcgataaaaaaatcgttccgaccaacaatataaacttctatatcgacaatacgacgataatcgtacccatctataacaccgacaataacgaaaccgacgtcgcgacgatccaaacgatcttccccgatcgtcaaataataaacctacgcgccgatacgatcctaaccgacgacgacaactttcactatatttcgcaacaaattccgacctcctcgctacctctaatccaaaacaaacgcttcccc

SEQ ID NO: 28609 - DNA, 961 bp, Artificial Sequence
  chemically treated genomic DNA (Homo sapiens) CpG-island No: 28609
tcgggatgtcgggtaggatttgaagcgtgatcgcgcggaatttttttttggtgatgaagtttattattcgtatcgtcggcggatagtcgaagcgcgtcgttttttgttcgggtagtatttcgattcgttttatcgttttatagggtaggttttggaattcggcgaagttcgatatgcgtcgttcgttgagtagtattatcggttcgttttcgttcgtcgaattggttagcgattttattcgtttgagtagttcggttaggttgggcgcgtttagcgtcgtaatcgtttcggtatcgagtatcgcgatcggttcgatcgtttcgatgacggagtcgggaatgcgtttgtcggtgacggtgattttcgtagggggtgtttgttcgtcgggatcggtttgcgttatcgtttttgtcggtatcgttagttttaagacgatcgtcgattattttacgtcgtttttcggtcgcgcgcgttttttatatcgtatcgtttagttatttttatcgtcgacgtgatggtgatgtttagtgtggtaattatgttataattaaggttcgtgtttcgttatatcgacggaatatcgcggtggtcgtttgtcgtggtttttataattgacgtgaagatatggtttgtttattcgttcgacgattgtcgaataaggttaaacgatcgcgacgatatgtagggagaagcgttcgcgatgagtatgaatgtcgtcgttagagtgggcgattcgatcggttatagttttagttagggtttgttcggcgaggcgttggatggtttgttttttgttcgtcgtagcgaggtggatatgcgcgcgggtaatttcggtcggttgatcgcgcgcgggttgagcggcggacgttggacgtcggtcgatggttagttgacgttcggatcgcgcgacgtttttattaatggttttttcgttattatgacgattcggtcgatcggttaa

SEQ ID NO: 28610 - DNA, 961 bp, Artificial Sequence
  chemically treated genomic DNA (Homo sapiens) CpG-island No: 28610
ttaaccgatcgaccgaatcgtcataataacgaaaaaaccattaataaaaacgtcgcgcgatccgaacgtcaactaaccatcgaccgacgtccaacgtccgccgctcaacccgcgcgcgatcaaccgaccgaaattacccgcgcgcatatccacctcgctacgacgaacaaaaaacaaaccatccaacgcctcgccgaacaaaccctaactaaaactataaccgatcgaatcgcccactctaacgacgacattcatactcatcgcgaacgcttctccctacatatcgtcgcgatcgtttaaccttattcgacaatcgtcgaacgaataaacaaaccatatcttcacgtcaattataaaaaccacgacaaacgaccaccgcgatattccgtcgatataacgaaacacgaaccttaattataacataattaccacactaaacatcaccatcacgtcgacgataaaaataactaaacgatacgatataaaaaacgcgcgcgaccgaaaaacgacgtaaaataatcgacgatcgtcttaaaactaacgataccgacaaaaacgataacgcaaaccgatcccgacgaacaaacaccccctacgaaaatcaccgtcaccgacaaacgcattcccgactccgtcatcgaaacgatcgaaccgatcgcgatactcgataccgaaacgattacgacgctaaacgcgcccaacctaaccgaactactcaaacgaataaaatcgctaaccaattcgacgaacgaaaacgaaccgataatactactcaacgaacgacgcatatcgaacttcgccgaattccaaaacctaccctataaaacgataaaacgaatcgaaatactacccgaacaaaaaacgacgcgcttcgactatccgccgacgatacgaataataaacttcatcaccaaaaaaaaattccgcgcgatcacgcttcaaatcctacccgacatcccga

SEQ ID NO: 28611 - DNA, 961 bp, Artificial Sequence
  chemically treated genomic DNA (Homo sapiens) CpG-island No: 28611
ttggtcggtcgatcggatcgttatggtggcgggggggttattgatgaagacgtcgcgcgattcgagcgttagttggttatcggtcggcgtttagcgttcgtcgtttagttcgcgcgcgattagtcggtcgagattgttcgcgcgtatgtttatttcgttgcgacgggtaaagaataaattatttagcgtttcgtcgaataggttttggttaaagttgtggtcgatcggatcgtttattttggcggcggtatttatgtttatcgcgggcgtttttttttgtatgtcgtcgcgatcgtttgattttattcgataatcgtcggacgggtaaataagttatatttttacgttagttatgaaaattacggtaggcggttatcgcgatatttcgtcgatatggcgaagtacgagttttaattgtgatatgattgttatattaaatattattattacgtcggcgatgggagtggttggacgatgcggtatggggagcgcgcgcggtcgaggggcggcgtgggatggtcggcggtcgttttgggattggcgatatcgatagggacgatggcgtaggtcgatttcggcgaataggtattttttgcggaagttatcgttatcggtaagcgtattttcggtttcgttatcggggcggtcgagtcggtcgcggtgttcgatgtcgaggcgattgcggcgttgggcgcgtttagtttggtcgaattgtttaagcgggtgaagtcgttgattagttcggcgagcgggggcgagtcggtgatgttgtttaacgggcggcgtatatcgggtttcgtcgagttttagaatttgttttatgaggcgatggagcggatcgaagtgttgttcgagtaggaggcggcgcgtttcggttattcgtcgacggtgcgggtgatgaattttattattaagaagaaatttcgcgcggttacgttttaggttttgttcggtatttcga

SEQ ID NO: 28612 - DNA, 961 bp, Artificial Sequence
  chemically treated genomic DNA (Homo sapiens) CpG-island No: 28612
tcgaaataccgaacaaaacctaaaacgtaaccgcgcgaaatttcttcttaataataaaattcatcacccgcaccgtcgacgaataaccgaaacgcgccgcctcctactcgaacaacacttcgatccgctccatcgcctcataaaacaaattctaaaactcgacgaaacccgatatacgccgcccgttaaacaacatcaccgactcgcccccgctcgccgaactaatcaacgacttcacccgcttaaacaattcgaccaaactaaacgcgcccaacgccgcaatcgcctcgacatcgaacaccgcgaccgactcgaccgccccgataacgaaaccgaaaatacgcttaccgataacgataacttccgcaaaaaatacctattcgccgaaatcgacctacgccatcgtccctatcgatatcgccaatcccaaaacgaccgccgaccatcccacgccgcccctcgaccgcgcgcgctccccataccgcatcgtccaaccactcccatcgccgacgtaataataatatttaatataacaatcatatcacaattaaaactcgtacttcgccatatcgacgaaatatcgcgataaccgcctaccgtaattttcataactaacgtaaaaatataacttatttacccgtccgacgattatcgaataaaatcaaacgatcgcgacgacatacaaaaaaaaacgcccgcgataaacataaataccgccgccaaaataaacgatccgatcgaccacaactttaaccaaaacctattcgacgaaacgctaaataatttattctttacccgtcgcaacgaaataaacatacgcgcgaacaatctcgaccgactaatcgcgcgcgaactaaacgacgaacgctaaacgccgaccgataaccaactaacgctcgaatcgcgcgacgtcttcatcaataacccccccgccaccataacgatccgatcgaccgaccaa

SEQ ID NO: 28613 - DNA, 510 bp, Artificial Sequence
  chemically treated genomic DNA (Homo sapiens) CpG-island No: 28613
ttcgttagggttataatgagtagtttcgtcgtaaaacgatttgatattcggatcgaggtcgtttcgttaaatacgttattttgaatagcggcgtaggatgttgtcgcgaagtcggtgatcgacggttttgggcgcgataggattatgatgtttaagcgtcgtataaggatgtacgattaaatcgagcgtatttgtttttttgatattttaggcggtcgtggaaattatatattcgtatcgttaggatcgggcgtttgcggggttattatgtttcgtaacggatatgagtcgaatagattcgcgtcgtattaaaggacgatatcggttataagataatattttgtagtattttgttgatcggcgttgtcgggttcgttatcgcgtaggttttcgattatatcgataggggtgttcgggttatagcggttaggttttagtatgcgattcgttatcgggtttaggcggagtttttgttatttttttttaatttggttgttattattggtaagg

SEQ ID NO: 28614 - DNA, 510 bp, Artificial Sequence
  chemically treated genomic DNA (Homo sapiens) CpG-island No: 28614
ccttaccaataataacaaccaaattaaaaaaaaataacaaaaactccgcctaaacccgataacgaatcgcatactaaaacctaaccgctataacccgaacacccctatcgatataatcgaaaacctacgcgataacgaacccgacaacgccgatcaacaaaatactacaaaatattatcttataaccgatatcgtcctttaatacgacgcgaatctattcgactcatatccgttacgaaacataataaccccgcaaacgcccgatcctaacgatacgaatatataatttccacgaccgcctaaaatatcaaaaaaacaaatacgctcgatttaatcgtacatccttatacgacgcttaaacatcataatcctatcgcgcccaaaaccgtcgatcaccgacttcgcgacaacatcctacgccgctattcaaaataacgtatttaacgaaacgacctcgatccgaatatcaaatcgttttacgacgaaactactcattataaccctaacgaa

SEQ ID NO: 28615 - DNA, 510 bp, Artificial Sequence
  chemically treated genomic DNA (Homo sapiens) CpG-island No: 28615
ttttgttagtggtggtagttagattgagaaagagtgataggaatttcgtttgggttcggtggcggatcgtatgttgaaatttgatcgttatagttcgaatatttttgtcggtgtggtcgggagtttgcgcggtagcgggttcggtagcgtcgattagtagggtgttgtaaggtgttattttatggtcgatgtcgttttttggtgcgacgcggatttgttcggtttatgttcgttacgagatatggtaatttcgtaagcgttcgattttaacgatgcgggtatgtagtttttacggtcgtttggaatattaggaaggtagatacgttcgatttggtcgtgtatttttatgcgacgtttgagtattatgattttatcgcgtttaaaatcgtcgattatcgatttcgcggtagtattttacgtcgttgtttaggataacgtatttggcggaacggtttcggttcgggtgttaggtcgttttgcggcgggattgtttattatagttttggcgga

SEQ ID NO: 28616 - DNA, 510 bp, Artificial Sequence
  chemically treated genomic DNA (Homo sapiens) CpG-island No: 28616
tccgccaaaactataataaacaatcccgccgcaaaacgacctaacacccgaaccgaaaccgttccgccaaatacgttatcctaaacaacgacgtaaaatactaccgcgaaatcgataatcgacgattttaaacgcgataaaatcataatactcaaacgtcgcataaaaatacacgaccaaatcgaacgtatctaccttcctaatattccaaacgaccgtaaaaactacatacccgcatcgttaaaatcgaacgcttacgaaattaccatatctcgtaacgaacataaaccgaacaaatccgcgtcgcaccaaaaaacgacatcgaccataaaataacaccttacaacaccctactaatcgacgctaccgaacccgctaccgcgcaaactcccgaccacaccgacaaaaatattcgaactataacgatcaaatttcaacatacgatccgccaccgaacccaaacgaaattcctatcactctttctcaatctaactaccaccactaacaaaa

SEQ ID NO: 28617 - DNA, 637 bp, Artificial Sequence
  chemically treated genomic DNA (Homo sapiens) CpG-island No: 28617
gcggtagcgacggcgttttgaacggtaatatatagtaagtaatcgtgacgattacgttttagatgaatagcgttagtaaaggtcgttaaatttcggcgatgatgatgcgggtgcggggtacggtatcgacgattaaattaggttttttttaaacggttatttagtgttttttagggcgtagtaacgtcgggtaattcggttggatgcgttatcgaaataatagtgcgatgtagtaaaggaaggggcggacgggtatcggatattaaacgttacgaatcgttatagatttgttatcgattggatcgtcggtaattcgtttaatcgttggtattttttgggacgtttaaaatatcgttcgtatatatgatcgtcggggtcgtttttgtcgtatagaggttggttcggtaatgatagaaatataacgttttttttttcgtttcgtattttgatcgtcgtcggtttcgatttcggcggcggcgtcggtatttaggcggatatttaagattcgtgaggatgatggggcgattaatttttaatgataacgattaatcgcgattatcgcgtaaaataatttgtttcgtgtagcgggtgtattttcgtttaaaaatttgggtaatgtgtaagatgatagcggatg

SEQ ID NO: 28618 - DNA, 637 bp, Artificial Sequence
  chemically treated genomic DNA (Homo sapiens) CpG-island No: 28618
catccgctatcatcttacacattacccaaatttttaaacgaaaatacacccgctacacgaaacaaattattttacgcgataatcgcgattaatcgttatcattaaaaattaatcgccccatcatcctcacgaatcttaaatatccgcctaaataccgacgccgccgccgaaatcgaaaccgacgacgatcaaaatacgaaacgaaaaaaaaaacgttatatttctatcattaccgaaccaacctctatacgacaaaaacgaccccgacgatcatatatacgaacgatattttaaacgtcccaaaaaataccaacgattaaacgaattaccgacgatccaatcgataacaaatctataacgattcgtaacgtttaatatccgatacccgtccgccccttcctttactacatcgcactattatttcgataacgcatccaaccgaattacccgacgttactacgccctaaaaaacactaaataaccgtttaaaaaaaacctaatttaatcgtcgataccgtaccccgcacccgcatcatcatcgccgaaatttaacgacctttactaacgctattcatctaaaacgtaatcgtcacgattacttactatatattaccgttcaaaacgccgtcgctaccgc

SEQ ID NO: 28619 - DNA, 637 bp, Artificial Sequence
  chemically treated genomic DNA (Homo sapiens) CpG-island No: 28619
tattcgttgttattttgtatattatttaggtttttggacggagatgtattcgttgtacggggtagattgttttgcgcggtgatcgcggttgatcgttgttattggggattggtcgttttattatttttacgggttttggatgttcgtttggatgtcggcgtcgtcgtcggagtcggagtcggcgacgattaggatgcggggcggaggggaggacgttatgtttttgttattgtcgggttagtttttgtgcggtaagggcggtttcggcgattatgtgtacggacggtattttgggcgttttaagaaatgttaacggttgaacgggttgtcggcggtttagtcgatggtaagtttatggcggttcgtgacgtttgatgttcggtgttcgttcgtttttttttttgttgtatcgtattattatttcggtggcgtatttaatcggattgttcggcgttgttgcgttttgaggaatattgggtggtcgtttgagggagatttgatttgatcgtcgatgtcgtatttcgtattcgtattattatcgtcgaggtttggcggtttttgttggcgttgtttatttgggacgtgatcgttacgattgtttattatgtattgtcgtttaaggcgtcgtcgttgtcgt

SEQ ID NO: 28620 - DNA, 637 bp, Artificial Sequence
  chemically treated genomic DNA (Homo sapiens) CpG-island No: 28620
acgacaacgacgacgccttaaacgacaatacataataaacaatcgtaacgatcacgtcccaaataaacaacgccaacaaaaaccgccaaacctcgacgataataatacgaatacgaaatacgacatcgacgatcaaatcaaatctccctcaaacgaccacccaatattcctcaaaacgcaacaacgccgaacaatccgattaaatacgccaccgaaataataatacgatacaacaaaaaaaaaaacgaacgaacaccgaacatcaaacgtcacgaaccgccataaacttaccatcgactaaaccgccgacaacccgttcaaccgttaacatttcttaaaacgcccaaaataccgtccgtacacataatcgccgaaaccgcccttaccgcacaaaaactaacccgacaataacaaaaacataacgtcctcccctccgccccgcatcctaatcgtcgccgactccgactccgacgacgacgccgacatccaaacgaacatccaaaacccgtaaaaataataaaacgaccaatccccaataacaacgatcaaccgcgatcaccgcgcaaaacaatctaccccgtacaacgaatacatctccgtccaaaaacctaaataatatacaaaataacaacgaata

SEQ ID NO: 28621 - DNA, 792 bp, Artificial Sequence
  chemically treated genomic DNA (Homo sapiens) CpG-island No: 28621
cgattcgatcggttcgatcgaagttttcgtcgacgtttattggggcgcgtagatcgaacggagttttgagaatttttttttcggcgcgcgcgagtagatgtcgatcggtatcgtttatgcgttcgttatcgttaaaaaggtcgcggtacggattaatcgcggttatggtttcgcgggcgaaaaggtcgatgcgatcgaatcggcggcgtaggaggtgatcgaggggcggtatgacgattagttttcgttggttatttggtagatcggtttcggtatttagtttaatatgaacgttaatgaggtgatcgcgggtcgtgttaacgaaattttgatcggtacgcgtgggggaaaagtcgttcgtttattttaatgacgacgttaatcgcggttagttttttaacgatattttttcgattgcgttttatgtcgttgtcgtttttgcggtgacgaagtagtttttttttcgcgttcgatcggttttacgtcgcgttcgatgttaaggttaaggaatgggattcgatcgttaagatcggtcgtatttatttgtaggacgcgatttcgttgattttgggttaggaatttttcggttatgtttagtaattcgttaatgttcgcgatcggatcgaggggacgttttatcgtaatattttgtcgttcgcgtaagggggtacggcggtcggtatcggtttgaacgcgtcgtatggttttgtcgaggcgatcgtagtcgagatcgtcgacgcgatcgggttcgatttcgttatcgcgttttataagttttaggagtaggcgagt

SEQ ID NO: 28622 - DNA, 792 bp, Artificial Sequence
  chemically treated genomic DNA (Homo sapiens) CpG-island No: 28622
actcgcctactcctaaaacttataaaacgcgataacgaaatcgaacccgatcgcgtcgacgatctcgactacgatcgcctcgacaaaaccatacgacgcgttcaaaccgataccgaccgccgtacccccttacgcgaacgacaaaatattacgataaaacgtcccctcgatccgatcgcgaacattaacgaattactaaacataaccgaaaaattcctaacccaaaatcaacgaaatcgcgtcctacaaataaatacgaccgatcttaacgatcgaatcccattccttaaccttaacatcgaacgcgacgtaaaaccgatcgaacgcgaaaaaaaaactacttcgtcaccgcaaaaacgacaacgacataaaacgcaatcgaaaaaatatcgttaaaaaactaaccgcgattaacgtcgtcattaaaataaacgaacgacttttcccccacgcgtaccgatcaaaatttcgttaacacgacccgcgatcacctcattaacgttcatattaaactaaataccgaaaccgatctaccaaataaccaacgaaaactaatcgtcataccgcccctcgatcacctcctacgccgccgattcgatcgcatcgaccttttcgcccgcgaaaccataaccgcgattaatccgtaccgcgacctttttaacgataacgaacgcataaacgataccgatcgacatctactcgcgcgcgccgaaaaaaaaattctcaaaactccgttcgatctacgcgccccaataaacgtcgacgaaaacttcgatcgaaccgatcgaatcg

SEQ ID NO: 28623 - DNA, 792 bp, Artificial Sequence
  chemically treated genomic DNA (Homo sapiens) CpG-island No: 28623
gttcgtttgtttttggaatttgtggggcgcggtggcgaagtcgagttcggtcgcgtcggcgatttcggttgcgatcgtttcggtaaaattatgcggcgcgtttagatcggtgtcgatcgtcgtgtttttttgcgcgagcggtaggatgttgcggtgaagcgttttttcgattcggtcgcgggtattggcgagttgttggatatagtcggagaatttttggtttaaagttagcggggtcgcgttttgtaaatgggtgcggtcgattttgacgatcgaattttattttttggttttggtatcgagcgcggcgtgaagtcggtcgagcgcgggagaaaagttgtttcgttatcgtaagagcggtagcgatatggagcgtagtcgggaaggtatcgttggaggattgatcgcgattgacgtcgttattagggtgaacgggcgattttttttttacgcgtatcggttaggatttcgttggtacggttcgcgattattttattggcgtttatgttggattgggtgtcggagtcggtttgttagatgattagcgggaattggtcgttatgtcgtttttcgattattttttgcgtcgtcgattcgatcgtatcggttttttcgttcgcgaggttatggtcgcgattgattcgtgtcgcggtttttttaacgatggcgagcgtatggacgatgtcgatcggtatttgttcgcgcgcgtcgaaggggaaatttttaagatttcgttcggtttgcgcgttttaataggcgtcggcggggatttcgatcgggtcgatcgaatcg

SEQ ID NO: 28624 - DNA, 792 bp, Artificial Sequence
  chemically treated genomic DNA (Homo sapiens) CpG-island No: 28624
cgattcgatcgacccgatcgaaatccccgccgacgcctattaaaacgcgcaaaccgaacgaaatcttaaaaatttccccttcgacgcgcgcgaacaaataccgatcgacatcgtccatacgctcgccatcgttaaaaaaaccgcgacacgaatcaatcgcgaccataacctcgcgaacgaaaaaaccgatacgatcgaatcgacgacgcaaaaaataatcgaaaaacgacataacgaccaattcccgctaatcatctaacaaaccgactccgacacccaatccaacataaacgccaataaaataatcgcgaaccgtaccaacgaaatcctaaccgatacgcgtaaaaaaaaaatcgcccgttcaccctaataacgacgtcaatcgcgatcaatcctccaacgataccttcccgactacgctccatatcgctaccgctcttacgataacgaaacaacttttctcccgcgctcgaccgacttcacgccgcgctcgataccaaaaccaaaaaataaaattcgatcgtcaaaatcgaccgcacccatttacaaaacgcgaccccgctaactttaaaccaaaaattctccgactatatccaacaactcgccaatacccgcgaccgaatcgaaaaaacgcttcaccgcaacatcctaccgctcgcgcaaaaaaacacgacgatcgacaccgatctaaacgcgccgcataattttaccgaaacgatcgcaaccgaaatcgccgacgcgaccgaactcgacttcgccaccgcgccccacaaattccaaaaacaaacgaac

SEQ ID NO: 28625 - DNA, 654 bp, Artificial Sequence
  chemically treated genomic DNA (Homo sapiens) CpG-island No: 28625
atagcgttacgagtattcgcgtgaaggtaacggcggtgaatacgttggtcgcgatgtcgattagtagtacgatcgcgaaattttttatcggtttcgagtcgagtacgagtatgatgatattcgagatggcgtgggttatattcgtttcgaagatcgtacggttggtttttttgtaatttagttcgatcgattggacgacgtttcgttcgcgtcgtcgtttttcgcgaatgcgttcgttgattagtacgttcgcgtcgatttgtcgtgtcgatggttagtacgaagttcgcgatattcggtagggttagcgtcgcgttgagtatttttattacggttaggatgattagtacgttgatgacgatcgcgatgttagtatagatgtcgaagcgattataggtgagggttatgaatacgatttcggcgattttcgcgatcgaggagcggagtatgttcgcgtggatagagtcggcgtttaggttcggttcgacggtgcgtttttagtcgatttttagatcgatcggtagtttggtcgaatatagcgagatcgttagttgattggcggtatcgacggtggagttgtcgttgatcgaggcgcgttcgtttaggatcggttcgttaatatttcgggcggaaagtatttggttattataaaat

SEQ ID NO: 28626 - DNA, 654 bp, Artificial Sequence
  chemically treated genomic DNA (Homo sapiens) CpG-island No: 28626
attttataataaccaaatactttccgcccgaaatattaacgaaccgatcctaaacgaacgcgcctcgatcaacgacaactccaccgtcgataccgccaatcaactaacgatctcgctatattcgaccaaactaccgatcgatctaaaaatcgactaaaaacgcaccgtcgaaccgaacctaaacgccgactctatccacgcgaacatactccgctcctcgatcgcgaaaatcgccgaaatcgtattcataaccctcacctataatcgcttcgacatctatactaacatcgcgatcgtcatcaacgtactaatcatcctaaccgtaataaaaatactcaacgcgacgctaaccctaccgaatatcgcgaacttcgtactaaccatcgacacgacaaatcgacgcgaacgtactaatcaacgaacgcattcgcgaaaaacgacgacgcgaacgaaacgtcgtccaatcgatcgaactaaattacaaaaaaaccaaccgtacgatcttcgaaacgaatataacccacgccatctcgaatatcatcatactcgtactcgactcgaaaccgataaaaaatttcgcgatcgtactactaatcgacatcgcgaccaacgtattcaccgccgttaccttcacgcgaatactcgtaacgctat

SEQ ID NO: 28627 - DNA, 654 bp, Artificial Sequence
  chemically treated genomic DNA (Homo sapiens) CpG-island No: 28627
attttatgatggttaagtgtttttcgttcggaatattaacgaatcgattttgggcggacgcgtttcgattagcggtaattttatcgtcgatatcgttaattagttggcgatttcgttgtgttcggttaagttgtcgatcgatttgaaggtcggttaagagcgtatcgtcgggtcggatttgggcgtcgattttatttacgcgggtatatttcgtttttcgatcgcggagatcgtcgagatcgtgtttatgatttttatttatggtcgtttcggtatttatgttaatatcgcggtcgttattaacgtgttggttattttggtcgtgatggggatgtttaacgcgacgttgattttgtcgggtatcgcgggtttcgtgttgattatcggtacgatagatcgacgcgaacgtgttgattaacgagcgtattcgcgaagaacgacggcgcggacgaagcgtcgtttagtcggtcgagttgggttataaggaagttagtcgtacgattttcgaggcgaatgtgatttacgttatttcgggtgttattatgttcgtgttcggttcggggtcggtgaagggtttcgcggtcgtgttgttgatcggtatcgcgattagcgtgtttatcgtcgttatttttacgcggatgttcgtggcgttgt

SEQ ID NO: 28628 - DNA, 654 bp, Artificial Sequence
  chemically treated genomic DNA (Homo sapiens) CpG-island No: 28628
acaacgccacgaacatccgcgtaaaaataacgacgataaacacgctaatcgcgataccgatcaacaacacgaccgcgaaacccttcaccgaccccgaaccgaacacgaacataataacacccgaaataacgtaaatcacattcgcctcgaaaatcgtacgactaacttccttataacccaactcgaccgactaaacgacgcttcgtccgcgccgtcgttcttcgcgaatacgctcgttaatcaacacgttcgcgtcgatctatcgtaccgataatcaacacgaaacccgcgatacccgacaaaatcaacgtcgcgttaaacatccccatcacgaccaaaataaccaacacgttaataacgaccgcgatattaacataaataccgaaacgaccataaataaaaatcataaacacgatctcgacgatctccgcgatcgaaaaacgaaatatacccgcgtaaataaaatcgacgcccaaatccgacccgacgatacgctcttaaccgaccttcaaatcgatcgacaacttaaccgaacacaacgaaatcgccaactaattaacgatatcgacgataaaattaccgctaatcgaaacgcgtccgcccaaaatcgattcgttaatattccgaacgaaaaacacttaaccatcataaaat

SEQ ID NO: 28629 - DNA, 866 bp, Artificial Sequence
  chemically treated genomic DNA (Homo sapiens) CpG-island No: 28629
ggttacgaggcgttcgggaagtgtgtttaatgttcgaagtagtttttattcgggcggttttgagttcgggtcgcgttttggtgtattttttttgacgtttgttatttatagtttggggtaggagagtggcgacggcgaggagtaattgtacgcgatttgggattttgttttgtttcgcggttcgcgttattatggtaattgtaggtagttagtatcgacggcgggaaaacgaggatcggagtcgcgttatagttttggttttcgagtagtttagggagagtttttgcgttttttagttttcgtttttttttatgtcggaggttttaagttcgtagcgaagttcgtaaagagtttttttcgacgtttacgagatcggaagtgtttgggtttaggtggaggaaggattcgcgtggtcgttttcgcgttttttttggggttcgtgtttttttcggcgtttttttcgcgttttttattatggtaattcgggcgtcgggagcgtgggttgcgagtcgagtgggtgggggagtcgtcgggttttattcgttagtttacgagaagtgacgtaggtgacgggaggtcgtagggatttgagggcggagaggggaatttagaaagtgtcgggcggcggttttcgttttttttgcggggtttttgggtggtcgtggttgggagttgtcggggttcggtggtcgtgcgtttttgtttcgggtaagttttttttgtaaggttcgggcggcggtagggggtagtagcggttcgcgatgtttataggttcgttggtacggagttttcgggttggggcgtttagatttggagaagtcgggggttttggttatatttagagttgacgtttagtgcggtttttg

SEQ ID NO: 28630 - DNA, 866 bp, Artificial Sequence
  chemically treated genomic DNA (Homo sapiens) CpG-island No: 28630
caaaaaccgcactaaacgtcaactctaaatataaccaaaacccccgacttctccaaatctaaacgccccaacccgaaaactccgtaccaacgaacctataaacatcgcgaaccgctactaccccctaccgccgcccgaaccttacaaaaaaaacttacccgaaacaaaaacgcacgaccaccgaaccccgacaactcccaaccacgaccacccaaaaaccccgcaaaaaaaacgaaaaccgccgcccgacactttctaaattcccctctccgccctcaaatccctacgacctcccgtcacctacgtcacttctcgtaaactaacgaataaaacccgacgactcccccacccactcgactcgcaacccacgctcccgacgcccgaattaccataataaaaaacgcgaaaaaaacgccgaaaaaaacacgaaccccaaaaaaaacgcgaaaacgaccacgcgaatccttcctccacctaaacccaaacacttccgatctcgtaaacgtcgaaaaaaactctttacgaacttcgctacgaacttaaaacctccgacataaaaaaaaacgaaaactaaaaaacgcaaaaactctccctaaactactcgaaaaccaaaactataacgcgactccgatcctcgttttcccgccgtcgatactaactacctacaattaccataataacgcgaaccgcgaaacaaaacaaaatcccaaatcgcgtacaattactcctcgccgtcgccactctcctaccccaaactataaataacaaacgtcaaaaaaaatacaccaaaacgcgacccgaactcaaaaccgcccgaataaaaactacttcgaacattaaacacacttcccgaacgcctcgtaacc

SEQ ID NO: 28631 - DNA, 866 bp, Artificial Sequence
  chemically treated genomic DNA (Homo sapiens) CpG-island No: 28631
taagggtcgtattggacgttagttttgagtgtgattaaggttttcggtttttttagatttggacgttttagttcgggagtttcgtgttagcgagtttatgagtatcgcgggtcgttattgttttttgtcgtcgttcgggttttgtagggagagtttgttcggagtagaggcgtacggttatcgggtttcggtagtttttagttacgattatttagagatttcgtagaggaagcggaagtcgtcgttcggtattttttgaattttttttttcgtttttaggtttttgcggtttttcgttatttgcgttatttttcgtgggttggcggatagagttcggcggtttttttatttattcggttcgtagtttacgttttcgacgttcgagttgttatggtgaaggacgcgggagaaacgtcggaaggggtacggattttagggagagcgcggaggcggttacgcgggttttttttttatttgggtttaggtattttcggtttcgtaggcgtcggggaaagttttttgcggatttcgttgcgggtttaggattttcgatatgaagggaagcgggggttggaggacgtagagattttttttgggttgttcgaaggttaaggttgtaacgcggtttcggttttcgttttttcgtcgtcggtgttggttgtttgtagttgttatggtgacgcgggtcgcggggtagggtaaggttttaagtcgcgtgtagttgtttttcgtcgtcgttatttttttgttttaggttgtgggtagtagacgttaaaagagatatattagagcgcgattcggatttaggatcgttcgggtgggggttgtttcgggtattggatatatttttcgggcgtttcgtgatt

SEQ ID NO: 28632 - DNA, 866 bp, Artificial Sequence
  chemically treated genomic DNA (Homo sapiens) CpG-island No: 28632
aatcacgaaacgcccgaaaaatatatccaatacccgaaacaacccccacccgaacgatcctaaatccgaatcgcgctctaatatatctcttttaacgtctactacccacaacctaaaacaaaaaaataacgacgacgaaaaacaactacacgcgacttaaaaccttaccctaccccgcgacccgcgtcaccataacaactacaaacaaccaacaccgacgacgaaaaaacgaaaaccgaaaccgcgttacaaccttaaccttcgaacaacccaaaaaaaatctctacgtcctccaacccccgcttcccttcatatcgaaaatcctaaacccgcaacgaaatccgcaaaaaactttccccgacgcctacgaaaccgaaaatacctaaacccaaataaaaaaaaaacccgcgtaaccgcctccgcgctctccctaaaatccgtaccccttccgacgtttctcccgcgtccttcaccataacaactcgaacgtcgaaaacgtaaactacgaaccgaataaataaaaaaaccgccgaactctatccgccaacccacgaaaaataacgcaaataacgaaaaaccgcaaaaacctaaaaacgaaaaaaaaaattcaaaaaataccgaacgacgacttccgcttcctctacgaaatctctaaataatcgtaactaaaaactaccgaaacccgataaccgtacgcctctactccgaacaaactctccctacaaaacccgaacgacgacaaaaaacaataacgacccgcgatactcataaactcgctaacacgaaactcccgaactaaaacgtccaaatctaaaaaaaccgaaaaccttaatcacactcaaaactaacgtccaatacgaccctta

SEQ ID NO: 28633 - DNA, 673 bp, Artificial Sequence
  chemically treated genomic DNA (Homo sapiens) CpG-island No: 28633
gatacgagggcggtttcgcggcgtttcgtttgggacgtcggaaggttttcggtatttattaagatttgttttacgagtttttggtttcgttatcggggtttcgaagcgattatagttataaatttaacgttagggttatatcgttcgtgattttcgtttatttttcgattcggtttcgtttcgggagatcggcgcgtttttatcgtgggacgtttttttagggttaggcggttcgattacgtgttacgtaaacgtcgtcgttcgtatcggtcgcgattcggtaagggagcgggcggagagttgattcgcggcggaggggggttattcgtcggacggaacgttgcgcgtagttatcgttcgttgttagtcgcgttttaattcgttaggacgttgggttttgtcggcgggattttttttttattcggaaaggggaggcgtcggttatagtaggcgacgagtcgcgttcggttattatcgcggtggtcggcggaattttcgtttttttttcgttatttcgtcgagggggaagttgaggagggtttttttgtaagcgagtcgttattgtagcgttattataacggagagagagatagaggcggtaggtcgggggatttcgtattttaaggtatattttttggatcgttagagaaggtttttttatcgaggatgggtt

SEQ ID NO: 28634 - DNA, 673 bp, Artificial Sequence
  chemically treated genomic DNA (Homo sapiens) CpG-island No: 28634
aacccatcctcgataaaaaaaccttctctaacgatccaaaaaatataccttaaaatacgaaatcccccgacctaccgcctctatctctctctccgttataataacgctacaataacgactcgcttacaaaaaaaccctcctcaacttccccctcgacgaaataacgaaaaaaaaacgaaaattccgccgaccaccgcgataataaccgaacgcgactcgtcgcctactataaccgacgcctcccctttccgaataaaaaaaaaatcccgccgacaaaacccaacgtcctaacgaattaaaacgcgactaacaacgaacgataactacgcgcaacgttccgtccgacgaataacccccctccgccgcgaatcaactctccgcccgctcccttaccgaatcgcgaccgatacgaacgacgacgtttacgtaacacgtaatcgaaccgcctaaccctaaaaaaacgtcccacgataaaaacgcgccgatctcccgaaacgaaaccgaatcgaaaaataaacgaaaatcacgaacgatataaccctaacgttaaatttataactataatcgcttcgaaaccccgataacgaaaccaaaaactcgtaaaacaaatcttaataaataccgaaaaccttccgacgtcccaaacgaaacgccgcgaaaccgccctcgtatc

SEQ ID NO: 28635 - DNA, 673 bp, Artificial Sequence
  chemically treated genomic DNA (Homo sapiens) CpG-island No: 28635
gatttattttcggtgagaaagttttttttagcgatttaagaggtgtgttttggggtacgggatttttcggtttgtcgtttttgttttttttttcgttatggtagcgttgtagtagcgattcgtttgtagaggaattttttttagtttttttttcgacggggtgacggggggagagcgagggtttcgtcggttatcgcggtggtggtcgagcgcggttcgtcgtttattgtggtcggcgtttttttttttcgagtaaggggaggatttcgtcggtagggtttagcgttttagcgggttgggacgcggttgatagcgagcgatggttgcgcgtagcgtttcgttcggcgagtgattttttttcgtcgcgagttagtttttcgttcgtttttttgtcgagtcgcgatcggtgcggacgacggcgtttgcgtggtacgtggtcgggtcgtttggttttgggaaagcgttttacggtgggggcgcgtcggtttttcggagcgggatcgggtcggaggatggacgagaattacgagcgatgtggttttggcgttgagtttgtggttgtggtcgtttcggggtttcggtggcgggattaggggttcgtgaggtaggttttggtgggtgtcgagggtttttcggcgttttaggcggggcgtcgcgggatcgttttcgtgtt

SEQ ID NO: 28636 - DNA, 673 bp, Artificial Sequence
  chemically treated genomic DNA (Homo sapiens) CpG-island No: 28636
aacacgaaaacgatcccgcgacgccccgcctaaaacgccgaaaaaccctcgacacccaccaaaacctacctcacgaacccctaatcccgccaccgaaaccccgaaacgaccacaaccacaaactcaacgccaaaaccacatcgctcgtaattctcgtccatcctccgacccgatcccgctccgaaaaaccgacgcgcccccaccgtaaaacgctttcccaaaaccaaacgacccgaccacgtaccacgcaaacgccgtcgtccgcaccgatcgcgactcgacaaaaaaacgaacgaaaaactaactcgcgacgaaaaaaaatcactcgccgaacgaaacgctacgcgcaaccatcgctcgctatcaaccgcgtcccaacccgctaaaacgctaaaccctaccgacgaaatcctccccttactcgaaaaaaaaaaacgccgaccacaataaacgacgaaccgcgctcgaccaccaccgcgataaccgacgaaaccctcgctctccccccgtcaccccgtcgaaaaaaaaactaaaaaaaattcctctacaaacgaatcgctactacaacgctaccataacgaaaaaaaaaacaaaaacgacaaaccgaaaaatcccgtaccccaaaacacacctcttaaatcgctaaaaaaaactttctcaccgaaaataaatc

SEQ ID NO: 28637 - DNA, 862 bp, Artificial Sequence
  chemically treated genomic DNA (Homo sapiens) CpG-island No: 28637
gcgttcgcggttagggcggggatcggtaggtgcgagcgtgagcgtaattttataagttttcgttttttatttttttttttatttcgtttattcgttttttttttttagaggtaaagtattttcgagtaaatttatatacgatcggtcggaggtagaacggtagtttttcggcggtcggtcggcgtacgcgttattagtttaagtttatcgcgatcgtttatagggttcgtgcgtattcgttagaggggagtatcggacgtgcgttcgtcggattaggcgggcgttttttttcgcgtgggaggggcgcgtttcgttttatttaatcgtttcgaattttatatcgacgagtttttttaggatttacgcgcggatatcgaggcgtcgatcggaggagggggcgttgggggtgggaacgatatattatcgttcggtttcgggaatttgagggataattcggagcgttttaggagtatcgtaaaggtttagggggagttaacgttcgcgtaaatttttcgggagggtagtacgacgggtcggcgggatagtatttttatcgttgcggaggggggtcgttcgtaagtcgataattataggaggcgagagcgaggggtgtttgtcgcgttagaggatttttcgatttatttcgcgaggtagaaggcgggggcgggatagcgaggttaggtcgggtttcgtattttatgtttttttaacgtattattcgtaggcgaggaagaggagagataaggggttttcgcgggcgggacgagaagaagggttttattcgttacgaatgttcgtttttcgttcgtcgcggttcggatacggttagggagagtatgatattattatattttatttttat

SEQ ID NO: 28638 - DNA, 862 bp, Artificial Sequence
  chemically treated genomic DNA (Homo sapiens) CpG-island No: 28638
ataaaaataaaatataataatatcatactctccctaaccgtatccgaaccgcgacgaacgaaaaacgaacattcgtaacgaataaaacccttcttctcgtcccgcccgcgaaaaccccttatctctcctcttcctcgcctacgaataatacgttaaaaaaacataaaatacgaaacccgacctaacctcgctatcccgcccccgccttctacctcgcgaaataaatcgaaaaatcctctaacgcgacaaacacccctcgctctcgcctcctataattatcgacttacgaacgacccccctccgcaacgataaaaatactatcccgccgacccgtcgtactaccctcccgaaaaatttacgcgaacgttaactccccctaaacctttacgatactcctaaaacgctccgaattatccctcaaattcccgaaaccgaacgataatatatcgttcccacccccaacgccccctcctccgatcgacgcctcgatatccgcgcgtaaatcctaaaaaaactcgtcgatataaaattcgaaacgattaaataaaacgaaacgcgcccctcccacgcgaaaaaaaacgcccgcctaatccgacgaacgcacgtccgatactcccctctaacgaatacgcacgaaccctataaacgatcgcgataaacttaaactaataacgcgtacgccgaccgaccgccgaaaaactaccgttctacctccgaccgatcgtatataaatttactcgaaaatactttacctctaaaaaaaaaaaacgaataaacgaaataaaaaaaaaaataaaaaacgaaaacttataaaattacgctcacgctcgcacctaccgatccccgccctaaccgcgaacgc

SEQ ID NO: 28639 - DNA, 862 bp, Artificial Sequence
  chemically treated genomic DNA (Homo sapiens) CpG-island No: 28639
gtaagaatagaatatggtgatgttatgttttttttggtcgtgttcgagtcgcgacgggcgaggggcggatattcgtggcgaatgggattttttttttcgtttcgttcgcgggggttttttgttttttttttttttcgtttgcgggtggtgcgttgggaaggtatggggtgcggaattcggtttgatttcgttgtttcgttttcgttttttgtttcgcggggtgggtcggggggttttttgacgcggtaggtatttttcgttttcgttttttgtggttgtcgatttgcgggcggttttttttcgtagcggtgggggtgttgtttcgtcggttcgtcgtgttgttttttcggggagtttgcgcgagcgttggttttttttgggtttttgcggtgtttttggagcgtttcgggttgttttttaggttttcgaggtcgagcggtggtgtgtcgtttttatttttagcgttttttttttcggtcggcgtttcggtgttcgcgcgtgggttttgagggagttcgtcggtgtggggttcgaggcggttgagtgagacgagacgcgttttttttacgcggggaagggcgttcgtttggttcggcgagcgtacgttcggtgtttttttttggcgggtgcgtacgggttttgtgagcgatcgcggtgggtttgggttggtgacgcgtgcgtcggtcggtcgtcgaggggttatcgttttgttttcgatcggtcgtgtgtgggtttattcggaggtgttttgtttttgaagaaaagaggcgggtggacggggtgggggggggggtgggaggcgggggtttgtggagttgcgtttacgttcgtatttgtcggttttcgttttgatcgcgaacgt

SEQ ID NO: 28640 - DNA, 862 bp, Artificial Sequence
  chemically treated genomic DNA (Homo sapiens) CpG-island No: 28640
acgttcgcgatcaaaacgaaaaccgacaaatacgaacgtaaacgcaactccacaaacccccgcctcccacccccccccccaccccgtccacccgcctcttttcttcaaaaacaaaacacctccgaataaacccacacacgaccgatcgaaaacaaaacgataacccctcgacgaccgaccgacgcacgcgtcaccaacccaaacccaccgcgatcgctcacaaaacccgtacgcacccgccaaaaaaaaacaccgaacgtacgctcgccgaaccaaacgaacgcccttccccgcgtaaaaaaaacgcgtctcgtctcactcaaccgcctcgaaccccacaccgacgaactccctcaaaacccacgcgcgaacaccgaaacgccgaccgaaaaaaaaaacgctaaaaataaaaacgacacaccaccgctcgacctcgaaaacctaaaaaacaacccgaaacgctccaaaaacaccgcaaaaacccaaaaaaaaccaacgctcgcgcaaactccccgaaaaaacaacacgacgaaccgacgaaacaacacccccaccgctacgaaaaaaaaccgcccgcaaatcgacaaccacaaaaaacgaaaacgaaaaatacctaccgcgtcaaaaaaccccccgacccaccccgcgaaacaaaaaacgaaaacgaaacaacgaaatcaaaccgaattccgcaccccataccttcccaacgcaccacccgcaaacgaaaaaaaaaaaaaacaaaaaacccccgcgaacgaaacgaaaaaaaaaatcccattcgccacgaatatccgcccctcgcccgtcgcgactcgaacacgaccaaaaaaaacataacatcaccatattctattcttac

SEQ ID NO: 28641 - DNA, 705 bp, Artificial Sequence
  chemically treated genomic DNA (Homo sapiens) CpG-island No: 28641
ttgttcgtgtttcgttacgtcgggggttttttttacgtcgttttgtcggtttgttcgtttggttttggtcgtcgtttttattcgtcgtgtttgggttttttttggcgttttttttttttttcgttttgtcgttattttttttttcgttcgatggcgttattacgtaacggttcgattacgtatcgtttttttttaatattgcgtcgtttgtttggcgtatggcgatttgttgcggatattttttttttcgtttttgtgcggttttttatatcgattttggtgtttttttagaatatattgttttgtagtcgttttattttatttatttcgtatatcgattaatatcgatgtagcgttttgatagggtttgtttgttttcggttttcgttttacgtataattgtgtacgttttcgggtattgattgtgttcgtagtattttcgttttttacgtaaggtcgtatattacgggtttgagtatcgtttataaatatagtttagttcgtatatttaggttattaaagttcgatggttttatcgggtatgtggcgtttttattgttttttttttatttttatttttcggcgatttatttgataagtttttttgtcgtattttttttatcggtttttttttaggttattcgtttttttatttattattatttcgagcgttagtaataaaattatatttttcgtgttttaaaa

SEQ ID NO: 28642 - DNA, 705 bp, Artificial Sequence
  chemically treated genomic DNA (Homo sapiens) CpG-island No: 28642
ttttaaaacacgaaaaatataattttattactaacgctcgaaataataataaataaaaaaacgaataacctaaaaaaaaaccgataaaaaaaatacgacaaaaaaacttatcaaataaatcgccgaaaaataaaaataaaaaaaaaacaataaaaacgccacatacccgataaaaccatcgaactttaataacctaaatatacgaactaaactatatttataaacgatactcaaacccgtaatatacgaccttacgtaaaaaacgaaaatactacgaacacaatcaatacccgaaaacgtacacaattatacgtaaaacgaaaaccgaaaacaaacaaaccctatcaaaacgctacatcgatattaatcgatatacgaaataaataaaataaaacgactacaaaacaatatattctaaaaaaacaccaaaatcgatataaaaaaccgcacaaaaacgaaaaaaaaaatatccgcaacaaatcgccatacgccaaacaaacgacgcaatattaaaaaaaaacgatacgtaatcgaaccgttacgtaataacgccatcgaacgaaaaaaaaaataacgacaaaacgaaaaaaaaaaaaaacgccaaaaaaaacccaaacacgacgaataaaaacgacgaccaaaaccaaacgaacaaaccgacaaaacgacgtaaaaaaaacccccgacgtaacgaaacacgaacaa

SEQ ID NO: 28643 - DNA, 705 bp, Artificial Sequence
  chemically treated genomic DNA (Homo sapiens) CpG-island No: 28643
ttttgggatacgaggggtgtgattttgttgttgacgttcggggtggtggtgagtggggaaacgggtagtttagggggggatcggtgggaagagtgcggtaagggaatttgttaggtaggtcgtcggaaagtgaagatggaggagagataatgggggcgttatatgttcgataaggttatcgaattttagtaatttggatgtgcggattggattgtgtttataggcggtgtttaggttcgtggtgtgcggttttgcgtggaggacggggatattgcggatatagttagtgttcggagacgtgtatagttgtgcgtgaagcggaggtcgggagtagataagttttgttagggcgttgtatcggtgttggtcggtgtgcggggtgggtggaatgaggcggttgtagagtagtgtgttttgagagggtattagagtcggtgtgaaagatcgtatagaggcggaaggagaaatgttcgtagtaggtcgttatgcgttaggtaggcggcgtaatgttggggaagggcgatgcgtggtcgggtcgttgcgtgatgacgttatcgggcgaaagggggagtggcggtaaggcgaggaagggggggaacgttagggggggtttaggtacgacgggtgaaaacgacggttagggttaagcgggtaggtcggtagggcgacgtgagaggagttttcgacgtggcggggtacgggtag

SEQ ID NO: 28644 - DNA, 705 bp, Artificial Sequence
  chemically treated genomic DNA (Homo sapiens) CpG-island No: 28644
ctacccgtaccccgccacgtcgaaaactcctctcacgtcgccctaccgacctacccgcttaaccctaaccgtcgttttcacccgtcgtacctaaaccccccctaacgttcccccccttcctcgccttaccgccactccccctttcgcccgataacgtcatcacgcaacgacccgaccacgcatcgcccttccccaacattacgccgcctacctaacgcataacgacctactacgaacatttctccttccgcctctatacgatctttcacaccgactctaataccctctcaaaacacactactctacaaccgcctcattccacccaccccgcacaccgaccaacaccgatacaacgccctaacaaaacttatctactcccgacctccgcttcacgcacaactatacacgtctccgaacactaactatatccgcaatatccccgtcctccacgcaaaaccgcacaccacgaacctaaacaccgcctataaacacaatccaatccgcacatccaaattactaaaattcgataaccttatcgaacatataacgcccccattatctctcctccatcttcactttccgacgacctacctaacaaattcccttaccgcactcttcccaccgatccccccctaaactacccgtttccccactcaccaccaccccgaacgtcaacaacaaaatcacacccctcgtatcccaaaa

SEQ ID NO: 28645 - DNA, 595 bp, Artificial Sequence
  chemically treated genomic DNA (Homo sapiens) CpG-island No: 28645
ttcggttgttaacgaggtatcgtttattgatttcgcgtttcgttttttatagcgtggggttcggcgttgcgttaggttcgggtgcggggcggagttaggttgggattggttgggggtcgtttcgttcggcgtttgggttttcgcgtcggttttcggggaggagttatgataattttttttttattaaggcgttcgggtttttcggttatcgttaggatatattgttcgggcgcggtttttttcgttcgcggagcggttttgatattcgcggcggtagtatttacgttcgtagagtcgtcgatgcgtgtttagtgattcggatagtaaggttcgcgcgcggcgggggcggcggtagacgtttggttatcgtgatttcgattttggatttatcgtttgggggttggggggattttggatttaattggcgattgttttgggggacgtcggacgttatgttgtggaaaataatcgataatgttaagtacgaagaggattgcgaggtgagttggggtttcggggtgtagtttcgtttcgtcgaggatagttcgggaggtaggggttattggatcgaggtcggggacgagggtataggagt

SEQ ID NO: 28646 - DNA, 595 bp, Artificial Sequence
  chemically treated genomic DNA (Homo sapiens) CpG-island No: 28646
actcctataccctcgtccccgacctcgatccaataacccctacctcccgaactatcctcgacgaaacgaaactacaccccgaaaccccaactcacctcgcaatcctcttcgtacttaacattatcgattattttccacaacataacgtccgacgtcccccaaaacaatcgccaattaaatccaaaatccccccaacccccaaacgataaatccaaaatcgaaatcacgataaccaaacgtctaccgccgcccccgccgcgcgcgaaccttactatccgaatcactaaacacgcatcgacgactctacgaacgtaaatactaccgccgcgaatatcaaaaccgctccgcgaacgaaaaaaaccgcgcccgaacaatatatcctaacgataaccgaaaaacccgaacgccttaataaaaaaaaaattatcataactcctccccgaaaaccgacgcgaaaacccaaacgccgaacgaaacgacccccaaccaatcccaacctaactccgccccgcacccgaacctaacgcaacgccgaaccccacgctataaaaaacgaaacgcgaaatcaataaacgatacctcgttaacaaccgaa

SEQ ID NO: 28647 - DNA, 595 bp, Artificial Sequence
  chemically treated genomic DNA (Homo sapiens) CpG-island No: 28647
gtttttatgttttcgttttcgatttcggtttagtggtttttgtttttcggattgttttcggcggggcggggttgtatttcggagttttagtttatttcgtagtttttttcgtatttgatattatcggttattttttataatatggcgttcggcgttttttaaaatagtcgttagttaaatttaggatttttttagtttttaagcggtaaatttaaaatcggggttacggtgattaggcgtttgtcgtcgttttcgtcgcgcgcgggttttgttgttcgggttattggatacgtatcggcggttttgcgagcgtagatgttgtcgtcgcgagtgttaagatcgtttcgcggacggggaaagtcgcgttcgaatagtgtgttttggcgatagtcgggggattcgagcgttttaatgagaaggaaattattataattttttttcgggggtcggcgcggaggtttaggcgtcgggcggggcggtttttagttagttttagtttagtttcgtttcgtattcgggtttggcgtagcgtcgagttttacgttgtgagggacgaagcgcggagttagtgggcggtgtttcgttgatagtcgaa

SEQ ID NO: 28648 - DNA, 595 bp, Artificial Sequence
  chemically treated genomic DNA (Homo sapiens) CpG-island No: 28648
ttcgactatcaacgaaacaccgcccactaactccgcgcttcgtccctcacaacgtaaaactcgacgctacgccaaacccgaatacgaaacgaaactaaactaaaactaactaaaaaccgccccgcccgacgcctaaacctccgcgccgacccccgaaaaaaaattataataatttccttctcattaaaacgctcgaatcccccgactatcgccaaaacacactattcgaacgcgactttccccgtccgcgaaacgatcttaacactcgcgacgacaacatctacgctcgcaaaaccgccgatacgtatccaataacccgaacaacaaaacccgcgcgcgacgaaaacgacgacaaacgcctaatcaccgtaaccccgattttaaatttaccgcttaaaaactaaaaaaatcctaaatttaactaacgactattttaaaaaacgccgaacgccatattataaaaaataaccgataatatcaaatacgaaaaaaactacgaaataaactaaaactccgaaatacaaccccgccccgccgaaaacaatccgaaaaacaaaaaccactaaaccgaaatcgaaaacgaaaacataaaaac

SEQ ID NO: 28649 - DNA, 861 bp, Artificial Sequence
  chemically treated genomic DNA (Homo sapiens) CpG-island No: 28649
gggcggcgtagggtggcgggttttgtttttcgagcgtcgttcgttcggaggtttttgtttcgagggcgtggaagggagggtttcgggggcgggggaggtgcgtatttttcgcgtcgcgtattttattcgcgtttgtcgcgttgttatttttagtagtttttgcgttatgggcgggttttacgagatagttttgtatcgggcgttcggttttttcgtttcgggttttggttttttcgtttcgggtttcggttacggatttttttggtttaagatttagggttcggatttggcgtttttaagcgtttcgggtttgggagtagcgtttagattttcgtcgtcgggttttgagaattcgtttttttaggttttttattagattttttttttttttcgtattttttgtttataacgaaattttcggggcgtattgttttcgggtatttttcgattttgggtaagtttcgtcgggcggggtgcggttggtttttcggggttttttgcgtagttcggcgatgtcggttagttcgtagtagcggggtttcgtattaacggggttttttgtttttttttttttttttaggatcgttacgacgggagtagtaatgggaattcgcgggttttttatttttttttcgtcgggtagtatttttatagtttcgcgttattttttttttatattggagtcgtcgaatattagtcgttattttattttttttttttttattagtagttggtttatttttagtcggtcgatttttattcgtatttgggggaagcgtacgtcgtcgttattaattttttgtattagtcggcgtttataggtagttagtagtaggtttggttcggtcgttagagttagga

SEQ ID NO: 28650 - DNA, 861 bp, Artificial Sequence
  chemically treated genomic DNA (Homo sapiens) CpG-island No: 28650
tcctaactctaacgaccgaaccaaacctactactaactacctataaacgccgactaatacaaaaaattaataacgacgacgtacgcttcccccaaatacgaataaaaatcgaccgactaaaaataaaccaactactaataaaaaaaaaaaaaataaaataacgactaatattcgacgactccaatataaaaaaaaaataacgcgaaactataaaaatactacccgacgaaaaaaaaataaaaaacccgcgaattcccattactactcccgtcgtaacgatcctaaaaaaaaaaaaaaaaacaaaaaaccccgttaatacgaaaccccgctactacgaactaaccgacatcgccgaactacgcaaaaaaccccgaaaaaccaaccgcaccccgcccgacgaaacttacccaaaatcgaaaaatacccgaaaacaatacgccccgaaaatttcgttataaacaaaaaatacgaaaaaaaaaaaaaatctaataaaaaacctaaaaaaacgaattctcaaaacccgacgacgaaaatctaaacgctactcccaaacccgaaacgcttaaaaacgccaaatccgaaccctaaatcttaaaccaaaaaaatccgtaaccgaaacccgaaacgaaaaaaccaaaacccgaaacgaaaaaaccgaacgcccgatacaaaactatctcgtaaaacccgcccataacgcaaaaactactaaaaataacaacgcgacaaacgcgaataaaatacgcgacgcgaaaaatacgcacctcccccgcccccgaaaccctcccttccacgccctcgaaacaaaaacctccgaacgaacgacgctcgaaaaacaaaacccgccaccctacgccgccc

SEQ ID NO: 28651 - DNA, 861 bp, Artificial Sequence
  chemically treated genomic DNA (Homo sapiens) CpG-island No: 28651
ttttggttttggcggtcgggttaggtttgttgttggttgtttgtgggcgtcggttggtgtagggggttgatggcggcggcgtacgttttttttagatgcgagtaggggtcggtcgattgggagtaggttagttgttggtagggagggggaaagtagggtggcggttgatattcggcgattttagtgtgggagaggggtggcgcggggttgtagaggtgttgttcggcggaggagaggtgggggattcgcggatttttattgttgttttcgtcgtggcgattttggagggaaaaaaaaaaataggagatttcgttagtgcgaaatttcgttattgcgaattggtcggtatcgtcgggttacgtagagggtttcgggggattaatcgtatttcgttcggcggggtttgtttagggtcggaaggtattcgggggtaatgcgtttcgaggatttcgttgtaagtaaagagtgcggggagggaggagagtttggtgaaagatttgggggaacgagtttttaaagttcggcggcgaaggtttaggcgttgtttttaagttcgaggcgtttggaggcgttaagttcgaattttgggttttgggttagaaaagttcgtggtcggagttcggggcgaaggagttagagttcggggcgaaggagtcggacgttcggtgtagagttatttcgtggagttcgtttatgacgtagggattgttggaggtggtagcgcggtaggcgcggatagagtgcgcggcgcgggaaatgcgtatttttttcgttttcgggatttttttttttacgttttcgggataaagattttcgagcgggcggcgttcggaaagtagggttcgttattttgcgtcgttt

SEQ ID NO: 28652 - DNA, 861 bp, Artificial Sequence
  chemically treated genomic DNA (Homo sapiens) CpG-island No: 28652
aaacgacgcaaaataacgaaccctactttccgaacgccgcccgctcgaaaatctttatcccgaaaacgtaaaaaaaaaaatcccgaaaacgaaaaaaatacgcatttcccgcgccgcgcactctatccgcgcctaccgcgctaccacctccaacaatccctacgtcataaacgaactccacgaaataactctacaccgaacgtccgactccttcgccccgaactctaactccttcgccccgaactccgaccacgaacttttctaacccaaaacccaaaattcgaacttaacgcctccaaacgcctcgaacttaaaaacaacgcctaaaccttcgccgccgaactttaaaaactcgttcccccaaatctttcaccaaactctcctccctccccgcactctttacttacaacgaaatcctcgaaacgcattacccccgaataccttccgaccctaaacaaaccccgccgaacgaaatacgattaatcccccgaaaccctctacgtaacccgacgataccgaccaattcgcaataacgaaatttcgcactaacgaaatctcctatttttttttttccctccaaaatcgccacgacgaaaacaacaataaaaatccgcgaatcccccacctctcctccgccgaacaacacctctacaaccccgcgccacccctctcccacactaaaatcgccgaatatcaaccgccaccctactttccccctccctaccaacaactaacctactcccaatcgaccgacccctactcgcatctaaaaaaaacgtacgccgccgccatcaaccccctacaccaaccgacgcccacaaacaaccaacaacaaacctaacccgaccgccaaaaccaaaa

SEQ ID NO: 28653 - DNA, 1601 bp, Artificial Sequence
  chemically treated genomic DNA (Homo sapiens) CpG-island No: 28653
ggcgttcgtagtatttttcgacggtagttcgtattttcgcgagattggcggcgataattttttttattattttttatcgtgtttattcgatttttttttttttttttttttattagtttcgttagtagtttattaatttcgtcgatttttttaaaaaattagttttcggatttattaatttttcgaagggtttttcgcgtttttattttttttagttacgtttcgattttagttatttttcgtttttcgttagttttcgaacgcgttcgttttcgtttttttagtttttttaatcgcgacgttagggcgttaatttcggatttttttcgttttttttcgcgggtatttagcgttataaatttttttttatatatcgtttcgaacgcgttttagagatttcggtacgtcgcgttttcgtttttttcggttttaaagaatatttttattttcgtttttattttattacgtatttagtagttatttaggagtaggtcgtttagtttttatgtagtcgagtggtttcgagcgagttttttaatttcgagtcgtagttcgatcgtatcgcggttcgagagatagttcgttataattttcgtttttttatattcgtcgaggagcgttttatttttaattatgcggttattttcggaataggcgcggcgcggcgtcgaaaaaaacgtatatttcgtcgattcggggcggagagtttcgtagacgttcgttaggttcgttcggcgtagagtcgagtttaattttcgggtattttcgttaatttttcgtttcgtcgattcgtttaacgtcgatagcggggcgttaaagttttttattattatcgcgcgggagtttaagttttttcgtaggttatttatgattcgttttacgaattcgggcgttttcgcgtcggtcgtatatatatttaggatagttagtttttttcgtcgaatcgatttttttattattacgtaacggtttttttcgtttttttcgattttcgtcggtttaaagttcgttttattagagattaggatcgtaattttcgttttttttcgttttttattcgttcggtagatttttttttatttttttatttcgagtttacgcgcgttttcgtacgcgagacgggtttttcgaatatagtatatcgacgggtttcgattttttatttaatttattaattcgcgttttttaattagagtatttagtttatttatatttaaggttaatatcgttacgcgcgaattcgatttcgttattacgacgttagtcggttatttcgtttattagtcgacgtagtttttttttagtattgacggtttttataatcggtacgttttcgtagcggtcggtattagttttttttttttattcgatttttatttttttttttattttaagttcgtcgaattcgataatcgcgtttcggagtcgttttttcggaggagtattttcgcggtatttttcgtatttttcgaattcgaattcggttcgtttcgttaggtcggggaagttttttcggataatatttcgaagagcgttttttaattcggttttattttttttttattttttagtataattattttatttaaattacgtttttt

SEQ ID NO: 28654 - DNA, 1601 bp, Artificial Sequence
  chemically treated genomic DNA (Homo sapiens) CpG-island No: 28654
aaaaaacgtaatttaaataaaataattatactaaaaaataaaaaaaaaataaaaccgaattaaaaaacgctcttcgaaatattatccgaaaaaacttccccgacctaacgaaacgaaccgaattcgaattcgaaaaatacgaaaaataccgcgaaaatactcctccgaaaaaacgactccgaaacgcgattatcgaattcgacgaacttaaaataaaaaaaaaaataaaaatcgaataaaaaaaaaaaactaataccgaccgctacgaaaacgtaccgattataaaaaccgtcaatactaaaaaaaaactacgtcgactaataaacgaaataaccgactaacgtcgtaataacgaaatcgaattcgcgcgtaacgatattaaccttaaatataaataaactaaatactctaattaaaaaacgcgaattaataaattaaataaaaaatcgaaacccgtcgatatactatattcgaaaaacccgtctcgcgtacgaaaacgcgcgtaaactcgaaataaaaaaataaaaaaaaatctaccgaacgaataaaaaacgaaaaaaaacgaaaattacgatcctaatctctaataaaacgaactttaaaccgacgaaaatcgaaaaaaacgaaaaaaaccgttacgtaataataaaaaaatcgattcgacgaaaaaaactaactatcctaaatatatatacgaccgacgcgaaaacgcccgaattcgtaaaacgaatcataaataacctacgaaaaaacttaaactcccgcgcgataataataaaaaactttaacgccccgctatcgacgttaaacgaatcgacgaaacgaaaaattaacgaaaatacccgaaaattaaactcgactctacgccgaacgaacctaacgaacgtctacgaaactctccgccccgaatcgacgaaatatacgtttttttcgacgccgcgccgcgcctattccgaaaataaccgcataattaaaaataaaacgctcctcgacgaatataaaaaaacgaaaattataacgaactatctctcgaaccgcgatacgatcgaactacgactcgaaattaaaaaactcgctcgaaaccactcgactacataaaaactaaacgacctactcctaaataactactaaatacgtaataaaataaaaacgaaaataaaaatattctttaaaaccgaaaaaaacgaaaacgcgacgtaccgaaatctctaaaacgcgttcgaaacgatatataaaaaaaaatttataacgctaaatacccgcgaaaaaaaacgaaaaaaatccgaaattaacgccctaacgtcgcgattaaaaaaactaaaaaaacgaaaacgaacgcgttcgaaaactaacgaaaaacgaaaaataactaaaatcgaaacgtaactaaaaaaaataaaaacgcgaaaaacccttcgaaaaattaataaatccgaaaactaattttttaaaaaaatcgacgaaattaataaactactaacgaaactaataaaaaaaaaaaaaaaaaaaaatcgaataaacacgataaaaaataataaaaaaaattatcgccgccaatctcgcgaaaatacgaactaccgtcgaaaaatactacgaacgcc

SEQ ID NO: 28655 - DNA, 1601 bp, Artificial Sequence
  chemically treated genomic DNA (Homo sapiens) CpG-island No: 28655
agggagcgtggtttgggtgaagtaattatgttgagggatagaaaagaggtaaggtcggattaaggggcgtttttcgaaatgttgttcgaaggggttttttcggtttgacgggacgaatcgggttcgggttcgaagggtgcgagaggtatcgcgggagtgttttttcgaggagacggtttcggagcgcggttatcgagttcggcgggtttagggtaggaaggggggtaggggtcgggtagggaaagggggttaatgtcgatcgttacgggggcgtatcggttatgggagtcgttagtattgaaggagggttacgtcggttggtagacggggtggtcgattggcgtcgtggtagcgaagtcgggttcgcgcgtggcggtgttggttttgggtatgggtaaattgggtattttggttggggagcgcgagttaatgggttaagtgggagatcggagttcgtcgatatattatgttcgaagagttcgtttcgcgtacgagagcgcgcgtgaattcggggtgggaaagtaagaaggagtttgtcggacgggtaaggggcgggggggaacgaaaattacggttttgatttttagtggggcgagttttgggtcggcgggagtcggggagagcgggaggaatcgttgcgtggtaatgggaaagtcggttcggcggaggagattggttgttttgggtgtgtgtacgatcggcgcgaagacgttcgagttcgtgggacggattatagatagtttgcgggagagtttgagttttcgcgcggtggtggtaaagagttttggcgtttcgttatcggcgttgagcgagtcggcggaacgagggattggcggaagtgttcgaaggttaggttcgattttacgtcggacgagtttggcgagcgtttgcgaggtttttcgtttcgggtcggcgaggtgtgcgtttttttcgacgtcgcgtcgcgtttgtttcggggatagtcgtatgattaaggatgggacgtttttcgacgggtatggggaggcgagggttgtggcgggttatttttcgagtcgcgatacggtcgggttgcggttcgaagttggagggttcgttcggggttattcggttgtataagggttaggcggtttatttttaggtagttgttaaatgcgtggtagggtaggaacgagggtgggagtattttttagggtcgggagaggcgggagcgcggcgtgtcgaggtttttaaagcgcgttcgggacgatatatgaggaagggtttgtgacgttgggtattcgcggagagggacgaagggagttcggggttagcgttttggcgtcgcggttggggaggttgaggggacggagacgggcgcgttcggggattgacgaggaacggggggtggttggggtcgagacgtggttaggaagggtgagagcgcggggggtttttcggggggttggtaggttcgaagattaattttttagggaagtcggcggggttagtgagttattgacggagttggtgggaggaggggagagaggaggtcgggtgagtacggtggggggtagtgggaaaagttgtcgtcgttagtttcgcgagggtgcgggttgtcgtcgagaggtgttgcgggcgtt

SEQ ID NO: 28656 - DNA, 1601 bp, Artificial Sequence
  chemically treated genomic DNA (Homo sapiens) CpG-island No: 28656
aacgcccgcaacacctctcgacgacaacccgcaccctcgcgaaactaacgacgacaacttttcccactaccccccaccgtactcacccgacctcctctctcccctcctcccaccaactccgtcaataactcactaaccccgccgacttccctaaaaaattaatcttcgaacctaccaaccccccgaaaaaccccccgcgctctcacccttcctaaccacgtctcgaccccaaccaccccccgttcctcgtcaatccccgaacgcgcccgtctccgtcccctcaacctccccaaccgcgacgccaaaacgctaaccccgaactcccttcgtccctctccgcgaatacccaacgtcacaaacccttcctcatatatcgtcccgaacgcgctttaaaaacctcgacacgccgcgctcccgcctctcccgaccctaaaaaatactcccaccctcgttcctaccctaccacgcatttaacaactacctaaaaataaaccgcctaacccttatacaaccgaataaccccgaacgaaccctccaacttcgaaccgcaacccgaccgtatcgcgactcgaaaaataacccgccacaaccctcgcctccccatacccgtcgaaaaacgtcccatccttaatcatacgactatccccgaaacaaacgcgacgcgacgtcgaaaaaaacgcacacctcgccgacccgaaacgaaaaacctcgcaaacgctcgccaaactcgtccgacgtaaaatcgaacctaaccttcgaacacttccgccaatccctcgttccgccgactcgctcaacgccgataacgaaacgccaaaactctttaccaccaccgcgcgaaaactcaaactctcccgcaaactatctataatccgtcccacgaactcgaacgtcttcgcgccgatcgtacacacacccaaaacaaccaatctcctccgccgaaccgactttcccattaccacgcaacgattcctcccgctctccccgactcccgccgacccaaaactcgccccactaaaaatcaaaaccgtaattttcgttcccccccgccccttacccgtccgacaaactccttcttactttcccaccccgaattcacgcgcgctctcgtacgcgaaacgaactcttcgaacataatatatcgacgaactccgatctcccacttaacccattaactcgcgctccccaaccaaaatacccaatttacccatacccaaaaccaacaccgccacgcgcgaacccgacttcgctaccacgacgccaatcgaccaccccgtctaccaaccgacgtaaccctccttcaatactaacgactcccataaccgatacgcccccgtaacgatcgacattaaccccctttccctacccgacccctaccccccttcctaccctaaacccgccgaactcgataaccgcgctccgaaaccgtctcctcgaaaaaacactcccgcgatacctctcgcacccttcgaacccgaacccgattcgtcccgtcaaaccgaaaaaaccccttcgaacaacatttcgaaaaacgccccttaatccgaccttacctcttttctatccctcaacataattacttcacccaaaccacgctccct

SEQ ID NO: 28657 - DNA, 619 bp, Artificial Sequence
  chemically treated genomic DNA (Homo sapiens) CpG-island No: 28657
cggttattttggatagcgtatcgtcgttcgttcgggtcgtcgcgttatagtcgttgcggattatggtgagtggggtcgcgcgtcgttatcgatatcgtcgcgtttttttttttttttggatttacgtatcgggcgggaaagggtcgagcgggcgtcggcgcgggcgttgcgggttcgtcgttggaattcgttattttcggaggggtcgggttcgcgcgggtttggggagcgggagttgagcgtttgggtcgggggcgcgcgggtcggttcgaggttcgcgggtttcgggaattttgtttcggtttttttttttcggtttcgtttcggtatttcgaggcgttcgttcgcgtttagttttttgttgtatgtacggggtcgggcgttcgggatgttcgaggaagtcgtttttttttcgcggcggttattttcgcgcgtagtttatttttcgatttttcggattttcgaatttgttttcgttatcgttcgtcgacgtttggagcggagaacggcgtttttcgcgcgcggtatatattttgtttcgggagttttggggttcgggttttaacggttaagtttttgttttttttttttttttatcgcgtttgtatttcgggggtgt

SEQ ID NO: 28658 - DNA, 619 bp, Artificial Sequence
  chemically treated genomic DNA (Homo sapiens) CpG-island No: 28658
acacccccgaaatacaaacgcgataaaaaaaaaaaaaaaacaaaaacttaaccgttaaaacccgaaccccaaaactcccgaaacaaaatatataccgcgcgcgaaaaacgccgttctccgctccaaacgtcgacgaacgataacgaaaacaaattcgaaaatccgaaaaatcgaaaaataaactacgcgcgaaaataaccgccgcgaaaaaaaaacgacttcctcgaacatcccgaacgcccgaccccgtacatacaacaaaaaactaaacgcgaacgaacgcctcgaaataccgaaacgaaaccgaaaaaaaaaaaccgaaacaaaattcccgaaacccgcgaacctcgaaccgacccgcgcgcccccgacccaaacgctcaactcccgctccccaaacccgcgcgaacccgacccctccgaaaataacgaattccaacgacgaacccgcaacgcccgcgccgacgcccgctcgaccctttcccgcccgatacgtaaatccaaaaaaaaaaaaaaacgcgacgatatcgataacgacgcgcgaccccactcaccataatccgcaacgactataacgcgacgacccgaacgaacgacgatacgctatccaaaataaccg

SEQ ID NO: 28659 - DNA, 619 bp, Artificial Sequence
  chemically treated genomic DNA (Homo sapiens) CpG-island No: 28659
atattttcggggtgtaggcgcggtgaagggaggagaggggtaagagtttgatcgttagggttcgaattttagaattttcgaggtagggtgtgtgtcgcgcgcgggaaacgtcgtttttcgttttaggcgtcggcgggcggtggcgagagtaggttcgggggttcggagggtcggagggtgggttgcgcgcgggaatggtcgtcgcgaaggaggggcggttttttcgggtatttcgggcgttcggtttcgtgtatgtaataggggattgggcgcgagcgggcgtttcgaggtgtcggggcgggatcggggagaggggatcgagataaagttttcgagattcgcgggtttcgggtcgattcgcgcgttttcggtttaaacgtttagttttcgttttttaggttcgcgcggattcggttttttcgagggtagcgggttttagcggcgaattcgtagcgttcgcgtcggcgttcgttcggttttttttcgttcggtgcgtgggtttaggagagaaagaaagcgcggcggtgtcggtggcggcgcgcggttttatttattatgattcgtagcggttgtggcgcggcgattcgggcgggcggcgatgcgttgtttagggtagtcg

SEQ ID NO: 28660 - DNA, 619 bp, Artificial Sequence
  chemically treated genomic DNA (Homo sapiens) CpG-island No: 28660
cgactaccctaaacaacgcatcgccgcccgcccgaatcgccgcgccacaaccgctacgaatcataataaataaaaccgcgcgccgccaccgacaccgccgcgctttctttctctcctaaacccacgcaccgaacgaaaaaaaaccgaacgaacgccgacgcgaacgctacgaattcgccgctaaaacccgctaccctcgaaaaaaccgaatccgcgcgaacctaaaaaacgaaaactaaacgtttaaaccgaaaacgcgcgaatcgacccgaaacccgcgaatctcgaaaactttatctcgatcccctctccccgatcccgccccgacacctcgaaacgcccgctcgcgcccaatcccctattacatacacgaaaccgaacgcccgaaatacccgaaaaaaccgcccctccttcgcgacgaccattcccgcgcgcaacccaccctccgaccctccgaacccccgaacctactctcgccaccgcccgccgacgcctaaaacgaaaaacgacgtttcccgcgcgcgacacacaccctacctcgaaaattctaaaattcgaaccctaacgatcaaactcttacccctctcctcccttcaccgcgcctacaccccgaaaatat

SEQ ID NO: 28661 - DNA, 917 bp, Artificial Sequence
  chemically treated genomic DNA (Homo sapiens) CpG-island No: 28661
atcgtttttatttatcgtatattattagtagtaggacgattagtagcgtggttacgaatataagtagagttagttcgacgttgtgttatattttgggggtagaagggtagtcggttcggggcggttggcgcggacggcggtgagcgcgggcggcggcgcgttttgcgttttagcggcgggcgttaggcgcggttgggcgtcggggcggtatgggcggttggcgttttttcggtagcgtttttagggggtggggcggcgtaaaggcgggtattgtgggatcgttcgttcgttcgatttttttttcgtcggggtggttagagcgcgggaggtaggcgggttttagggcgtttttagttttttatcgtttcggagagtcgaggtcgcggtatttagagattttagcggtcggatgcgtttttatggcggacgtcgcgcgtttgtagggaggatagagggtaagtacgggtatatacggcggttataaggttttcgtcgttgtttattcgtgtttttgagattttagggatgttagatgttagcgtcgttcggtcgcggttgtagcggttttttcgttttaggttttttatcgttggggtagtttattattaagttcgtttttttcgcggcgcggggtcggttgggagatggagtgtagagtttggtggagtcgggacggcgttgtttcgtagggattataatttttagaatgtatcgttattcgggtttcgttgtttttattttcgggcggttttgtttttggttttgtttaagtcgttttagtcggacgatcgtgggttggttttttttaaagtcgcggatttggttgttcgttttgttgaggcgttagtgagattttaattattatttcgtatataaagtcgttttgtttttagtcgtaatcgatgaagtacggcgag

SEQ ID NO: 28662 - DNA, 917 bp, Artificial Sequence
  chemically treated genomic DNA (Homo sapiens) CpG-island No: 28662
ctcgccgtacttcatcgattacgactaaaaacaaaacgactttatatacgaaataataattaaaatctcactaacgcctcaacaaaacgaacaaccaaatccgcgactttaaaaaaaaccaacccacgatcgtccgactaaaacgacttaaacaaaaccaaaaacaaaaccgcccgaaaataaaaacaacgaaacccgaataacgatacattctaaaaattataatccctacgaaacaacgccgtcccgactccaccaaactctacactccatctcccaaccgaccccgcgccgcgaaaaaaacgaacttaataataaactaccccaacgataaaaaacctaaaacgaaaaaaccgctacaaccgcgaccgaacgacgctaacatctaacatccctaaaatctcaaaaacacgaataaacaacgacgaaaaccttataaccgccgtatatacccgtacttaccctctatcctccctacaaacgcgcgacgtccgccataaaaacgcatccgaccgctaaaatctctaaataccgcgacctcgactctccgaaacgataaaaaactaaaaacgccctaaaacccgcctacctcccgcgctctaaccaccccgacgaaaaaaaaatcgaacgaacgaacgatcccacaatacccgcctttacgccgccccaccccctaaaaacgctaccgaaaaaacgccaaccgcccataccgccccgacgcccaaccgcgcctaacgcccgccgctaaaacgcaaaacgcgccgccgcccgcgctcaccgccgtccgcgccaaccgccccgaaccgactacccttctacccccaaaatataacacaacgtcgaactaactctacttatattcgtaaccacgctactaatcgtcctactactaataatatacgataaataaaaacgat

SEQ ID NO: 28663 - DNA, 917 bp, Artificial Sequence
  chemically treated genomic DNA (Homo sapiens) CpG-island No: 28663
ttcgtcgtattttatcgattacggttagaaataaaacgattttgtatacggagtaatggttgaaattttattggcgttttagtaggacgggtagttagattcgcggttttggagaaggttagtttacggtcgttcgattgaggcgatttgagtaagattaaaggtagagtcgttcgagaatgaaagtagcgaagttcgagtggcggtgtattttgggagttgtagtttttgcgagataacgtcgtttcgattttattaggttttgtattttattttttagtcgatttcgcgtcgcggaggaggcgagtttggtgatgagttgttttagcggtagggggtttggggcggagaagtcgttatagtcgcggtcgggcgacgttgatatttggtatttttggggttttagagatacgggtggatagcgacgagggttttgtggtcgtcgtgtgtattcgtgtttattttttgttttttttataggcgcgcggcgttcgttatggaagcgtattcgatcgttggggtttttgggtgtcgcggtttcggtttttcggggcgatgagggattagaggcgttttgaggttcgtttgtttttcgcgttttggttatttcggcgggaaaaggatcgggcgggcgggcggttttatagtgttcgtttttgcgtcgttttattttttgggggcgttgtcgagggggcgttagtcgtttatgtcgtttcggcgtttagtcgcgtttggcgttcgtcgttgaagcgtaggacgcgtcgtcgttcgcgtttatcgtcgttcgcgttagtcgtttcgagtcgattgtttttttgtttttaagatgtggtatagcgtcgggttgattttgtttgtgttcgtggttacgttgttgatcgttttgttgttgatggtgtgcggtgagtgggggcggt

SEQ ID NO: 28664 - DNA, 917 bp, Artificial Sequence
  chemically treated genomic DNA (Homo sapiens) CpG-island No: 28664
accgcccccactcaccgcacaccatcaacaacaaaacgatcaacaacgtaaccacgaacacaaacaaaatcaacccgacgctataccacatcttaaaaacaaaaaaacaatcgactcgaaacgactaacgcgaacgacgataaacgcgaacgacgacgcgtcctacgcttcaacgacgaacgccaaacgcgactaaacgccgaaacgacataaacgactaacgccccctcgacaacgcccccaaaaaataaaacgacgcaaaaacgaacactataaaaccgcccgcccgcccgatccttttcccgccgaaataaccaaaacgcgaaaaacaaacgaacctcaaaacgcctctaatccctcatcgccccgaaaaaccgaaaccgcgacacccaaaaaccccaacgatcgaatacgcttccataacgaacgccgcgcgcctataaaaaaaacaaaaaataaacacgaatacacacgacgaccacaaaaccctcgtcgctatccacccgtatctctaaaaccccaaaaataccaaatatcaacgtcgcccgaccgcgactataacgacttctccgccccaaaccccctaccgctaaaacaactcatcaccaaactcgcctcctccgcgacgcgaaatcgactaaaaaataaaatacaaaacctaataaaatcgaaacgacgttatctcgcaaaaactacaactcccaaaatacaccgccactcgaacttcgctactttcattctcgaacgactctacctttaatcttactcaaatcgcctcaatcgaacgaccgtaaactaaccttctccaaaaccgcgaatctaactacccgtcctactaaaacgccaataaaatttcaaccattactccgtatacaaaatcgttttatttctaaccgtaatcgataaaatacgacgaa

SEQ ID NO: 28665 - DNA, 526 bp, Artificial Sequence
  chemically treated genomic DNA (Homo sapiens) CpG-island No: 28665
attttacgcggtaaaatcgagggtattgaagcggttttggtttagttgttgggtattcggggaattcgttacgattgtggttgtaatatggaacgttattataattgttttagtatttttaagggtttgttcgaggattcgaaggtcgtcggttagttgggagtttttcgtaatcgttttgtggttttcgtatcgtatattggtattagtttggagggcgatgtaatgtttttttcgggcgattttttttcgggttggttggttttttttttcgagatgcgtttgtacgaggagtaattgagattggtgtttttgtacgagaaagttttgtttgtcgtgttttttggtatacggattgagaggcgtagggtttcggagtcgggttgtgaggcgcgtgtttatgcgggtagtttgaggcgcgtgattcgtgcggttagtgagtatttgaggttggaggatagtgtttaggagttgtcggtatcgttgtaggattattatttggttattgtgtcggatagtgatatat

SEQ ID NO: 28666 - DNA, 526 bp, Artificial Sequence
  chemically treated genomic DNA (Homo sapiens) CpG-island No: 28666
atatatcactatccgacacaataaccaaataataatcctacaacgataccgacaactcctaaacactatcctccaacctcaaatactcactaaccgcacgaatcacgcgcctcaaactacccgcataaacacgcgcctcacaacccgactccgaaaccctacgcctctcaatccgtataccaaaaaacacgacaaacaaaactttctcgtacaaaaacaccaatctcaattactcctcgtacaaacgcatctcgaaaaaaaaaaccaaccaacccgaaaaaaaatcgcccgaaaaaaacattacatcgccctccaaactaataccaatatacgatacgaaaaccacaaaacgattacgaaaaactcccaactaaccgacgaccttcgaatcctcgaacaaacccttaaaaatactaaaacaattataataacgttccatattacaaccacaatcgtaacgaattccccgaatacccaacaactaaaccaaaaccgcttcaataccctcgattttaccgcgtaaaat

SEQ ID NO: 28667 - DNA, 526 bp, Artificial Sequence
  chemically treated genomic DNA (Homo sapiens) CpG-island No: 28667
gtatattattattcggtataatggttaaatgatggttttgtagcgatgtcggtaatttttggatattattttttagttttaggtgtttattgatcgtacggattacgcgttttaagttgttcgtataggtacgcgttttatagttcggtttcggaattttacgttttttaattcgtatgttaaggagtacggtagatagggttttttcgtataggggtattagttttagttgtttttcgtgtaaacgtatttcggagaggaaggttagttaattcgagggggagtcgttcgaaaagagtattatatcgttttttaagttaatattagtgtacggtgcgaagattataaaacgattgcgaagggtttttagttggtcggcgattttcggattttcggataagtttttgaggatgttgaggtagttgtggtagcgttttatgttgtagttataatcgtaacgggtttttcgaatgtttaataattggattaaagtcgttttaatgttttcgattttgtcgcgtagagt

SEQ ID NO: 28668 - DNA, 526 bp, Artificial Sequence
  chemically treated genomic DNA (Homo sapiens) CpG-island No: 28668
actctacgcgacaaaatcgaaaacattaaaacgactttaatccaattattaaacattcgaaaaacccgttacgattataactacaacataaaacgctaccacaactacctcaacatcctcaaaaacttatccgaaaatccgaaaatcgccgaccaactaaaaacccttcgcaatcgttttataatcttcgcaccgtacactaatattaacttaaaaaacgatataatactcttttcgaacgactccccctcgaattaactaaccttcctctccgaaatacgtttacacgaaaaacaactaaaactaatacccctatacgaaaaaaccctatctaccgtactccttaacatacgaattaaaaaacgtaaaattccgaaaccgaactataaaacgcgtacctatacgaacaacttaaaacgcgtaatccgtacgatcaataaacacctaaaactaaaaaataatatccaaaaattaccgacatcgctacaaaaccatcatttaaccattataccgaataataatatac

SEQ ID NO: 28669 - DNA, 781 bp, Artificial Sequence
  chemically treated genomic DNA (Homo sapiens) CpG-island No: 28669
tcggaattcgatttttgttgcgattttttcgtttttggttcgggagagacggatggcgatggcgttggtttttcgattttcgaattcgtttgttttgatgtcgtatcgttgttattattttttgtggtattgtttagggatcggggtttcggagtgggcgttttatttagaaggattttggatacgtttttattcggtgattcgttgttattgttatttatttgggtaagtggaggattggttgtcggggtaatgggtaagggagtggttattttaggcgttggttgcggaatattcggggtaggtgtgatcggtttcggtagtgaggttagtgatatattgttttttttattttgaaagttcggcggtggagtcggtgtcgttttttttttgatttgtagtaatcgttttcgaggcgttggtttcggatcgttagtaatcggaggttttagatttagtgtagtataatggttattcgttgagtttttattcggcgattttgagtcgttattattgtagtttaattttaagggatcggagaggttgggcgtggatatgtagagttgggggcgtttgataattatcgtataagcgggttcgtttttcgagttagtagttggaatattcggaatagattgttttggaatgtaaatttggtttggcggtcgaggagcggttcgttttttgcggggtggcggtgttagtatttttgttggtggtattattatcggggtacgagtgtagtttattttcgtggagtttatggagtttagtgagttgt

SEQ ID NO: 28670 - DNA, 781 bp, Artificial Sequence
  chemically treated genomic DNA (Homo sapiens) CpG-island No: 28670
acaactcactaaactccataaactccacgaaaataaactacactcgtaccccgataataataccaccaacaaaaatactaacaccgccaccccgcaaaaaacgaaccgctcctcgaccgccaaaccaaatttacattccaaaacaatctattccgaatattccaactactaactcgaaaaacgaacccgcttatacgataattatcaaacgcccccaactctacatatccacgcccaacctctccgatcccttaaaattaaactacaataataacgactcaaaatcgccgaataaaaactcaacgaataaccattatactacactaaatctaaaacctccgattactaacgatccgaaaccaacgcctcgaaaacgattactacaaatcaaaaaaaaaacgacaccgactccaccgccgaactttcaaaataaaaaaaacaatatatcactaacctcactaccgaaaccgatcacacctaccccgaatattccgcaaccaacgcctaaaataaccactcccttacccattaccccgacaaccaatcctccacttacccaaataaataacaataacaacgaatcaccgaataaaaacgtatccaaaatccttctaaataaaacgcccactccgaaaccccgatccctaaacaataccacaaaaaataataacaacgatacgacatcaaaacaaacgaattcgaaaatcgaaaaaccaacgccatcgccatccgtctctcccgaaccaaaaacgaaaaaatcgcaacaaaaatcgaattccga

SEQ ID NO: 28671 - DNA, 781 bp, Artificial Sequence
  chemically treated genomic DNA (Homo sapiens) CpG-island No: 28671
gtaatttattgaattttatggattttacgggaatgaattatattcgtatttcggtggtggtgttattagtaaaggtattagtatcgttatttcgtaaaaagcgaatcgtttttcggtcgttaagttaggtttgtattttagagtagtttgtttcggatattttagttgttaattcgaaaagcgaattcgtttatgcggtaattgttaagcgtttttagttttgtatgtttacgtttaattttttcggttttttggagttggattgtaatggtaacggtttaaagtcgtcggatgaagatttaacggatggttattatgttatattggatttgaaattttcgattgttggcggttcggagttaacgtttcgaaagcgattgttgtagattaaaaagaaaacggtatcggttttatcgtcggatttttaaagtgggggagataatatattattggttttattatcggaatcggttatatttatttcgaatatttcgtaattagcgtttaggataattatttttttgtttattgtttcgatagttaattttttatttgtttaagtaaatggtaatggtaacggattatcgaatggaaacgtgtttaaagtttttttgaatagaacgtttatttcggagtttcgatttttgggtagtgttatagaggatgatgataacgatacggtattaaagtaagcggattcgggaatcggagagttagcgttatcgttattcgtttttttcgaattagaggcggagaaatcgtagtaggaatcgagtttcga

SEQ ID NO: 28672 - DNA, 781 bp, Artificial Sequence
  chemically treated genomic DNA (Homo sapiens) CpG-island No: 28672
tcgaaactcgattcctactacgatttctccgcctctaattcgaaaaaaacgaataacgataacgctaactctccgattcccgaatccgcttactttaataccgtatcgttatcatcatcctctataacactacccaaaaatcgaaactccgaaataaacgttctattcaaaaaaactttaaacacgtttccattcgataatccgttaccattaccatttacttaaacaaataaaaaattaactatcgaaacaataaacaaaaaaataattatcctaaacgctaattacgaaatattcgaaataaatataaccgattccgataataaaaccaataatatattatctcccccactttaaaaatccgacgataaaaccgataccgttttctttttaatctacaacaatcgctttcgaaacgttaactccgaaccgccaacaatcgaaaatttcaaatccaatataacataataaccatccgttaaatcttcatccgacgactttaaaccgttaccattacaatccaactccaaaaaaccgaaaaaattaaacgtaaacatacaaaactaaaaacgcttaacaattaccgcataaacgaattcgcttttcgaattaacaactaaaatatccgaaacaaactactctaaaatacaaacctaacttaacgaccgaaaaacgattcgctttttacgaaataacgatactaatacctttactaataacaccaccaccgaaatacgaatataattcattcccgtaaaatccataaaattcaataaattac

SEQ ID NO: 28673 - DNA, 572 bp, Artificial Sequence
  chemically treated genomic DNA (Homo sapiens) CpG-island No: 28673
tttcgttttcgttagagaggttgttgtagttgttcgtttgggttaggaagagtcgcgttttttcgaatttattttcgaacgtattttcgtagttatggttattagagtggtcgtggacgtcgtttttttgattcgatagttatttttcgattgagatatggagtatattttttcgcgtttcgttaagatttttagatcgtttaatttgttttcgtttttgttggagttgtaggcggtgttgttgtcgtcggcgttttcgttttcgtcgtttattcgattagtagatttattatttgtttgaattattagttgttgttggtttattggttcgacgtcggtacgggttaaattatcgtcgagcggattgttgtcgtggttgttgttgttgcgattgttgttcggattgttgttgttggtggagtcgtttaaggcgttcgttgagagggggcggggtcggcggtttatcgtcggcgtgtttatttttgagttgcgttgttgagagtacgatatgatagttttttttggttgtattttgttcgtggttgaacgatttaataaatcgcgattcgtta

SEQ ID NO: 28674 - DNA, 572 bp, Artificial Sequence
  chemically treated genomic DNA (Homo sapiens) CpG-island No: 28674
taacgaatcgcgatttattaaatcgttcaaccacgaacaaaatacaaccaaaaaaaactatcatatcgtactctcaacaacgcaactcaaaaataaacacgccgacgataaaccgccgaccccgccccctctcaacgaacgccttaaacgactccaccaacaacaacaatccgaacaacaatcgcaacaacaacaaccacgacaacaatccgctcgacgataatttaacccgtaccgacgtcgaaccaataaaccaacaacaactaataattcaaacaaataataaatctactaatcgaataaacgacgaaaacgaaaacgccgacgacaacaacaccgcctacaactccaacaaaaacgaaaacaaattaaacgatctaaaaatcttaacgaaacgcgaaaaaatatactccatatctcaatcgaaaaataactatcgaatcaaaaaaacgacgtccacgaccactctaataaccataactacgaaaatacgttcgaaaataaattcgaaaaaacgcgactcttcctaacccaaacgaacaactacaacaacctctctaacgaaaacgaaa

SEQ ID NO: 28675 - DNA, 572 bp, Artificial Sequence
  chemically treated genomic DNA (Homo sapiens) CpG-island No: 28675
tgacgggtcgcgatttattgagtcgtttagttacgaatagggtgtagttaaaagaggttgttatatcgtatttttaataacgtaatttaaagatggatacgtcgacggtgaatcgtcggtttcgtttttttttagcgggcgttttgggcggttttattagtaatagtaattcgaataatagtcgtagtagtagtagttacggtaatagttcgttcggcggtggtttaattcgtgtcggcgtcgagttagtgggttaatagtagttggtggtttaagtaggtggtggatttgttggtcgagtaggcggcgggagcggaagcgtcggcggtaatagtatcgtttgtagttttaatagaggcgggagtaaattaggcgatttggaaattttagcgagacgcgagaagatatattttatgttttaatcgaggagtggttgtcgagttagggagacgacgtttacgattattttgatggttatggttacggagatgcgttcggggatggattcggagaaacgcgattttttttggtttaaacgagtagttgtagtagtttttttgacgaggacgagg

SEQ ID NO: 28676 - DNA, 572 bp, Artificial Sequence
  chemically treated genomic DNA (Homo sapiens) CpG-island No: 28676
cctcgtcctcgtcaaaaaaactactacaactactcgtttaaaccaaaaaaaatcgcgtttctccgaatccatccccgaacgcatctccgtaaccataaccatcaaaataatcgtaaacgtcgtctccctaactcgacaaccactcctcgattaaaacataaaatatatcttctcgcgtctcgctaaaatttccaaatcgcctaatttactcccgcctctattaaaactacaaacgatactattaccgccgacgcttccgctcccgccgcctactcgaccaacaaatccaccacctacttaaaccaccaactactattaacccactaactcgacgccgacacgaattaaaccaccgccgaacgaactattaccgtaactactactactacgactattattcgaattactattactaataaaaccgcccaaaacgcccgctaaaaaaaaacgaaaccgacgattcaccgtcgacgtatccatctttaaattacgttattaaaaatacgatataacaacctcttttaactacaccctattcgtaactaaacgactcaataaatcgcgacccgtca

SEQ ID NO: 28677 - DNA, 525 bp, Artificial Sequence
  chemically treated genomic DNA (Homo sapiens) CpG-island No: 28677
ggcggtggcggcggtataaatttcggaggtttgtcgttggttttgtcgtcggagttggtagtgtcgttcgcgttgttgattgttgaaatagtcgatgagggagttcgattcggcgttattatcgtggtcgtcgtcgttttcgttgttatcgtcgtatttatttcgatcggtgtcgttgttgttttcgtcggagatagaggcgtcggtcgagaggatgttatcgtggtggtgtttatgttttcgtcggcgagatcgcgttttggtacgttcgaggggcgttgatcgagtagatattcgtaggatgaggttattagtattgtcggcggttgaggatcgatagtcgtggtgggtagtagacgggtggtgagtaagggacgcggttttatcgtattcgtggttagattcggaagtagtcgttttacgttggagtgtaagtttttttggttttttatcgttagatttttttgttggtttttcgttgacggatttttttttcgattcggtattattggtcgaggaattagt

SEQ ID NO: 28678 - DNA, 525 bp, Artificial Sequence
  chemically treated genomic DNA (Homo sapiens) CpG-island No: 28678
actaattcctcgaccaataataccgaatcgaaaaaaaaatccgtcaacgaaaaaccaacaaaaaaatctaacgataaaaaaccaaaaaaacttacactccaacgtaaaacgactacttccgaatctaaccacgaatacgataaaaccgcgtcccttactcaccacccgtctactacccaccacgactatcgatcctcaaccgccgacaatactaataacctcatcctacgaatatctactcgatcaacgcccctcgaacgtaccaaaacgcgatctcgccgacgaaaacataaacaccaccacgataacatcctctcgaccgacgcctctatctccgacgaaaacaacaacgacaccgatcgaaataaatacgacgataacaacgaaaacgacgacgaccacgataataacgccgaatcgaactccctcatcgactatttcaacaatcaacaacgcgaacgacactaccaactccgacgacaaaaccaacgacaaacctccgaaatttataccgccgccaccgcc

SEQ ID NO: 28679 - DNA, 525 bp, Artificial Sequence
  chemically treated genomic DNA (Homo sapiens) CpG-island No: 28679
attagtttttcggttagtggtgtcggatcgggaggaggattcgttagcggagggttagtaggagaatttggcgatggaggattaggaggatttgtattttagcgtggagcgattgttttcgaatttggttacgagtgcgatggggtcgcgttttttatttattattcgtttattgtttattacggttatcgatttttagtcgtcggtagtattggtggttttattttgcgagtatttgttcgattagcgtttttcgagcgtattaggacgcgatttcgtcggcgggagtataggtattattacgatgatattttttcggtcgacgtttttgttttcggcgaaggtagtagcgatatcgatcgggatgaatgcgacgatgataacgaagacgacgacgattacgatgatgacgtcgagtcgagtttttttatcgattattttaataattagtagcgcgagcgatattattagtttcggcggtagagttagcggtagattttcgagatttgtatcgtcgttatcgtt

SEQ ID NO: 28680 - DNA, 525 bp, Artificial Sequence
  chemically treated genomic DNA (Homo sapiens) CpG-island No: 28680
aacgataacgacgatacaaatctcgaaaatctaccgctaactctaccgccgaaactaataatatcgctcgcgctactaattattaaaataatcgataaaaaaactcgactcgacgtcatcatcgtaatcgtcgtcgtcttcgttatcatcgtcgcattcatcccgatcgatatcgctactaccttcgccgaaaacaaaaacgtcgaccgaaaaaatatcatcgtaataatacctatactcccgccgacgaaatcgcgtcctaatacgctcgaaaaacgctaatcgaacaaatactcgcaaaataaaaccaccaatactaccgacgactaaaaatcgataaccgtaataaacaataaacgaataataaataaaaaacgcgaccccatcgcactcgtaaccaaattcgaaaacaatcgctccacgctaaaatacaaatcctcctaatcctccatcgccaaattctcctactaaccctccgctaacgaatcctcctcccgatccgacaccactaaccgaaaaactaat

SEQ ID NO: 28681 - DNA, 602 bp, Artificial Sequence
  chemically treated genomic DNA (Homo sapiens) CpG-island No: 28681
tttgagaagttcgggtcgagggtttcgttgatcgttagttcgcggataggttcgggcgcgtttggtttgtttttgtataggttcgtttgaacgtgggagcgtagttcgtttgacggttgagttcgaggttcgtaattttgcggcgtttattttttttcggcgcggttttttatttcggcgagtacggcggcggtgtgggttatggattaagaaggaggcggcgtgggaggaggaagatggcggtcggtaagagcggcggtagcgtaggggagattattttttttggaaggtacgtttgtttttgtttttgacggggagaagggagggtatattggaaaacgtggtttttagaatttcggatatttagttatttgcgttgggtgggtttcgggggcggtgaagtacgagggatgagcgatgacggggagggagtgtgttgcgagcgtatttggttcgagttcgtttaggtaaggggttcggttgcgagtcggttcggtttagggggcgcgggtggattgagttataagttaaagttggtgggcgttttttgagagtgcgcgttgaagtttttgatatttaaaaaattttggggtggtggttta

SEQ ID NO: 28682 - DNA, 602 bp, Artificial Sequence
  chemically treated genomic DNA (Homo sapiens) CpG-island No: 28682
taaaccaccaccccaaaattttttaaatatcaaaaacttcaacgcgcactctcaaaaaacgcccaccaactttaacttataactcaatccacccgcgccccctaaaccgaaccgactcgcaaccgaaccccttacctaaacgaactcgaaccaaatacgctcgcaacacactccctccccgtcatcgctcatccctcgtacttcaccgcccccgaaacccacccaacgcaaataactaaatatccgaaattctaaaaaccacgttttccaatataccctcccttctccccgtcaaaaacaaaaacaaacgtaccttccaaaaaaaataatctcccctacgctaccgccgctcttaccgaccgccatcttcctcctcccacgccgcctccttcttaatccataacccacaccgccgccgtactcgccgaaataaaaaaccgcgccgaaaaaaaataaacgccgcaaaattacgaacctcgaactcaaccgtcaaacgaactacgctcccacgttcaaacgaacctatacaaaaacaaaccaaacgcgcccgaacctatccgcgaactaacgatcaacgaaaccctcgacccgaacttctcaaa

SEQ ID NO: 28683 - DNA, 602 bp, Artificial Sequence
  chemically treated genomic DNA (Homo sapiens) CpG-island No: 28683
taggttattattttaaaattttttaaatgttaaagattttagcgcgtatttttaaaggacgtttattaattttggtttgtagtttaatttattcgcgttttttgggtcgaatcggttcgtaatcgagttttttgtttaggcggattcgaattaggtgcgttcgtagtatatttttttttcgttatcgtttatttttcgtattttatcgttttcgaaatttatttagcgtagataattgaatattcggggttttgggggttacgttttttagtatattttttttttttttcgttaagggtagaaatagacgtattttttagaaaagataattttttttgcgttatcgtcgtttttgtcggtcgttatttttttttttttacgtcgttttttttttaatttatggtttatatcgtcgtcgtgttcgtcgggatgaggggtcgcgtcggaggagggtagacgtcgtagggttgcgggtttcgggtttagtcgttaggcgggttgcgtttttacgtttagacgggtttatataaaggtaggttaggcgcgttcgggtttgttcgcgggttggcggttagcgaggttttcggttcgagttttttagg

SEQ ID NO: 28684 - DNA, 602 bp, Artificial Sequence
  chemically treated genomic DNA (Homo sapiens) CpG-island No: 28684
cctaaaaaactcgaaccgaaaacctcgctaaccgccaacccgcgaacaaacccgaacgcgcctaacctacctttatataaacccgtctaaacgtaaaaacgcaacccgcctaacgactaaacccgaaacccgcaaccctacgacgtctaccctcctccgacgcgacccctcatcccgacgaacacgacgacgatataaaccataaattaaaaaaaaaacgacgtaaaaaaaaaaaaataacgaccgacaaaaacgacgataacgcaaaaaaaattatcttttctaaaaaatacgtctatttctacccttaacgaaaaaaaaaaaaaatatactaaaaaacgtaacccccaaaaccccgaatattcaattatctacgctaaataaatttcgaaaacgataaaatacgaaaaataaacgataacgaaaaaaaaatatactacgaacgcacctaattcgaatccgcctaaacaaaaaactcgattacgaaccgattcgacccaaaaaacgcgaataaattaaactacaaaccaaaattaataaacgtcctttaaaaatacgcgctaaaatctttaacatttaaaaaattttaaaataataaccta

SEQ ID NO: 28685 - DNA, 522 bp, Artificial Sequence
  chemically treated genomic DNA (Homo sapiens) CpG-island No: 28685
tttttttcgggttggggcgttggatggagtatcggggtaggagggcgggtttcgggcgtcgggagcgtagttgtcgggggtcgggggggcggataggtcgggtttttgttattttagttaggttcgcgttcgcgttttcgcgtttcgcggttttagggttttatcgcgcgcgtttagttcggcggtcgttacgtgttcggtgagtattgtttcgaatcgtcgtagtcgagatacgattcgttcgtatagcgttttgttttcgcgttcgtcgcgaatgttttcgtagaagtatagggtcgggcggttaggtttttcgcgtttttagttttcgttgcgtttcggtattatggtagtagttattttttagtcgttcgcgtttttcggcgttagggggcgttagttcgcggttacgtgatttcgttcggtttagcgtagagttcggttgttgagtttatatttgtggaatggggacgacgaattgggaggatttagtcgggattttttcgggaatatatttttttt

SEQ ID NO: 28686 - DNA, 522 bp, Artificial Sequence
  chemically treated genomic DNA (Homo sapiens) CpG-island No: 28686
aaaaaaaatatattcccgaaaaaatcccgactaaatcctcccaattcgtcgtccccattccacaaatataaactcaacaaccgaactctacgctaaaccgaacgaaatcacgtaaccgcgaactaacgccccctaacgccgaaaaacgcgaacgactaaaaaataactactaccataataccgaaacgcaacgaaaactaaaaacgcgaaaaacctaaccgcccgaccctatacttctacgaaaacattcgcgacgaacgcgaaaacaaaacgctatacgaacgaatcgtatctcgactacgacgattcgaaacaatactcaccgaacacgtaacgaccgccgaactaaacgcgcgcgataaaaccctaaaaccgcgaaacgcgaaaacgcgaacgcgaacctaactaaaataacaaaaacccgacctatccgcccccccgacccccgacaactacgctcccgacgcccgaaacccgccctcctaccccgatactccatccaacgccccaacccgaaaaaaa

SEQ ID NO: 28687 - DNA, 522 bp, Artificial Sequence
  chemically treated genomic DNA (Homo sapiens) CpG-island No: 28687
aggaagggtgtgttttcgaaagggtttcggttggatttttttagttcgtcgtttttattttataggtgtggatttagtagtcgggttttgcgttgggtcgggcggggttacgtggtcgcgggttggcgttttttggcgtcggagagcgcgggcggttggggaatggttgttgttatggtgtcggggcgtagcgagagttgggagcgcggggagtttggtcgttcggttttgtatttttgcgggagtattcgcggcggacgcgaggataggacgttgtacgagcggatcgtgtttcggttgcggcgattcgggatagtgtttatcgagtacgtggcggtcgtcgagttgggcgcgcgcggtgaggttttggggtcgcgggacgcggggacgcgggcgcggatttggttggggtggtagggattcggtttgttcgttttttcgattttcggtagttgcgttttcggcgttcggagttcgtttttttatttcggtgttttatttagcgttttagttcgagaagga

SEQ ID NO: 28688 - DNA, 522 bp, Artificial Sequence
  chemically treated genomic DNA (Homo sapiens) CpG-island No: 28688
tccttctcgaactaaaacgctaaataaaacaccgaaataaaaaaacgaactccgaacgccgaaaacgcaactaccgaaaatcgaaaaaacgaacaaaccgaatccctaccaccccaaccaaatccgcgcccgcgtccccgcgtcccgcgaccccaaaacctcaccgcgcgcgcccaactcgacgaccgccacgtactcgataaacactatcccgaatcgccgcaaccgaaacacgatccgctcgtacaacgtcctatcctcgcgtccgccgcgaatactcccgcaaaaatacaaaaccgaacgaccaaactccccgcgctcccaactctcgctacgccccgacaccataacaacaaccattccccaaccgcccgcgctctccgacgccaaaaaacgccaacccgcgaccacgtaaccccgcccgacccaacgcaaaacccgactactaaatccacacctataaaataaaaacgacgaactaaaaaaatccaaccgaaaccctttcgaaaacacacccttcct

SEQ ID NO: 28689 - DNA, 1032 bp, Artificial Sequence
  chemically treated genomic DNA (Homo sapiens) CpG-island No: 28689
tcgtttacgtcgttcgtatcgcgcgtatttagtcgggttagggcgagggatttaggtttttcggttttttagggcgcgcgttcggggttcgggggtggggggcgtggaggcggtttttttggagcgtttaattagtagtaaggttcggcggtggcgttagtgacgtagatcgcgttttttttcgttttattgcgggtcgacgttcggcgtcgttagttacgcgcgttgtagcgcgaggggagagcgagaaggagggttttggggtcgatcggttgttggagggcggcgggtcgcggggagcgggggagtgagtatgcgtagcggtttcggggagcgtaggggaggaggggtcggcgttgagaggcgcgcgcgtgcgcgtgtacgagtggttcgtcggcggttgcgggtggagggggcggtttttcgagtgtcggcgattcgagggcgggtaggcgggcggtaggtgtcgtcgtagtttttggttggtttcgcgttttcgtttttcggcggcgatgagttgggttttgtcgggggttgtatttgtcggttgtttattagtatcggttttttggcgtgatttcggttttttcgcgtgtttagttttcgcggcgcggcgttgtttttgagagggagcggcggcggtttttttcgtttcgagttttcgttcgggggtcgcgcgaggacggcgttcggtttttttttttttttttttcgttcgtcgtttttaatgttttttcggcggggagggggttgtttgggagatacgttgagcggtttttttacggaggtttttcggttgtagtagtagtagcgttcggttcggcgtttcgtagtttttattagcggcggcggtttggaggagtcgcgtattcgtcgtcgtttttcgagtttcgtagtcgtcgtcgtcgttcggtattcgaggagagggcggcgggcgtttttcggggaagatgaaggcggaggggggcgattattttatgattaatttgtcggtgtagtaggttttgagtttttgggtttacgggacggtgt

SEQ ID NO: 28690 - DNA, 1032 bp, Artificial Sequence
  chemically treated genomic DNA (Homo sapiens) CpG-island No: 28690
acaccgtcccgtaaacccaaaaactcaaaacctactacaccgacaaattaatcataaaataatcgcccccctccgccttcatcttccccgaaaaacgcccgccgccctctcctcgaataccgaacgacgacgacgactacgaaactcgaaaaacgacgacgaatacgcgactcctccaaaccgccgccgctaataaaaactacgaaacgccgaaccgaacgctactactactacaaccgaaaaacctccgtaaaaaaaccgctcaacgtatctcccaaacaaccccctccccgccgaaaaaacattaaaaacgacgaacgaaaaaaaaaaaaaaaaaaaccgaacgccgtcctcgcgcgacccccgaacgaaaactcgaaacgaaaaaaaccgccgccgctccctctcaaaaacaacgccgcgccgcgaaaactaaacacgcgaaaaaaccgaaatcacgccaaaaaaccgatactaataaacaaccgacaaatacaacccccgacaaaacccaactcatcgccgccgaaaaacgaaaacgcgaaaccaaccaaaaactacgacgacacctaccgcccgcctacccgccctcgaatcgccgacactcgaaaaaccgccccctccacccgcaaccgccgacgaaccactcgtacacgcgcacgcgcgcgcctctcaacgccgacccctcctcccctacgctccccgaaaccgctacgcatactcactcccccgctccccgcgacccgccgccctccaacaaccgatcgaccccaaaaccctccttctcgctctcccctcgcgctacaacgcgcgtaactaacgacgccgaacgtcgacccgcaataaaacgaaaaaaaacgcgatctacgtcactaacgccaccgccgaaccttactactaattaaacgctccaaaaaaaccgcctccacgccccccacccccgaaccccgaacgcgcgccctaaaaaaccgaaaaacctaaatccctcgccctaacccgactaaatacgcgcgatacgaacgacgtaaacga

SEQ ID NO: 28691 - DNA, 1032 bp, Artificial Sequence
  chemically treated genomic DNA (Homo sapiens) CpG-island No: 28691
gtatcgtttcgtgggtttagaggtttaggatttgttgtatcgataggttgattatggaatggtcgttttttttcgtttttatttttttcgaggggcgttcgtcgtttttttttcgggtgtcgggcggcggcggcggttgcgaggttcggggggcggcggcgggtgcgcggtttttttaggtcgtcgtcgttggtggaggttgcgggacgtcgggtcgggcgttgttgttgttgtagtcggagggttttcgtgggggggtcgtttagcgtgttttttaggtagtttttttttcgtcggggagatattgaggacggcggacggaggaaggaggggagggggtcgggcgtcgttttcgcgcggttttcgagcgaggattcggggcggaggaggtcgtcgtcgtttttttttaggggtagcgtcgcgtcgcggggattggatacgcgaggaggtcgaggttacgttaggaggtcggtgttgatgggtagtcggtaggtgtagttttcgatagggtttagtttatcgtcgtcggaggacggagacgcgggattagttagaggttgcggcggtatttgtcgttcgtttgttcgttttcgggtcgtcgatattcgaggaatcgttttttttattcgtagtcgtcggcgggttattcgtgtacgcgtacgcgcgcgttttttagcgtcggtttttttttttttgcgtttttcggagtcgttgcgtatgtttattttttcgtttttcgcgattcgtcgttttttaatagtcggtcggttttaaagttttttttttcgtttttttttcgcgttgtagcgcgcgtggttgacggcgtcgagcgtcggttcgtagtggggcggagggaagcgcggtttacgttattggcgttatcgtcgggttttattgttgattgggcgttttaagggaatcgtttttacgttttttattttcggatttcgggcgcgcgttttgagagatcgggagatttggatttttcgttttggttcggttgggtgcgcgcggtgcgggcggcgtgggcgg

SEQ ID NO: 28692 - DNA, 1032 bp, Artificial Sequence
  chemically treated genomic DNA (Homo sapiens) CpG-island No: 28692
ccgcccacgccgcccgcaccgcgcgcacccaaccgaaccaaaacgaaaaatccaaatctcccgatctctcaaaacgcgcgcccgaaatccgaaaataaaaaacgtaaaaacgattcccttaaaacgcccaatcaacaataaaacccgacgataacgccaataacgtaaaccgcgcttccctccgccccactacgaaccgacgctcgacgccgtcaaccacgcgcgctacaacgcgaaaaaaaaacgaaaaaaaaaactttaaaaccgaccgactattaaaaaacgacgaatcgcgaaaaacgaaaaaataaacatacgcaacgactccgaaaaacgcaaaaaaaaaaaaaccgacgctaaaaaacgcgcgcgtacgcgtacacgaataacccgccgacgactacgaataaaaaaaacgattcctcgaatatcgacgacccgaaaacgaacaaacgaacgacaaataccgccgcaacctctaactaatcccgcgtctccgtcctccgacgacgataaactaaaccctatcgaaaactacacctaccgactacccatcaacaccgacctcctaacgtaacctcgacctcctcgcgtatccaatccccgcgacgcgacgctacccctaaaaaaaaacgacgacgacctcctccgccccgaatcctcgctcgaaaaccgcgcgaaaacgacgcccgaccccctcccctccttcctccgtccgccgtcctcaatatctccccgacgaaaaaaaaactacctaaaaaacacgctaaacgacccccccacgaaaaccctccgactacaacaacaacaacgcccgacccgacgtcccgcaacctccaccaacgacgacgacctaaaaaaaccgcgcacccgccgccgccccccgaacctcgcaaccgccgccgccgcccgacacccgaaaaaaaaacgacgaacgcccctcgaaaaaaataaaaacgaaaaaaaacgaccattccataatcaacctatcgatacaacaaatcctaaacctctaaacccacgaaacgatac

SEQ ID NO: 28693 - DNA, 915 bp, Artificial Sequence
  chemically treated genomic DNA (Homo sapiens) CpG-island No: 28693
tgttattttttcgcggtgtttagttttcgtttttttttggcgttcgcgtttttttttttttttttgttttttagtacggattttttttcgacgttgtttacgtgttagattcgggatcgcgagcggcgttcgtattcgtacgtatattcggttacgttcgtattcgcgcggtcgcggggtcggttgtttattttcggggttttatggtcgcgtcgttagtttgggtgtgagagggggagagggtgtgaggacgtgtgtggcgtttagtttcgaaggacggggcggaggaaggggtttggagtttgttattttttgagggagcgcggaggtcgagagatttgtgaggcgcgcggcggggtcgggagggttagtatattgtgagtcggtaaggggacgcggaatagtcgggcggcgcgcggttatcgggtacggaattcgttgtcgttattatttcgtcgtcgtagttcggcgagtggcggggcgcggggaggagggggttgagtcgggtgggggagcgcggggcgcggcggcggtattaggcggttcgattggagttttgcgttagtcggcggtacgcgtatatttgttcgtcgtcgttatcggtcgcgttattggttgtcggcgtcgagcgcgcgagattgaattttttatttattttagggtcgggcgggcgagcgcggtcgcggtggagttttatcgcgggcgttttcgaattttcgaagcgcgttttcgcgtaggtcgtgggcgcgtacggtcgttgtcgtcgtttgttttggtggaggttgcgagtgtttgggtttgtgattttcggtttttcgcgcgtagcgttagtttgggagggaagtttatatggcggtttttagggtgcgattggagggaggcgggacgatgttattttttgttttttaatttgat

SEQ ID NO: 28694 - DNA, 915 bp, Artificial Sequence
  chemically treated genomic DNA (Homo sapiens) CpG-island No: 28694
atcaaattaaaaaacaaaaaataacatcgtcccgcctccctccaatcgcaccctaaaaaccgccatataaacttccctcccaaactaacgctacgcgcgaaaaaccgaaaatcacaaacccaaacactcgcaacctccaccaaaacaaacgacgacaacgaccgtacgcgcccacgacctacgcgaaaacgcgcttcgaaaattcgaaaacgcccgcgataaaactccaccgcgaccgcgctcgcccgcccgaccctaaaataaataaaaaattcaatctcgcgcgctcgacgccgacaaccaataacgcgaccgataacgacgacgaacaaatatacgcgtaccgccgactaacgcaaaactccaatcgaaccgcctaataccgccgccgcgccccgcgctcccccacccgactcaaccccctcctccccgcgccccgccactcgccgaactacgacgacgaaataataacgacaacgaattccgtacccgataaccgcgcgccgcccgactattccgcgtccccttaccgactcacaatatactaaccctcccgaccccgccgcgcgcctcacaaatctctcgacctccgcgctccctcaaaaaataacaaactccaaaccccttcctccgccccgtccttcgaaactaaacgccacacacgtcctcacaccctctccccctctcacacccaaactaacgacgcgaccataaaaccccgaaaataaacaaccgaccccgcgaccgcgcgaatacgaacgtaaccgaatatacgtacgaatacgaacgccgctcgcgatcccgaatctaacacgtaaacaacgtcgaaaaaaaatccgtactaaaaaacaaaaaaaaaaaaaaaaacgcgaacgccaaaaaaaaacgaaaactaaacaccgcgaaaaaataaca

SEQ ID NO: 28695 - DNA, 915 bp, Artificial Sequence
  chemically treated genomic DNA (Homo sapiens) CpG-island No: 28695
gttaggttggggagtaaggagtagtatcgtttcgtttttttttagtcgtattttagggatcgttatgtgagttttttttttagattgacgttgcgcgcggagagtcgggagttataggtttaggtattcgtagtttttattagaataaacggcggtagcggtcgtgcgcgtttacggtttgcgcggggacgcgtttcgggggttcgggggcgttcgcggtaaagttttatcgcggtcgcgttcgttcgttcggttttggaatgaatggaaggtttaatttcgcgcgttcggcgtcggtagttaatgacgcggtcggtagcggcggcgggtaggtgtgcgcgtgtcgtcggttgacgtagggttttagtcgaatcgtttggtgtcgtcgtcgcgtttcgcgtttttttattcggtttagttttttttttttcgcgtttcgttattcgtcgggttgcggcggcggagtggtggcgatagcggatttcgtgttcggtggtcgcgcgtcgttcggttgtttcgcgtttttttgtcggtttataatgtgttgattttttcggtttcgtcgcgcgttttataggtttttcgattttcgcgtttttttaggaagtgatagattttaggttttttttttcgtttcgtttttcgggattgaacgttatatacgtttttatatttttttttttttttatatttaggttagcgacgcgattatgaggtttcggaggtaagtagtcggtttcgcggtcgcgcgagtgcgagcgtggtcgggtgtgcgtgcgggtgcggacgtcgttcgcggtttcgagtttggtacgtgagtaacgtcgaggggaaattcgtgttgaggagtaggaagaaaagaggaggcgcgagcgttagggaggggcgaggattgggtatcgcggggaagtgata

SEQ ID NO: 28696 - DNA, 915 bp, Artificial Sequence
  chemically treated genomic DNA (Homo sapiens) CpG-island No: 28696
tatcacttccccgcgatacccaatcctcgcccctccctaacgctcgcgcctcctcttttcttcctactcctcaacacgaatttcccctcgacgttactcacgtaccaaactcgaaaccgcgaacgacgtccgcacccgcacgcacacccgaccacgctcgcactcgcgcgaccgcgaaaccgactacttacctccgaaacctcataatcgcgtcgctaacctaaatataaaaaaaaaaaaaaatataaaaacgtatataacgttcaatcccgaaaaacgaaacgaaaaaaaaaacctaaaatctatcacttcctaaaaaaacgcgaaaatcgaaaaacctataaaacgcgcgacgaaaccgaaaaaatcaacacattataaaccgacaaaaaaacgcgaaacaaccgaacgacgcgcgaccaccgaacacgaaatccgctatcgccaccactccgccgccgcaacccgacgaataacgaaacgcgaaaaaaaaaaaactaaaccgaataaaaaaacgcgaaacgcgacgacgacaccaaacgattcgactaaaaccctacgtcaaccgacgacacgcgcacacctacccgccgccgctaccgaccgcgtcattaactaccgacgccgaacgcgcgaaattaaaccttccattcattccaaaaccgaacgaacgaacgcgaccgcgataaaactttaccgcgaacgcccccgaacccccgaaacgcgtccccgcgcaaaccgtaaacgcgcacgaccgctaccgccgtttattctaataaaaactacgaatacctaaacctataactcccgactctccgcgcgcaacgtcaatctaaaaaaaaaactcacataacgatccctaaaatacgactaaaaaaaaacgaaacgatactactccttactccccaacctaac

SEQ ID NO: 28697 - DNA, 1147 bp, Artificial Sequence
  chemically treated genomic DNA (Homo sapiens) CpG-island No: 28697
gttcgcgacgttatcgcgtttttcgtcgtcgtcgtcgtcgtcggggttttcgttgacgtacgggtttcgttttttttttttttttttttttatagttcgggcgtcgggcggcgagtgcgttagtcggtcgggacgcggagttgtgtgtattttttacgcgggttcgttcgttttcgggagtcgcgtagttttttcggcggtggtaggagcggcgaagagcgttattagcgggtttttacggttttaggtttcgcggcgcgcggttcgttcgtttttttcgttcgtttaatttgcggtttgtggaggcgtgaggcgacgataggcgagcgtttcgagtagcgttagtcgttgcggtcgtcggttttttttttatttttttttcggttttttttcgtttttttttttttatttttcgagtttcggcgtgtttcggttacgttcgacgttgttgtaggaataaaggaagatttcgcggcggcggcggcgttattttcgtttgttgtttcgattcgttttcggttcgcggcggcggtattagggcgttcggtttagttttttcggaggtttcggttcggttttatcgtgtcggtttcgcgcgcgaattcggttttcgtatttgggattttgtagggtgagtgatacggggttgcgggtgggagtcgggttttttgttgtcgggtcgggggcgggagtgaagggatcggggcgtcgcgggttaatggcgaagtcggagtaggtcgcggatggcggcgttcgggggaggggagttcgttcgttagtttaggaagtataaagacggaggcgttattttgtcgtcgtggttcgagatttggttttcggcgtttttggttcgttttatagtacggtcgggaaataatgtacggcgtgtcgtttttgcggggtcggtttttaggtcgttcgttttcgcggcggcgttcggcgtgggtattacgatttagagaaataaagaggtcgaggcggcggtcgcgttttttgttcgttgtagttttttttagtttttttttaagaggagtcgttcggggtcgggggtcgggggtcggggattcgcgtggggtttgtaggcgaagggttggtcgggtttgttgagttgttgttttgtatgatttagtggttttcggagagggtt

SEQ ID NO: 28698 - DNA, 1147 bp, Artificial Sequence
  chemically treated genomic DNA (Homo sapiens) CpG-island No: 28698
aaccctctccgaaaaccactaaatcatacaaaacaacaactcaacaaacccgaccaacccttcgcctacaaaccccacgcgaatccccgacccccgacccccgaccccgaacgactcctcttaaaaaaaaactaaaaaaaactacaacgaacaaaaaacgcgaccgccgcctcgacctctttatttctctaaatcgtaatacccacgccgaacgccgccgcgaaaacgaacgacctaaaaaccgaccccgcaaaaacgacacgccgtacattatttcccgaccgtactataaaacgaaccaaaaacgccgaaaaccaaatctcgaaccacgacgacaaaataacgcctccgtctttatacttcctaaactaacgaacgaactcccctcccccgaacgccgccatccgcgacctactccgacttcgccattaacccgcgacgccccgatcccttcactcccgcccccgacccgacaacaaaaaacccgactcccacccgcaaccccgtatcactcaccctacaaaatcccaaatacgaaaaccgaattcgcgcgcgaaaccgacacgataaaaccgaaccgaaacctccgaaaaaactaaaccgaacgccctaataccgccgccgcgaaccgaaaacgaatcgaaacaacaaacgaaaataacgccgccgccgccgcgaaatcttcctttattcctacaacaacgtcgaacgtaaccgaaacacgccgaaactcgaaaaataaaaaaaaaaaaacgaaaaaaaaccgaaaaaaaaataaaaaaaaaaccgacgaccgcaacgactaacgctactcgaaacgctcgcctatcgtcgcctcacgcctccacaaaccgcaaattaaacgaacgaaaaaaacgaacgaaccgcgcgccgcgaaacctaaaaccgtaaaaacccgctaataacgctcttcgccgctcctaccaccgccgaaaaaactacgcgactcccgaaaacgaacgaacccgcgtaaaaaatacacacaactccgcgtcccgaccgactaacgcactcgccgcccgacgcccgaactataaaaaaaaaaaaaaaaaaaaaacgaaacccgtacgtcaacgaaaaccccgacgacgacgacgacgacgaaaaacgcgataacgtcgcgaac

SEQ ID NO: 28699 - DNA, 1147 bp, Artificial Sequence
  chemically treated genomic DNA (Homo sapiens) CpG-island No: 28699
ggtttttttcgaaaattattgagttatgtagaatagtagtttagtaggttcggttagtttttcgtttgtaggttttacgcggattttcgattttcgattttcgatttcgaacggttttttttaggggagagttagggggggttgtaacgggtagggggcgcggtcgtcgtttcggtttttttgtttttttgggtcgtggtgtttacgtcgggcgtcgtcgcggaggcgagcggtttagaggtcggtttcgtagaggcggtacgtcgtgtattgtttttcgatcgtgttgtggagcgagttagggacgtcgggagttaggtttcgggttacgacgataggatgacgttttcgtttttgtgttttttgggttggcgggcgggtttttttttttcggacgtcgttattcgcggtttgtttcggtttcgttattggttcgcggcgtttcggtttttttattttcgttttcggttcggtaataaggagttcggtttttattcgtagtttcgtattatttattttgtagggttttaaatgcgaaagtcgggttcgcgcgcgaagtcggtacgatgaggtcgggtcgaggttttcgggaaggttgagtcgggcgttttggtgtcgtcgtcgcgggtcgggagcgggtcggagtagtaggcggaggtggcgtcgtcgtcgtcgcggggtttttttttgtttttgtagtagcgtcgagcgtggtcgggatacgtcggagttcgggaagtgggaggagggaagcgagggggggtcgaggaggaggtggagggaggatcggcggtcgtagcggttaacgttgttcgaggcgttcgtttgtcgtcgttttacgtttttataggtcgtaggttgggcggacgaggagggcgagcggatcgcgcgtcgcgaggtttggggtcgtaagggttcgttgatggcgtttttcgtcgtttttgttatcgtcggggaagttgcgcggttttcgggagcgagcgagttcgcgtaggagatgtatatagtttcgcgtttcggtcgattaacgtattcgtcgttcggcgttcgggttgtgagggaaaagagggggagggggcgggattcgtgcgttagcgaaaatttcggcggcggcggcggcggcggggagcgcggtgacgtcgcgggt

SEQ ID NO: 28700 - DNA, 1147 bp, Artificial Sequence
  chemically treated genomic DNA (Homo sapiens) CpG-island No: 28700
acccgcgacgtcaccgcgctccccgccgccgccgccgccgccgaaattttcgctaacgcacgaatcccgccccctccccctcttttccctcacaacccgaacgccgaacgacgaatacgttaatcgaccgaaacgcgaaactatatacatctcctacgcgaactcgctcgctcccgaaaaccgcgcaacttccccgacgataacaaaaacgacgaaaaacgccatcaacgaacccttacgaccccaaacctcgcgacgcgcgatccgctcgccctcctcgtccgcccaacctacgacctataaaaacgtaaaacgacgacaaacgaacgcctcgaacaacgttaaccgctacgaccgccgatcctccctccacctcctcctcgaccccccctcgcttccctcctcccacttcccgaactccgacgtatcccgaccacgctcgacgctactacaaaaacaaaaaaaaaccccgcgacgacgacgacgccacctccgcctactactccgacccgctcccgacccgcgacgacgacaccaaaacgcccgactcaaccttcccgaaaacctcgacccgacctcatcgtaccgacttcgcgcgcgaacccgactttcgcatttaaaaccctacaaaataaataatacgaaactacgaataaaaaccgaactccttattaccgaaccgaaaacgaaaataaaaaaaccgaaacgccgcgaaccaataacgaaaccgaaacaaaccgcgaataacgacgtccgaaaaaaaaaaacccgcccgccaacccaaaaaacacaaaaacgaaaacgtcatcctatcgtcgtaacccgaaacctaactcccgacgtccctaactcgctccacaacacgatcgaaaaacaatacacgacgtaccgcctctacgaaaccgacctctaaaccgctcgcctccgcgacgacgcccgacgtaaacaccacgacccaaaaaaacaaaaaaaccgaaacgacgaccgcgccccctacccgttacaaccccccctaactctcccctaaaaaaaaccgttcgaaatcgaaaatcgaaaatcgaaaatccgcgtaaaacctacaaacgaaaaactaaccgaacctactaaactactattctacataactcaataattttcgaaaaaaacc

SEQ ID NO: 28701 - DNA, 554 bp, Artificial Sequence
  chemically treated genomic DNA (Homo sapiens) CpG-island No: 28701
cgtttcgttcgattgtttcgtttttaacgcggatttacgttatcgcgcgttagtttgcggtcgttttgatttcgcgggatttgagtttcggtgttaataaatatttttatcgcggttgcgtttattttatttgtcggcggcgattagtttttgaagaaaagtgtttattatggtgtcgaggagttttattttcgaaatggtagtgtcgggtggtatagatttcgaagacgattttttatgttttttttttttatagtcgttgtttagattggcgttatttgtttcggttatgttgaagttgaatttttaaatttaattggttcggttttttcgtttgtcggagttttcgattggtcgttttcgcgaagggtgttttcgattggaagtagtagaacgtttgttatcgagtagggcgggggcggggaagttatcggaggttgagggtagcggggaggcgaggttttgcgcggtgggatgttcgcgatcggaaaaatacgcgtaagttaaagttcgggggtttaataaaaatttttaattatattttagagatttcg

SEQ ID NO: 28702 - DNA, 554 bp, Artificial Sequence
  chemically treated genomic DNA (Homo sapiens) CpG-island No: 28702
cgaaatctctaaaatataattaaaaatttttattaaacccccgaactttaacttacgcgtatttttccgatcgcgaacatcccaccgcgcaaaacctcgcctccccgctaccctcaacctccgataacttccccgcccccgccctactcgataacaaacgttctactacttccaatcgaaaacacccttcgcgaaaacgaccaatcgaaaactccgacaaacgaaaaaaccgaaccaattaaatttaaaaattcaacttcaacataaccgaaacaaataacgccaatctaaacaacgactataaaaaaaaaaaacataaaaaatcgtcttcgaaatctataccacccgacactaccatttcgaaaataaaactcctcgacaccataataaacacttttcttcaaaaactaatcgccgccgacaaataaaataaacgcaaccgcgataaaaatatttattaacaccgaaactcaaatcccgcgaaatcaaaacgaccgcaaactaacgcgcgataacgtaaatccgcgttaaaaacgaaacaatcgaacgaaacg

SEQ ID NO: 28703 - DNA, 554 bp, Artificial Sequence
  chemically treated genomic DNA (Homo sapiens) CpG-island No: 28703
cgaagtttttgaaatgtaattaaaagtttttattgagttttcgagttttggtttgcgcgtattttttcggtcgcggatattttatcgcgtagagtttcgttttttcgttgtttttagttttcgatgattttttcgttttcgttttgttcggtgatagacgttttattgtttttaatcggaggtatttttcgcgggagcggttaatcgggagtttcggtaggcggggaggtcgggttagttagatttggaggtttaattttaatatggtcgaagtaagtagcgttaatttaggtagcggttgtgaggaaaaaaggtatgaggggtcgttttcggaatttgtgttattcggtattattatttcgagggtgaagtttttcgatattatggtggatatttttttttagaagttggtcgtcgtcggtaggtaaagtggacgtagtcgcggtgggagtgtttgttggtatcgaagtttaaatttcgcgaggttaggacggtcgtaggttggcgcgcggtgacgtgggttcgcgttgggggcggggtagtcggacgaggcg

SEQ ID NO: 28704 - DNA, 554 bp, Artificial Sequence
  chemically treated genomic DNA (Homo sapiens) CpG-island No: 28704
cgcctcgtccgactaccccgcccccaacgcgaacccacgtcaccgcgcgccaacctacgaccgtcctaacctcgcgaaatttaaacttcgataccaacaaacactcccaccgcgactacgtccactttacctaccgacgacgaccaacttctaaaaaaaaatatccaccataatatcgaaaaacttcaccctcgaaataataataccgaataacacaaattccgaaaacgacccctcataccttttttcctcacaaccgctacctaaattaacgctacttacttcgaccatattaaaattaaacctccaaatctaactaacccgacctccccgcctaccgaaactcccgattaaccgctcccgcgaaaaatacctccgattaaaaacaataaaacgtctatcaccgaacaaaacgaaaacgaaaaaatcatcgaaaactaaaaacaacgaaaaaacgaaactctacgcgataaaatatccgcgaccgaaaaaatacgcgcaaaccaaaactcgaaaactcaataaaaacttttaattacatttcaaaaacttcg

SEQ ID NO: 28705 - DNA, 1240 bp, Artificial Sequence
  chemically treated genomic DNA (Homo sapiens) CpG-island No: 28705
atcgttttaggcgcggatattcgggttttttcgttttattttacgggttaaggagacgttagtaggattttattttttatagtagtcgagtaagagagtacgcggaatagaggagttttgcgtgattttatataagagttattcggattttttttaaatttgaggtaaagcgtattttttttcgcggtttcgggtagttttcgagtatcgggttttcggtattattttttttgggtcgtggggtggtagtaaacgttaagggggatgcgtatgttttgtgtggggtttcgcgtttcgttttcgcggtcgtcgagtgacggaagcgcgtgtttaggtttatgggaaatgtggtttttaaatcgcgggcgttttttgtttgggtttagagcgggattttagttttcggtcggttggttggcgcgtgtggaaacgcgggaggagagggcggggcgagtgggagaaaaggtgggcggagtcggtgggaaggttaggcggagggggcggggtttcggtcggttaagtcgcggttattcgcggtttgagggatcggaggagcggggtcgggagttgcgaggagttttttagacgtcgtcgagcgcgagggcgggcgtgttcggagtggtcgttcgttagtcgtcgttttttagttttcgtatttgtaggtttttttttttttcgtcgggacgcgggagagttcggttcgcggcgggggcggttaatgcgaaattggttggtgttgttgtgttcgtgtgtgttcggggtcgcgttgtatttttggttgcggttgcgtttttcgtcgttcgtttgcgttttcggggtcggttttgtaggtgaggttttggggtcgggcgggttggcggtcgtcgggggggtgggaggttcggtttggtgtcgcggggtttcgtcgggaattgttggaggcgggggaagggttaaacgcgacggtttttagacgaaataaacggttttttttatttttggagcgttaatatcgggtaaatttgagggagttttttttttttcgtgttttcgtcgttttttattttttcgtttgttttaacgttcgtagagtcggcgttcgtagttgtaagtttttcgttcgtttttaggtttggttagtgatgttcgacgtcgttcgttcgttcgggagcggaatttcgtgtgttttttagtcgttagcgttttttgttttgggagttttggttttgaagttgttttttttttttttaagttgttggtt

SEQ ID NO: 28706 - DNA, 1240 bp, Artificial Sequence
  chemically treated genomic DNA (Homo sapiens) CpG-island No: 28706
aaccaacaacttaaaaaaaaaaaaaacaacttcaaaaccaaaactcccaaaacaaaaaacgctaacgactaaaaaacacacgaaattccgctcccgaacgaacgaacgacgtcgaacatcactaaccaaacctaaaaacgaacgaaaaacttacaactacgaacgccgactctacgaacgttaaaacaaacgaaaaaataaaaaacgacgaaaacacgaaaaaaaaaaaactccctcaaatttacccgatattaacgctccaaaaataaaaaaaaccgtttatttcgtctaaaaaccgtcgcgtttaacccttcccccgcctccaacaattcccgacgaaaccccgcgacaccaaaccgaacctcccacccccccgacgaccgccaacccgcccgaccccaaaacctcacctacaaaaccgaccccgaaaacgcaaacgaacgacgaaaaacgcaaccgcaaccaaaaatacaacgcgaccccgaacacacacgaacacaacaacaccaaccaatttcgcattaaccgcccccgccgcgaaccgaactctcccgcgtcccgacgaaaaaaaaaaaaacctacaaatacgaaaactaaaaaacgacgactaacgaacgaccactccgaacacgcccgccctcgcgctcgacgacgtctaaaaaactcctcgcaactcccgaccccgctcctccgatccctcaaaccgcgaataaccgcgacttaaccgaccgaaaccccgccccctccgcctaaccttcccaccgactccgcccaccttttctcccactcgccccgccctctcctcccgcgtttccacacgcgccaaccaaccgaccgaaaactaaaatcccgctctaaacccaaacaaaaaacgcccgcgatttaaaaaccacatttcccataaacctaaacacgcgcttccgtcactcgacgaccgcgaaaacgaaacgcgaaaccccacacaaaacatacgcatcccccttaacgtttactaccaccccacgacccaaaaaaaataataccgaaaacccgatactcgaaaactacccgaaaccgcgaaaaaaaatacgctttacctcaaatttaaaaaaaatccgaataactcttatataaaatcacgcaaaactcctctattccgcgtactctcttactcgactactataaaaaataaaatcctactaacgtctccttaacccgtaaaataaaacgaaaaaacccgaatatccgcgcctaaaacgat

SEQ ID NO: 28707 - DNA, 1240 bp, Artificial Sequence
  chemically treated genomic DNA (Homo sapiens) CpG-island No: 28707
gattaataatttgggggggaagaaaataattttagagttagagtttttaaagtagaaagcgttggcggttgaagggtatacgaggtttcgttttcgggcgaacgggcggcgtcggatattattaattaggtttggggacgggcgaaggatttgtagttgcgggcgtcggttttgcgggcgttaaggtaaacggggaagtgagaagcggcggggatacgaaaagagaaaagtttttttaagtttgttcgatgttaacgttttaaggatgaaaagagtcgtttgtttcgtttggggatcgtcgcgtttggtttttttttcgtttttaataattttcggcgaagtttcgcggtattaagtcgggttttttattttttcggcggtcgttaattcgttcggttttaggattttatttgtagggtcggtttcggaggcgtaggcgggcggcggggagcgtagtcgtagttagaggtgtagcgcggtttcgagtatatacgggtatagtagtattagttagtttcgtattggtcgttttcgtcgcgagtcgggttttttcgcgtttcggcggagagggaggggatttgtaagtgcggagattgaggggcggcggttgacgagcgattatttcgagtacgttcgttttcgcgttcggcgacgtttggagggtttttcgtagttttcggtttcgttttttcggttttttagatcgcgggtggtcgcggtttagtcggtcgaagtttcgtttttttcgtttggtttttttatcggtttcgtttatttttttttttattcgtttcgtttttttttttcgcgtttttatacgcgttagttagtcggtcgggagttgaagtttcgttttgggtttaggtagggggcgttcgcggtttagaaattatattttttatgagtttaagtacgcgttttcgttattcggcggtcgcgggggcgaagcgcgaggttttatatagagtatgcgtattttttttgacgtttgttgttattttacggtttaggggaggtagtgtcggagattcggtgttcggaggttgttcggagtcgcgaagggaaatgcgttttgttttagatttgaaggaaattcgagtggtttttgtgtgaaattacgtagagtttttttgtttcgcgtgtttttttgttcgattgttgtgggaggtgggattttgttgacgtttttttggttcgtagagtggggcgaggaagttcgagtgttcgcgtttggagcggt

SEQ ID NO: 28708 - DNA, 1240 bp, Artificial Sequence
  chemically treated genomic DNA (Homo sapiens) CpG-island No: 28708
accgctccaaacgcgaacactcgaacttcctcgccccactctacgaaccaaaaaaacgtcaacaaaatcccacctcccacaacaatcgaacaaaaaaacacgcgaaacaaaaaaactctacgtaatttcacacaaaaaccactcgaatttccttcaaatctaaaacaaaacgcatttcccttcgcgactccgaacaacctccgaacaccgaatctccgacactacctcccctaaaccgtaaaataacaacaaacgtcaaaaaaaatacgcatactctatataaaacctcgcgcttcgcccccgcgaccgccgaataacgaaaacgcgtacttaaactcataaaaaatataatttctaaaccgcgaacgccccctacctaaacccaaaacgaaacttcaactcccgaccgactaactaacgcgtataaaaacgcgaaaaaaaaaaacgaaacgaataaaaaaaaaaataaacgaaaccgataaaaaaaccaaacgaaaaaaacgaaacttcgaccgactaaaccgcgaccacccgcgatctaaaaaaccgaaaaaacgaaaccgaaaactacgaaaaaccctccaaacgtcgccgaacgcgaaaacgaacgtactcgaaataatcgctcgtcaaccgccgcccctcaatctccgcacttacaaatcccctccctctccgccgaaacgcgaaaaaacccgactcgcgacgaaaacgaccaatacgaaactaactaatactactatacccgtatatactcgaaaccgcgctacacctctaactacgactacgctccccgccgcccgcctacgcctccgaaaccgaccctacaaataaaatcctaaaaccgaacgaattaacgaccgccgaaaaaataaaaaacccgacttaataccgcgaaacttcgccgaaaattattaaaaacgaaaaaaaaaccaaacgcgacgatccccaaacgaaacaaacgactcttttcatccttaaaacgttaacatcgaacaaacttaaaaaaacttttctcttttcgtatccccgccgcttctcacttccccgtttaccttaacgcccgcaaaaccgacgcccgcaactacaaatccttcgcccgtccccaaacctaattaataatatccgacgccgcccgttcgcccgaaaacgaaacctcgtatacccttcaaccgccaacgctttctactttaaaaactctaactctaaaattattttcttcccccccaaattattaatc

SEQ ID NO: 28709 - DNA, 939 bp, Artificial Sequence
  chemically treated genomic DNA (Homo sapiens) CpG-island No: 28709
ttcgcgttgttatttagttgggtagtcgggggagcgcgcgtgggggtttcgcgagtcgttcgtttttggtttttggggaagtttgggggacgcggttgtggcggaggcgttttgggatttaggtcgtttggagcgtggtacgtagagttttaggcgcggagttgaggtcgcgcggtcgcgtttggttttagcgggcgtgggattgagtagtttgttgtttttcgatatgtgatttagtttcgtcgtttatgcgggttttcggtcgttcggttttgcggtcgttgtcgttgtcgtcgttgttgttgttgtttttggcggcgttttggggacgggtaggtaggtgggtcgcgtcgttaggtgcgggtcggggatgtttttaggtcggggtttcgttaggtagagttcgaggtcgagttttttttttttgttcgtcggttaggtttcgttttcgggcgggtagaggacgaggtgcgcggaggtcggagtttttagtttcggggttgtagggagttcgggggatattcgtcgtcgtttcgcgtattttggttcggggttaagtttgtaggatttcgcgtttcgtattttcggtttcgagaattgaggtggggtggggggagttcggtggggggtgcgttttgcgcggtgtttatagtttatgatttgcggtcggggacggttattatgcggggtttttcgtcggttagttttaggttttcgttattatcgtcgcggtcgcgcggaggggtttttgtggatgtcgcgtttcggtcgtcgggtttcgtagttttgtaagtcgcgcgtcgcgagattcgcgttttaaaagttaaatttttcgaaagggttagtttcgaaggaatatgatttagaaagacgtagttttttaaagtaagttttttttgttttgggtacgtcgttgttttttttgtagttatgattatg

SEQ ID NO: 28710 - DNA, 939 bp, Artificial Sequence
  chemically treated genomic DNA (Homo sapiens) CpG-island No: 28710
cataatcataactacaaaaaaaacaacgacgtacccaaaacaaaaaaaacttactttaaaaaactacgtctttctaaatcatattccttcgaaactaaccctttcgaaaaatttaacttttaaaacgcgaatctcgcgacgcgcgacttacaaaactacgaaacccgacgaccgaaacgcgacatccacaaaaacccctccgcgcgaccgcgacgataataacgaaaacctaaaactaaccgacgaaaaaccccgcataataaccgtccccgaccgcaaatcataaactataaacaccgcgcaaaacgcaccccccaccgaactccccccaccccacctcaattctcgaaaccgaaaatacgaaacgcgaaatcctacaaacttaaccccgaaccaaaatacgcgaaacgacgacgaatatcccccgaactccctacaaccccgaaactaaaaactccgacctccgcgcacctcgtcctctacccgcccgaaaacgaaacctaaccgacgaacaaaaaaaaaaaactcgacctcgaactctacctaacgaaaccccgacctaaaaacatccccgacccgcacctaacgacgcgacccacctacctacccgtccccaaaacgccgccaaaaacaacaacaacaacgacgacaacgacaacgaccgcaaaaccgaacgaccgaaaacccgcataaacgacgaaactaaatcacatatcgaaaaacaacaaactactcaatcccacgcccgctaaaaccaaacgcgaccgcgcgacctcaactccgcgcctaaaactctacgtaccacgctccaaacgacctaaatcccaaaacgcctccgccacaaccgcgtcccccaaacttccccaaaaaccaaaaacgaacgactcgcgaaacccccacgcgcgctcccccgactacccaactaaataacaacgcgaa

SEQ ID NO: 28711 - DNA, 939 bp, Artificial Sequence
  chemically treated genomic DNA (Homo sapiens) CpG-island No: 28711
tatggttataattgtaaaggaaataacggcgtatttaggatagggggagtttattttaagaagttgcgtttttttggattatgttttttcggggttgattttttcggggagtttggtttttaaagcgcggatttcgcgacgcgcggtttgtaggattgcggggttcggcggtcgagacgcggtatttataggggttttttcgcgcggtcgcggcggtggtggcgggaatttgggattggtcggcgaggggtttcgtatggtaatcgttttcgatcgtaagttataggttgtgggtatcgcgtagagcgtattttttatcgaattttttttattttattttaattttcgagatcgaaagtgcggagcgcggagttttgtaaatttgatttcgagttaaggtgcgcgaggcgacggcgagtgtttttcgggttttttgtagtttcggggttggaagtttcggttttcgcgtatttcgttttttgttcgttcgaaagcgaaatttggtcggcgggtaggaggggagagttcggtttcgagttttgtttggcggggtttcggtttggaggtattttcgattcgtatttggcggcgcgatttatttatttgttcgtttttaaggcgtcgttaggagtaatagtagtagcggcggtagcggtagcggtcgtagggtcgggcggtcgggagttcgtatgggcggcggggttgggttatatgtcggggggtagtagattgtttagttttacgttcgttggggttaagcgcggtcgcgcggttttagtttcgcgtttggggttttgcgtgttacgttttaggcgatttgagttttagggcgttttcgttatagtcgcgttttttaggtttttttagaaattaagggcgagcgattcgcggagtttttacgcgcgttttttcggttatttagttggatggtagcgcgag

SEQ ID NO: 28712 - DNA, 939 bp, Artificial Sequence
  chemically treated genomic DNA (Homo sapiens) CpG-island No: 28712
ctcgcgctaccatccaactaaataaccgaaaaaacgcgcgtaaaaactccgcgaatcgctcgcccttaatttctaaaaaaacctaaaaaacgcgactataacgaaaacgccctaaaactcaaatcgcctaaaacgtaacacgcaaaaccccaaacgcgaaactaaaaccgcgcgaccgcgcttaaccccaacgaacgtaaaactaaacaatctactaccccccgacatataacccaaccccgccgcccatacgaactcccgaccgcccgaccctacgaccgctaccgctaccgccgctactactattactcctaacgacgccttaaaaacgaacaaataaataaatcgcgccgccaaatacgaatcgaaaatacctccaaaccgaaaccccgccaaacaaaactcgaaaccgaactctcccctcctacccgccgaccaaatttcgctttcgaacgaacaaaaaacgaaatacgcgaaaaccgaaacttccaaccccgaaactacaaaaaacccgaaaaacactcgccgtcgcctcgcgcaccttaactcgaaatcaaatttacaaaactccgcgctccgcactttcgatctcgaaaattaaaataaaataaaaaaaattcgataaaaaatacgctctacgcgatacccacaacctataacttacgatcgaaaacgattaccatacgaaacccctcgccgaccaatcccaaattcccgccaccaccgccgcgaccgcgcgaaaaaacccctataaataccgcgtctcgaccgccgaaccccgcaatcctacaaaccgcgcgtcgcgaaatccgcgctttaaaaaccaaactccccgaaaaaatcaaccccgaaaaaacataatccaaaaaaacgcaacttcttaaaataaactccccctatcctaaatacgccgttatttcctttacaattataaccata

SEQ ID NO: 28713 - DNA, 1188 bp, Artificial Sequence
  chemically treated genomic DNA (Homo sapiens) CpG-island No: 28713
tgggcgcggaattgtagttcgtggttttgtttggtttgcggttgttcgtcggttattttaatatcgtttataaggatcgcgttgttagtattaatggcgatatttttaatattttgtttaatcgaattttttatggcggcgttattatcgttagttttagcgcgtcggcggtcgacggttattacgttagttcgtatttttataattcgtcggttttggacgcgggtagtattcgttatattatcgacgcgcgggtgaagaatatttcgcgggtcgagtaggacggtatcgatttcgacgttatttatcgcggcggtttgggcggtagcgtttacgaggtcggtttgagcgggatttatattttgtcgatgacgcgaggcgttatcgtcggcgtttttatggttagtattttggatatagtcggtaattttagcgcgttgcgtttgcgaggtcggttgttttggcggcgtggatcggtggaagtcggtgtttttgttaatttcgtcgatggttatattaattagacggttaattcggtagagtatgttcgtagttggattattatggatttttaggtcgggtatcgttttgatgcggcgttcggttttttgaagtaattgcgtgttagtttcgcggttagtaatttgttcgattaggattcgttttatgcggtgttgcgaatttcgattttcgtcgtcggtttcgacgtcgataaagttagtttcgtcggtcggttgattttcgtgacggtgattaagggatggtgaggttttgggcgttcgttttggtcgttttaatcggcggcgcggtttcggtcgtatcgacgacgatcgatttattggttttgaaagatgttttggcgtcgtttttgttattcgacggacgttacgtcgtttatcggatcgattaggcggatgttatcgttaatcgtagaacggttttttggtggatcgcgttaatcgatcggttagagttttcgcgtcgcgttttcgacggtgggatcgcgatatggtaaagttcgggcggggcggtgatcgaggcgtttatttgggtttttgacggtaaggttttttattttcgtgttttgatcggcggcgtcgtttaggtttggcgtagttttattgaaggcggttaggtcgcgtttattatcgatgacgcggcggacgttcgttttttttaatttttagt

SEQ ID NO: 28714 - DNA, 1188 bp, Artificial Sequence
  chemically treated genomic DNA (Homo sapiens) CpG-island No: 28714
actaaaaattaaaaaaaacgaacgtccgccgcgtcatcgataataaacgcgacctaaccgccttcaataaaactacgccaaacctaaacgacgccgccgatcaaaacacgaaaataaaaaaccttaccgtcaaaaacccaaataaacgcctcgatcaccgccccgcccgaactttaccatatcgcgatcccaccgtcgaaaacgcgacgcgaaaactctaaccgatcgattaacgcgatccaccaaaaaaccgttctacgattaacgataacatccgcctaatcgatccgataaacgacgtaacgtccgtcgaataacaaaaacgacgccaaaacatctttcaaaaccaataaatcgatcgtcgtcgatacgaccgaaaccgcgccgccgattaaaacgaccaaaacgaacgcccaaaacctcaccatcccttaatcaccgtcacgaaaatcaaccgaccgacgaaactaactttatcgacgtcgaaaccgacgacgaaaatcgaaattcgcaacaccgcataaaacgaatcctaatcgaacaaattactaaccgcgaaactaacacgcaattacttcaaaaaaccgaacgccgcatcaaaacgatacccgacctaaaaatccataataatccaactacgaacatactctaccgaattaaccgtctaattaatataaccatcgacgaaattaacaaaaacaccgacttccaccgatccacgccgccaaaacaaccgacctcgcaaacgcaacgcgctaaaattaccgactatatccaaaatactaaccataaaaacgccgacgataacgcctcgcgtcatcgacaaaatataaatcccgctcaaaccgacctcgtaaacgctaccgcccaaaccgccgcgataaataacgtcgaaatcgataccgtcctactcgacccgcgaaatattcttcacccgcgcgtcgataatataacgaatactacccgcgtccaaaaccgacgaattataaaaatacgaactaacgtaataaccgtcgaccgccgacgcgctaaaactaacgataataacgccgccataaaaaattcgattaaacaaaatattaaaaatatcgccattaatactaacaacgcgatccttataaacgatattaaaataaccgacgaacaaccgcaaaccaaacaaaaccacgaactacaattccgcgccca

SEQ ID NO: 28715 - DNA, 1188 bp, Artificial Sequence
  chemically treated genomic DNA (Homo sapiens) CpG-island No: 28715
gttgaaagttggaaggagcggacgttcgtcgcgttatcggtgatgggcgcggtttggtcgtttttaatagggttgcgttagatttggacggcgtcgtcgattagagtacgaaagtaaaaggttttgtcgttaggggtttaggtgggcgtttcgattatcgtttcgttcgagttttgttatatcgcgattttatcgtcggaaacgcggcgcgggggttttgatcgatcggttggcgcgatttattaggaagtcgttttgcggttggcggtgatattcgtttgatcgattcgataggcgacgtagcgttcgtcgggtgatagggacggcgttaggatattttttagggttagtaggtcggtcgtcgtcggtgcggtcgaagtcgcgtcgtcgattagggcgattaagacgagcgtttagagttttattattttttggttatcgttacggagattaatcggtcgacgggattggttttgtcggcgtcgaagtcgacggcggaggtcggggttcgtagtatcgtatagggcgggttttggtcgaatagattgttggtcgcgaggttgatacgtagttgttttaagggatcggacgtcgtattaaagcgatattcgatttgaagatttatggtggtttagttgcgaatatgttttgtcggattgatcgtttggttggtatagttatcgacgaagttgataaaggtatcgatttttatcggtttacgtcgttaggataatcgatttcgtagacgtagcgcgttgggattgtcgattgtgtttagaatgttggttatgggagcgtcggcggtgacgtttcgcgttatcgataggatgtaggtttcgtttaggtcggtttcgtagacgttgtcgtttaggtcgtcgcgataggtggcgtcgaagtcgatgtcgttttgttcgattcgcgagatgttttttattcgcgcgtcgatgatgtagcggatgttgttcgcgtttagggtcgacggattatagaagtacgggttggcgtagtagtcgtcgatcgtcgacgcgttgggattggcggtgatgacgtcgttatagagggttcggttgagtaaggtattgaaaatgtcgttattgatgttggtaacgcgatttttgtaggcggtgttgaagtagtcgacggataatcgtagattaggtagggttacgggttgtaatttcgcgttta

SEQ ID NO: 28716 - DNA, 1188 bp, Artificial Sequence
  chemically treated genomic DNA (Homo sapiens) CpG-island No: 28716
taaacgcgaaattacaacccgtaaccctacctaatctacgattatccgtcgactacttcaacaccgcctacaaaaatcgcgttaccaacatcaataacgacattttcaataccttactcaaccgaaccctctataacgacgtcatcaccgccaatcccaacgcgtcgacgatcgacgactactacgccaacccgtacttctataatccgtcgaccctaaacgcgaacaacatccgctacatcatcgacgcgcgaataaaaaacatctcgcgaatcgaacaaaacgacatcgacttcgacgccacctatcgcgacgacctaaacgacaacgtctacgaaaccgacctaaacgaaacctacatcctatcgataacgcgaaacgtcaccgccgacgctcccataaccaacattctaaacacaatcgacaatcccaacgcgctacgtctacgaaatcgattatcctaacgacgtaaaccgataaaaatcgatacctttatcaacttcgtcgataactataccaaccaaacgatcaatccgacaaaacatattcgcaactaaaccaccataaatcttcaaatcgaatatcgctttaatacgacgtccgatcccttaaaacaactacgtatcaacctcgcgaccaacaatctattcgaccaaaacccgccctatacgatactacgaaccccgacctccgccgtcgacttcgacgccgacaaaaccaatcccgtcgaccgattaatctccgtaacgataaccaaaaaataataaaactctaaacgctcgtcttaatcgccctaatcgacgacgcgacttcgaccgcaccgacgacgaccgacctactaaccctaaaaaatatcctaacgccgtccctatcacccgacgaacgctacgtcgcctatcgaatcgatcaaacgaatatcaccgccaaccgcaaaacgacttcctaataaatcgcgccaaccgatcgatcaaaacccccgcgccgcgtttccgacgataaaatcgcgatataacaaaactcgaacgaaacgataatcgaaacgcccacctaaacccctaacgacaaaaccttttactttcgtactctaatcgacgacgccgtccaaatctaacgcaaccctattaaaaacgaccaaaccgcgcccatcaccgataacgcgacgaacgtccgctccttccaactttcaac

SEQ ID NO: 28717 - DNA, 1053 bp, Artificial Sequence
  chemically treated genomic DNA (Homo sapiens) CpG-island No: 28717
gcgcgttcgtttgcgcgttagggcgttcgtttggtttagtttcgtttgtatcgttttttagaagcgttagtagcgtcgggcgttcgggttcgtttcgcgcgcgtcgcgggcgcggtcgtcgtcgggttcgggtaatagtttttcggttagggcgtttaggattagtagttttttttttacgcggtcggattttagggacgttttaggcgcggttagttcgttttatacggttcgtagcgtcgtttcgttatattggattagtattggtagtagtcgttcggttattagcgtcgtcgcgttttcggtaggttcggttttattttcgttttcgttttcgtttagcgttagggcgacggcggttttcgttacgcgttttagtagcggttcgttttcgcggggtcgtaaatatggttcgacggttgttagtatttttacggtagtttcggcgttaggcgcgcgttattcggcgagtagatcgcgtagcgtttttttagttagcgcggtcgttagttgcggacgttcggttaggcggacgtacgagcgtagggtcgcgttcgtcgtttttagtacgcgtcggcggtggcgaggttgtagattggggttcgggtcgttcgcggggcgttcgcgtaggtttcgtagtagtggtacgaggtattttgtagttatttcgcgcgtcgttttcgggagcgcgtttgcgttttcgttgtcgcgcgttttttcgttttcgagtcgttgtagaaggaagcgtagcgtttttacgcgtttcgcggatgtttttttttggtatagcgttttaagtagggttcgggggtttcggttttgcgagagtagcgttttcgcgagtatttattttatttgtcgagcgttcgcgttatcggttcgggtttttaaaggaaggcgtcggcgtgtgcgatgcgtgcgtataggatcggtcggtttttacgtgcgcgtgcgtcgacggagtcgggcgcgcggtcgtagagagggggattttagttcggtttggtgtagtttagttttttttgggtttttgttattaattttgtttagata

SEQ ID NO: 28718 - DNA, 1053 bp, Artificial Sequence
  chemically treated genomic DNA (Homo sapiens) CpG-island No: 28718
tatctaaacaaaattaataacaaaaacccaaaaaaaactaaactacaccaaaccgaactaaaatccccctctctacgaccgcgcgcccgactccgtcgacgcacgcgcacgtaaaaaccgaccgatcctatacgcacgcatcgcacacgccgacgccttcctttaaaaacccgaaccgataacgcgaacgctcgacaaataaaataaatactcgcgaaaacgctactctcgcaaaaccgaaacccccgaaccctacttaaaacgctataccaaaaaaaaacatccgcgaaacgcgtaaaaacgctacgcttccttctacaacgactcgaaaacgaaaaaacgcgcgacaacgaaaacgcaaacgcgctcccgaaaacgacgcgcgaaataactacaaaatacctcgtaccactactacgaaacctacgcgaacgccccgcgaacgacccgaaccccaatctacaacctcgccaccgccgacgcgtactaaaaacgacgaacgcgaccctacgctcgtacgtccgcctaaccgaacgtccgcaactaacgaccgcgctaactaaaaaaacgctacgcgatctactcgccgaataacgcgcgcctaacgccgaaactaccgtaaaaatactaacaaccgtcgaaccatatttacgaccccgcgaaaacgaaccgctactaaaacgcgtaacgaaaaccgccgtcgccctaacgctaaacgaaaacgaaaacgaaaataaaaccgaacctaccgaaaacgcgacgacgctaataaccgaacgactactaccaatactaatccaatataacgaaacgacgctacgaaccgtataaaacgaactaaccgcgcctaaaacgtccctaaaatccgaccgcgtaaaaaaaaaactactaatcctaaacgccctaaccgaaaaactattacccgaacccgacgacgaccgcgcccgcgacgcgcgcgaaacgaacccgaacgcccgacgctactaacgcttctaaaaaacgatacaaacgaaactaaaccaaacgaacgccctaacgcgcaaacgaacgcgc

SEQ ID NO: 28719 - DNA, 1053 bp, Artificial Sequence
  chemically treated genomic DNA (Homo sapiens) CpG-island No: 28719
tatttaggtagggttggtggtaggaatttaagggaagttgagttgtattaagtcgggttgggatttttttttttgcggtcgcgcgttcggtttcgtcggcgtacgcgtacgtaggggtcggtcggttttgtgcgtacgtatcgtatacgtcggcgtttttttttgggagttcgggtcggtggcgcgggcgttcggtaaatggagtgggtgttcgcggaagcgttgttttcgtagagtcgggattttcgggttttgtttggggcgttgtgttaaggggaggtattcgcggagcgcgtggagacgttgcgtttttttttgtagcggttcgaggacgaggaggcgcgcggtagcgggggcgtaggcgcgttttcggaggcggcgcgcgaggtggttgtagggtatttcgtgttattgttgcggagtttgcgcggacgtttcgcgggcggttcggattttagtttgtagtttcgttatcgtcggcgcgtgttgagggcggcgggcgcggttttgcgttcgtgcgttcgtttggtcgggcgttcgtagttggcggtcgcgttggttgaggaggcgttgcgcgatttgttcgtcgggtggcgcgcgtttggcgtcgaggttgtcgtggaagtgttagtagtcgtcgggttatgtttgcggtttcgcgaggacgggtcgttattggagcgcgtggcggggatcgtcgtcgttttggcgttgggcgggggcggggacggggatgaggtcgggtttgtcgaggacgcggcggcgttggtggtcgggcgattgttgttagtgttggtttaatgtggcggggcggcgttgcgggtcgtgtggggcgggttggtcgcgtttggggcgtttttggggttcggtcgcgtagaggagaagttgttggttttgagcgttttggtcgagaagttgttgttcgagttcggcggcgatcgcgttcgcggcgcgcgcgaggcgggttcggacgttcggcgttgttggcgtttttggaggacggtgtaggcggggttgggttaggcggacgttttgacgcgtaagcgagcgcgt

SEQ ID NO: 28720 - DNA, 1053 bp, Artificial Sequence
  chemically treated genomic DNA (Homo sapiens) CpG-island No: 28720
acgcgctcgcttacgcgtcaaaacgtccgcctaacccaaccccgcctacaccgtcctccaaaaacgccaacaacgccgaacgtccgaacccgcctcgcgcgcgccgcgaacgcgatcgccgccgaactcgaacaacaacttctcgaccaaaacgctcaaaaccaacaacttctcctctacgcgaccgaaccccaaaaacgccccaaacgcgaccaacccgccccacacgacccgcaacgccgccccgccacattaaaccaacactaacaacaatcgcccgaccaccaacgccgccgcgtcctcgacaaacccgacctcatccccgtccccgcccccgcccaacgccaaaacgacgacgatccccgccacgcgctccaataacgacccgtcctcgcgaaaccgcaaacataacccgacgactactaacacttccacgacaacctcgacgccaaacgcgcgccacccgacgaacaaatcgcgcaacgcctcctcaaccaacgcgaccgccaactacgaacgcccgaccaaacgaacgcacgaacgcaaaaccgcgcccgccgccctcaacacgcgccgacgataacgaaactacaaactaaaatccgaaccgcccgcgaaacgtccgcgcaaactccgcaacaataacacgaaataccctacaaccacctcgcgcgccgcctccgaaaacgcgcctacgcccccgctaccgcgcgcctcctcgtcctcgaaccgctacaaaaaaaaacgcaacgtctccacgcgctccgcgaatacctccccttaacacaacgccccaaacaaaacccgaaaatcccgactctacgaaaacaacgcttccgcgaacacccactccatttaccgaacgcccgcgccaccgacccgaactcccaaaaaaaaacgccgacgtatacgatacgtacgcacaaaaccgaccgacccctacgtacgcgtacgccgacgaaaccgaacgcgcgaccgcaaaaaaaaaaatcccaacccgacttaatacaactcaacttcccttaaattcctaccaccaaccctacctaaata

SEQ ID NO: 28721 - DNA, 744 bp, Artificial Sequence
  chemically treated genomic DNA (Homo sapiens) CpG-island No: 28721
gtttcgcgggttaggagcgtagcggtttcggacgtttggtcgttgatcgttaggcgtcgcgagttttcggggcgtgggtaagcggagtggtagttagtttgggaaatttgggtttagattttggtcgcgtttagtttcgttggtttttcgcgtcgtttgcgttcgttaggttttgttcgatagtatcgcgttgggttttgtttgagcgttagtttttcggtttttagtcgagaggtcgtttttatagttatttttattgatttttttttcgcggagtttttgacgttcgcgcggtatcgaagttttttttttcgtttttcgatgaaatttttttttacgcgttttcgttttgtttaagtggggcgggggttttgtgttcgggtcggatcggggcgggttttggcggcggttttgggagacgtagatttgagttcgcggagttcgggtgcgtagagtttcgttcgtagtagttaggtgagggcgttggaggttaggattcggtggagcggtcgcggcggatcgcggagagtaagttttcgggtttttaggagtcgggtcgttcgtgtttcgttcgcgtttcggggcgttttgcgaggtaaagaggtagtggaggataggagaaaaggtttgcgtttgttatagaatcgtcgcgagtcggggttttaggttaaggtttaggatttttttttaatttagtagtaaaagagtgtttcgagaaagagattttggtattggtttattagt

SEQ ID NO: 28722 - DNA, 744 bp, Artificial Sequence
  chemically treated genomic DNA (Homo sapiens) CpG-island No: 28722
actaataaaccaataccaaaatctctttctcgaaacactcttttactactaaattaaaaaaaaatcctaaaccttaacctaaaaccccgactcgcgacgattctataacaaacgcaaaccttttctcctatcctccactacctctttacctcgcaaaacgccccgaaacgcgaacgaaacacgaacgacccgactcctaaaaacccgaaaacttactctccgcgatccgccgcgaccgctccaccgaatcctaacctccaacgccctcacctaactactacgaacgaaactctacgcacccgaactccgcgaactcaaatctacgtctcccaaaaccgccgccaaaacccgccccgatccgacccgaacacaaaacccccgccccacttaaacaaaacgaaaacgcgtaaaaaaaaatttcatcgaaaaacgaaaaaaaaaacttcgataccgcgcgaacgtcaaaaactccgcgaaaaaaaaatcaataaaaataactataaaaacgacctctcgactaaaaaccgaaaaactaacgctcaaacaaaacccaacgcgatactatcgaacaaaacctaacgaacgcaaacgacgcgaaaaaccaacgaaactaaacgcgaccaaaatctaaacccaaatttcccaaactaactaccactccgcttacccacgccccgaaaactcgcgacgcctaacgatcaacgaccaaacgtccgaaaccgctacgctcctaacccgcgaaac

SEQ ID NO: 28723 - DNA, 744 bp, Artificial Sequence
  chemically treated genomic DNA (Homo sapiens) CpG-island No: 28723
attgataggttaatattaaaatttttttttcggggtatttttttgttgttgagttaaaaagagattttgagttttagtttgggatttcgattcgcggcgattttgtggtaggcgtagatttttttttttgttttttattgtttttttgtttcgtagggcgtttcggggcgcgagcggggtacgggcgattcggtttttggaggttcggggatttgtttttcgcggttcgtcgcggtcgttttatcgagttttggtttttagcgtttttatttggttgttgcgggcgggattttgcgtattcgggtttcgcgggtttaggtttgcgttttttagagtcgtcgttagagttcgtttcggttcggttcgggtatagggttttcgttttatttgggtaaggcgggggcgcgtggagggaagttttatcggggggcgagggagggagtttcggtgtcgcgcgggcgttaggggtttcgcgggggaggagttagtaaaagtggttataaaagcggtttttcggttgagggtcggggagttagcgtttaagtagagtttagcgcggtgttatcggatagagtttggcgagcgtaagcggcgcggggagttagcggggttgagcgcggttagggtttgaatttagattttttagattagttattatttcgtttgtttacgtttcgggagttcgcggcgtttggcggttagcgattagacgttcggggtcgttgcgtttttggttcgcgaggt

SEQ ID NO: 28724 - DNA, 744 bp, Artificial Sequence
  chemically treated genomic DNA (Homo sapiens) CpG-island No: 28724
acctcgcgaaccaaaaacgcaacgaccccgaacgtctaatcgctaaccgccaaacgccgcgaactcccgaaacgtaaacaaacgaaataataactaatctaaaaaatctaaattcaaaccctaaccgcgctcaaccccgctaactccccgcgccgcttacgctcgccaaactctatccgataacaccgcgctaaactctacttaaacgctaactccccgaccctcaaccgaaaaaccgcttttataaccacttttactaactcctcccccgcgaaacccctaacgcccgcgcgacaccgaaactccctccctcgccccccgataaaacttccctccacgcgcccccgccttacccaaataaaacgaaaaccctatacccgaaccgaaccgaaacgaactctaacgacgactctaaaaaacgcaaacctaaacccgcgaaacccgaatacgcaaaatcccgcccgcaacaaccaaataaaaacgctaaaaaccaaaactcgataaaacgaccgcgacgaaccgcgaaaaacaaatccccgaacctccaaaaaccgaatcgcccgtaccccgctcgcgccccgaaacgccctacgaaacaaaaaaacaataaaaaacaaaaaaaaaaatctacgcctaccacaaaatcgccgcgaatcgaaatcccaaactaaaactcaaaatctctttttaactcaacaacaaaaaaataccccgaaaaaaaaattttaatattaacctatcaat

SEQ ID NO: 28725 - DNA, 733 bp, Artificial Sequence
  chemically treated genomic DNA (Homo sapiens) CpG-island No: 28725
tttttgggttattagcgacgttttttaagcgggtcgagcggaggcgcgttcgcgatttaggggtagcgtgtcgagttcgggcgtgggggggcgtggtttttttattcggcgattttcggttatcgtttatttcgcgcgtgggggcgtgcgcgattgcggggcgcggagaggggtgatttcggattattttaggcgttcgtagtacgttttgtatatagacgcgaggcgttgttttgaggtgatatcggttgtacggtataagtagtaggcgtcgtcgattaattagttcgtatcgaggattttttttggtgcgtggtttagttttttttaggacgggttttaatttttttttgatatcgttttttttatcgttacgtttcgaggtttttttcggggaagtttcgcgtttttttttcgcggtttcgggtcgtacgcgcgcgatttttcgattttataggcggttcgcgtcgcgggtgggggcggggcgcgcggggagggggttggcggtcgttaggggaggggggtcggggttcggggggcggaggagggtcggcgtggggagtttttcgttcgcggattatacgtttcgcgggttaatttcgagttagtttttagtagtgtcgtacgcgggatacgtttaagcgtttgttggtacggttagtgagggggagggggcgaggaggagggaggggagttgagtgataggttttgcggggtaggttgggaattgtag

SEQ ID NO: 28726 - DNA, 733 bp, Artificial Sequence
  chemically treated genomic DNA (Homo sapiens) CpG-island No: 28726
ctacaattcccaacctaccccgcaaaacctatcactcaactcccctccctcctcctcgccccctccccctcactaaccgtaccaacaaacgcttaaacgtatcccgcgtacgacactactaaaaactaactcgaaattaacccgcgaaacgtataatccgcgaacgaaaaactccccacgccgaccctcctccgccccccgaaccccgacccccctcccctaacgaccgccaaccccctccccgcgcgccccgcccccacccgcgacgcgaaccgcctataaaatcgaaaaatcgcgcgcgtacgacccgaaaccgcgaaaaaaaaacgcgaaacttccccgaaaaaaacctcgaaacgtaacgataaaaaaaacgatatcaaaaaaaaattaaaacccgtcctaaaaaaaactaaaccacgcaccaaaaaaaatcctcgatacgaactaattaatcgacgacgcctactacttataccgtacaaccgatatcacctcaaaacaacgcctcgcgtctatatacaaaacgtactacgaacgcctaaaataatccgaaatcacccctctccgcgccccgcaatcgcgcacgcccccacgcgcgaaataaacgataaccgaaaatcgccgaataaaaaaaccacgcccccccacgcccgaactcgacacgctacccctaaatcgcgaacgcgcctccgctcgacccgcttaaaaaacgtcgctaataacccaaaaa

SEQ ID NO: 28727 - DNA, 733 bp, Artificial Sequence
  chemically treated genomic DNA (Homo sapiens) CpG-island No: 28727
ttataatttttagtttgtttcgtaaagtttgttatttaatttttttttttttttttcgtttttttttttttattggtcgtgttaataaacgtttggacgtgtttcgcgtgcgatattgttagaggttggttcgggattggttcgcggagcgtgtggttcgcgagcgaggaattttttacgtcggttttttttcgtttttcgggtttcggttttttttttttggcggtcgttagtttttttttcgcgcgtttcgtttttattcgcggcgcgaatcgtttgtggaatcgaggaatcgcgcgcgtgcggttcggagtcgcgggggagggacgcgaggttttttcggggaaggtttcggagcgtggcggtgaggggggcggtgttagggaggggttggagttcgttttaaggaaaattgggttacgtattaagaggaattttcggtgcgaattagttgatcggcggcgtttgttgtttgtgtcgtgtagtcggtgttattttaggatagcgtttcgcgtttgtgtatagagcgtgttgcgggcgtttagggtagttcgaggttattttttttcgcgtttcgtagtcgcgtacgtttttacgcgcggggtgggcggtggtcgggggtcgtcgagtggaaaggttacgtttttttacgttcgggttcggtacgttgtttttgggtcgcgaacgcgttttcgttcgattcgtttggaggacgtcgttggtggtttaggag

SEQ ID NO: 28728 - DNA, 733 bp, Artificial Sequence
  chemically treated genomic DNA (Homo sapiens) CpG-island No: 28728
ctcctaaaccaccaacgacgtcctccaaacgaatcgaacgaaaacgcgttcgcgacccaaaaacaacgtaccgaacccgaacgtaaaaaaacgtaacctttccactcgacgacccccgaccaccgcccaccccgcgcgtaaaaacgtacgcgactacgaaacgcgaaaaaaaataacctcgaactaccctaaacgcccgcaacacgctctatacacaaacgcgaaacgctatcctaaaataacaccgactacacgacacaaacaacaaacgccgccgatcaactaattcgcaccgaaaattcctcttaatacgtaacccaattttccttaaaacgaactccaacccctccctaacaccgcccccctcaccgccacgctccgaaaccttccccgaaaaaacctcgcgtccctcccccgcgactccgaaccgcacgcgcgcgattcctcgattccacaaacgattcgcgccgcgaataaaaacgaaacgcgcgaaaaaaaaactaacgaccgccaaaaaaaaaaaaccgaaacccgaaaaacgaaaaaaaaccgacgtaaaaaattcctcgctcgcgaaccacacgctccgcgaaccaatcccgaaccaacctctaacaatatcgcacgcgaaacacgtccaaacgtttattaacacgaccaataaaaaaaaaaaaacgaaaaaaaaaaaaaaaaattaaataacaaactttacgaaacaaactaaaaattataa

SEQ ID NO: 28729 - DNA, 522 bp, Artificial Sequence
  chemically treated genomic DNA (Homo sapiens) CpG-island No: 28729
  misc_feature (493)..(493): n is either a, c, g or t
  misc_feature (499)..(499): n is either a, c, g or t
  misc_feature (521)..(521): n is either a, c, g or t
ggtacgttcgtttcggatgtagttataaagtaaatggggtagaatttggacgagaatcgtatttcgttttttatttcggatttcgttgaggtggagagtagcgtggggtgggtttttttttttattgcgggcgtttagcggatcgtgttttcgagttcgggcgttcggttgtaagttcgtggttggcggcggttgcgggaggtacggtacgagttaatgtatcgggagtagagtcggtgttttcgacgttttcgagtcggttgcgaaagggacggttcgcgggggtcgcggtaggttgggtcggggttgggcgggcgggcgcgcgcgcgcggtttatagggggtatatttcgggttttaggcgggcgcgcgaggcgggtatcggtttattcgggtcggtttgtaggcgggtaggagggcgggtggggcgcgggggtggcgcggtttgcggggcgcggggaggggagagcgcgcggggagggggtgggagcggnggcggnggcgtgggcgtgtcggggaggng

SEQ ID NO: 28730 - DNA, 522 bp, Artificial Sequence
  chemically treated genomic DNA (Homo sapiens) CpG-island No: 28730
  misc_feature (2)..(2): n is either a, c, g or t
  misc_feature (24)..(24): n is either a, c, g or t
  misc_feature (30)..(30): n is either a, c, g or t
cncctccccgacacgcccacgccnccgccnccgctcccaccccctccccgcgcgctctcccctccccgcgccccgcaaaccgcgccacccccgcgccccacccgccctcctacccgcctacaaaccgacccgaataaaccgatacccgcctcgcgcgcccgcctaaaacccgaaatataccccctataaaccgcgcgcgcgcgcccgcccgcccaaccccgacccaacctaccgcgacccccgcgaaccgtccctttcgcaaccgactcgaaaacgtcgaaaacaccgactctactcccgatacattaactcgtaccgtacctcccgcaaccgccgccaaccacgaacttacaaccgaacgcccgaactcgaaaacacgatccgctaaacgcccgcaataaaaaaaaaaacccaccccacgctactctccacctcaacgaaatccgaaataaaaaacgaaatacgattctcgtccaaattctaccccatttactttataactacatccgaaacgaacgtacc

SEQ ID NO: 28731 - DNA, 522 bp, Artificial Sequence
  chemically treated genomic DNA (Homo sapiens) CpG-island No: 28731
  misc_feature (2)..(2): n is either a, c, g or t
  misc_feature (24)..(24): n is either a, c, g or t
  misc_feature (30)..(30): n is either a, c, g or t
tnttttttcggtacgtttacgttntcgttntcgtttttatttttttttcgcgcgttttttttttttcgcgtttcgtaggtcgcgttattttcgcgttttattcgtttttttgttcgtttgtaagtcggttcgggtagatcggtgttcgtttcgcgcgttcgtttagagttcggagtatgttttttataggtcgcgcgcgcgcgttcgttcgtttagtttcggtttagtttgtcgcgattttcgcgggtcgtttttttcgtagtcggttcgaggacgtcgggaatatcggttttgttttcggtgtattaattcgtgtcgtgtttttcgtagtcgtcgttagttacgggtttgtagtcggacgttcggattcggagatacgattcgttgaacgttcgtaataagaaagaaaatttattttacgttgttttttattttaacgaggttcggaatgggaggcggggtgcggttttcgtttaagttttattttatttgttttgtggttgtattcgaaacggacgtgtt

SEQ ID NO: 28732 - DNA, 522 bp, Artificial Sequence
  chemically treated genomic DNA (Homo sapiens) CpG-island No: 28732
  misc_feature (493)..(493): n is either a, c, g or t
  misc_feature (499)..(499): n is either a, c, g or t
  misc_feature (521)..(521): n is either a, c, g or t
aacacgtccgtttcgaatacaaccacaaaacaaataaaataaaacttaaacgaaaaccgcaccccgcctcccattccgaacctcgttaaaataaaaaacaacgtaaaataaattttctttcttattacgaacgttcaacgaatcgtatctccgaatccgaacgtccgactacaaacccgtaactaacgacgactacgaaaaacacgacacgaattaatacaccgaaaacaaaaccgatattcccgacgtcctcgaaccgactacgaaaaaaacgacccgcgaaaatcgcgacaaactaaaccgaaactaaacgaacgaacgcgcgcgcgcgacctataaaaaacatactccgaactctaaacgaacgcgcgaaacgaacaccgatctacccgaaccgacttacaaacgaacaaaaaaacgaataaaacgcgaaaataacgcgacctacgaaacgcgaaaaaaaaaaaacgcgcgaaaaaaaaataaaaacganaacganaacgtaaacgtaccgaaaaaana

SEQ ID NO: 28733 - DNA, 625 bp, Artificial Sequence
  chemically treated genomic DNA (Homo sapiens) CpG-island No: 28733
gttggcgattgcggacgcgaaggatatgttttgttaagggttggtttgcgtatttataggttttcgtaagaattgattggttttaatttttggagtggtgaattcgttagcgaggtgtcgtcggtttttatttaagtcgaggtggttcggttttatgtatcgcgacgtaacgcggggaggtagataaggtatagggcggtgtttataatttatgttaattcgttttatgtgttcgtcgagcggtataaatcgtcgcgacgattatgcggtttaatgatcgaagttaggttggttagagacgcgtagcgatttttgaagttgtttttgatggtcgttatttatttgtttggatagtattgttttgtaacgcgggttatttcgatgttttcggaagcgagaagaattatattgtggaagttatttagtttttcgtcgcgaacgtttttaagatttaattttatcgcgtttgtcggtatgttcgcggatatgggttttttttttttcgaaatttttgttggtcggattatcgaataaagttttgattaaggtttgttaatatttaaatttcgtttgttataggtcggtttttgttgcgtttttaataaatacggttttttcgaaaatg

SEQ ID NO: 28734 - DNA, 625 bp, Artificial Sequence
  chemically treated genomic DNA (Homo sapiens) CpG-island No: 28734
cattttcgaaaaaaccgtatttattaaaaacgcaacaaaaaccgacctataacaaacgaaatttaaatattaacaaaccttaatcaaaactttattcgataatccgaccaacaaaaatttcgaaaaaaaaaaaacccatatccgcgaacataccgacaaacgcgataaaattaaatcttaaaaacgttcgcgacgaaaaactaaataacttccacaatataattcttctcgcttccgaaaacatcgaaataacccgcgttacaaaacaatactatccaaacaaataaataacgaccatcaaaaacaacttcaaaaatcgctacgcgtctctaaccaacctaacttcgatcattaaaccgcataatcgtcgcgacgatttataccgctcgacgaacacataaaacgaattaacataaattataaacaccgccctataccttatctacctccccgcgttacgtcgcgatacataaaaccgaaccacctcgacttaaataaaaaccgacgacacctcgctaacgaattcaccactccaaaaattaaaaccaatcaattcttacgaaaacctataaatacgcaaaccaacccttaacaaaacatatccttcgcgtccgcaatcgccaac

SEQ ID NO: 28735 - DNA, 625 bp, Artificial Sequence
  chemically treated genomic DNA (Homo sapiens) CpG-island No: 28735
tattttcggagaggtcgtatttgttggaggcgtaataaagatcggtttgtagtaagcggaatttgaatattggtaggttttggttagagttttgttcggtggttcgattaataaaggtttcggggaagaagaagtttatattcgcgggtatgtcggtaaacgcgatgggattaggttttgggggcgttcgcgacgagaggttggatggtttttataatatgatttttttcgttttcggaggtatcgggatggttcgcgttgtaaggtaatgttgtttaggtaggtagatgacgattattagggatagttttaaggatcgttgcgcgtttttaattagtttaatttcgattattgggtcgtatgatcgtcgcggcgatttatgtcgttcggcgagtatatggaacgggttggtatggattgtaggtatcgttttatattttgtttgttttttcgcgttgcgtcgcggtgtatggagtcgggttatttcgatttgaatggaagtcggcggtatttcgttaacggatttattattttaagaattggagttaattaatttttgcggagatttgtgaatgcgtaaattaatttttggtagaatatatttttcgcgttcgtaatcgttagt

SEQ ID NO: 28736 - DNA, 625 bp, Artificial Sequence
  chemically treated genomic DNA (Homo sapiens) CpG-island No: 28736
actaacgattacgaacgcgaaaaatatattctaccaaaaattaatttacgcattcacaaatctccgcaaaaattaattaactccaattcttaaaataataaatccgttaacgaaataccgccgacttccattcaaatcgaaataacccgactccatacaccgcgacgcaacgcgaaaaaacaaacaaaatataaaacgatacctacaatccataccaacccgttccatatactcgccgaacgacataaatcgccgcgacgatcatacgacccaataatcgaaattaaactaattaaaaacgcgcaacgatccttaaaactatccctaataatcgtcatctacctacctaaacaacattaccttacaacgcgaaccatcccgatacctccgaaaacgaaaaaaatcatattataaaaaccatccaacctctcgtcgcgaacgcccccaaaacctaatcccatcgcgtttaccgacatacccgcgaatataaacttcttcttccccgaaacctttattaatcgaaccaccgaacaaaactctaaccaaaacctaccaatattcaaattccgcttactacaaaccgatctttattacgcctccaacaaatacgacctctccgaaaata

SEQ ID NO: 28737 - DNA, 706 bp, Artificial Sequence
  chemically treated genomic DNA (Homo sapiens) CpG-island No: 28737
tgattgggaaaattttggcgttatttaatttaatcgttttgtaatatatgatttttttttttcgttcgtttttttatttaataggttttttttttttttttttttttttatttttttttttttttacgttcgtacgattttttgtgcgtttttttttttttttttcgtttttttttttttttttatttatttatttttttcgtgtttttatttattttgttttaatatttattttttttttttttatttttttttttacgtttttttttttttatttttttttttttttttttttttttattcgttttaattatttttcgtcgtttgttttttttttcgtttttgttttattttttttttttcgatcgttattttttttatcgttatataagtttttttttttcgttcgcgtttacgtttatattttatattcgtacgttcgttatttcgttttttttttcgtatatttatttatatttttacgttatttaattttttttttttttaatattttttttttttattataatttaaatttttattttttatttttattatttttttttttatttcgtatttatattttatgttttatcgttttattatttttttttttttttttgtgttttcgttcgtattcgttttttatttattttcgttttttattttgttatttagttttttttttattttttttcgttattcg

SEQ ID NO: 28738 - DNA, 706 bp, Artificial Sequence
  chemically treated genomic DNA (Homo sapiens) CpG-island No: 28738
cgaataacgaaaaaaaataaaaaaaaaactaaataacaaaataaaaaacgaaaataaataaaaaacgaatacgaacgaaaacacaaaaaaaaaaaaaaaaataataaaacgataaaacataaaatataaatacgaaataaaaaaaaaaataataaaaataaaaaataaaaatttaaattataataaaaaaaaaaaatattaaaaaaaaaaaaaattaaataacgtaaaaatataaataaatatacgaaaaaaaaaacgaaataacgaacgtacgaatataaaatataaacgtaaacgcgaacgaaaaaaaaaaacttatataacgataaaaaaaataacgatcgaaaaaaaaaaaataaaacaaaaacgaaaaaaaaaacaaacgacgaaaaataattaaaacgaataaaaaaaaaaaaaaaaaaaaaaaaataaaaaaaaaaaaacgtaaaaaaaaaaataaaaaaaaaaaaaataaatattaaaacaaaataaataaaaacacgaaaaaaataaataaataaaaaaaaaaaaaaaaacgaaaaaaaaaaaaaaaaacgcacaaaaaatcgtacgaacgtaaaaaaaaaaaaaaataaaaaaaaaaaaaaaaaaaaaaaacctattaaataaaaaaacgaacgaaaaaaaaaaatcatatattacaaaacgattaaattaaataacgccaaaattttcccaatca

SEQ ID NO: 28739 - DNA, 706 bp, Artificial Sequence
  chemically treated genomic DNA (Homo sapiens) CpG-island No: 28739
cgagtggcggaggggggtgagagagaaattgaatgataaaataaagggcgaagatagataaagagcgggtgcggacgaggatataggagaaagggggagggtgatggggcggtgaagtatagggtataggtacggggtagaggaaagggtggtagggatagggagtgaagatttgagttgtagtaggggagggaggtgttgaaggggaggggggttgggtggcgtaggggtgtgagtggatgtgcgagagaaggagcggagtgacgggcgtacgggtatgggatgtgggcgtgggcgcgggcggagaggagagatttatgtagcgatagggaaaataacggtcgagggaaaggaggtgggataaaggcggggggggagatagacgacgggaggtgattggggcgggtaggagggaggagggggggggaggagtaggggggaagaggcgtaggggggggggtgggaggaggaaaggtaggtgttgggataagatgaataaaaatacgagaggggtgggtggatgggggggagggaaggggcggggggagagaaaaggggcgtatagaaggtcgtgcgggcgtggaggggggggggggtggggaggaggggggagggagagggtttgttgggtggaggggcggacggaagaggggggttatgtattgtaaggcgattaagttgggtgacgttagggtttttttagtta

SEQ ID NO: 28740 - DNA, 706 bp, Artificial Sequence
  chemically treated genomic DNA (Homo sapiens) CpG-island No: 28740
taactaaaaaaaccctaacgtcacccaacttaatcgccttacaatacataacccccctcttccgtccgcccctccacccaacaaaccctctccctcccccctcctccccacccccccccccctccacgcccgcacgaccttctatacgccccttttctctccccccgccccttccctcccccccatccacccacccctctcgtatttttattcatcttatcccaacacctacctttcctcctcccacccccccccctacgcctcttcccccctactcctccccccccctcctccctcctacccgccccaatcacctcccgtcgtctatctccccccccgcctttatcccacctcctttccctcgaccgttattttccctatcgctacataaatctctcctctccgcccgcgcccacgcccacatcccatacccgtacgcccgtcactccgctccttctctcgcacatccactcacacccctacgccacccaacccccctccccttcaacacctccctcccctactacaactcaaatcttcactccctatccctaccaccctttcctctaccccgtacctataccctatacttcaccgccccatcaccctccccctttctcctatatcctcgtccgcacccgctctttatctatcttcgccctttattttatcattcaatttctctctcacccccctccgccactcg

SEQ ID NO: 28741 - DNA, 996 bp, Artificial Sequence
  chemically treated genomic DNA (Homo sapiens) CpG-island No: 28741
gtggcggtgggaaggaggaggggttgggggagggcggcggaggtgttgggttcggtcggtttacgagggagttgtagaagagttggtttagattttaattagagttgtcgtcggttttttgtagtcgtcgtagcgttttcgcgaaggaggacgtgtcgattcggttgcgcgtttaaggtagaggttcgcgtcggcgttggttgggcgtgagttgggaggtcgagttgtgagcgcgaagggagttggagagacgattgcggtattttcggtcgtttcggagtatatacgattatcggggttgcgggattaagggtcgcgtcgttcggaggtcgtttttgagcgggtttcgtagtttcgtcgtttagcgttttttggttttttttcgtagttaggttgttaatttattcgggagttcggggtatgaacggttacggttttttttatttgtatatgggcggttcggtgtcgtagtcgttacgggcgtttttgtagcgtacgtttaagtgcgcgcgttgtcgtaattatggcgttttgttttggtttaagggttataagcgttattgtcgttttaaggattgtatttgcgagaagtgtatttttattatcgagcggtagcgggttatggttgcgtaggtggcgttgcgtcggtagtaggttaacgagagtttggagagttttattttcgattcgttgcgcgttttgttagggttttcgtcgtcgggggacgtcgtcgtcgtttcgtagtcgtcgttagttttttagtcgtcgtagtcgtagtcgtcgcgttttgttgtcgagttggtcgcggtcgtcgcgttgcgttggattgtcgagtcgtagttcggggttttgtaggcgtagttcgttaagttaggtaagagcgtttgaggtgcgggagtttggtcgggcgcgggggtaatttcggagtgttagttgtagttttatttgggaggattggaggtaaagttttgggacgtgggtttgtcggggtttttt

SEQ ID NO: 28742 - DNA, 996 bp, Artificial Sequence
  chemically treated genomic DNA (Homo sapiens) CpG-island No: 28742
aaaaaaccccgacaaacccacgtcccaaaactttacctccaatcctcccaaataaaactacaactaacactccgaaattacccccgcgcccgaccaaactcccgcacctcaaacgctcttacctaacttaacgaactacgcctacaaaaccccgaactacgactcgacaatccaacgcaacgcgacgaccgcgaccaactcgacaacaaaacgcgacgactacgactacgacgactaaaaaactaacgacgactacgaaacgacgacgacgtcccccgacgacgaaaaccctaacaaaacgcgcaacgaatcgaaaataaaactctccaaactctcgttaacctactaccgacgcaacgccacctacgcaaccataacccgctaccgctcgataataaaaatacacttctcgcaaatacaatccttaaaacgacaataacgcttataacccttaaaccaaaacaaaacgccataattacgacaacgcgcgcacttaaacgtacgctacaaaaacgcccgtaacgactacgacaccgaaccgcccatatacaaataaaaaaaaccgtaaccgttcataccccgaactcccgaataaattaacaacctaactacgaaaaaaaaccaaaaaacgctaaacgacgaaactacgaaacccgctcaaaaacgacctccgaacgacgcgacccttaatcccgcaaccccgataatcgtatatactccgaaacgaccgaaaataccgcaatcgtctctccaactcccttcgcgctcacaactcgacctcccaactcacgcccaaccaacgccgacgcgaacctctaccttaaacgcgcaaccgaatcgacacgtcctccttcgcgaaaacgctacgacgactacaaaaaaccgacgacaactctaattaaaatctaaaccaactcttctacaactccctcgtaaaccgaccgaacccaacacctccgccgccctcccccaacccctcctccttcccaccgccac

SEQ ID NO: 28743 - DNA, 996 bp, Artificial Sequence
  chemically treated genomic DNA (Homo sapiens) CpG-island No: 28743
ggaaagtttcgataggtttacgttttaaaattttgtttttagtttttttaagtggagttgtagttggtatttcgaagttgttttcgcgttcggttaaattttcgtattttagacgtttttatttggtttggcgagttgcgtttgtagagtttcgggttgcggttcggtagtttaacgtagcgcggcggtcgcggttaattcggtagtagggcgcggcggttgcggttgcgacggttgagaggttggcggcggttgcggggcggcgacggcgtttttcggcggcgggggttttggtagagcgcgtagcgagtcggggatgaggttttttaagttttcgttggtttgttgtcggcgtagcgttatttgcgtagttatgattcgttgtcgttcgatgatgaggatgtatttttcgtaggtgtagtttttgaagcggtagtaacgtttgtggtttttgagttaggataggacgttatggttgcggtagcgcgcgtatttgggcgtgcgttgtaggggcgttcgtggcggttgcgatatcgggtcgtttatgtataggtagggggagtcgtagtcgtttatgtttcgggttttcgaatgagttggtagtttggttgcgggagagggttagggagcgttggacggcggggttgcgaggttcgtttaggggcggttttcgggcgacgcggtttttggtttcgtagtttcggtggtcgtgtgtgtttcggggcggtcggaggtgtcgtagtcgtttttttagtttttttcgcgtttatagttcggttttttagtttacgtttagttaacgtcgacgcgggtttttgttttgggcgcgtagtcgggtcggtacgttttttttcgcggaggcgttgcggcggttgtaaggagtcggcgatagttttgattaaggtttgagttagtttttttgtagttttttcgtgagtcggtcggatttaatattttcgtcgtttttttttaatttttttttttttttatcgttat

SEQ ID NO: 28744 - DNA, 996 bp, Artificial Sequence
  chemically treated genomic DNA (Homo sapiens) CpG-island No: 28744
ataacgataaaaaaaaaaaaaaattaaaaaaaaacgacgaaaatattaaatccgaccgactcacgaaaaaactacaaaaaaactaactcaaaccttaatcaaaactatcgccgactccttacaaccgccgcaacgcctccgcgaaaaaaaacgtaccgacccgactacgcgcccaaaacaaaaacccgcgtcgacgttaactaaacgtaaactaaaaaaccgaactataaacgcgaaaaaaactaaaaaaacgactacgacacctccgaccgccccgaaacacacacgaccaccgaaactacgaaaccaaaaaccgcgtcgcccgaaaaccgcccctaaacgaacctcgcaaccccgccgtccaacgctccctaaccctctcccgcaaccaaactaccaactcattcgaaaacccgaaacataaacgactacgactccccctacctatacataaacgacccgatatcgcaaccgccacgaacgcccctacaacgcacgcccaaatacgcgcgctaccgcaaccataacgtcctatcctaactcaaaaaccacaaacgttactaccgcttcaaaaactacacctacgaaaaatacatcctcatcatcgaacgacaacgaatcataactacgcaaataacgctacgccgacaacaaaccaacgaaaacttaaaaaacctcatccccgactcgctacgcgctctaccaaaacccccgccgccgaaaaacgccgtcgccgccccgcaaccgccgccaacctctcaaccgtcgcaaccgcaaccgccgcgccctactaccgaattaaccgcgaccgccgcgctacgttaaactaccgaaccgcaacccgaaactctacaaacgcaactcgccaaaccaaataaaaacgtctaaaatacgaaaatttaaccgaacgcgaaaacaacttcgaaataccaactacaactccacttaaaaaaactaaaaacaaaattttaaaacgtaaacctatcgaaactttcc

SEQ ID NO: 28745 - DNA, 726 bp, Artificial Sequence
  chemically treated genomic DNA (Homo sapiens) CpG-island No: 28745
gggttttttgttcgcggcgcgtcgtagatatacggtcgggaagtataaaggcgcgcggagtttgggtagtagttttcgagacggttacgttttcgtcgtttttcggttttatgcggtcgtataaagattagagttttatcgttatttacgtatttatttacgttcgagaggggcgtcgcgcggcgtaggtcgttatatttattcgggttcgttttcgtttttcgggtttcgggcgttttgatgaatatgtatcgcggcgcgttcgttttcggttttttttttcggtttttttttcgtcgttaggcggaagcgaagagtcgcgtttttcgcgcgtttaggtcggtcgtggtagggtggggcggggcgggtcgcgagtcggagaaagagaaagttagggaggcgattgtaggaggagcgcgggtcgggcgcggaagggtgcgttgttgggtggcggtttcggggtagtttcgtcgcgggttaggttaattcgagggcggggaaggggcgatcgcgcgatttcggggtcgtgtcggttgtatttgatcggcgtagttttatttttggagtagtttcgttaaaataataataaaatttattatatatatatatatatgtatatacgtatacgcgggcgtatatatatatattattttggacggcgtttaagttaagtacgagaaatagttttttgtaagggagaggaaagaaagttggaaatttagatag

SEQ ID NO: 28746 - DNA, 726 bp, Artificial Sequence
  chemically treated genomic DNA (Homo sapiens) CpG-island No: 28746
ctatctaaatttccaactttctttcctctcccttacaaaaaactatttctcgtacttaacttaaacgccgtccaaaataatatatatatatacgcccgcgtatacgtatatacatatatatatatatataataaattttattattattttaacgaaactactccaaaaataaaactacgccgatcaaatacaaccgacacgaccccgaaatcgcgcgatcgccccttccccgccctcgaattaacctaacccgcgacgaaactaccccgaaaccgccacccaacaacgcacccttccgcgcccgacccgcgctcctcctacaatcgcctccctaactttctctttctccgactcgcgacccgccccgccccaccctaccacgaccgacctaaacgcgcgaaaaacgcgactcttcgcttccgcctaacgacgaaaaaaaaaccgaaaaaaaaaaccgaaaacgaacgcgccgcgatacatattcatcaaaacgcccgaaacccgaaaaacgaaaacgaacccgaataaatataacgacctacgccgcgcgacgcccctctcgaacgtaaataaatacgtaaataacgataaaactctaatctttatacgaccgcataaaaccgaaaaacgacgaaaacgtaaccgtctcgaaaactactacccaaactccgcgcgcctttatacttcccgaccgtatatctacgacgcgccgcgaacaaaaaaccc

SEQ ID NO: 28747 - DNA, 726 bp, Artificial Sequence
  chemically treated genomic DNA (Homo sapiens) CpG-island No: 28747
ttgtttggatttttagttttttttttttttttttgtagaaggttgtttttcgtgtttgatttgaacgtcgtttaggatggtgtgtgtgtgtgcgttcgcgtgtgcgtgtgtgtatgtatgtgtgtgtgtggtgggttttattgttgttttagcggggttgttttaggagtggggttgcgtcggttagatgtagtcggtacggtttcggggtcgcgcgatcgtttttttttcgttttcggattggtttggttcgcggcggggttgtttcggaatcgttatttagtagcgtattttttcgcgttcggttcgcgttttttttgtagtcgtttttttggtttttttttttttcggttcgcggttcgtttcgttttattttattacggtcggtttgggcgcgcgggaagcgcggtttttcgttttcgtttggcggcgggaaggaaatcgaaaggaggagtcgggggcgggcgcgtcgcgatgtatatttattagggcgttcgggattcgggaggcgggagcgggttcgagtgggtgtggcggtttgcgtcgcgcggcgtttttttcgagcgtgggtgggtgcgtgggtagcggtggggttttggtttttgtgcggtcgtatggggtcggagagcggcgagggcgtgatcgtttcgggggttgttgtttaggtttcgcgcgtttttgtgtttttcgatcgtgtgtttgcggcgcgtcgcgggtaaggggttt

SEQ ID NO: 28748 - DNA, 726 bp, Artificial Sequence
  chemically treated genomic DNA (Homo sapiens) CpG-island No: 28748
aaaccccttacccgcgacgcgccgcaaacacacgatcgaaaaacacaaaaacgcgcgaaacctaaacaacaacccccgaaacgatcacgccctcgccgctctccgaccccatacgaccgcacaaaaaccaaaaccccaccgctacccacgcacccacccacgctcgaaaaaaacgccgcgcgacgcaaaccgccacacccactcgaacccgctcccgcctcccgaatcccgaacgccctaataaatatacatcgcgacgcgcccgcccccgactcctcctttcgatttccttcccgccgccaaacgaaaacgaaaaaccgcgcttcccgcgcgcccaaaccgaccgtaataaaataaaacgaaacgaaccgcgaaccgaaaaaaaaaaaaaccaaaaaaacgactacaaaaaaaacgcgaaccgaacgcgaaaaaatacgctactaaataacgattccgaaacaaccccgccgcgaaccaaaccaatccgaaaacgaaaaaaaaacgatcgcgcgaccccgaaaccgtaccgactacatctaaccgacgcaaccccactcctaaaacaaccccgctaaaacaacaataaaacccaccacacacacacatacatacacacacgcacacgcgaacgcacacacacacaccatcctaaacgacgttcaaatcaaacacgaaaaacaaccttctacaaaaaaaaaaaaaaaaaactaaaaatccaaacaa

SEQ ID NO: 28749 - DNA, 1369 bp, Artificial Sequence
  chemically treated genomic DNA (Homo sapiens) CpG-island No: 28749
gttgcgattttattttttcggtaaggggtcgaagttttcgggcggggcggggcggaggatagtacgaggtttaggatttttacgttatttttgtagtttcgcgtttttttttttagttttggtcgggttttcgcgttttttcgattttcgatcgtaaagtcggggtgcgagagggaaagggaagtgaggcggtacgcgtatggagggtgtgagtgcggatatatatatagggtggttaggtacgaaaaatttcgttttttttcgaattttcgtttcggattagttgtagttttattattttagggttttttgcgtcgggataaagttgtcgcggtttttttgcgttcgcggagcgcgtcgtcgttcgatttttttagtttttttcggtcgtaatttcgttttaaaggattcgtgggtcgttttagggacggaggggattcggagtcgggcgttcgtagttttcgtttttcgcgttttcgttcggcgtcgtcgtttatttgtttagtattttgcggattttttggcgtacgttagttcgggaggaggcggataggttttcgtcgtcgtcgttgttttcggtcggtaggttttcgatggtggttattatatggttcggcggggttggcgacggcggttgtagttgttgttgcggttgtttaggggggattatcgcggtagaggttgaggcgcggcggcgattagaacgtagtcgggtgtatcgtgtgtcggtttcgggttcgggaacgcgtagaggattcggtcgggcggtcgcggttcgggaggcggtgttgtttgcgaagcggtgaggcggggaggtattcgcggttacggtcgtcgtcgtttagttcgttatttatttttttttagttttagtgcgcgtattttcgcgttcgtgtcgtcgtcgtcgtcgttcgtttcggtttttttcgagtcgcgtttttaagttttggttcgtttcgcgaagtggttgcgaagggtgtcgcgcgggggcgcggagttgtcggtcggtttcggggaaggagttttgatttttttttgttttttcgtgttcgggttttttcggggcgcgcggcggtagttgtgttggcgtcgttttagtttgtgtttcgttcggtcggaaagttatcgtttgtgttttacggagtgagagatcgagggtgaattcggagagtcgggcgggggcgtcggcggcggcggcggcggcggcggcggcggcggtattttggggcgcgggcgggggatttgcgcgtttttttttcgttagagggcgttgtcgaggtgttttgttgttttcgattttttattgtttcgttcgtaaaggtttacggattaggttgtggtgattgttttggtttgggtgttttttagg

SEQ ID NO: 28750 - DNA, 1369 bp, Artificial Sequence
  chemically treated genomic DNA (Homo sapiens) CpG-island No: 28750
cctaaaaaacacccaaaccaaaacaatcaccacaacctaatccgtaaacctttacgaacgaaacaataaaaaatcgaaaacaacaaaacacctcgacaacgccctctaacgaaaaaaaaacgcgcaaatcccccgcccgcgccccaaaataccgccgccgccgccgccgccgccgccgccgccgacgcccccgcccgactctccgaattcaccctcgatctctcactccgtaaaacacaaacgataactttccgaccgaacgaaacacaaactaaaacgacgccaacacaactaccgccgcgcgccccgaaaaaacccgaacacgaaaaaacaaaaaaaaatcaaaactccttccccgaaaccgaccgacaactccgcgcccccgcgcgacacccttcgcaaccacttcgcgaaacgaaccaaaacttaaaaacgcgactcgaaaaaaaccgaaacgaacgacgacgacgacgacacgaacgcgaaaatacgcgcactaaaactaaaaaaaaataaataacgaactaaacgacgacgaccgtaaccgcgaatacctccccgcctcaccgcttcgcaaacaacaccgcctcccgaaccgcgaccgcccgaccgaatcctctacgcgttcccgaacccgaaaccgacacacgatacacccgactacgttctaatcgccgccgcgcctcaacctctaccgcgataatcccccctaaacaaccgcaacaacaactacaaccgccgtcgccaaccccgccgaaccatataataaccaccatcgaaaacctaccgaccgaaaacaacgacgacgacgaaaacctatccgcctcctcccgaactaacgtacgccaaaaaatccgcaaaatactaaacaaataaacgacgacgccgaacgaaaacgcgaaaaacgaaaactacgaacgcccgactccgaatcccctccgtccctaaaacgacccacgaatcctttaaaacgaaattacgaccgaaaaaaactaaaaaaatcgaacgacgacgcgctccgcgaacgcaaaaaaaccgcgacaactttatcccgacgcaaaaaaccctaaaataataaaactacaactaatccgaaacgaaaattcgaaaaaaaacgaaatttttcgtacctaaccaccctatatatatatccgcactcacaccctccatacgcgtaccgcctcacttccctttccctctcgcaccccgactttacgatcgaaaatcgaaaaaacgcgaaaacccgaccaaaactaaaaaaaaaaacgcgaaactacaaaaataacgtaaaaatcctaaacctcgtactatcctccgccccgccccgcccgaaaacttcgaccccttaccgaaaaaataaaatcgcaac

SEQ ID NO: 28751 - DNA, 1369 bp, Artificial Sequence
  chemically treated genomic DNA (Homo sapiens) CpG-island No: 28751
tttaaaaaatatttaaattaaaataattattataatttagttcgtgggtttttacggacggggtagtagagggtcgggggtaataaggtatttcggtagcgttttttggcgagaggagagcgcgtaggtttttcgttcgcgttttaaaatgtcgtcgtcgtcgtcgtcgtcgtcgtcgtcgtcggcgttttcgttcggtttttcgggtttattttcggttttttatttcgtgagatatagacggtagtttttcgatcgagcggggtataggttgaggcggcgttagtataattgtcgtcgcgcgtttcgaggagattcgggtacgaggaaataaggagaaattaggatttttttttcggaatcgatcggtagtttcgcgttttcgcgcgatatttttcgtagttatttcgcggggcgggttaggatttggggacgcggttcgggaagagtcggggcgggcggcggcggcggcggtacgggcgcgagggtgcgcgtattgggattggagaggagtgagtggcgggttgggcggcggcggtcgtagtcgcgggtgttttttcgttttatcgtttcgtaggtagtatcgtttttcgggtcgcggtcgttcggtcgggttttttgcgcgttttcgggttcggaatcggtatacgatgtattcggttgcgttttgatcgtcgtcgcgttttagtttttgtcgcgatgattttttttgagtagtcgtagtagtagttgtagtcgtcgtcgttagtttcgtcgaattatgtggtgattattatcgagaatttgtcggtcgagggtagcggcggcggcgggagtttgttcgttttttttcgggttggcgtgcgttagaggattcgtaaagtgttgaataggtgagcggcggcgtcgggcgagggcgcggggggcgggggttgcgggcgttcggtttcgggtttttttcgtttttggggcggtttacgggttttttgggacggggttgcggtcggaggagattgaggagatcgggcgacgacgcgtttcgcgggcgtagagaggtcgcggtagttttgtttcggcgtagggagttttggagtggtggagttgtagttggttcgaggcgggagttcggggagaggcggggtttttcgtatttagttattttgtatgtgtgttcgtatttatattttttatacgcgtgtcgttttatttttttttttttttcgtatttcggttttgcgatcgggggtcggggggacgcggggattcggttagggttgaggagggaggcgcggggttgtagagatggcgtggaagttttgggtttcgtgttgtttttcgtttcgtttcgttcgggggtttcgattttttgtcgggggaatggggtcgtagt

SEQ ID NO: 28752 - DNA, 1369 bp, Artificial Sequence
  chemically treated genomic DNA (Homo sapiens) CpG-island No: 28752
actacgaccccattcccccgacaaaaaatcgaaacccccgaacgaaacgaaacgaaaaacaacacgaaacccaaaacttccacgccatctctacaaccccgcgcctccctcctcaaccctaaccgaatccccgcgtccccccgacccccgatcgcaaaaccgaaatacgaaaaaaaaaaaaaaataaaacgacacgcgtataaaaaatataaatacgaacacacatacaaaataactaaatacgaaaaaccccgcctctccccgaactcccgcctcgaaccaactacaactccaccactccaaaactccctacgccgaaacaaaactaccgcgacctctctacgcccgcgaaacgcgtcgtcgcccgatctcctcaatctcctccgaccgcaaccccgtcccaaaaaacccgtaaaccgccccaaaaacgaaaaaaacccgaaaccgaacgcccgcaacccccgccccccgcgccctcgcccgacgccgccgctcacctattcaacactttacgaatcctctaacgcacgccaacccgaaaaaaaacgaacaaactcccgccgccgccgctaccctcgaccgacaaattctcgataataatcaccacataattcgacgaaactaacgacgacgactacaactactactacgactactcaaaaaaaatcatcgcgacaaaaactaaaacgcgacgacgatcaaaacgcaaccgaatacatcgtataccgattccgaacccgaaaacgcgcaaaaaacccgaccgaacgaccgcgacccgaaaaacgatactacctacgaaacgataaaacgaaaaaacacccgcgactacgaccgccgccgcccaacccgccactcactcctctccaatcccaatacgcgcaccctcgcgcccgtaccgccgccgccgccgcccgccccgactcttcccgaaccgcgtccccaaatcctaacccgccccgcgaaataactacgaaaaatatcgcgcgaaaacgcgaaactaccgatcgattccgaaaaaaaaatcctaatttctccttatttcctcgtacccgaatctcctcgaaacgcgcgacgacaattatactaacgccgcctcaacctataccccgctcgatcgaaaaactaccgtctatatctcacgaaataaaaaaccgaaaataaacccgaaaaaccgaacgaaaacgccgacgacgacgacgacgacgacgacgacgacgacattttaaaacgcgaacgaaaaacctacgcgctctcctctcgccaaaaaacgctaccgaaataccttattacccccgaccctctactaccccgtccgtaaaaacccacgaactaaattataataattattttaatttaaatattttttaaa

SEQ ID NO: 28753 - DNA, 599 bp, Artificial Sequence
  chemically treated genomic DNA (Homo sapiens) CpG-island No: 28753
ggacgacgtttataggtttcggcgtcgggcgggggtcgtagggtagggcggttcggtttatttttttgagttgttttatttcgttgcggatagttttatagtttatttcgagtttttcgaattgtagtttgagttggtgttttttttcgagtatcgttagttcgtattcggtcgtttggatttttttacgcgtggtttcggttagttcgtgggatagtcgttttatttcggcgcgtagttatttcggttgcgtttttattattagtcgcgcgtattttttttttttcgacggcgtcgatatggtggtcgagggttgagtcggtttttattgaggttttcgtaggtcgggttttttttagtcgtcgtcgttgtcgtcgtcgtcgtcgttttgtttcgacggtcgttcgttcgttcgcgtcgtcgtacggtttttttttttcggcgcgcggggttcgttgggggttggagttttgtttgcgtttcgattataaggtttattatgttcggcgttcgttcggttttcggttatgattggtttatgttttgtgaggggcgggttttcgggcgtagttattgacgttaatgtggtttagggggtt

SEQ ID NO: 28754 - DNA, 599 bp, Artificial Sequence
  chemically treated genomic DNA (Homo sapiens) CpG-island No: 28754
aaccccctaaaccacattaacgtcaataactacgcccgaaaacccgcccctcacaaaacataaaccaatcataaccgaaaaccgaacgaacgccgaacataataaaccttataatcgaaacgcaaacaaaactccaacccccaacgaaccccgcgcgccgaaaaaaaaaaaccgtacgacgacgcgaacgaacgaacgaccgtcgaaacaaaacgacgacgacgacgacaacgacgacgactaaaaaaaacccgacctacgaaaacctcaataaaaaccgactcaaccctcgaccaccatatcgacgccgtcgaaaaaaaaaaaatacgcgcgactaataataaaaacgcaaccgaaataactacgcgccgaaataaaacgactatcccacgaactaaccgaaaccacgcgtaaaaaaatccaaacgaccgaatacgaactaacgatactcgaaaaaaaacaccaactcaaactacaattcgaaaaactcgaaataaactataaaactatccgcaacgaaataaaacaactcaaaaaaataaaccgaaccgccctaccctacgacccccgcccgacgccgaaacctataaacgtcgtcc

SEQ ID NO: 28755 - DNA, 599 bp, Artificial Sequence
  chemically treated genomic DNA (Homo sapiens) CpG-island No: 28755
agttttttgggttatattggcgttagtggttgcgttcgagggttcgttttttatagagtatgggttaattatagtcgggggtcgggcgggcgtcgggtatgatggattttgtggtcggagcgtaggtaggattttagtttttagcgggtttcgcgcgtcggaggggaggagtcgtgcggcggcgcgggcgggcgggcggtcgtcggggtagggcggcggcggcggcggtagcggcggcggttgaggagggttcggtttgcgagagttttagtgggagtcggtttagttttcggttattatgtcggcgtcgtcggaggaggaggagtacgcgcggttggtgatggaggcgtagtcggagtggttgcgcgtcgaggtgaagcggttgttttacgagttggtcgagattacgcgtgagaagatttaggcggtcgagtacgggttggcggtgttcgaggagaagtattagtttaagttgtagttcgaggagttcgaggtggattatgaggttattcgtagcgagatggagtagtttaaggaggtgagtcgagtcgttttgttttgcgattttcgttcggcgtcggggtttgtgggcgtcgttt

SEQ ID NO: 28756 - DNA, 599 bp, Artificial Sequence
  chemically treated genomic DNA (Homo sapiens) CpG-island No: 28756
aaacgacgcccacaaaccccgacgccgaacgaaaatcgcaaaacaaaacgactcgactcacctccttaaactactccatctcgctacgaataacctcataatccacctcgaactcctcgaactacaacttaaactaatacttctcctcgaacaccgccaacccgtactcgaccgcctaaatcttctcacgcgtaatctcgaccaactcgtaaaacaaccgcttcacctcgacgcgcaaccactccgactacgcctccatcaccaaccgcgcgtactcctcctcctccgacgacgccgacataataaccgaaaactaaaccgactcccactaaaactctcgcaaaccgaaccctcctcaaccgccgccgctaccgccgccgccgccgccctaccccgacgaccgcccgcccgcccgcgccgccgcacgactcctcccctccgacgcgcgaaacccgctaaaaactaaaatcctacctacgctccgaccacaaaatccatcatacccgacgcccgcccgacccccgactataattaacccatactctataaaaaacgaaccctcgaacgcaaccactaacgccaatataacccaaaaaact

SEQ ID NO: 28757 - DNA, 604 bp, Artificial Sequence
  chemically treated genomic DNA (Homo sapiens) CpG-island No: 28757
  misc_feature (415)..(415): n is either a, c, g or t
  misc_feature (470)..(470): n is either a, c, g or t
atgtacgtttgcgatttcgagacgtttcgcgcgagtttaggagaattcgtaagttagtagcgtttgcgttcgagttgtagtagttttttgtaggttacgcgggttcgggagcggttttcggagttcgagttggcgttgagttgtaggcgcgagtttaaaggtttagtcggggtttacgttgtttgagagatcggagcgtttagttataggtacgcgtttaacggtttcgtggagtttattcggtttgagaggtcggaggttgcgagtgtcgttgttgaaggttgtggtggattaggttggatcgcggattttgagttatatcgcgggtttggtggtggattttggatttgggggtggatcgcgggtttgggggtggattttggatttggggggtggatttcggggatgtgggggngatggcggaatttggggttgggtgggggttggaaaaaagttacgaggagtcgcgncggtttaggagcgggtggtgggcgtttgaaaagtcgttattatgaggaagttttttagtttcgggagacgtttgggttaggcgtttttggattttatggattaagagtacgttggtcgggggtattatattcgg

SEQ ID NO: 28758 - DNA, 604 bp, Artificial Sequence
  chemically treated genomic DNA (Homo sapiens) CpG-island No: 28758
  misc_feature (135)..(135): n is either a, c, g or t
  misc_feature (190)..(190): n is either a, c, g or t
ccgaatataatacccccgaccaacgtactcttaatccataaaatccaaaaacgcctaacccaaacgtctcccgaaactaaaaaacttcctcataataacgacttttcaaacgcccaccacccgctcctaaaccgncgcgactcctcgtaacttttttccaacccccacccaaccccaaattccgccatcncccccacatccccgaaatccaccccccaaatccaaaatccacccccaaacccgcgatccacccccaaatccaaaatccaccaccaaacccgcgatataactcaaaatccgcgatccaacctaatccaccacaaccttcaacaacgacactcgcaacctccgacctctcaaaccgaataaactccacgaaaccgttaaacgcgtacctataactaaacgctccgatctctcaaacaacgtaaaccccgactaaacctttaaactcgcgcctacaactcaacgccaactcgaactccgaaaaccgctcccgaacccgcgtaacctacaaaaaactactacaactcgaacgcaaacgctactaacttacgaattctcctaaactcgcgcgaaacgtctcgaaatcgcaaacgtacat

SEQ ID NO: 28759 - DNA, 604 bp, Artificial Sequence
  chemically treated genomic DNA (Homo sapiens) CpG-island No: 28759
  misc_feature (135)..(135): n is either a, c, g or t
  misc_feature (190)..(190): n is either a, c, g or t
tcggatgtggtattttcgattagcgtatttttggtttatggagtttaggagcgtttggtttaggcgtttttcgaagttgaagagtttttttatggtggcgattttttagacgtttattattcgtttttgagtcgncgcggtttttcgtggtttttttttaatttttatttagttttaaatttcgttattntttttatattttcgggatttattttttaaatttaagatttatttttaaattcgcgatttatttttaaatttaagatttattattaaattcgcgatgtagtttagaattcgcgatttagtttggtttattatagtttttagtagcgatattcgtagttttcgattttttagatcgagtgagttttacgaagtcgttaagcgcgtgtttgtagttgaacgtttcgattttttagatagcgtgggtttcggttaagtttttaggttcgcgtttgtagtttagcgttagttcggatttcggaaatcgttttcgagttcgcgtggtttgtagggggttgttgtagttcgggcgtaggcgttgttggtttgcgggtttttttgggttcgcgcgggacgtttcggaatcgtagacgtgtat

SEQ ID NO: 28760 - DNA, 604 bp, Artificial Sequence
  chemically treated genomic DNA (Homo sapiens) CpG-island No: 28760
  misc_feature (415)..(415): n is either a, c, g or t
  misc_feature (470)..(470): n is either a, c, g or t
atacacgtctacgattccgaaacgtcccgcgcgaacccaaaaaaacccgcaaaccaacaacgcctacgcccgaactacaacaaccccctacaaaccacgcgaactcgaaaacgatttccgaaatccgaactaacgctaaactacaaacgcgaacctaaaaacttaaccgaaacccacgctatctaaaaaatcgaaacgttcaactacaaacacgcgcttaacgacttcgtaaaactcactcgatctaaaaaatcgaaaactacgaatatcgctactaaaaactataataaaccaaactaaatcgcgaattctaaactacatcgcgaatttaataataaatcttaaatttaaaaataaatcgcgaatttaaaaataaatcttaaatttaaaaaataaatcccgaaaatataaaaanaataacgaaatttaaaactaaataaaaattaaaaaaaaaccacgaaaaaccgcgncgactcaaaaacgaataataaacgtctaaaaaatcgccaccataaaaaaactcttcaacttcgaaaaacgcctaaaccaaacgctcctaaactccataaaccaaaaatacgctaatcgaaaataccacatccga

SEQ ID NO: 28761 - DNA, 626 bp, Artificial Sequence
  chemically treated genomic DNA (Homo sapiens) CpG-island No: 28761
cgttttcggaatatttacgttttcgggatatttacgttttcgggatatttacgttttcgggatacgtatattttcgggatattttcgttttcggaatatttatattttcgggatatttatattttcgggatatttacgttttcgggatatttatattttcgggatatttacgttttcgggatatttatattttcgggatatttacgttttcgggatatttacgttttcgggatatttacgttttcgggatatttatattttcgggatattttcgttttcgggatatttatattttcgggatatttattttttcgggatatttatattttcgggatattttcgttttcgggatatttatattttcgggatatttattttttcgggatatttatattttcgggatatttacgttttcgggatatttatattttcgggatattttcgttttcgggatatttatattttcgggatatttattttttcgggatatttatattttcgggatatttacgttttcgggatatttacgttttcgggatatttacggtttcgggatatttacgtttttgggatatttaggttttcggaatatttatattttcgggatatttattttttcgggatat

SEQ ID NO: 28762 - DNA, 626 bp, Artificial Sequence
  chemically treated genomic DNA (Homo sapiens) CpG-island No: 28762
atatcccgaaaaaataaatatcccgaaaatataaatattccgaaaacctaaatatcccaaaaacgtaaatatcccgaaaccgtaaatatcccgaaaacgtaaatatcccgaaaacgtaaatatcccgaaaatataaatatcccgaaaaaataaatatcccgaaaatataaatatcccgaaaacgaaaatatcccgaaaatataaatatcccgaaaacgtaaatatcccgaaaatataaatatcccgaaaaaataaatatcccgaaaatataaatatcccgaaaacgaaaatatcccgaaaatataaatatcccgaaaaaataaatatcccgaaaatataaatatcccgaaaacgaaaatatcccgaaaatataaatatcccgaaaacgtaaatatcccgaaaacgtaaatatcccgaaaacgtaaatatcccgaaaatataaatatcccgaaaacgtaaatatcccgaaaatataaatatcccgaaaacgtaaatatcccgaaaatataaatatcccgaaaatataaatattccgaaaacgaaaatatcccgaaaatatacgtatcccgaaaacgtaaatatcccgaaaacgtaaatatcccgaaaacgtaaatattccgaaaacg

SEQ ID NO: 28763 - DNA, 626 bp, Artificial Sequence
  chemically treated genomic DNA (Homo sapiens) CpG-island No: 28763
gtgtttcgggggagtgggtgtttcgggagtgtgggtgtttcgggggtttgggtgttttaggagcgtgggtgtttcggggtcgtgggtgtttcgggagcgtgggtgtttcgggggcgtgggtgtttcgggagtgtgggtgtttcgggggagtgggtgtttcgggagtgtgggtgtttcggaggcgagggtgtttcgggagtgtgggtgtttcgggggcgtgggtgtttcgggagtgtgggtgtttcgggggagtgggtgtttcgggagtgtgggtgtttcggaggcgagggtgtttcgggagtgtgggtgtttcgggggagtgggtgtttcgggagtgtgggtgtttcggaggcgagggtgtttcgggagtgtgggtgtttcgggggcgtgggtgtttcgggagcgtgggtgtttcgggggcgtgggtgtttcgggagtgtgggtgtttcgggggcgtgggtgtttcgggagtgtgggtgtttcgggggcgtgggtgtttcgggagtgtgggtgtttcgggagtgtgggtgtttcggaggcgagggtgtttcgggagtgtgcgtgtttcgggggcgtgggtgtttcgggggcgtgggtgtttcgggggcgtgggtgtttcggaggcg

SEQ ID NO: 28764 - DNA, 626 bp, Artificial Sequence
  chemically treated genomic DNA (Homo sapiens) CpG-island No: 28764
cgcctccgaaacacccacgcccccgaaacacccacgcccccgaaacacccacgcccccgaaacacgcacactcccgaaacaccctcgcctccgaaacacccacactcccgaaacacccacactcccgaaacacccacgcccccgaaacacccacactcccgaaacacccacgcccccgaaacacccacactcccgaaacacccacgcccccgaaacacccacgctcccgaaacacccacgcccccgaaacacccacactcccgaaacaccctcgcctccgaaacacccacactcccgaaacacccactcccccgaaacacccacactcccgaaacaccctcgcctccgaaacacccacactcccgaaacacccactcccccgaaacacccacactcccgaaacacccacgcccccgaaacacccacactcccgaaacaccctcgcctccgaaacacccacactcccgaaacacccactcccccgaaacacccacactcccgaaacacccacgcccccgaaacacccacgctcccgaaacacccacgaccccgaaacacccacgctcctaaaacacccaaacccccgaaacacccacactcccgaaacacccactcccccgaaacac

SEQ ID NO: 28765 - DNA, 600 bp, Artificial Sequence
  chemically treated genomic DNA (Homo sapiens) CpG-island No: 28765
cggttatttgtggataaataggatcgtcgttttgtttatgggaagacggggttggtgagggttagagacgtttagggcgaggtaatttcgtgcgtttagtttcgagtaggtcgttttttaggacgttttatagtcgaggggatcgttattcgggagcgtcgtgagttgtgggtattacgcggtggtggagagtgattttcgtttcggggcggtcgtgttgttcgaatttgttttagttcgcgaggggagacgggtttgggggtaggcgggagagggaggtttcgggaggaggcgagcggggttgagaggacgcgcgggaggggttttggagaggtcgtaggaggcgcgtttcggagggacgatttttgttgggaggacgaggttttaggtggacgttgtgggtcggtgggtaggagttcgagttttgtaggagcggtttaaattggttattgagcgcggaagaagggacggaaggtgagcgttattgggttacgtggggtcgagagaaaggttattgtttgttttttttaaaattagttttatacgtcgacgtttttagagaattggtttggtttggaaggaggttgaggatgtaggcgg

SEQ ID NO: 28766 - DNA, 600 bp, Artificial Sequence
  chemically treated genomic DNA (Homo sapiens) CpG-island No: 28766
ccgcctacatcctcaacctccttccaaaccaaaccaattctctaaaaacgtcgacgtataaaactaattttaaaaaaaacaaacaataacctttctctcgaccccacgtaacccaataacgctcaccttccgtcccttcttccgcgctcaataaccaatttaaaccgctcctacaaaactcgaactcctacccaccgacccacaacgtccacctaaaacctcgtcctcccaacaaaaatcgtccctccgaaacgcgcctcctacgacctctccaaaacccctcccgcgcgtcctctcaaccccgctcgcctcctcccgaaacctccctctcccgcctacccccaaacccgtctcccctcgcgaactaaaacaaattcgaacaacacgaccgccccgaaacgaaaatcactctccaccaccgcgtaatacccacaactcacgacgctcccgaataacgatcccctcgactataaaacgtcctaaaaaacgacctactcgaaactaaacgcacgaaattacctcgccctaaacgtctctaaccctcaccaaccccgtcttcccataaacaaaacgacgatcctatttatccacaaataaccg

SEQ ID NO: 28767 - DNA, 600 bp, Artificial Sequence
  chemically treated genomic DNA (Homo sapiens) CpG-island No: 28767
tcgtttgtatttttagtttttttttaaattagattagttttttaggggcgtcgacgtgtgaaattgattttaaagaaaataggtagtggtttttttttcggttttacgtggtttagtagcgtttatttttcgttttttttttcgcgtttagtaattaatttaggtcgtttttgtagaattcgggtttttgtttatcggtttatagcgtttatttgaggtttcgtttttttagtaaaggtcgttttttcggaacgcgttttttgcggtttttttagagtttttttcgcgcgtttttttagtttcgttcgttttttttcggggtttttttttttcgtttgtttttaggttcgttttttttcgcgggttgaggtaggttcgggtagtacggtcgtttcggggcgggggttattttttattatcgcgtggtgtttatagtttacggcgttttcgggtgacggttttttcggttgtagggcgttttgaagagcggtttgttcggagttgagcgtacggggttgtttcgttttgggcgtttttggtttttattagtttcgtttttttatgggtaaaacggcggttttgtttgtttataagtaatcg

SEQ ID NO: 28768 - DNA, 600 bp, Artificial Sequence
  chemically treated genomic DNA (Homo sapiens) CpG-island No: 28768
cgattacttataaacaaacaaaaccgccgttttacccataaaaaaacgaaactaataaaaaccaaaaacgcccaaaacgaaacaaccccgtacgctcaactccgaacaaaccgctcttcaaaacgccctacaaccgaaaaaaccgtcacccgaaaacgccgtaaactataaacaccacgcgataataaaaaataacccccgccccgaaacgaccgtactacccgaacctacctcaacccgcgaaaaaaaacgaacctaaaaacaaacgaaaaaaaaaaaccccgaaaaaaaacgaacgaaactaaaaaaacgcgcgaaaaaaactctaaaaaaaccgcaaaaaacgcgttccgaaaaaacgacctttactaaaaaaacgaaacctcaaataaacgctataaaccgataaacaaaaacccgaattctacaaaaacgacctaaattaattactaaacgcgaaaaaaaaaacgaaaaataaacgctactaaaccacgtaaaaccgaaaaaaaaaccactacctattttctttaaaatcaatttcacacgtcgacgcccctaaaaaactaatctaatttaaaaaaaaactaaaaatacaaacga

SEQ ID NO: 28769 - DNA, 670 bp, Artificial Sequence
  chemically treated genomic DNA (Homo sapiens) CpG-island No: 28769
cgacgttcgggaggtaagagtcgcggcggtcgtttttcgattcgatattcggcgttttttagattcggtcgtaggcgtcgttttattcgcgattttcgggttatttttggaagggacggggcggtttcgtcggttcgaagtcgcggggataacggcgcggggtagatgttcggggttgggcggcggcggtcgggggtcgggttagtttttggaggtttttcggttcgcgtttggcggaggcgtcgaggatagcgtagtttcgcgggtttcgttcgtagttcgtatcgaggattcggcgaggttgcggagggaggaggagacggggcgggttgcggcggggataggcggggatatggaggaggacgcgggagtcgtcgttattagggcgcgcgcggggacggcgacgttattttttcgtagttaagtttcgtttagtttcgcgtagtcgtcgtcgtcgtcgttagtttcgtagtttcgcggttagtgcgggcgtttcgcgaggtcgattcgggatcgtgtcgttagtgtttttttcgtgtggcggggatttagtagtttagttttggcggcgattttcgtgtagcgagcgtgaggtttgacgtaaaaaaaaaaagtatttttaagaagacggtgttgtaattattttcggttagtagaacgggtgtcgatt

SEQ ID NO: 28770 - DNA, 670 bp, Artificial Sequence
  chemically treated genomic DNA (Homo sapiens) CpG-island No: 28770
aatcgacacccgttctactaaccgaaaataattacaacaccgtcttcttaaaaatactttttttttttacgtcaaacctcacgctcgctacacgaaaatcgccgccaaaactaaactactaaatccccgccacacgaaaaaaacactaacgacacgatcccgaatcgacctcgcgaaacgcccgcactaaccgcgaaactacgaaactaacgacgacgacgacgactacgcgaaactaaacgaaacttaactacgaaaaaataacgtcgccgtccccgcgcgcgccctaataacgacgactcccgcgtcctcctccatatccccgcctatccccgccgcaacccgccccgtctcctcctccctccgcaacctcgccgaatcctcgatacgaactacgaacgaaacccgcgaaactacgctatcctcgacgcctccgccaaacgcgaaccgaaaaacctccaaaaactaacccgacccccgaccgccgccgcccaaccccgaacatctaccccgcgccgttatccccgcgacttcgaaccgacgaaaccgccccgtcccttccaaaaataacccgaaaatcgcgaataaaacgacgcctacgaccgaatctaaaaaacgccgaatatcgaatcgaaaaacgaccgccgcgactcttacctcccgaacgtcg

SEQ ID NO: 28771 - DNA, 670 bp, Artificial Sequence
  chemically treated genomic DNA (Homo sapiens) CpG-island No: 28771
aatcgatattcgttttgttaatcgaaggtgattatagtatcgtttttttggggatattttttttttttacgttaggttttacgttcgttgtacggggatcgtcgttagggttgggttgttggattttcgttatacgggggaagtattggcggtacgatttcggatcgatttcgcgaggcgttcgtattggtcgcggggttgcgggattggcggcggcggcggcggttgcgcggggttgggcggggtttggttgcggggaaatgacgtcgtcgttttcgcgcgcgttttggtaacggcggttttcgcgtttttttttatgttttcgtttattttcgtcgtagttcgtttcgttttttttttttttcgtagtttcgtcgagttttcggtgcgggttgcgagcgggattcgcggagttgcgttgttttcgacgttttcgttaggcgcgggtcgaggagtttttaagagttggttcggttttcggtcgtcgtcgtttaatttcgggtatttgtttcgcgtcgttgttttcgcggtttcgggtcggcgggatcgtttcgttttttttaggggtgattcgggggtcgcgggtgggacggcgtttgcggtcgagtttggggggcgtcgggtgtcgggtcgggaagcggtcgtcgcgatttttgtttttcgggcgtcg

SEQ ID NO: 28772 - DNA, 670 bp, Artificial Sequence
  chemically treated genomic DNA (Homo sapiens) CpG-island No: 28772
cgacgcccgaaaaacaaaaatcgcgacgaccgcttcccgacccgacacccgacgccccccaaactcgaccgcaaacgccgtcccacccgcgacccccgaatcacccctaaaaaaaacgaaacgatcccgccgacccgaaaccgcgaaaacaacgacgcgaaacaaatacccgaaattaaacgacgacgaccgaaaaccgaaccaactcttaaaaactcctcgacccgcgcctaacgaaaacgtcgaaaacaacgcaactccgcgaatcccgctcgcaacccgcaccgaaaactcgacgaaactacgaaaaaaaaaaaaaacgaaacgaactacgacgaaaataaacgaaaacataaaaaaaaacgcgaaaaccgccgttaccaaaacgcgcgcgaaaacgacgacgtcatttccccgcaaccaaaccccgcccaaccccgcgcaaccgccgccgccgccgccaatcccgcaaccccgcgaccaatacgaacgcctcgcgaaatcgatccgaaatcgtaccgccaatacttcccccgtataacgaaaatccaacaacccaaccctaacgacgatccccgtacaacgaacgtaaaacctaacgtaaaaaaaaaaaatatccccaaaaaaacgatactataatcaccttcgattaacaaaacgaatatcgatt

SEQ ID NO: 28773 - DNA, 649 bp, Artificial Sequence
  chemically treated genomic DNA (Homo sapiens) CpG-island No: 28773
agaagcgtcgttcggtttcgtttaagcgtatacgaaggggtcgtttttcgtttttcgtattttagattaggcggtttacggaatatcgttttttagttttggttcgggattaggcggttttttagtcggtttcggcgtcgcggtcggggacgcgcgttttttttttttaggcgtcggacgtggaatttgcgagtttttggcggcgttttaagttatgtataggtcgtagttgtttattaagttttttttgggaggtcgttttggttttcgagaggggcgcgcgggagtggacgttttcgtattttcgttttatttatatttgtcgtcgtcgtcggggtcgttagcgtcgtggtttcgtttcggtttcgtttttcgtcgttttcggttttcgttttagtcgtcgtcgcgatcgtcgcggaaaggagggggagggaagaggcgtttggacggggttgcgggagcggtcgtgttgagtttttttttttgggttcggacgggatttaggtttttttattgtaacgtagttttcgagtgacggaattttgtgggggaagcggcggttattacgttcgtttttggtatagtagttttttgcgggtgggagtttttcgtagttagagttaagggagagggagtttatttgtaagag

SEQ ID NO: 28774 - DNA, 649 bp, Artificial Sequence
  chemically treated genomic DNA (Homo sapiens) CpG-island No: 28774
ctcttacaaataaactccctctcccttaactctaactacgaaaaactcccacccgcaaaaaactactataccaaaaacgaacgtaataaccgccgcttcccccacaaaattccgtcactcgaaaactacgttacaataaaaaaacctaaatcccgtccgaacccaaaaaaaaaaactcaacacgaccgctcccgcaaccccgtccaaacgcctcttccctccccctcctttccgcgacgatcgcgacgacgactaaaacgaaaaccgaaaacgacgaaaaacgaaaccgaaacgaaaccacgacgctaacgaccccgacgacgacgacaaatataaataaaacgaaaatacgaaaacgtccactcccgcgcgcccctctcgaaaaccaaaacgacctcccaaaaaaaacttaataaacaactacgacctatacataacttaaaacgccgccaaaaactcgcaaattccacgtccgacgcctaaaaaaaaaaaacgcgcgtccccgaccgcgacgccgaaaccgactaaaaaaccgcctaatcccgaaccaaaactaaaaaacgatattccgtaaaccgcctaatctaaaatacgaaaaacgaaaaacgaccccttcgtatacgcttaaacgaaaccgaacgacgcttct

SEQ ID NO: 28775 - DNA, 649 bp, Artificial Sequence
  chemically treated genomic DNA (Homo sapiens) CpG-island No: 28775
tttttgtaggtggatttttttttttttagttttgattgcgagaagtttttattcgtaaagggttattgtgttaaaagcgagcgtagtggtcgtcgttttttttataaaatttcgttattcgggagttgcgttgtagtggagaaatttgggtttcgttcgggtttaagggaggaggtttagtacggtcgttttcgtagtttcgtttaggcgttttttttttttttttttttttcgcggcggtcgcggcggcggttggagcgggagtcgggggcggcgaggggcggagtcggggcggagttacggcgttggcggtttcggcgacgacggtaggtgtggatggggcgaaggtgcgggaacgtttattttcgcgcgtttttttcggggattagggcggttttttaggaggagtttggtgagtagttgcgatttgtgtataatttggggcgtcgttaggggttcgtaggttttacgttcggcgtttggagaaggaagacgcgcgttttcggtcgcggcgtcgaagtcggttgggggatcgtttggtttcgggttagagttgggaggcggtgtttcgtgagtcgtttggtttggggtgcggggggcgggaagcggttttttcgtgtgcgtttgggcgaggtcgggcggcgttttt

SEQ ID NO: 28776 - DNA, 649 bp, Artificial Sequence
  chemically treated genomic DNA (Homo sapiens) CpG-island No: 28776
aaaaacgccgcccgacctcgcccaaacgcacacgaaaaaaccgcttcccgccccccgcaccccaaaccaaacgactcacgaaacaccgcctcccaactctaacccgaaaccaaacgatcccccaaccgacttcgacgccgcgaccgaaaacgcgcgtcttccttctccaaacgccgaacgtaaaacctacgaacccctaacgacgccccaaattatacacaaatcgcaactactcaccaaactcctcctaaaaaaccgccctaatccccgaaaaaaacgcgcgaaaataaacgttcccgcaccttcgccccatccacacctaccgtcgtcgccgaaaccgccaacgccgtaactccgccccgactccgcccctcgccgcccccgactcccgctccaaccgccgccgcgaccgccgcgaaaaaaaaaaaaaaaaaaaaaacgcctaaacgaaactacgaaaacgaccgtactaaacctcctcccttaaacccgaacgaaacccaaatttctccactacaacgcaactcccgaataacgaaattttataaaaaaaacgacgaccactacgctcgcttttaacacaataaccctttacgaataaaaacttctcgcaatcaaaactaaaaaaaaaaaaatccacctacaaaaa

SEQ ID NO: 28777 - DNA, 1084 bp, Artificial Sequence
  chemically treated genomic DNA (Homo sapiens) CpG-island No: 28777
atttttgttattttggagtttaggtcgagtagcgagtaggggttgttcgcggcggcggcggcggcggtagcggcggcggtagcggtcgattgcgggaagaagacgcgtgcggcggtagcggcggcggtcgcggtcgttttttcgggattggcgagtagcgatttaggtattaggtcgtcgttcgttttcgcgtgtagttcggcgttcgttttgagcgtagggtgttcggcgttcgttacgtcgtttaggtcgtagggtatcgggaaggcgaatttgttttttttgagtagcgttttgggtttgcgtcgcggtcggtatttgtagtcggggtgtttttttatgtgtatggcgcgtagacgtttggtttcgtcgatgaacggtcgttttttcgattttgtgagtagtttttattcggcgtttaagcgtttgttgattttcgagttgtgtattttggggtttttttgggttattttgcgtcgttgagttcgcgattatattatgaaggcgtttatgggtcgtttgacgtggtttatcggtttggatatgttttcgttttgtcgcggttgtagttcgtcgtttttcgggttttcgttttcggttcggaggaaattaatgttggttgttcgcggagattcgttcggtcggtcggggttcgtcgcgtttcggcgtcgttttcgtttcggaggagggggttgggggattagtttagggttacgtcgcgtttcgggtcgttttagtgttttcggtcgagcgttcgagtaggttgtttttgggatattttaatttttcggcggtgtttttttttcgcggcggtagtttgttttttacgttttttgggtttttcgtttgtagtggcgtttgttggtgagtttttcgtaggtagcggcggtcgggtagagcgtttttttttttcggtcgtttttttttaaatgtaaagcgtttttaaaagttgcgtcgcggagatttttcgaagttgagtcgaggagttcgtcgtcgcgtgttgttaagtgttaaagggggtttttagcggttggagtgtttgggtttttttcggtgatttttttatttgatagaagtagatggg

SEQ ID NO: 28778 - DNA, 1084 bp, Artificial Sequence
  chemically treated genomic DNA (Homo sapiens) CpG-island No: 28778
cccatctacttctatcaaataaaaaaatcaccgaaaaaaacccaaacactccaaccgctaaaaaccccctttaacacttaacaacacgcgacgacgaactcctcgactcaacttcgaaaaatctccgcgacgcaacttttaaaaacgctttacatttaaaaaaaaacgaccgaaaaaaaaaaacgctctacccgaccgccgctacctacgaaaaactcaccaacaaacgccactacaaacgaaaaacccaaaaaacgtaaaaaacaaactaccgccgcgaaaaaaaaacaccgccgaaaaattaaaatatcccaaaaacaacctactcgaacgctcgaccgaaaacactaaaacgacccgaaacgcgacgtaaccctaaactaatcccccaaccccctcctccgaaacgaaaacgacgccgaaacgcgacgaaccccgaccgaccgaacgaatctccgcgaacaaccaacattaatttcctccgaaccgaaaacgaaaacccgaaaaacgacgaactacaaccgcgacaaaacgaaaacatatccaaaccgataaaccacgtcaaacgacccataaacgccttcataatataatcgcgaactcaacgacgcaaaataacccaaaaaaaccccaaaatacacaactcgaaaatcaacaaacgcttaaacgccgaataaaaactactcacaaaatcgaaaaaacgaccgttcatcgacgaaaccaaacgtctacgcgccatacacataaaaaaacaccccgactacaaataccgaccgcgacgcaaacccaaaacgctactcaaaaaaaacaaattcgccttcccgataccctacgacctaaacgacgtaacgaacgccgaacaccctacgctcaaaacgaacgccgaactacacgcgaaaacgaacgacgacctaatacctaaatcgctactcgccaatcccgaaaaaacgaccgcgaccgccgccgctaccgccgcacgcgtcttcttcccgcaatcgaccgctaccgccgccgctaccgccgccgccgccgccgcgaacaacccctactcgctactcgacctaaactccaaaataacaaaaat

SEQ ID NO: 28779 - DNA, 1084 bp, Artificial Sequence
  chemically treated genomic DNA (Homo sapiens) CpG-island No: 28779
tttatttgtttttgttaaatgagaaagttatcgaggagaatttaaatattttagtcgttgagagttttttttggtatttggtagtacgcggcggcgggtttttcggtttaatttcgaggagttttcgcgacgtaatttttggggacgttttgtatttaagagagaacgatcgaggaggaggagcgttttgttcggtcgtcgttatttgcggggagtttattagtaaacgttattgtagacgaaggatttaaagaacgtaaagggtaaattgtcgtcgcggggagggggtatcgtcgagaagttagagtgttttagagataatttgttcgagcgttcggtcggagatattaaggcggttcggggcgcggcgtggttttgggttggttttttagttttttttttcggggcgggagcgacgtcggggcgcgacgagtttcggtcggtcgagcgggttttcgcgggtagttaatattgatttttttcgggtcgagggcgagggttcgggaggcggcgggttgtagtcgcggtagggcgagagtatgtttaagtcggtggattacgttaagcggtttatgaacgtttttatggtgtggtcgcgggtttagcggcgtaagatggtttaggagaattttaagatgtataattcggagattagtaagcgtttgggcgtcgagtggaaattgtttatagagtcggagaagcggtcgtttatcgacgaggttaagcgtttacgcgttatgtatatgaaggagtatttcgattataagtatcggtcgcggcgtaagtttaagacgttgtttaagaaggataagttcgttttttcggtgttttacggtttgggcggcgtggcggacgtcgagtattttgcgtttaaggcgggcgtcgggttgtacgcgggggcgggcggcggtttggtgtttgagtcgttgttcgttaatttcgagaaggcggtcgcggtcgtcgtcgttgtcgtcgtacgcgtttttttttcgtagtcggtcgttgtcgtcgtcgttgtcgtcgtcgtcgtcgtcgcgggtagtttttattcgttgttcgatttgggttttaaaatggtagagat

SEQ ID NO: 28780 - DNA, 1084 bp, Artificial Sequence
  chemically treated genomic DNA (Homo sapiens) CpG-island No: 28780
atctctaccattttaaaacccaaatcgaacaacgaataaaaactacccgcgacgacgacgacgacgacaacgacgacgacaacgaccgactacgaaaaaaaaacgcgtacgacgacaacgacgacgaccgcgaccgccttctcgaaattaacgaacaacgactcaaacaccaaaccgccgcccgcccccgcgtacaacccgacgcccgccttaaacgcaaaatactcgacgtccgccacgccgcccaaaccgtaaaacaccgaaaaaacgaacttatccttcttaaacaacgtcttaaacttacgccgcgaccgatacttataatcgaaatactccttcatatacataacgcgtaaacgcttaacctcgtcgataaacgaccgcttctccgactctataaacaatttccactcgacgcccaaacgcttactaatctccgaattatacatcttaaaattctcctaaaccatcttacgccgctaaacccgcgaccacaccataaaaacgttcataaaccgcttaacgtaatccaccgacttaaacatactctcgccctaccgcgactacaacccgccgcctcccgaaccctcgccctcgacccgaaaaaaatcaatattaactacccgcgaaaacccgctcgaccgaccgaaactcgtcgcgccccgacgtcgctcccgccccgaaaaaaaaaactaaaaaaccaacccaaaaccacgccgcgccccgaaccgccttaatatctccgaccgaacgctcgaacaaattatctctaaaacactctaacttctcgacgataccccctccccgcgacgacaatttaccctttacgttctttaaatccttcgtctacaataacgtttactaataaactccccgcaaataacgacgaccgaacaaaacgctcctcctcctcgatcgttctctcttaaatacaaaacgtccccaaaaattacgtcgcgaaaactcctcgaaattaaaccgaaaaacccgccgccgcgtactaccaaataccaaaaaaaactctcaacgactaaaatatttaaattctcctcgataactttctcatttaacaaaaacaaataaa

SEQ ID NO: 28781 - DNA, 510 bp, Artificial Sequence
  chemically treated genomic DNA (Homo sapiens) CpG-island No: 28781
tggtcgttcggttttagaggaagttttttcggttcgtcgaggagtcgcgttcggtcgttttttgggttatgtcggttttgttcgtttcgagtttttttaggcgcgtttgtcgatttagggttttcggagttcgtcggtcgcggagggtagcgtagtttttacgcggcgtcgtaggtttggtatcggtcgcgttttcgtttcgtttttttcggtagtcgtttggtatttgtaattaatttcgtttaagttttttgcgtcgcggcgtttttttcggcgcgtttttgggagcgtgcgttcgcgagttcgtcgcgttcggggtttttttgttttcgttgttgtggttagagtcgagtcggcgtaggggcggaggtgttgtaggagagttaaggaaaacgggttattattttagttcgtaggttcgcgttgtggtatttttcgttttttttattttcgcggcgtagggggtttttttttagtttaggtcgttttttgtatcggtttaggtgagtg

SEQ ID NO: 28782 - DNA, 510 bp, Artificial Sequence
  chemically treated genomic DNA (Homo sapiens) CpG-island No: 28782
cactcacctaaaccgatacaaaaaacgacctaaactaaaaaaaaaccccctacgccgcgaaaataaaaaaaacgaaaaataccacaacgcgaacctacgaactaaaataataacccgttttccttaactctcctacaacacctccgcccctacgccgactcgactctaaccacaacaacgaaaacaaaaaaaccccgaacgcgacgaactcgcgaacgcacgctcccaaaaacgcgccgaaaaaaacgccgcgacgcaaaaaacttaaacgaaattaattacaaataccaaacgactaccgaaaaaaacgaaacgaaaacgcgaccgataccaaacctacgacgccgcgtaaaaactacgctaccctccgcgaccgacgaactccgaaaaccctaaatcgacaaacgcgcctaaaaaaactcgaaacgaacaaaaccgacataacccaaaaaacgaccgaacgcgactcctcgacgaaccgaaaaaacttcctctaaaaccgaacgacca

SEQ ID NO: 28783 - DNA, 510 bp, Artificial Sequence
  chemically treated genomic DNA (Homo sapiens) CpG-island No: 28783
tatttatttgagtcggtgtagagggcggtttgggttgggaaggggttttttgcgtcgcgggagtggggagagcgggaggtgttatagcgcggatttgcgaattgaggtgatggttcgttttttttaatttttttgtagtattttcgtttttgcgtcggttcggttttggttatagtagcgaggatagaggggtttcgggcgcggcggattcgcgggcgtacgtttttaggagcgcgtcgagaggggcgtcgcggcgtaggaaatttgggcgaagttagttgtaagtgttaggcggttgtcgagaagagcgaggcggggacgcggtcggtgttaggtttgcggcgtcgcgtggaggttgcgttgtttttcgcggtcggcgagtttcgggagttttaagtcggtaggcgcgtttgaaggggttcggagcgaatagagtcggtatggtttaggggacggtcggacgcggtttttcggcgagtcgggagaattttttttgaggtcgggcgatta

SEQ ID NO: 28784 - DNA, 510 bp, Artificial Sequence
  chemically treated genomic DNA (Homo sapiens) CpG-island No: 28784
taatcgcccgacctcaaaaaaaattctcccgactcgccgaaaaaccgcgtccgaccgtcccctaaaccataccgactctattcgctccgaaccccttcaaacgcgcctaccgacttaaaactcccgaaactcgccgaccgcgaaaaacaacgcaacctccacgcgacgccgcaaacctaacaccgaccgcgtccccgcctcgctcttctcgacaaccgcctaacacttacaactaacttcgcccaaatttcctacgccgcgacgcccctctcgacgcgctcctaaaaacgtacgcccgcgaatccgccgcgcccgaaacccctctatcctcgctactataaccaaaaccgaaccgacgcaaaaacgaaaatactacaaaaaaattaaaaaaaacgaaccatcacctcaattcgcaaatccgcgctataacacctcccgctctccccactcccgcgacgcaaaaaaccccttcccaacccaaaccgccctctacaccgactcaaataaata

SEQ ID NO: 28785 - DNA, 609 bp, Artificial Sequence
  chemically treated genomic DNA (Homo sapiens) CpG-island No: 28785
ggttttttcgtcgttggaggatttggatttgagcggagaggaggtttagcggtttattttcgttttttaggattcggagtttcggcgaatgtttttttagtacgtcgaggagtttatcgattcggagaatcggcggcgttacgaggcggagattatcgcgttagagcgtgagcgcggggtggaagtgcggttcgtgtattcggagttcggttatgtgttgcgtattagtttggacggggcgcggcgttgttttgtgaatgtttgtagtaacgcgttggtgggcgcgtttagtagtcggttcggtttcggtggcgatcggggcgtagtttttggtagttattggtttttgttttatagtttggcgttcggtcgcgagtacgcggggcgtagtagtagtcgttatatggtttacgacgtggttttttatttagacgcgtttgcgttggttcggcggtacgagggttttcgttagatgttggacgttacggttttggaggtcgtcgagaagtagttcggcgtgaagttggatcgtaggaatgttaagattttgaaggttaagtataaggggattttagaggttgcggtgttgcgtacgtttttgttcggggt

SEQ ID NO: 28786 - DNA, 609 bp, Artificial Sequence
  chemically treated genomic DNA (Homo sapiens) CpG-island No: 28786
accccgaacaaaaacgtacgcaacaccgcaacctctaaaatccccttatacttaaccttcaaaatcttaacattcctacgatccaacttcacgccgaactacttctcgacgacctccaaaaccgtaacgtccaacatctaacgaaaaccctcgtaccgccgaaccaacgcaaacgcgtctaaataaaaaaccacgtcgtaaaccatataacgactactactacgccccgcgtactcgcgaccgaacgccaaactataaaacaaaaaccaataactaccaaaaactacgccccgatcgccaccgaaaccgaaccgactactaaacgcgcccaccaacgcgttactacaaacattcacaaaacaacgccgcgccccgtccaaactaatacgcaacacataaccgaactccgaatacacgaaccgcacttccaccccgcgctcacgctctaacgcgataatctccgcctcgtaacgccgccgattctccgaatcgataaactcctcgacgtactaaaaaaacattcgccgaaactccgaatcctaaaaaacgaaaataaaccgctaaacctcctctccgctcaaatccaaatcctccaacgacgaaaaaacc

SEQ ID NO: 28787 - DNA, 609 bp, Artificial Sequence
  chemically treated genomic DNA (Homo sapiens) CpG-island No: 28787
atttcgggtaggggcgtgcgtagtatcgtagtttttggggtttttttatatttggtttttagggttttggtatttttgcggtttagttttacgtcgaattgtttttcgacggtttttagggtcgtggcgtttagtatttggcggaagttttcgtgtcgtcgggttagcgtaagcgcgtttggatggaagattacgtcgtagattatgtagcggttgttgttgcgtttcgcgtattcgcggtcgggcgttaggttgtagggtagggattagtggttgttaggagttgcgtttcggtcgttatcggagtcgggtcggttgttgggcgcgtttattaacgcgttgttgtagatatttataaagtagcgtcgcgtttcgtttaggttggtgcgtagtatatggtcgggtttcgggtgtacgaatcgtatttttatttcgcgtttacgttttagcgcggtgattttcgtttcgtagcgtcgtcggtttttcgggtcggtgagtttttcggcgtattgggagaatattcgtcggaatttcgggttttggaaggcggaggtgagtcgttggatttttttttcgtttaggtttaagttttttagcgacgaggaggtt

SEQ ID NO: 28788 - DNA, 609 bp, Artificial Sequence
  chemically treated genomic DNA (Homo sapiens) CpG-island No: 28788
aacctcctcgtcgctaaaaaacttaaacctaaacgaaaaaaaaatccaacgactcacctccgccttccaaaacccgaaattccgacgaatattctcccaatacgccgaaaaactcaccgacccgaaaaaccgacgacgctacgaaacgaaaatcaccgcgctaaaacgtaaacgcgaaataaaaatacgattcgtacacccgaaacccgaccatatactacgcaccaacctaaacgaaacgcgacgctactttataaatatctacaacaacgcgttaataaacgcgcccaacaaccgacccgactccgataacgaccgaaacgcaactcctaacaaccactaatccctaccctacaacctaacgcccgaccgcgaatacgcgaaacgcaacaacaaccgctacataatctacgacgtaatcttccatccaaacgcgcttacgctaacccgacgacacgaaaacttccgccaaatactaaacgccacgaccctaaaaaccgtcgaaaaacaattcgacgtaaaactaaaccgcaaaaataccaaaaccctaaaaaccaaatataaaaaaaccccaaaaactacgatactacgcacgcccctacccgaaat

SEQ ID NO: 28789 - DNA, 737 bp, Artificial Sequence
  chemically treated genomic DNA (Homo sapiens) CpG-island No: 28789
tttttcggattttttttatttttattagtattcggtagttttcgggtttcgggcgttttttttttcggaagcggttttgtagttcgtttttatcgagtttcgttatagcgtggtgtagcgttattacgtggatttttaggattatcgttgttttagggatttagtttcgagtttcgtgttttatgagttggtgattattatcgaattgtcgttgttgcgttcggtcgagtaggcggcgttggaggtaacgagaaagttgttgtgtttcgattcgaggaaatttgattatcggttgcggttttcgttttcgtatttagtggacgatggtcgcggtaaggtataatttaataaggttcggcggtagttggtggttacgttgttagtggtgttgtcggtcgcgcgtcgggagttcgttgtcgtcgtcgtcgtcgtcgcgtcggaagagttcgcggatcggttcggaattgacggttaggtttgcgttttcgttcgcgagggggaggcgggattcgcgaggagtcgcgcggaggacggaggttacgatatttgcgtggttggggttgcgggtttcggggttattattttgggcgattcggaggtggcgttttcgtcggtcgtagttggagaggagcgtgtttttaagtcgggggagtaggatttgagtaggtacgcggggttatcgtcgggtagcgtggaggagttattttttggaggagaaaatttatttggtggcggag

SEQ ID NO: 28790 - DNA, 737 bp, Artificial Sequence
  chemically treated genomic DNA (Homo sapiens) CpG-island No: 28790
ctccgccaccaaataaattttctcctccaaaaaataactcctccacgctacccgacgataaccccgcgtacctactcaaatcctactcccccgacttaaaaacacgctcctctccaactacgaccgacgaaaacgccacctccgaatcgcccaaaataataaccccgaaacccgcaaccccaaccacgcaaatatcgtaacctccgtcctccgcgcgactcctcgcgaatcccgcctccccctcgcgaacgaaaacgcaaacctaaccgtcaattccgaaccgatccgcgaactcttccgacgcgacgacgacgacgacgacaacgaactcccgacgcgcgaccgacaacaccactaacaacgtaaccaccaactaccgccgaaccttattaaattataccttaccgcgaccatcgtccactaaatacgaaaacgaaaaccgcaaccgataatcaaatttcctcgaatcgaaacacaacaactttctcgttacctccaacgccgcctactcgaccgaacgcaacaacgacaattcgataataatcaccaactcataaaacacgaaactcgaaactaaatccctaaaacaacgataatcctaaaaatccacgtaataacgctacaccacgctataacgaaactcgataaaaacgaactacaaaaccgcttccgaaaaaaaaaacgcccgaaacccgaaaactaccgaatactaataaaaataaaaaaaatccgaaaaa

SEQ ID NO: 28791 - DNA, 737 bp, Artificial Sequence
  chemically treated genomic DNA (Homo sapiens) CpG-island No: 28791
tttcgttattaggtgagtttttttttttaggagatggtttttttacgttgttcggcggtgatttcgcgtgtttgtttaagttttgttttttcggtttggggatacgtttttttttagttgcggtcggcggaggcgttattttcgggtcgtttagggtggtgatttcggagttcgtagttttagttacgtaggtatcgtggttttcgtttttcgcgcgatttttcgcgggtttcgtttttttttcgcgagcggaagcgtaggtttggtcgttagtttcggatcggttcgcggattttttcggcgcggcggcggcgacggcgatagcgggttttcggcgcgcggtcggtagtattattggtagcgtaattattagttgtcgtcgggttttgttgaattgtgttttgtcgcggttatcgtttattgggtacgggagcgagagtcgtagtcggtagttaggttttttcgagtcgaggtatagtagttttttcgttatttttagcgtcgtttgttcggtcgagcgtaatagcggtagttcgatggtgattattagtttatggggtacggggttcggggttgagtttttggagtagcggtaattttggaggtttacgtggtggcgttgtattacgttgtagcgaggttcggtgggggcgggttgtaaggtcgttttcggaggggagagcgttcggggttcgggaattgtcgggtattggtaagggtaggggaagttcgggaga

SEQ ID NO: 28792 - DNA, 737 bp, Artificial Sequence
  chemically treated genomic DNA (Homo sapiens) CpG-island No: 28792
tctcccgaacttcccctacccttaccaatacccgacaattcccgaaccccgaacgctctcccctccgaaaacgaccttacaacccgcccccaccgaacctcgctacaacgtaatacaacgccaccacgtaaacctccaaaattaccgctactccaaaaactcaaccccgaaccccgtaccccataaactaataatcaccatcgaactaccgctattacgctcgaccgaacaaacgacgctaaaaataacgaaaaaactactatacctcgactcgaaaaaacctaactaccgactacgactctcgctcccgtacccaataaacgataaccgcgacaaaacacaattcaacaaaacccgacgacaactaataattacgctaccaataatactaccgaccgcgcgccgaaaacccgctatcgccgtcgccgccgccgcgccgaaaaaatccgcgaaccgatccgaaactaacgaccaaacctacgcttccgctcgcgaaaaaaaaacgaaacccgcgaaaaatcgcgcgaaaaacgaaaaccacgatacctacgtaactaaaactacgaactccgaaatcaccaccctaaacgacccgaaaataacgcctccgccgaccgcaactaaaaaaaaacgtatccccaaaccgaaaaaacaaaacttaaacaaacacgcgaaatcaccgccgaacaacgtaaaaaaaccatctcctaaaaaaaaaaactcacctaataacgaaa

SEQ ID NO: 28793 - DNA, 1026 bp, Artificial Sequence
  chemically treated genomic DNA (Homo sapiens) CpG-island No: 28793
gggatcgtcgggattagggaagtcgtcgatacgttggagattttgcggatgtttatagttatagaggggtggtttttatcgcggtcgtcggtatttcgcgcgggttcggcgtttagtaacggtggggcgagggtttcgttttttttttgtcgtttattgttgttttagaggacgaagtcgtaggcggttattacgagcgttaggattagtatttttcgtttgtagatgcggaattttatggtttttagggtcgggagcgtaggcgggcgggcgcggaaaggagtagttgtttttgtacggaaggggcgggcgggcggcggtcgtcgttttggtttgttacggtcggaattggttttcgcggttgttttcgttaatttatttcgggtttcgggggttttggggttcgagattttttatttatttcgcgtcgtttgcgttttatatattttcgtttggtagttatagttcgagtatcggcgtcgcgtttaggagtcgcggttcggtttcgttttcgttttttttatttagtattacgggtttcggaaaaagtttagtcgcggttttaatcgtattttagtttcgttatttgcgtttttagcggttttgcgttttttgcgtttttatttttataggggttttagacggttagaattgagcgacgcggtttcgttttatttcggcggggatcgttatgataattcgtaattgtttcgcggtatatcgcggtttttcggtttatattttttcggttcgttttttagatcgttggttggtgttttttagacgcgatcgaaggcgtttgatcgtcgtggtcggttgtttattggtttgtagtattgtcgtttaggtgtagtttttattttcgtttgtttttttttttttttgttaggcgagagttgcgaaaggcgagagttgcgaagggttaggtgtcgggcgttgtttttcggtaagttaagaacgaggttgtagcggttttaataggagttttttttgtttagaattttgggtaggattaggtttttttag

SEQ ID NO: 28794 - DNA, 1026 bp, Artificial Sequence
  chemically treated genomic DNA (Homo sapiens) CpG-island No: 28794
ctaaaaaaacctaatcctacccaaaattctaaacaaaaaaaactcctattaaaaccgctacaacctcgttcttaacttaccgaaaaacaacgcccgacacctaacccttcgcaactctcgcctttcgcaactctcgcctaacaaaaaaaaaaaaaaacaaacgaaaataaaaactacacctaaacgacaatactacaaaccaataaacaaccgaccacgacgatcaaacgccttcgatcgcgtctaaaaaacaccaaccaacgatctaaaaaacgaaccgaaaaaatataaaccgaaaaaccgcgatataccgcgaaacaattacgaattatcataacgatccccgccgaaataaaacgaaaccgcgtcgctcaattctaaccgtctaaaacccctataaaaataaaaacgcaaaaaacgcaaaaccgctaaaaacgcaaataacgaaactaaaatacgattaaaaccgcgactaaactttttccgaaacccgtaatactaaataaaaaaaacgaaaacgaaaccgaaccgcgactcctaaacgcgacgccgatactcgaactataactaccaaacgaaaatatataaaacgcaaacgacgcgaaataaataaaaaatctcgaaccccaaaacccccgaaacccgaaataaattaacgaaaacaaccgcgaaaaccaattccgaccgtaacaaaccaaaacgacgaccgccgcccgcccgccccttccgtacaaaaacaactactcctttccgcgcccgcccgcctacgctcccgaccctaaaaaccataaaattccgcatctacaaacgaaaaatactaatcctaacgctcgtaataaccgcctacgacttcgtcctctaaaacaacaataaacgacaaaaaaaaaacgaaaccctcgccccaccgttactaaacgccgaacccgcgcgaaataccgacgaccgcgataaaaaccacccctctataactataaacatccgcaaaatctccaacgtatcgacgacttccctaatcccgacgatccc

SEQ ID NO: 28795 - DNA, 1026 bp, Artificial Sequence
  chemically treated genomic DNA (Homo sapiens) CpG-island No: 28795
ttaagaaggtttagttttatttaggattttgagtaagggaggtttttattggagtcgttatagtttcgtttttagtttatcgagaaatagcgttcgatatttggtttttcgtagttttcgtttttcgtagttttcgtttaataggaaagggaagaaataggcggaagtgggaattgtatttgagcgatagtattgtaaattaataggtagtcggttacggcggttaggcgttttcggtcgcgtttggaaagtattaattaacggtttaaggggcgggtcggaggggtgtgggtcggagggtcgcggtgtgtcgcggggtagttgcgggttgttataacggttttcgtcggagtgaggcgaggtcgcgtcgtttagttttggtcgtttagggtttttgtaaggatgagagcgtagaggacgtagggtcgttggaggcgtaggtaacgaagttagggtgcggttgggatcgcggttgagtttttttcgggattcgtggtgttgaatggagaggacggagacgaagtcgagtcgcggtttttaggcgcggcgtcgatgttcgagttgtagttgttaggcgaggatgtgtggagcgtaggcggcgcggggtaaatgagaggtttcgggttttaggattttcggggttcgggatgagttagcgagggtagtcgcgggggttagtttcgatcgtgataggttaaggcgacggtcgtcgttcgttcgtttttttcgtgtagaagtagttgttttttttcgcgttcgttcgtttgcgttttcggttttggagattatgaggtttcgtatttataaacggaaggtgttaattttgacgttcgtggtggtcgtttgcggtttcgttttttggagtagtaatgggcgataaaggaagaacgaggttttcgttttatcgttgttggacgtcgaattcgcgcggggtgtcggcggtcgcggtggggattatttttttgtggttgtgggtattcgtagggtttttaacgtgtcggcggtttttttggtttcggcggtttt

SEQ ID NO: 28796 - DNA, 1026 bp, Artificial Sequence
  chemically treated genomic DNA (Homo sapiens) CpG-island No: 28796
aaaaccgccgaaaccaaaaaaaccgccgacacgttaaaaaccctacgaatacccacaaccacaaaaaaataatccccaccgcgaccgccgacaccccgcgcgaattcgacgtccaacaacgataaaacgaaaacctcgttcttcctttatcgcccattactactccaaaaaacgaaaccgcaaacgaccaccacgaacgtcaaaattaacaccttccgtttataaatacgaaacctcataatctccaaaaccgaaaacgcaaacgaacgaacgcgaaaaaaaacaactacttctacacgaaaaaaacgaacgaacgacgaccgtcgccttaacctatcacgatcgaaactaacccccgcgactaccctcgctaactcatcccgaaccccgaaaatcctaaaacccgaaacctctcatttaccccgcgccgcctacgctccacacatcctcgcctaacaactacaactcgaacatcgacgccgcgcctaaaaaccgcgactcgacttcgtctccgtcctctccattcaacaccacgaatcccgaaaaaaactcaaccgcgatcccaaccgcaccctaacttcgttacctacgcctccaacgaccctacgtcctctacgctctcatccttacaaaaaccctaaacgaccaaaactaaacgacgcgacctcgcctcactccgacgaaaaccgttataacaacccgcaactaccccgcgacacaccgcgaccctccgacccacacccctccgacccgccccttaaaccgttaattaatactttccaaacgcgaccgaaaacgcctaaccgccgtaaccgactacctattaatttacaatactatcgctcaaatacaattcccacttccgcctatttcttccctttcctattaaacgaaaactacgaaaaacgaaaactacgaaaaaccaaatatcgaacgctatttctcgataaactaaaaacgaaactataacgactccaataaaaacctcccttactcaaaatcctaaataaaactaaaccttcttaa

SEQ ID NO: 28797 - DNA, 559 bp, Artificial Sequence
  chemically treated genomic DNA (Homo sapiens) CpG-island No: 28797
ggtcgaagacggtgggtacgtattttttcgggaaggcgtcgttggtatagtttatgagtaggtacgttttgtttatcgtttcgtcgtcgattattacgtatttgagtattagcgcgtcgggttcgtgagttatgatgttgttgtcggtcggttttcgggtatggttttttcggagttttcgtttcggtttcgggtttagttttagttcgtttggagggttcgtcgtcgtcgtcgtcgttttacgtcgcggggtcgttttttcggttttaagtagtaatttttttcgtcggaggggagagggtcgtaggttttcggcgttgtcgtcgtcgcggtcgtcgttcggattttcgtttcggtttcggtcgtcgcgttcgttcgttgttttcgttattcggcgttcgcgtttttttttcgtttcggtttttttaggaggattcgtcggattataagatcggtcggtttcgggggagacggtaattgtggggagggcggtcgatttgtttttttaagttagggagaatattgtgggagaaagaatttattgaatagaattgtagtt

SEQ ID NO: 28798 - DNA, 559 bp, Artificial Sequence
  chemically treated genomic DNA (Homo sapiens) CpG-island No: 28798
aactacaattctattcaataaattctttctcccacaatattctccctaacttaaaaaaacaaatcgaccgccctccccacaattaccgtctcccccgaaaccgaccgatcttataatccgacgaatcctcctaaaaaaaccgaaacgaaaaaaaaacgcgaacgccgaataacgaaaacaacgaacgaacgcgacgaccgaaaccgaaacgaaaatccgaacgacgaccgcgacgacgacaacgccgaaaacctacgaccctctcccctccgacgaaaaaaattactacttaaaaccgaaaaaacgaccccgcgacgtaaaacgacgacgacgacgacgaaccctccaaacgaactaaaactaaacccgaaaccgaaacgaaaactccgaaaaaaccatacccgaaaaccgaccgacaacaacatcataactcacgaacccgacgcgctaatactcaaatacgtaataatcgacgacgaaacgataaacaaaacgtacctactcataaactataccaacgacgccttcccgaaaaaatacgtacccaccgtcttcgacc

SEQ ID NO: 28799 - DNA, 559 bp, Artificial Sequence
  chemically treated genomic DNA (Homo sapiens) CpG-island No: 28799
aattgtagttttgtttagtgaatttttttttttataatattttttttagtttaaaaaagtaggtcggtcgttttttttatagttgtcgtttttttcggggtcggtcggttttatgattcggcggatttttttggggaggtcgggacggggagagggcgcgggcgtcgagtggcgggggtagcgggcgggcgcggcgatcggggtcggggcggggattcgggcggcgatcgcggcggcggtagcgtcgggagtttgcggttttttttttttcggcgaggggagttgttgtttggggtcgggggggcggtttcgcggcgtggagcggcggcgacggcggcggattttttaggcgggttgaggttgagttcggggtcggggcgggggtttcggggggattatgttcggaggtcggtcggtagtagtattatggtttacgggttcggcgcgttgatgtttaagtgcgtggtggtcggcgacggggcggtgggtaagacgtgtttatttatgagttgtgttaacgacgttttttcggaggagtacgtgtttatcgttttcgatt

SEQ ID NO: 28800 - DNA, 559 bp, Artificial Sequence
  chemically treated genomic DNA (Homo sapiens) CpG-island No: 28800
aatcgaaaacgataaacacgtactcctccgaaaaaacgtcgttaacacaactcataaataaacacgtcttacccaccgccccgtcgccgaccaccacgcacttaaacatcaacgcgccgaacccgtaaaccataatactactaccgaccgacctccgaacataatccccccgaaacccccgccccgaccccgaactcaacctcaacccgcctaaaaaatccgccgccgtcgccgccgctccacgccgcgaaaccgcccccccgaccccaaacaacaactcccctcgccgaaaaaaaaaaaaccgcaaactcccgacgctaccgccgccgcgatcgccgcccgaatccccgccccgaccccgatcgccgcgcccgcccgctacccccgccactcgacgcccgcgccctctccccgtcccgacctccccaaaaaaatccgccgaatcataaaaccgaccgaccccgaaaaaaacgacaactataaaaaaaacgaccgacctacttttttaaactaaaaaaaatattataaaaaaaaaaattcactaaacaaaactacaatt

SEQ ID NO: 28801 - DNA, 603 bp, Artificial Sequence
  chemically treated genomic DNA (Homo sapiens) CpG-island No: 28801
gtagttttatttcgtttaacggttataattacgttaagttggttttgaaattttttttttttcgttattcggcgtcgttatcggggttttcgcgtacgcgggttgtttattgatttgtttgtttgttggattggttcgcgattcgggttgttttagtatcgtgtttgtatgaagttcgcgggaaacggtttttttttttttttagtagggtcgggttttcgtcgtggttgcgtatcgggattgattatttggattcgggttcgcgttcgggaaatcggtagtcggcgggggcgtaacgttttttttttcgagcgcgtagttggtagcggtggttgtttttgttcggggaggatttcgagggttttagttgttgacgttttacgcgttgcgggcgtacgtcgggtcgttgtttttcgagggaaggtaggtgtgtttttgcgttatagggaaaggtatttagaattgtttgagtggtttcgtaagttagcgagggcgtatttttcggcgcggacgggttgttggtggttttggtggttgtttttcggaggtatatttggtacgtcgaaggggggttttatatggttgtatttgatttggtaattt

SEQ ID NO: 28802 - DNA, 603 bp, Artificial Sequence
  chemically treated genomic DNA (Homo sapiens) CpG-island No: 28802
aaattaccaaatcaaatacaaccatataaaaccccccttcgacgtaccaaatatacctccgaaaaacaaccaccaaaaccaccaacaacccgtccgcgccgaaaaatacgccctcgctaacttacgaaaccactcaaacaattctaaatacctttccctataacgcaaaaacacacctaccttccctcgaaaaacaacgacccgacgtacgcccgcaacgcgtaaaacgtcaacaactaaaaccctcgaaatcctccccgaacaaaaacaaccaccgctaccaactacgcgctcgaaaaaaaaaacgttacgcccccgccgactaccgatttcccgaacgcgaacccgaatccaaataatcaatcccgatacgcaaccacgacgaaaacccgaccctactaaaaaaaaaaaaaaaccgtttcccgcgaacttcatacaaacacgatactaaaacaacccgaatcgcgaaccaatccaacaaacaaacaaatcaataaacaacccgcgtacgcgaaaaccccgataacgacgccgaataacgaaaaaaaaaaaatttcaaaaccaacttaacgtaattataaccgttaaacgaaataaaactac

SEQ ID NO: 28803 - DNA, 603 bp, Artificial Sequence
  chemically treated genomic DNA (Homo sapiens) CpG-island No: 28803
gaattgttaagttaaatatagttatataaagttttttttcgacgtgttaggtgtgttttcggagagtagttattaaaattattagtagttcgttcgcgtcgggaaatgcgttttcgttggtttacggggttatttagatagttttaagtgtttttttttgtaacgtagaggtatatttgttttttttcgggaaatagcggttcgacgtgcgttcgtaacgcgtaaagcgttaatagttgaaattttcggaatttttttcgaatagaaataattatcgttgttagttgcgcgttcgggggaaaagacgttgcgttttcgtcgattgtcggtttttcgggcgcgagttcggatttaggtggttagtttcggtacgtaattacggcgagaattcggttttgttaagggagaagggaagtcgtttttcgcgggttttatatagatacggtgttaagatagttcgagtcgcggattagtttaataggtaggtagattagtgggtagttcgcgtgcgcgaggatttcgatggcggcgtcgggtggcgggaaggaggaagttttaaagttagtttgacgtggttgtggtcgttgggcgagatgaagttat

SEQ ID NO: 28804 - DNA, 603 bp, Artificial Sequence
  chemically treated genomic DNA (Homo sapiens) CpG-island No: 28804
ataacttcatctcgcccaacgaccacaaccacgtcaaactaactttaaaacttcctccttcccgccacccgacgccgccatcgaaatcctcgcgcacgcgaactacccactaatctacctacctattaaactaatccgcgactcgaactatcttaacaccgtatctatataaaacccgcgaaaaacgacttcccttctcccttaacaaaaccgaattctcgccgtaattacgtaccgaaactaaccacctaaatccgaactcgcgcccgaaaaaccgacaatcgacgaaaacgcaacgtcttttcccccgaacgcgcaactaacaacgataattatttctattcgaaaaaaattccgaaaatttcaactattaacgctttacgcgttacgaacgcacgtcgaaccgctatttcccgaaaaaaaacaaatatacctctacgttacaaaaaaaaacacttaaaactatctaaataaccccgtaaaccaacgaaaacgcatttcccgacgcgaacgaactactaataattttaataactactctccgaaaacacacctaacacgtcgaaaaaaaactttatataactatatttaacttaacaattc

SEQ ID NO: 28805 - DNA, 566 bp, Artificial Sequence
  chemically treated genomic DNA (Homo sapiens) CpG-island No: 28805
agatggtcgcggacgaagggtatcgtttgtaaagtattgaattattagggttttttttgtaggtcgaaggtttgcgcgaatgtcggttagttattatggagatcggttcgcggtattttagtatgtttcgggattaaattgtttaattgtgagtattttcgacggtcgttttttgatgacgtatacggaagtatcgataggttttgtttttcgaagaaaagggagtcgcgtagcgtttacgggagttcggcggtagtagtcggtatcggtaattacgggtagtttttagggaattttcgtcgtgaggttagaggttttagttttcgcggtgcgtatcgttatgtatggtttttggttcgtttttttcggttagtcgagtagggtcggtataattttttttttcgaggtcgaagtagagatttaatcggtttgacgcgtgttgggttgcgggcgagttagtgatatttcggttcgtttcggcgtatttagaagggagcgggaggttttttgggcgttgcggagaagttggattgatttttgcgagagtggggagggtttgttttttt

SEQ ID NO: 28806 - DNA, 566 bp, Artificial Sequence
  chemically treated genomic DNA (Homo sapiens) CpG-island No: 28806
aaaaaaacaaaccctccccactctcgcaaaaatcaatccaacttctccgcaacgcccaaaaaacctcccgctcccttctaaatacgccgaaacgaaccgaaatatcactaactcgcccgcaacccaacacgcgtcaaaccgattaaatctctacttcgacctcgaaaaaaaaaattataccgaccctactcgactaaccgaaaaaaacgaaccaaaaaccatacataacgatacgcaccgcgaaaactaaaacctctaacctcacgacgaaaattccctaaaaactacccgtaattaccgataccgactactaccgccgaactcccgtaaacgctacgcgactcccttttcttcgaaaaacaaaacctatcgatacttccgtatacgtcatcaaaaaacgaccgtcgaaaatactcacaattaaacaatttaatcccgaaacatactaaaataccgcgaaccgatctccataataactaaccgacattcgcgcaaaccttcgacctacaaaaaaaaccctaataattcaatactttacaaacgatacccttcgtccgcgaccatct

SEQ ID NO: 28807 - DNA, 566 bp, Artificial Sequence
  chemically treated genomic DNA (Homo sapiens) CpG-island No: 28807
gggaaggtagattttttttattttcgtagaggttaatttagttttttcgtagcgtttagggggtttttcgtttttttttagatgcgtcggagcgggtcggaatattattggttcgttcgtagtttagtacgcgttaggtcggttaaatttttgtttcggtttcggaggaggaggttgtgtcggttttgttcgattaatcggagagggcgaattaaaagttatgtatgacgatacgtatcgcggggattggagtttttggttttacgacggagattttttgagagttgttcgtggttgtcggtatcggttgttgtcgtcggattttcgtaggcgttgcgcggttttttttttttcgggaggtagagtttatcggtgttttcgtgtgcgttattaggaggcgatcgtcggggatgtttatagttggatagtttggtttcgaggtatgttgggatatcgcgggtcggtttttatagtaattggtcgatattcgcgtaggttttcggtttgtagggaaggttttgatggtttagtgttttgtagacggtgtttttcgttcgcggttattt

SEQ ID NO: 28808 - DNA, 566 bp, Artificial Sequence
  chemically treated genomic DNA (Homo sapiens) CpG-island No: 28808
aaataaccgcgaacgaaaaacaccgtctacaaaacactaaaccatcaaaaccttccctacaaaccgaaaacctacgcgaatatcgaccaattactataaaaaccgacccgcgatatcccaacatacctcgaaaccaaactatccaactataaacatccccgacgatcgcctcctaataacgcacacgaaaacaccgataaactctacctcccgaaaaaaaaaaaaccgcgcaacgcctacgaaaatccgacgacaacaaccgataccgacaaccacgaacaactctcaaaaaatctccgtcgtaaaaccaaaaactccaatccccgcgatacgtatcgtcatacataacttttaattcgccctctccgattaatcgaacaaaaccgacacaacctcctcctccgaaaccgaaacaaaaatttaaccgacctaacgcgtactaaactacgaacgaaccaataatattccgacccgctccgacgcatctaaaaaaaaacgaaaaaccccctaaacgctacgaaaaaactaaattaacctctacgaaaataaaaaaaatctaccttccc

SEQ ID NO: 28809 - DNA, 611 bp, Artificial Sequence
  chemically treated genomic DNA (Homo sapiens) CpG-island No: 28809
  misc_feature (3)..(3): n is either a, c, g or t
  misc_feature (15)..(15): n is either a, c, g or t
  misc_feature (29)..(31): n is either a, c, g or t
  misc_feature (36)..(38): n is either a, c, g or t
  misc_feature (41)..(45): n is either a, c, g or t
  misc_feature (111)..(113): n is either a, c, g or t
  misc_feature (404)..(409): n is either a, c, g or t
  misc_feature (588)..(588): n is either a, c, g or t
agntcgttttttttntttagcgagtattnnnggagnnntgnnnnnggagagtttgtagagtttttcgattatcggtcgtaaacgtttttgggagcgtagtttgttgcgagnnncgaagggtgagacgtacggcgttttcgagttttcggcgagggtgtttgggacgcgtttttttttgcggttgcggcggcgtatagatttcggtcgagcgaggcgacgtgaggagaggtggttataggtttaagttatggcgtagaggaggggtcgggcggtgtggtcgtagggttcgcggatcgggttcgagttttttttttgtcggcgttttagtgtagtcggttatttagtagggttgggaggttattatttttagcggagatcgagtattgttgttttcgtcgttgttnnnnnnggatgtcgtagtcgtcgtcgttatcgtttttttttttgggaagcgattttatttttttttgtagttttcggttttcgtcgttgttcgcgaatgatgttgtagtcgttgtcgtcgtcgtttttgtttttgttgtagggaagcggttttatttttttatgttgtttagtagtgagaaaaanatttaggaacgatgttgattgaa

SEQ ID NO: 28810 - DNA, 611 bp, Artificial Sequence
  chemically treated genomic DNA (Homo sapiens) CpG-island No: 28810
  misc_feature (24)..(24): n is either a, c, g or t
  misc_feature (203)..(208): n is either a, c, g or t
  misc_feature (499)..(501): n is either a, c, g or t
  misc_feature (567)..(571): n is either a, c, g or t
  misc_feature (574)..(576): n is either a, c, g or t
  misc_feature (581)..(583): n is either a, c, g or t
  misc_feature (597)..(597): n is either a, c, g or t
  misc_feature (609)..(609): n is either a, c, g or t
ttcaatcaacatcgttcctaaatntttttctcactactaaacaacataaaaaaataaaaccgcttccctacaacaaaaacaaaaacgacgacgacaacgactacaacatcattcgcgaacaacgacgaaaaccgaaaactacaaaaaaaaataaaatcgcttcccaaaaaaaaaaacgataacgacgacgactacgacatccnnnnnnaacaacgacgaaaacaacaatactcgatctccgctaaaaataataacctcccaaccctactaaataaccgactacactaaaacgccgacaaaaaaaaaactcgaacccgatccgcgaaccctacgaccacaccgcccgacccctcctctacgccataacttaaacctataaccacctctcctcacgtcgcctcgctcgaccgaaatctatacgccgccgcaaccgcaaaaaaaaacgcgtcccaaacaccctcgccgaaaactcgaaaacgccgtacgtctcacccttcgnnnctcgcaacaaactacgctcccaaaaacgtttacgaccgataatcgaaaaactctacaaactctccnnnnncannnctccnnnaatactcgctaaanaaaaaaaacganct

SEQ ID NO: 28811 - DNA, 611 bp, Artificial Sequence
  chemically treated genomic DNA (Homo sapiens) CpG-island No: 28811
  misc_feature (24)..(24): n is either a, c, g or t
  misc_feature (203)..(208): n is either a, c, g or t
  misc_feature (499)..(501): n is either a, c, g or t
  misc_feature (567)..(571): n is either a, c, g or t
  misc_feature (574)..(576): n is either a, c, g or t
  misc_feature (581)..(583): n is either a, c, g or t
  misc_feature (597)..(597): n is either a, c, g or t
  misc_feature (609)..(609): n is either a, c, g or t
tttagttagtatcgtttttggatnttttttttattgttgagtagtataaaagggtggggtcgtttttttgtagtagaggtagaggcggcggcggtagcggttgtagtattattcgcgggtagcggcggagatcgagagttgtagaaaagggtggggtcgttttttaggagaagaggcggtggcggcggcggttgcggtatttnnnnnnggtagcggcggaggtagtaatgttcggttttcgttggaggtgatggttttttagttttgttaggtggtcggttgtattaggacgtcggtaggaaggagattcgagttcggttcgcggattttgcggttatatcgttcggttttttttttgcgttatggtttaagtttgtagttatttttttttacgtcgtttcgttcgatcgaggtttgtgcgtcgtcgtagtcgtagggaggggcgcgttttagatattttcgtcggggattcgggaacgtcgtgcgttttatttttcgnnnttcgtagtagattgcgtttttaaaggcgtttgcgatcggtaatcgagggattttatagattttttnnnnntannnttttnnnggtgttcgttgagngaggagggcgantt

SEQ ID NO: 28812 - DNA, 611 bp, Artificial Sequence
  chemically treated genomic DNA (Homo sapiens) CpG-island No: 28812
  misc_feature (3)..(3): n is either a, c, g or t
  misc_feature (15)..(15): n is either a, c, g or t
  misc_feature (29)..(31): n is either a, c, g or t
  misc_feature (36)..(38): n is either a, c, g or t
  misc_feature (41)..(45): n is either a, c, g or t
  misc_feature (111)..(113): n is either a, c, g or t
  misc_feature (404)..(409): n is either a, c, g or t
  misc_feature (588)..(588): n is either a, c, g or t
aantcgccctcctcnctcaacgaacaccnnnaaaannntannnnnaaaaaatctataaaatccctcgattaccgatcgcaaacgcctttaaaaacgcaatctactacgaannncgaaaaataaaacgcacgacgttcccgaatccccgacgaaaatatctaaaacgcgcccctccctacgactacgacgacgcacaaacctcgatcgaacgaaacgacgtaaaaaaaaataactacaaacttaaaccataacgcaaaaaaaaaaccgaacgatataaccgcaaaatccgcgaaccgaactcgaatctccttcctaccgacgtcctaatacaaccgaccacctaacaaaactaaaaaaccatcacctccaacgaaaaccgaacattactacctccgccgctaccnnnnnnaaataccgcaaccgccgccgccaccgcctcttctcctaaaaaacgaccccacccttttctacaactctcgatctccgccgctacccgcgaataatactacaaccgctaccgccgccgcctctacctctactacaaaaaaacgaccccacccttttatactactcaacaataaaaaaaanatccaaaaacgatactaactaaa

SEQ ID NO: 28813 - DNA, 562 bp, Artificial Sequence
  chemically treated genomic DNA (Homo sapiens) CpG-island No: 28813
attttggcgagtatgcgtagatcgttcgcgtacgtcgtcgttcgttgagagtaagcgtaacgggcgttttcgtttgtgacgttagggagcgtgaggacgtggggttttcgtgaatgcgtagtgggtgcgtcggttacgattttttggttaggttagggagggggcgacgttgagatgggggcggcggcggcggaagcggatcgtattttttttgtgggtaattttgaaacgaaagtgatcgaggagttttttttcgagtttttttattaggtaagcggttgggttcggttttttgtttttcgtttttcgtttcgtttagggtttggttagcggttatttcgtttttttttcgtagtcgttaggggattcgacgggtggttgtttgggggtgaaaggcgggtttgggttgcgaaacgttcgttgggtgtcgtttttttggaagattttggttcgtttaggtcgaaagtgacgattaaaggtggtggagggattttcgattaggtttttcgtggtagagatttaggggtttttgggaatatagtgtgtgtgtagggttttcgtt

SEQ ID NO: 28814 - DNA, 562 bp, Artificial Sequence
  chemically treated genomic DNA (Homo sapiens) CpG-island No: 28814
aacgaaaaccctacacacacactatattcccaaaaacccctaaatctctaccacgaaaaacctaatcgaaaatccctccaccacctttaatcgtcactttcgacctaaacgaaccaaaatcttccaaaaaaacgacacccaacgaacgtttcgcaacccaaacccgcctttcacccccaaacaaccacccgtcgaatcccctaacgactacgaaaaaaaaacgaaataaccgctaaccaaaccctaaacgaaacgaaaaacgaaaaacaaaaaaccgaacccaaccgcttacctaataaaaaaactcgaaaaaaaactcctcgatcactttcgtttcaaaattacccacaaaaaaaatacgatccgcttccgccgccgccgcccccatctcaacgtcgccccctccctaacctaaccaaaaaatcgtaaccgacgcacccactacgcattcacgaaaaccccacgtcctcacgctccctaacgtcacaaacgaaaacgcccgttacgcttactctcaacgaacgacgacgtacgcgaacgatctacgcatactcgccaaaat

SEQ ID NO: 28815 - DNA, 562 bp, Artificial Sequence
  chemically treated genomic DNA (Homo sapiens) CpG-island No: 28815
aacgaagattttatatatatattgtgtttttaaggatttttggatttttattacgggaaatttgatcgaggatttttttattatttttagtcgttattttcggtttaaacgaattaagattttttaggaaagcgatatttagcgagcgtttcgtaatttagattcgttttttatttttaaatagttattcgtcgggttttttgacggttacgaaaagaaaacggggtggtcgttggttaggttttaggcgagacggaaaacgaaaggtaaagggtcgaatttagtcgtttatttggtggaaaagttcgaaaaggagtttttcggttattttcgttttaaggttgtttataaagagagtgcgattcgttttcgtcgtcgtcgtttttattttagcgtcgttttttttttaatttggttaaaaggtcgtggtcgacgtatttattgcgtatttacggaagttttacgtttttacgttttttggcgttataaacgaaaacgttcgttgcgtttgtttttagcgggcgacgacgtgcgcggacggtttgcgtatgttcgttaggat

SEQ ID NO: 28816 - DNA, 562 bp, Artificial Sequence
  chemically treated genomic DNA (Homo sapiens) CpG-island No: 28816
atcctaacgaacatacgcaaaccgtccgcgcacgtcgtcgcccgctaaaaacaaacgcaacgaacgttttcgtttataacgccaaaaaacgtaaaaacgtaaaacttccgtaaatacgcaataaatacgtcgaccacgaccttttaaccaaattaaaaaaaaaacgacgctaaaataaaaacgacgacgacgaaaacgaatcgcactctctttataaacaaccttaaaacgaaaataaccgaaaaactccttttcgaacttttccaccaaataaacgactaaattcgaccctttacctttcgttttccgtctcgcctaaaacctaaccaacgaccaccccgttttcttttcgtaaccgtcaaaaaacccgacgaataactatttaaaaataaaaaacgaatctaaattacgaaacgctcgctaaatatcgctttcctaaaaaatcttaattcgtttaaaccgaaaataacgactaaaaataataaaaaaatcctcgatcaaatttcccgtaataaaaatccaaaaatccttaaaaacacaatatatatataaaatcttcgtt

SEQ ID NO: 28817 - DNA, 562 bp, Artificial Sequence
  chemically treated genomic DNA (Homo sapiens) CpG-island No: 28817
ttcgtttttcgttcgtttttgttttacgaggttttcggaatacggtttagaattatagagaaaatatattgcgtacgcgtattttttcgttatcgttgtgcggtttttgtttggttggttagttcgttttaattttcgatttatagggttgcggagtagtaatttttacgatatttgttgcgattcgtaggcgttattcgttgtcgggttttggcgcgtttttttagttttgtttgttgtcggtatcgttgcgttattcggaatcgtcgggtcgaatagtatgacgttcgttttggagaattatattaatcgtatttttaagttggtcgtcgcgggcgtgagtcggggtcgcggagaggtcgcggtcggggatcggtgggaggttgggaggtttggtttcggcgggattttgggggcgggcgaggagatgagggtttcggaacgatttagagttcgtcggcggcgtttcgagttttttcgttgttgcgggtttaggggttttttttattttgtttgtaaaatttaaataaaaatttagtgtgattatttcgaatttttttgt

SEQ ID NO: 28818 - DNA, 562 bp, Artificial Sequence
  chemically treated genomic DNA (Homo sapiens) CpG-island No: 28818
acaaaaaaattcgaaataatcacactaaatttttatttaaattttacaaacaaaataaaaaaaacccctaaacccgcaacaacgaaaaaactcgaaacgccgccgacgaactctaaatcgttccgaaaccctcatctcctcgcccgcccccaaaatcccgccgaaaccaaacctcccaacctcccaccgatccccgaccgcgacctctccgcgaccccgactcacgcccgcgacgaccaacttaaaaatacgattaatataattctccaaaacgaacgtcatactattcgacccgacgattccgaataacgcaacgataccgacaacaaacaaaactaaaaaaacgcgccaaaacccgacaacgaataacgcctacgaatcgcaacaaatatcgtaaaaattactactccgcaaccctataaatcgaaaattaaaacgaactaaccaaccaaacaaaaaccgcacaacgataacgaaaaaatacgcgtacgcaatatattttctctataattctaaaccgtattccgaaaacctcgtaaaacaaaaacgaacgaaaaacgaa

SEQ ID NO: 28819 - DNA, 562 bp, Artificial Sequence
  chemically treated genomic DNA (Homo sapiens) CpG-island No: 28819
atagaaaagttcggaataattatattgggtttttatttgggttttgtaggtaaaatggaaaggatttttgggttcgtagtagcgggaaggttcgaggcgtcgtcggcgaattttgggtcgtttcggggtttttattttttcgttcgtttttaggatttcgtcgaggttaggttttttaattttttatcgattttcgatcgcggttttttcgcgatttcggtttacgttcgcggcggttagtttgaggatacggttgatgtagttttttaaagcggacgttatgttgttcggttcggcggtttcgggtaacgtagcggtgtcgatagtaagtagaattgaaagggcgcgttagaattcggtagcggatagcgtttgcgggtcgtagtaaatatcgtgagagttgttgtttcgtagttttgtgagtcggaaattgggacgaattggttaattaaatagaagtcgtatagcggtgacgagagagtgcgcgtgcgtagtgtgttttttttgtaattttgggtcgtgtttcggaagtttcgtaagataaaagcgaacgagaggcgga

SEQ ID NO: 28820 - DNA, 562 bp, Artificial Sequence
  chemically treated genomic DNA (Homo sapiens) CpG-island No: 28820
tccgcctctcgttcgcttttatcttacgaaacttccgaaacacgacccaaaattacaaaaaaaacacactacgcacgcgcactctctcgtcaccgctatacgacttctatttaattaaccaattcgtcccaatttccgactcacaaaactacgaaacaacaactctcacgatatttactacgacccgcaaacgctatccgctaccgaattctaacgcgccctttcaattctacttactatcgacaccgctacgttacccgaaaccgccgaaccgaacaacataacgtccgctttaaaaaactacatcaaccgtatcctcaaactaaccgccgcgaacgtaaaccgaaatcgcgaaaaaaccgcgatcgaaaatcgataaaaaattaaaaaacctaacctcgacgaaatcctaaaaacgaacgaaaaaataaaaaccccgaaacgacccaaaattcgccgacgacgcctcgaaccttcccgctactacgaacccaaaaatcctttccattttacctacaaaacccaaataaaaacccaatataattattccgaacttttctat

SEQ ID NO: 28821 - DNA, 758 bp, Artificial Sequence
  chemically treated genomic DNA (Homo sapiens) CpG-island No: 28821
gtttcggacgtttggacgggcgaggattcggcggagtttaattttgattcggcggagtggattcgagatatgtacgttaaggttacggagatttggtaggaggttatgtagcggcgggacgacgacggcgcgttttacgtcgtttgttaggtgtagtcgtcggttacgttggacgtcgcgtagtttcgggtgatcggcgtcgttttttttcggtagtttgcgtttcgcgttaagttcgacgtttttttcgttttggagggtttttcgatcgagtcgaatagttttagtcgcgttatttacgtgtattagttcggggatttgagttagggttgcgagtttatcgggttttattataattcgttggtcgtgtcgtattcgtagtattcgggcgatttcggtaatttcgcggttcgcgacggtagtttttggaggtatcgcgtcggtttggtcgtttcgttcgcgggttcgtattttatcgtgggtcgggtcgtggtcgtttacgttggcgaggacgatttgggtcgcggcggtaattaggttagcgtggagaacgggaacgcgggtcggcggttggtttgttgcgtggtgggcgtgtgcgggttcgggttttgggagcgttaggcgcgggagtatttagagcgtaagaagcggcggcgcgagagcgagtgtaaggtcgtttgagcgcggtttttattcggcggcggttagggattttcgaggtttttttttgtttttgagttttttttttgttttaatag

SEQ ID NO: 28822 - DNA, 758 bp, Artificial Sequence
  chemically treated genomic DNA (Homo sapiens) CpG-island No: 28822
ctattaaaacaaaaaaaaaactcaaaaacaaaaaaaaacctcgaaaatccctaaccgccgccgaataaaaaccgcgctcaaacgaccttacactcgctctcgcgccgccgcttcttacgctctaaatactcccgcgcctaacgctcccaaaacccgaacccgcacacgcccaccacgcaacaaaccaaccgccgacccgcgttcccgttctccacgctaacctaattaccgccgcgacccaaatcgtcctcgccaacgtaaacgaccacgacccgacccacgataaaatacgaacccgcgaacgaaacgaccaaaccgacgcgatacctccaaaaactaccgtcgcgaaccgcgaaattaccgaaatcgcccgaatactacgaatacgacacgaccaacgaattataataaaacccgataaactcgcaaccctaactcaaatccccgaactaatacacgtaaataacgcgactaaaactattcgactcgatcgaaaaaccctccaaaacgaaaaaaacgtcgaacttaacgcgaaacgcaaactaccgaaaaaaaacgacgccgatcacccgaaactacgcgacgtccaacgtaaccgacgactacacctaacaaacgacgtaaaacgcgccgtcgtcgtcccgccgctacataacctcctaccaaatctccgtaaccttaacgtacatatctcgaatccactccgccgaatcaaaattaaactccgccgaatcctcgcccgtccaaacgtccgaaac

SEQ ID NO: 28823 - DNA, 758 bp, Artificial Sequence
  chemically treated genomic DNA (Homo sapiens) CpG-island No: 28823
ttgttggagtagaggagaagtttaaaggtagaggggggtttcgggggtttttggtcgtcgtcgggtgggggtcgcgtttaggcggttttgtattcgttttcgcgtcgtcgttttttgcgttttgagtgttttcgcgtttggcgtttttagagttcgggttcgtatacgtttattacgtagtaggttagtcgtcggttcgcgttttcgttttttacgttggtttggttgtcgtcgcggtttaggtcgttttcgttagcgtggacgattacggttcggtttacgatggagtgcgggttcgcgagcgaggcggttaggtcggcgcggtatttttagaggttgtcgtcgcggatcgcgaagttgtcgaagtcgttcgggtgttgcgggtgcggtacggttagcgggttgtagtggggttcggtggattcgtagttttggtttaggttttcgaattggtgtacgtggatggcgcggttggagttgttcggttcggtcgggaagttttttagggcgaagaaggcgtcgagtttggcgcggggcgtaagttgtcggaagaggacgacgtcggttattcggggttgcgcggcgtttagcgtggtcgacggttgtatttggtaggcggcgtggagcgcgtcgtcgtcgtttcgtcgttgtatgattttttgttagattttcgtgattttggcgtatatgtttcggatttatttcgtcgagttagagttgggtttcgtcgagttttcgttcgtttaggcgttcgaggt

SEQ ID NO: 28824 - DNA, 758 bp, Artificial Sequence
  chemically treated genomic DNA (Homo sapiens) CpG-island No: 28824
acctcgaacgcctaaacgaacgaaaactcgacgaaacccaactctaactcgacgaaataaatccgaaacatatacgccaaaatcacgaaaatctaacaaaaaatcatacaacgacgaaacgacgacgacgcgctccacgccgcctaccaaatacaaccgtcgaccacgctaaacgccgcgcaaccccgaataaccgacgtcgtcctcttccgacaacttacgccccgcgccaaactcgacgccttcttcgccctaaaaaacttcccgaccgaaccgaacaactccaaccgcgccatccacgtacaccaattcgaaaacctaaaccaaaactacgaatccaccgaaccccactacaacccgctaaccgtaccgcacccgcaacacccgaacgacttcgacaacttcgcgatccgcgacgacaacctctaaaaataccgcgccgacctaaccgcctcgctcgcgaacccgcactccatcgtaaaccgaaccgtaatcgtccacgctaacgaaaacgacctaaaccgcgacgacaaccaaaccaacgtaaaaaacgaaaacgcgaaccgacgactaacctactacgtaataaacgtatacgaacccgaactctaaaaacgccaaacgcgaaaacactcaaaacgcaaaaaacgacgacgcgaaaacgaatacaaaaccgcctaaacgcgacccccacccgacgacgaccaaaaacccccgaaacccccctctacctttaaacttctcctctactccaacaa

SEQ ID NO: 28825 - DNA, 1045 bp, Artificial Sequence
  chemically treated genomic DNA (Homo sapiens) CpG-island No: 28825
ttttgtatatattagttcgtttgtttcggatcgtcgcggtgttgagttcggagttgacgttttcgagtcgttagtaagcggaaaattcggagtggatttttacgttttttggatcggagttaaagggtatttcggaggaggtggtcggttttgcggttttgttcggtgttaggtcgcggttatcgggggagtacgggttgggggtgggtcgcgtagcggagtcggattttttggtcggacgagttcggtcgtggggttcggcggtttttttcgcggggattgcgaggcgggcggggcgcggggcggcggtcgtgttttcggggcggtttcgggcggcggcgggcgcgggtgtagtgcggcgcgcggtcggtagcgggcgtaggcggtggttgtggtcgcggcgttcggcggttggcgggcggcgtcggcggtgtttcgggcgcgtttatatacgcgtttatatatatatatatatacggtttcgtatatatatatacgtttcggcgcgtatacgcggcgcgtaggtcggagggaggcggttcggcgttgttcggcggcggcggtagcgtgtttcgcgggcgggcgggagggttggcgggcggttttcgtttttcggtttcgcggttaggtgtagttcgttcggttttcgttttcggattcgttttcgggggtcgttcggttttatgtttagcggcggcggcggagtagcgcgcggtcgcgggcggttttgaggagttcggagggaatcggcgacgaggggattatgtatcgggattcggaggcggttagtttaggtaagcgcggtttcggcgggttggggcgtttcgtatcggcgggtaggatagcggtagcgtcggacgtcgtttcggagttttagtttggggttgttgttcgttcggagtcgtacgggtttttttaggggttattttagtttcgggggcgcgggatcgagcggtagcggttcggatttcggtttttcgtagtttggatattgttaggttggatgtttgggatcggtttcgtagtgtttttataaggatttttt

SEQ ID NO: 28826 - DNA, 1045 bp, Artificial Sequence
  chemically treated genomic DNA (Homo sapiens) CpG-island No: 28826
aaaaaatccttataaaaacactacgaaaccgatcccaaacatccaacctaacaatatccaaactacgaaaaaccgaaatccgaaccgctaccgctcgatcccgcgcccccgaaactaaaataacccctaaaaaaacccgtacgactccgaacgaacaacaaccccaaactaaaactccgaaacgacgtccgacgctaccgctatcctacccgccgatacgaaacgccccaacccgccgaaaccgcgcttacctaaactaaccgcctccgaatcccgatacataatcccctcgtcgccgattccctccgaactcctcaaaaccgcccgcgaccgcgcgctactccgccgccgccgctaaacataaaaccgaacgacccccgaaaacgaatccgaaaacgaaaaccgaacgaactacacctaaccgcgaaaccgaaaaacgaaaaccgcccgccaaccctcccgcccgcccgcgaaacacgctaccgccgccgccgaacaacgccgaaccgcctccctccgacctacgcgccgcgtatacgcgccgaaacgtatatatatatacgaaaccgtatatatatatatatataaacgcgtatataaacgcgcccgaaacaccgccgacgccgcccgccaaccgccgaacgccgcgaccacaaccaccgcctacgcccgctaccgaccgcgcgccgcactacacccgcgcccgccgccgcccgaaaccgccccgaaaacacgaccgccgccccgcgccccgcccgcctcgcaatccccgcgaaaaaaaccgccgaaccccacgaccgaactcgtccgaccaaaaaatccgactccgctacgcgacccacccccaacccgtactcccccgataaccgcgacctaacaccgaacaaaaccgcaaaaccgaccacctcctccgaaataccctttaactccgatccaaaaaacgtaaaaatccactccgaattttccgcttactaacgactcgaaaacgtcaactccgaactcaacaccgcgacgatccgaaacaaacgaactaatatatacaaaa

SEQ ID NO: 28827 - DNA, 1045 bp, Artificial Sequence
  chemically treated genomic DNA (Homo sapiens) CpG-island No: 28827
gagaggtttttgtggggatattgcgaagtcggttttagatatttagtttggtagtgtttagattgcgggggatcggggttcgagtcgttgtcgttcgatttcgcgttttcggggttgggatgatttttgggggagttcgtgcggtttcgggcggataatagttttaggttggggtttcgagacggcgttcggcgttgtcgttgttttgttcgtcggtgcggggcgttttagttcgtcggggtcgcgtttatttgggttggtcgttttcgggtttcggtatatggttttttcgtcgtcggtttttttcgggttttttagagtcgttcgcggtcgcgcgttgtttcgtcgtcgtcgttgggtatggggtcgggcgattttcgggggcgggttcgagggcgggggtcgagcgggttgtatttagtcgcggagtcggggagcgggggtcgttcgttagttttttcgttcgttcgcggagtacgttgtcgtcgtcgtcgaatagcgtcgagtcgttttttttcggtttgcgcgtcgcgtgtgcgcgtcggagcgtgtgtgtgtgtacgaggtcgtgtgtatgtgtgtgtgtgagcgcgtgtgtgagcgcgttcggggtatcgtcggcgtcgttcgttagtcgtcgaacgtcgcggttatagttatcgtttgcgttcgttgtcggtcgcgcgtcgtattgtattcgcgttcgtcgtcgttcgaagtcgtttcgagggtacggtcgtcgtttcgcgtttcgttcgtttcgtagttttcgcggggagggtcgtcgagttttacggtcgggttcgttcggttaggggattcggtttcgttgcgcgatttatttttagttcgtgttttttcgatggtcgcggtttggtatcgggtagggtcgtagagtcggttatttttttcgaggtgttttttggtttcgatttaaaaggcgtggagatttatttcgggtttttcgtttgttggcggttcgagggcgttagtttcggatttaatatcgcggcggttcggggtagacggattggtgtgtgtaaaa

SEQ ID NO: 28828 - DNA, 1045 bp, Artificial Sequence
  chemically treated genomic DNA (Homo sapiens) CpG-island No: 28828
ttttacacacaccaatccgtctaccccgaaccgccgcgatattaaatccgaaactaacgccctcgaaccgccaacaaacgaaaaacccgaaataaatctccacgccttttaaatcgaaaccaaaaaacacctcgaaaaaaataaccgactctacgaccctacccgataccaaaccgcgaccatcgaaaaaacacgaactaaaaataaatcgcgcaacgaaaccgaatcccctaaccgaacgaacccgaccgtaaaactcgacgaccctccccgcgaaaactacgaaacgaacgaaacgcgaaacgacgaccgtaccctcgaaacgacttcgaacgacgacgaacgcgaatacaatacgacgcgcgaccgacaacgaacgcaaacgataactataaccgcgacgttcgacgactaacgaacgacgccgacgataccccgaacgcgctcacacacgcgctcacacacacacatacacacgacctcgtacacacacacacgctccgacgcgcacacgcgacgcgcaaaccgaaaaaaaacgactcgacgctattcgacgacgacgacaacgtactccgcgaacgaacgaaaaaactaacgaacgacccccgctccccgactccgcgactaaatacaacccgctcgacccccgccctcgaacccgcccccgaaaatcgcccgaccccatacccaacgacgacgacgaaacaacgcgcgaccgcgaacgactctaaaaaacccgaaaaaaaccgacgacgaaaaaaccatataccgaaacccgaaaacgaccaacccaaataaacgcgaccccgacgaactaaaacgccccgcaccgacgaacaaaacaacgacaacgccgaacgccgtctcgaaaccccaacctaaaactattatccgcccgaaaccgcacgaactcccccaaaaatcatcccaaccccgaaaacgcgaaatcgaacgacaacgactcgaaccccgatcccccgcaatctaaacactaccaaactaaatatctaaaaccgacttcgcaatatccccacaaaaacctctc

SEQ ID NO: 28829 - DNA, 889 bp, Artificial Sequence
  chemically treated genomic DNA (Homo sapiens) CpG-island No: 28829
gagtttgcgttttttttggtacgttgaaaacgtttttcgtagtttcgtatcggtttcgcggcgttttgatagttgggtgaggagggagcgaatgtttatcggcgtttttggggtaatttgggatagaggtatcgtcgcggggggcggaggattgggcgcgaaggcgttggttttttaagggggggacggagcgtatgcgcggcgcgggtcgtagtcgagtttggtgggcggttggttggtaggggacgtggtcggcggtagcggggtttaggggcggtcggggttgtagtagcggcggttttagtttcgtcgagtagcgatcggttggtgggtttttcgttggcgggtttcgcgttggcgggttgttttttaggtattagcggtagcgcgcgttcgttcggtttcgttattcgtttttagttatattcgtcggtcgaggttgcgcgagttttcgggtttgcggttttcgtttcgcggttttttttttatttttagttagggtagttgtagttcgagcgaatagttacggagtatttttcgttcgttcgggtcgcgttatcgtttatgttgtagttagttttaggtagcgatttcgcggtcgtagttcgtcgtttagtgattttagtttggtttttgcgcgtcgttcgagtcggtttcgttgagtcgcgggtttcgtgttttgcgatggttcggttggtgtagcgcggcgttaggtgttagtcgttttttcgttgagacgcgttcgagtggggattcgttgggtttcggggttcgtagttttcgttttttcgtcgcgttcgttttttttttggggatttcgtcgttgtttttggggacgaggggataggggatttagataaagtttattttgtgtagggagttggtcgta

SEQ ID NO: 28830 - DNA, 889 bp, Artificial Sequence
  chemically treated genomic DNA (Homo sapiens) CpG-island No: 28830
tacgaccaactccctacacaaaataaactttatctaaatcccctatcccctcgtccccaaaaacaacgacgaaatccccaaaaaaaaaacgaacgcgacgaaaaaacgaaaactacgaaccccgaaacccaacgaatccccactcgaacgcgtctcaacgaaaaaacgactaacacctaacgccgcgctacaccaaccgaaccatcgcaaaacacgaaacccgcgactcaacgaaaccgactcgaacgacgcgcaaaaaccaaactaaaatcactaaacgacgaactacgaccgcgaaatcgctacctaaaactaactacaacataaacgataacgcgacccgaacgaacgaaaaatactccgtaactattcgctcgaactacaactaccctaactaaaaataaaaaaaaaaccgcgaaacgaaaaccgcaaacccgaaaactcgcgcaacctcgaccgacgaatataactaaaaacgaataacgaaaccgaacgaacgcgcgctaccgctaatacctaaaaaacaacccgccaacgcgaaacccgccaacgaaaaacccaccaaccgatcgctactcgacgaaactaaaaccgccgctactacaaccccgaccgcccctaaaccccgctaccgccgaccacgtcccctaccaaccaaccgcccaccaaactcgactacgacccgcgccgcgcatacgctccgtcccccccttaaaaaaccaacgccttcgcgcccaatcctccgccccccgcgacgatacctctatcccaaattaccccaaaaacgccgataaacattcgctccctcctcacccaactatcaaaacgccgcgaaaccgatacgaaactacgaaaaacgttttcaacgtaccaaaaaaaacgcaaactc

SEQ ID NO: 28831 - DNA, 889 bp, Artificial Sequence
  chemically treated genomic DNA (Homo sapiens) CpG-island No: 28831
tgcggttaattttttgtataaagtgggttttgtttgggttttttgttttttcgtttttagaaatagcggcggagtttttagaaagggagcgggcgcggcggggaggcgaaggttgcgagtttcgaggtttagcgggtttttattcgggcgcgttttagcgggaggacggttggtatttggcgtcgcgttgtattagtcgagttatcgtagggtacggggttcgcggtttagcgggatcggttcgggcggcgcgtaggggttaggttgaggttattgagcggcgggttgcggtcgcggggtcgttgtttgggattggttgtagtatgggcggtggcgcggttcgggcgggcggaggatgtttcgtggttgttcgttcgggttgtagttgttttggttgagggtggaggaaggatcgcggggcggggatcgtaagttcggaggttcgcgtagtttcggtcggcggatgtagttggaggcgagtgacgaagtcgggcgagcgcgcgttgtcgttggtgtttggggagtagttcgttaacgcggagttcgttaacgagaagtttattagtcgatcgttgttcggcgaagttggggtcgtcgttgttgtagtttcggtcgtttttgggtttcgttgtcgtcgattacgttttttgttagttagtcgtttattaggttcgattacggttcgcgtcgcgtatgcgtttcgttttttttttaaagggttagcgttttcgcgtttagtttttcgtttttcgcggcggtgtttttgttttaagttattttaaggacgtcggtgggtattcgttttttttttatttagttgttagggcgtcgcgaagtcggtgcgaagttgcggaggacgtttttaacgtgttagagggagcgtaaattt

SEQ ID NO: 28832 - DNA, 889 bp, Artificial Sequence
  chemically treated genomic DNA (Homo sapiens) CpG-island No: 28832
aaatttacgctccctctaacacgttaaaaacgtcctccgcaacttcgcaccgacttcgcgacgccctaacaactaaataaaaaaaaaacgaatacccaccgacgtccttaaaataacttaaaacaaaaacaccgccgcgaaaaacgaaaaactaaacgcgaaaacgctaaccctttaaaaaaaaaacgaaacgcatacgcgacgcgaaccgtaatcgaacctaataaacgactaactaacaaaaaacgtaatcgacgacaacgaaacccaaaaacgaccgaaactacaacaacgacgaccccaacttcgccgaacaacgatcgactaataaacttctcgttaacgaactccgcgttaacgaactactccccaaacaccaacgacaacgcgcgctcgcccgacttcgtcactcgcctccaactacatccgccgaccgaaactacgcgaacctccgaacttacgatccccgccccgcgatccttcctccaccctcaaccaaaacaactacaacccgaacgaacaaccacgaaacatcctccgcccgcccgaaccgcgccaccgcccatactacaaccaatcccaaacaacgaccccgcgaccgcaacccgccgctcaataacctcaacctaacccctacgcgccgcccgaaccgatcccgctaaaccgcgaaccccgtaccctacgataactcgactaatacaacgcgacgccaaataccaaccgtcctcccgctaaaacgcgcccgaataaaaacccgctaaacctcgaaactcgcaaccttcgcctccccgccgcgcccgctccctttctaaaaactccgccgctatttctaaaaacgaaaaaacaaaaaacccaaacaaaacccactttatacaaaaaattaaccgca

SEQ ID NO: 28833 - DNA, 596 bp, Artificial Sequence
  chemically treated genomic DNA (Homo sapiens) CpG-island No: 28833
gacgtcgggtagggcgcggttttcgtcgtttacgtttacgatcgcgtttcgcgagttgttttcgtggtggcgcgtcgtttttaggtttagttcgaagtcgtagtttattttttcgtttttcgttagttttttttttttttttttttttttttttttttttttttcgtcgttttttttttttttttcgttttcgtttttcgggattaggttggggtcgttttcgtttttgaatttggttattacggatttgagcgcgttgttggcgttgtttattaagtcgttggtgtcgggtttcggggagttggcggtggagagatcgtcgtcggatttgatcgttatgggggacgatttgtgtatgtgcgtttttatgtggcgttttagtttgttggtttgggtgtacgcgtggtcgtataggttgtatttgtagggtttttcgttcgtgtggttgcgtcggtgtattattaggttgttttgaaatttgaacgttttgtcgtagaattcgtatgatttggatttgatcgggggttgggagggaggaggggcggattgtagaggagggagggggggcgtcgttaggaagggcggtttgttatttg

SEQ ID NO: 28834 - DNA, 596 bp, Artificial Sequence
  chemically treated genomic DNA (Homo sapiens) CpG-island No: 28834
caaataacaaaccgcccttcctaacgacgccccccctccctcctctacaatccgcccctcctccctcccaacccccgatcaaatccaaatcatacgaattctacgacaaaacgttcaaatttcaaaacaacctaataatacaccgacgcaaccacacgaacgaaaaaccctacaaatacaacctatacgaccacgcgtacacccaaaccaacaaactaaaacgccacataaaaacgcacatacacaaatcgtcccccataacgatcaaatccgacgacgatctctccaccgccaactccccgaaacccgacaccaacgacttaataaacaacgccaacaacgcgctcaaatccgtaataaccaaattcaaaaacgaaaacgaccccaacctaatcccgaaaaacgaaaacgaaaaaaaaaaaaaaaacgacgaaaaaaaaaaaaaaaaaaaaaaaaaaaaaaaaaaaaaactaacgaaaaacgaaaaaataaactacgacttcgaactaaacctaaaaacgacgcgccaccacgaaaacaactcgcgaaacgcgatcgtaaacgtaaacgacgaaaaccgcgccctacccgacgtc

SEQ ID NO: 28835 - DNA, 596 bp, Artificial Sequence
  chemically treated genomic DNA (Homo sapiens) CpG-island No: 28835
taggtagtaagtcgttttttttggcgacgtttttttttttttttttgtaattcgtttttttttttttttagttttcggttaagtttaagttatgcgagttttgcggtaagacgtttaaattttagagtaatttggtggtgtatcggcgtagttatacgggcgagaagttttataagtgtaatttgtgcgattacgcgtgtatttaggttagtaagttgaagcgttatatgaagacgtatatgtataaatcgttttttatgacggttaagttcgacgacggtttttttatcgttagtttttcggaattcggtattagcgatttggtgggtagcgttagtagcgcgtttaagttcgtggtggttaagtttaagagcgagaacgattttaatttgatttcggagaacggggacgaggaggaagaggaggacgacgaggaagaggaagaagaggaggaagaggaggaggaggagttgacggagagcgagagggtggattacggtttcgggttgagtttggaggcggcgcgttattacgagaatagttcgcggggcgcggtcgtgggcgtgggcgacgagagtcgcgttttgttcgacgtt

SEQ ID NO: 28836 - DNA, 596 bp, Artificial Sequence
  chemically treated genomic DNA (Homo sapiens) CpG-island No: 28836
aacgtcgaacaaaacgcgactctcgtcgcccacgcccacgaccgcgccccgcgaactattctcgtaataacgcgccgcctccaaactcaacccgaaaccgtaatccaccctctcgctctccgtcaactcctcctcctcctcttcctcctcttcttcctcttcctcgtcgtcctcctcttcctcctcgtccccgttctccgaaatcaaattaaaatcgttctcgctcttaaacttaaccaccacgaacttaaacgcgctactaacgctacccaccaaatcgctaataccgaattccgaaaaactaacgataaaaaaaccgtcgtcgaacttaaccgtcataaaaaacgatttatacatatacgtcttcatataacgcttcaacttactaacctaaatacacgcgtaatcgcacaaattacacttataaaacttctcgcccgtataactacgccgatacaccaccaaattactctaaaatttaaacgtcttaccgcaaaactcgcataacttaaacttaaccgaaaactaaaaaaaaaaaaaaacgaattacaaaaaaaaaaaaaaaaacgtcgccaaaaaaaacgacttactaccta

SEQ ID NO: 28837 - DNA, 637 bp, Artificial Sequence
  chemically treated genomic DNA (Homo sapiens) CpG-island No: 28837
aacgtcgatcgtattatagtttttttcgtttaagttttgttttttttttcgtttcggtttgggtcggagttaaattttataggaatgtagttcggttatatgcgttgcggcggtggacgtgttttttttttcgcgttttaaagagatttagcgttattttgttttgacgtagttataaaagttacgggagaaattttgttttttttttcgcgttagcgttttaaagttttgtagaggtcgagtcggggtttttatttcgcgtagggatagtagaaaatggttagggaagagttttgcgatttttttcgttattgtttgggttttatatcggtcgcggtagtaacgattattatcgttatttttttttttttatttttgtaatagtttttttttacggttttggttttattcgttgttgtaggatgaggttatcgttagttaattacgacgcgttcgataggatatattaggcgttgattggttgtcgagatcgtttttgtttttttttatttcgttttttttagcgttttgggtcgttgcggggtaaggggaagacggaaattatttcggggaaagatttttaaaataagagtcggaatcgtcgtgttattttagtggggaaattttttttttattt

SEQ ID NO: 28838 - DNA, 637 bp, Artificial Sequence
  chemically treated genomic DNA (Homo sapiens) CpG-island No: 28838
aaataaaaaaaaaatttccccactaaaataacacgacgattccgactcttattttaaaaatctttccccgaaataatttccgtcttccccttaccccgcaacgacccaaaacgctaaaaaaaacgaaataaaaaaaaacaaaaacgatctcgacaaccaatcaacgcctaatatatcctatcgaacgcgtcgtaattaactaacgataacctcatcctacaacaacgaataaaaccaaaaccgtaaaaaaaaactattacaaaaataaaaaaaaaaaaataacgataataatcgttactaccgcgaccgatataaaacccaaacaataacgaaaaaaatcgcaaaactcttccctaaccattttctactatccctacgcgaaataaaaaccccgactcgacctctacaaaactttaaaacgctaacgcgaaaaaaaaaacaaaatttctcccgtaacttttataactacgtcaaaacaaaataacgctaaatctctttaaaacgcgaaaaaaaaaacacgtccaccgccgcaacgcatataaccgaactacattcctataaaatttaactccgacccaaaccgaaacgaaaaaaaaaacaaaacttaaacgaaaaaaactataatacgatcgacgtt

SEQ ID NO: 28839 - DNA, 637 bp, Artificial Sequence
  chemically treated genomic DNA (Homo sapiens) CpG-island No: 28839
gaataaaagaagggtttttttattaaaatgatacggcgatttcggtttttgttttgggggttttttttcgaaatggttttcgttttttttttgtttcgtagcgatttagagcgttgggggaagcggagtggggagaggtagaggcggtttcggtagttaattagcgtttgatgtgttttgtcgggcgcgtcgtggttggttggcgatgattttattttgtagtagcgggtggggttaaagtcgtagggggaggttgttgtaaaggtagagagggagaagtgacgatggtgatcgttgttgtcgcggtcgatatggaatttaagtagtggcgaagggaatcgtaaggtttttttttgattattttttattgtttttgcgcgaggtgagggtttcggttcggtttttgtaaaattttggggcgttggcgcggaggaggagataggatttttttcgtgatttttgtaattgcgttagggtaagatggcgttgggtttttttggggcgcggggggagaggtacgtttatcgtcgtagcgtatgtgatcgggttgtatttttgtggggtttggtttcgatttaggtcggggcgggggaggggatagggtttgggcggaggagattgtggtgcggtcggcgtt

SEQ ID NO: 28840 - DNA, 637 bp, Artificial Sequence
  chemically treated genomic DNA (Homo sapiens) CpG-island No: 28840
aacgccgaccgcaccacaatctcctccgcccaaaccctatcccctcccccgccccgacctaaatcgaaaccaaaccccacaaaaatacaacccgatcacatacgctacgacgataaacgtacctctccccccgcgccccaaaaaaacccaacgccatcttaccctaacgcaattacaaaaatcacgaaaaaaatcctatctcctcctccgcgccaacgccccaaaattttacaaaaaccgaaccgaaaccctcacctcgcgcaaaaacaataaaaaataatcaaaaaaaaaccttacgattcccttcgccactacttaaattccatatcgaccgcgacaacaacgatcaccatcgtcacttctccctctctacctttacaacaacctccccctacgactttaaccccacccgctactacaaaataaaatcatcgccaaccaaccacgacgcgcccgacaaaacacatcaaacgctaattaactaccgaaaccgcctctacctctccccactccgcttcccccaacgctctaaatcgctacgaaacaaaaaaaaaacgaaaaccatttcgaaaaaaaacccccaaaacaaaaaccgaaatcgccgtatcattttaataaaaaaacccttcttttattc

SEQ ID NO: 28841 - DNA, 1099 bp, Artificial Sequence
  chemically treated genomic DNA (Homo sapiens) CpG-island No: 28841
tcggtcgcgggagagggttcggtaggtgttaaggagttcgggcggttttttagttcgtattttttcgcggtcgttcggagtcggttttcgttagtcgggcgggtaggcggttattggcgttaggattggtcggcgtcgttcgcgttttcgcggtttcgggtggagtttttcgttcggtcgttttttgcggtattcgcgatacgggtggggattagaggttttcggcggcggttttcggcggcggttttcgggttgtgattggttagcgttatagggggcgggacggcgggcgtgaagtgagcgggttggggtcgttggcgcgtttttttattttttcgtttgcgttcgcgttcgcggttttcgtttgtattatttttagtcggcggttgttttagggaggttgggcgcgatttttttcgttcgcggttttaattcgtattttgcgttttttttcgtttttttcgtatttgtttttgcgttaggttcggagattttcggggcggttttttagaatttgcggagtataattggtcgatcgatttatttattgggaatttcgttttttgttagagtttacgttttttgttatttttagttcggagcggcgtgtagcgttatggagaagagtaacgagattaacggttattttgatagcgtttaggcggcgtgcggtcgggttcggagtttcggggatcgcggcgggacgttacggcgttgcgcgggttttttgcggcgttaagcgttggtgttgtttatcgtgttcggggtgttggcgggcgcgggtttgggcgcggcgttgcgcggtttagtttgagtcgtacgtaggttatttatttggtttttttcggcgagatgttgtttcgtatgttgcgtatgattattttgtcgttggtggtttgtagtttggtgtcgggcgcgtttcgttcgatgttagttgtttcgggcgtttgggcggtatcgttgtcgtttattttggttttattatattgagtgtttcggcgttcgtcgtggttttggcgtttattattaagttaggattcggtgcgtagattttttagtttagcgatttggggttggaggattcggggtttttttttgt

SEQ ID NO: 28842 - DNA, 1099 bp, Artificial Sequence
  chemically treated genomic DNA (Homo sapiens) CpG-island No: 28842
acaaaaaaaaaccccgaatcctccaaccccaaatcgctaaactaaaaaatctacgcaccgaatcctaacttaataataaacgccaaaaccacgacgaacgccgaaacactcaatataataaaaccaaaataaacgacaacgataccgcccaaacgcccgaaacaactaacatcgaacgaaacgcgcccgacaccaaactacaaaccaccaacgacaaaataatcatacgcaacatacgaaacaacatctcgccgaaaaaaaccaaataaataacctacgtacgactcaaactaaaccgcgcaacgccgcgcccaaacccgcgcccgccaacaccccgaacacgataaacaacaccaacgcttaacgccgcaaaaaacccgcgcaacgccgtaacgtcccgccgcgatccccgaaactccgaacccgaccgcacgccgcctaaacgctatcaaaataaccgttaatctcgttactcttctccataacgctacacgccgctccgaactaaaaataacaaaaaacgtaaactctaacaaaaaacgaaattcccaataaataaatcgatcgaccaattatactccgcaaattctaaaaaaccgccccgaaaatctccgaacctaacgcaaaaacaaatacgaaaaaaacgaaaaaaaacgcaaaatacgaattaaaaccgcgaacgaaaaaaatcgcgcccaacctccctaaaacaaccgccgactaaaaataatacaaacgaaaaccgcgaacgcgaacgcaaacgaaaaaataaaaaaacgcgccaacgaccccaacccgctcacttcacgcccgccgtcccgccccctataacgctaaccaatcacaacccgaaaaccgccgccgaaaaccgccgccgaaaacctctaatccccacccgtatcgcgaataccgcaaaaaacgaccgaacgaaaaactccacccgaaaccgcgaaaacgcgaacgacgccgaccaatcctaacgccaataaccgcctacccgcccgactaacgaaaaccgactccgaacgaccgcgaaaaaatacgaactaaaaaaccgcccgaactccttaacacctaccgaaccctctcccgcgaccga

SEQ ID NO: 28843 - DNA, 1099 bp, Artificial Sequence
  chemically treated genomic DNA (Homo sapiens) CpG-island No: 28843
ataggaggaggtttcgagttttttagttttaggtcgttggattgaagggtttgcgtatcggattttggtttgatgatgaacgttaaggttacggcgagcgtcgaggtatttagtgtggtgaggttaaagtaggcgatagcgatgtcgtttagacgttcgaggtagttggtatcgagcgaggcgcgttcgatattaggttgtagattattagcggtaggatgattatgcgtagtatgcggagtagtatttcgtcggggaaggttaggtaggtgatttgcgtgcggtttaggttgagtcgcgtaacgtcgcgtttaggttcgcgttcgttagtatttcggatacggtgagtagtattagcgtttggcgtcgtaggaagttcgcgtaacgtcgtggcgtttcgtcgcggttttcggagtttcgggttcggtcgtacgtcgtttgagcgttgttaaggtagtcgttggtttcgttgtttttttttatggcgttatacgtcgtttcgagttagaggtggtaggggacgtgggttttggtaaaagacggggtttttaatgaatgggtcggtcggttagttgtgtttcgtaggttttgggaagtcgtttcgggggttttcgggtttggcgtaggagtaggtgcgagaaaggcgaggagaggcgtagagtgcgggttggagtcgcgggcggagaggatcgcgtttagtttttttggagtagtcgtcggttggagatgatgtaaacgggagtcgcgaacgcggacgtagacggggaagtaggagggcgcgttagcggttttagttcgtttattttacgttcgtcgtttcgttttttgtggcgttggttaattatagttcgggagtcgtcgtcgggagtcgtcgtcgggagtttttggtttttattcgtgtcgcgggtgtcgtagggggcggtcgggcgggaggttttattcgaggtcgcgggggcgcgggcggcgtcggttaattttggcgttaatagtcgtttattcgttcggttaacggaggtcggtttcgggcgatcgcggggaagtgcgggttgaaggatcgttcgggttttttggtatttgtcgggttttttttcgcggtcgg

SEQ ID NO: 28844 - DNA, 1099 bp, Artificial Sequence
  chemically treated genomic DNA (Homo sapiens) CpG-island No: 28844
ccgaccgcgaaaaaaaacccgacaaataccaaaaaacccgaacgatccttcaacccgcacttccccgcgatcgcccgaaaccgacctccgttaaccgaacgaataaacgactattaacgccaaaattaaccgacgccgcccgcgcccccgcgacctcgaataaaacctcccgcccgaccgccccctacgacacccgcgacacgaataaaaaccaaaaactcccgacgacgactcccgacgacgactcccgaactataattaaccaacgccacaaaaaacgaaacgacgaacgtaaaataaacgaactaaaaccgctaacgcgccctcctacttccccgtctacgtccgcgttcgcgactcccgtttacatcatctccaaccgacgactactccaaaaaaactaaacgcgatcctctccgcccgcgactccaacccgcactctacgcctctcctcgcctttctcgcacctactcctacgccaaacccgaaaacccccgaaacgacttcccaaaacctacgaaacacaactaaccgaccgacccattcattaaaaaccccgtcttttaccaaaacccacgtcccctaccacctctaactcgaaacgacgtataacgccataaaaaaaaacaacgaaaccaacgactaccttaacaacgctcaaacgacgtacgaccgaacccgaaactccgaaaaccgcgacgaaacgccacgacgttacgcgaacttcctacgacgccaaacgctaatactactcaccgtatccgaaatactaacgaacgcgaacctaaacgcgacgttacgcgactcaacctaaaccgcacgcaaatcacctacctaaccttccccgacgaaatactactccgcatactacgcataatcatcctaccgctaataatctacaacctaatatcgaacgcgcctcgctcgataccaactacctcgaacgtctaaacgacatcgctatcgcctactttaacctcaccacactaaatacctcgacgctcgccgtaaccttaacgttcatcatcaaaccaaaatccgatacgcaaacccttcaatccaacgacctaaaactaaaaaactcgaaacctcctcctat

SEQ ID NO: 28845 - DNA, 1026 bp, Artificial Sequence
  chemically treated genomic DNA (Homo sapiens) CpG-island No: 28845
ggtcgcgtcgtcgggttttgtagacgcgaatgtaaatagaaatatagtgaaaggcgttcggagagtttcgtgattgcggtacggcggcgagtcgggaatattagtgcgtttagagtaaaatgaacgaatgtacgtatgatttttggagcgatttttacgagggaaagcgcgtttttcggtatttatttttaagcgttttaaaatgattagtttttatataatttagttcgtaggcgaagttgaggtcggagttttaaaagcgagggaggatagtcgttgaagaagtttcggttttttataggttaggacgaagtagggggcgggtttattttgtaggagcgtttacgtattggtggagtcgcggatttagagttgcgattcgttgcgcgaaattgtcgaaagttttttcgcggagggagaaggggcgggaagaagggcgtggttagcgcggtcgaagggcgtggttggcgttcggttttgttttgcgcgttttgggttgcggttggagggtcgtagttgtagttagggttcgttagttcggggttagcgtatggggttgttgagatcgtttcggacgtgcgaagcgttcgcggtgcggtaggtaggtagtgtttcgcgtgcgggtgttggtgtcgggggtgtcgcggcgttgggggcggtggttcgggttagattcgcgcgcgcgttcggttttttttttcgcgttttttcggtgtttgcggggtttttgcggtgcgggtcgtttggtttcgcgttttcgtcggtaagggtataaaggttttttggggggcgggggcgtttcgtgttttcgtttttattttgcgagcggaacggcgtgtgttgtggcggtcgaggggtcggggtcgaggcgggcggttgggtttgggaatgttcgggcgcggcgagggagtgcgcgagttcgcgtatttggcggtcgagtagttgcgtcgttggtcggtttgggtttcgggggaggttatttttttttaggtttttttcgggcgtgggttgtttatttagtttttt

SEQ ID NO: 28846 - DNA, 1026 bp, Artificial Sequence
  chemically treated genomic DNA (Homo sapiens) CpG-island No: 28846
aaaaaactaaataaacaacccacgcccgaaaaaaacctaaaaaaaaataacctcccccgaaacccaaaccgaccaacgacgcaactactcgaccgccaaatacgcgaactcgcgcactccctcgccgcgcccgaacattcccaaacccaaccgcccgcctcgaccccgacccctcgaccgccacaacacacgccgttccgctcgcaaaataaaaacgaaaacacgaaacgcccccgccccccaaaaaacctttatacccttaccgacgaaaacgcgaaaccaaacgacccgcaccgcaaaaaccccgcaaacaccgaaaaaacgcgaaaaaaaaaaccgaacgcgcgcgcgaatctaacccgaaccaccgcccccaacgccgcgacacccccgacaccaacacccgcacgcgaaacactacctacctaccgcaccgcgaacgcttcgcacgtccgaaacgatctcaacaaccccatacgctaaccccgaactaacgaaccctaactacaactacgaccctccaaccgcaacccaaaacgcgcaaaacaaaaccgaacgccaaccacgcccttcgaccgcgctaaccacgcccttcttcccgccccttctccctccgcgaaaaaactttcgacaatttcgcgcaacgaatcgcaactctaaatccgcgactccaccaatacgtaaacgctcctacaaaataaacccgccccctacttcgtcctaacctataaaaaaccgaaacttcttcaacgactatcctccctcgcttttaaaactccgacctcaacttcgcctacgaactaaattatataaaaactaatcattttaaaacgcttaaaaataaataccgaaaaacgcgctttccctcgtaaaaatcgctccaaaaatcatacgtacattcgttcattttactctaaacgcactaatattcccgactcgccgccgtaccgcaatcacgaaactctccgaacgcctttcactatatttctatttacattcgcgtctacaaaacccgacgacgcgacc

SEQ ID NO: 28847 - DNA, 1026 bp, Artificial Sequence
  chemically treated genomic DNA (Homo sapiens) CpG-island No: 28847
ggggagttgggtaaatagtttacgttcgggagaggtttgagggaaagtgatttttttcggggtttaggtcgattagcggcgtagttgttcggtcgttagatgcgcggattcgcgtattttttcgtcgcgttcgggtatttttaagtttagtcgttcgtttcggtttcgatttttcggtcgttatagtatacgtcgtttcgttcgtaagatggaggcgaaggtacgaggcgttttcgttttttagggagtttttgtgtttttgtcggcggggacgcgaggttagacggttcgtatcgtaagggtttcgtaggtatcgaagagacgcgggggagggggtcgggcgcgcgcgcggatttagttcgggttatcgtttttagcgtcgcggtattttcgatattagtattcgtacgcgggatattgtttatttatcgtatcgcgaacgtttcgtacgttcggagcggttttagtagttttatgcgttggtttcgagttggcggattttgattgtaattgcggttttttaatcgtagtttaaaacgcgtagggtaggatcgagcgttaattacgtttttcggtcgcgttgattacgttttttttttcgtttttttttttttcgcgggagggttttcggtaatttcgcgtagcgaatcgtagttttaagttcgcggttttattaatacgtggacgtttttgtaagatgagttcgttttttatttcgttttggtttatgggaagtcgggatttttttagcggttgttttttttcgtttttggagtttcgattttagtttcgtttgcgagttgggttgtgtaaaggttggttattttggggcgtttaggggtgggtgtcggggggcgcgttttttttcgtgaaggtcgttttaggagttatgcgtatattcgtttattttgttttggacgtattgatgttttcggttcgtcgtcgtgtcgtagttacgaggtttttcgaacgttttttattgtgtttttgtttatattcgcgtttgtaagattcggcggcgcgatt

SEQ ID NO: 28848 - DNA, 1026 bp, Artificial Sequence
  chemically treated genomic DNA (Homo sapiens) CpG-island No: 28848
aatcgcgccgccgaatcttacaaacgcgaatataaacaaaaacacaataaaaaacgttcgaaaaacctcgtaactacgacacgacgacgaaccgaaaacatcaatacgtccaaaacaaaataaacgaatatacgcataactcctaaaacgaccttcacgaaaaaaaacgcgccccccgacacccacccctaaacgccccaaaataaccaacctttacacaacccaactcgcaaacgaaactaaaatcgaaactccaaaaacgaaaaaaaacaaccgctaaaaaaatcccgacttcccataaaccaaaacgaaataaaaaacgaactcatcttacaaaaacgtccacgtattaataaaaccgcgaacttaaaactacgattcgctacgcgaaattaccgaaaaccctcccgcgaaaaaaaaaaaaacgaaaaaaaaaacgtaatcaacgcgaccgaaaaacgtaattaacgctcgatcctaccctacgcgttttaaactacgattaaaaaaccgcaattacaatcaaaatccgccaactcgaaaccaacgcataaaactactaaaaccgctccgaacgtacgaaacgttcgcgatacgataaataaacaatatcccgcgtacgaatactaatatcgaaaataccgcgacgctaaaaacgataacccgaactaaatccgcgcgcgcgcccgaccccctcccccgcgtctcttcgatacctacgaaacccttacgatacgaaccgtctaacctcgcgtccccgccgacaaaaacacaaaaactccctaaaaaacgaaaacgcctcgtaccttcgcctccatcttacgaacgaaacgacgtatactataacgaccgaaaaatcgaaaccgaaacgaacgactaaacttaaaaatacccgaacgcgacgaaaaaatacgcgaatccgcgcatctaacgaccgaacaactacgccgctaatcgacctaaaccccgaaaaaaatcactttccctcaaacctctcccgaacgtaaactatttacccaactcccc

SEQ ID NO: 28849 - DNA, 578 bp, Artificial Sequence
  chemically treated genomic DNA (Homo sapiens) CpG-island No: 28849
tgggcgtgtcgtgggagtcgaggcgcgaggttcgggttggggatgaggggttgaggggcgcgggagggatgtagagaggatgcggtgaagtgcgaagatttcgtttcggtttcggcggggcgtgggcggcgtgaaacgttatatattaggttgagaggttcgggttcggtcgagcggtttgaggagtaggtgggtgtgggtgtgggtgtgggcgcgaagggttgagggcgtgggcgttcgcgttttattagagattggaagcgaggttttgggtatcgagcgggggacgcggtcggatatcgggtcgtttagtatcgttagtagtagtagcgggaagggcgaggttgtaggttgttcgggattcgggcggggtcgcgtagtagaggtcggtatttttggtttcgtttggtcgcgggtgcggcgtaagttacggtttttgtttagggtttcggggttattggtttcggttttattcgggttttttcggttcggttcggtttagtttgaggttgagggatgaaatatcgttcggtttcgtttttttagaaaggggttaatggtcgggttttttttttttt

SEQ ID NO: 28850 - DNA, 578 bp, Artificial Sequence
  chemically treated genomic DNA (Homo sapiens) CpG-island No: 28850
aaaaaaaaaaaaacccgaccattaacccctttctaaaaaaacgaaaccgaacgatatttcatccctcaacctcaaactaaaccgaaccgaaccgaaaaaacccgaataaaaccgaaaccaataaccccgaaaccctaaacaaaaaccgtaacttacgccgcacccgcgaccaaacgaaaccaaaaataccgacctctactacgcgaccccgcccgaatcccgaacaacctacaacctcgcccttcccgctactactactaacgatactaaacgacccgatatccgaccgcgtcccccgctcgatacccaaaacctcgcttccaatctctaataaaacgcgaacgcccacgccctcaacccttcgcgcccacacccacacccacacccacctactcctcaaaccgctcgaccgaacccgaacctctcaacctaatatataacgtttcacgccgcccacgccccgccgaaaccgaaacgaaatcttcgcacttcaccgcatcctctctacatccctcccgcgcccctcaacccctcatccccaacccgaacctcgcgcctcgactcccacgacacgccca

SEQ ID NO: 28851 - DNA, 578 bp, Artificial Sequence
  chemically treated genomic DNA (Homo sapiens) CpG-island No: 28851
aggaagaaggaggttcgattattggtttttttttgagggggcggagtcgggcggtgttttattttttagttttaggttgagtcggatcgagtcgagaggattcgagtggggtcgaggttagtagtttcggggttttgagtagaggtcgtagtttgcgtcgtattcgcggttaggcggagttaaagatgtcggtttttgttgcgcggtttcgttcgggtttcgggtagtttatagtttcgtttttttcgttattgttgttggcggtgttgagcggttcggtattcggtcgcgtttttcgttcggtgtttagaatttcgtttttaatttttggtaaggcgcggacgtttacgtttttagtttttcgcgtttatatttatatttatatttatttgttttttagatcgttcggtcggattcgggttttttagtttggtgtatggcgttttacgtcgtttacgtttcgtcgggatcggggcgagattttcgtattttatcgtattttttttgtatttttttcgcgttttttagttttttatttttagttcgggtttcgcgtttcggtttttacgatacgttta

SEQ ID NO: 28852 - DNA, 578 bp, Artificial Sequence
  chemically treated genomic DNA (Homo sapiens) CpG-island No: 28852
taaacgtatcgtaaaaaccgaaacgcgaaacccgaactaaaaataaaaaactaaaaaacgcgaaaaaaatacaaaaaaaatacgataaaatacgaaaatctcgccccgatcccgacgaaacgtaaacgacgtaaaacgccatacaccaaactaaaaaacccgaatccgaccgaacgatctaaaaaacaaataaatataaatataaatataaacgcgaaaaactaaaaacgtaaacgtccgcgccttaccaaaaattaaaaacgaaattctaaacaccgaacgaaaaacgcgaccgaataccgaaccgctcaacaccgccaacaacaataacgaaaaaaacgaaactataaactacccgaaacccgaacgaaaccgcgcaacaaaaaccgacatctttaactccgcctaaccgcgaatacgacgcaaactacgacctctactcaaaaccccgaaactactaacctcgaccccactcgaatcctctcgactcgatccgactcaacctaaaactaaaaaataaaacaccgcccgactccgccccctcaaaaaaaaaccaataatcgaacctccttcttcct

SEQ ID NO: 28853 - DNA, 547 bp, Artificial Sequence
  chemically treated genomic DNA (Homo sapiens) CpG-island No: 28853
tttcggttcggttttttcggcggttataattattcggttttacgttgcggtcgtcgtcgcgtcgtcgttttttttacgtcgttgcggacgacgataagcggttaatcgttttcgtttttcgcggttcgtcgtcgcgtcgaatttggttatatttataaggagaggagaattttcgtagtttttcgttcggggtgaaattttaatatggttttcgttttcgtcgtttttttttttttttttatttcggtttttttaattttttttttttttttcgattttcgttcgattgcgtagtcgcgatttcggagggagcgcgttaggtttggcgcgtattcgattttttgcgcgtttcggtttcgcgcgtttgttaggtcggggtcggcggcggaatagtttgggattcgaaacgtttcggtttttttgcggattcgcgttcggtcgttgtcgtcggacgtttgaaaaggtttgtttggtttagggatcggggttaggattagtagaaagtggttttttttcgtttttgatttttttaacgataaagttggat

SEQ ID NO: 28854 - DNA, 547 bp, Artificial Sequence
  chemically treated genomic DNA (Homo sapiens) CpG-island No: 28854
atccaactttatcgttaaaaaaatcaaaaacgaaaaaaaaccactttctactaatcctaaccccgatccctaaaccaaacaaaccttttcaaacgtccgacgacaacgaccgaacgcgaatccgcaaaaaaaccgaaacgtttcgaatcccaaactattccgccgccgaccccgacctaacaaacgcgcgaaaccgaaacgcgcaaaaaatcgaatacgcgccaaacctaacgcgctccctccgaaatcgcgactacgcaatcgaacgaaaatcgaaaaaaaaaaaaaaaattaaaaaaaccgaaataaaaaaaaaaaaaaaaacgacgaaaacgaaaaccatattaaaatttcaccccgaacgaaaaactacgaaaattctcctctccttataaatataaccaaattcgacgcgacgacgaaccgcgaaaaacgaaaacgattaaccgcttatcgtcgtccgcaacgacgtaaaaaaaacgacgacgcgacgacgaccgcaacgtaaaaccgaataattataaccgccgaaaaaaccgaaccgaaa

SEQ ID NO: 28855 - DNA, 547 bp, Artificial Sequence
  chemically treated genomic DNA (Homo sapiens) CpG-island No: 28855
gtttaattttgtcgttaggggaattagaaacgaaaagaagttattttttgttagttttaatttcggtttttgggttaggtaaatttttttaagcgttcggcggtagcggtcgggcgcgggttcgtagaaaagtcgaggcgtttcgggttttaagttgtttcgtcgtcggtttcggtttggtaggcgcgcggagtcggaacgcgtaaggggtcgggtgcgcgttaggtttggcgcgtttttttcgggatcgcggttgcgtagtcgggcgggagtcgggaaaaggggaggaggttggaggagtcggagtaaggggagggggaggagcggcgaaagcggaagttatgttggagttttatttcgagcgaggggttgcgagggtttttttttttttgtgggtgtgattaggttcggcgcggcggcgggtcgcggggggcggggacgattggtcgtttgtcgtcgttcgtagcggcgtgaggggagcggcggcgcggcggcggtcgtagcgtggagtcgggtgattgtgatcgtcgggggagtcgggtcggag

SEQ ID NO: 28856 - DNA, 547 bp, Artificial Sequence
  chemically treated genomic DNA (Homo sapiens) CpG-island No: 28856
ctccgacccgactcccccgacgatcacaatcacccgactccacgctacgaccgccgccgcgccgccgctcccctcacgccgctacgaacgacgacaaacgaccaatcgtccccgccccccgcgacccgccgccgcgccgaacctaatcacacccacaaaaaaaaaaaaaccctcgcaacccctcgctcgaaataaaactccaacataacttccgctttcgccgctcctccccctccccttactccgactcctccaacctcctccccttttcccgactcccgcccgactacgcaaccgcgatcccgaaaaaaacgcgccaaacctaacgcgcacccgaccccttacgcgttccgactccgcgcgcctaccaaaccgaaaccgacgacgaaacaacttaaaacccgaaacgcctcgacttttctacgaacccgcgcccgaccgctaccgccgaacgcttaaaaaaatttacctaacccaaaaaccgaaattaaaactaacaaaaaataacttcttttcgtttctaattcccctaacgacaaaattaaac

SEQ ID NO: 28857 - DNA, 575 bp, Artificial Sequence
  chemically treated genomic DNA (Homo sapiens) CpG-island No: 28857
  misc_feature (468)..(468): n is either a, c, g or t
ggtaatcgggtttcgaggggattgacgtttatttgcgcgcgttacggtatataacggttttaaatttgattttagtagtatatttatgttgaaattcgtaggttagttcgtttcgttagagtgggagtttagattattttcgggagaagatacgtttcgataggaattacgttattggtagagcggaaataggttgagttttacgcgcgtatgttttgttcgttatggtcgtagttaaggagtttttggagttttatgttaagcggttttggcgtttcgaggaggtagtagaagattcggacgaggaggatgaggataatattagttgaagtcgagaatgggtttttttggaggaagtgttacggttcggaggtattaaggtaacggtcgcggtttcggggaacgggattaggcgtggagagtttcgaagtgtgttaggttgattgtttcgtcgtttacgcgttggtnagagtttcggtttaggtatcgagattttagtttttgaagtatgtgttcggtgcgttttttacgtcggtttttattgttgtttataaaagaaaagtttcgaattgaat

SEQ ID NO: 28858 - DNA, 575 bp, Artificial Sequence
  chemically treated genomic DNA (Homo sapiens) CpG-island No: 28858
  misc_feature (108)..(108): n is either a, c, g or t
attcaattcgaaacttttcttttataaacaacaataaaaaccgacgtaaaaaacgcaccgaacacatacttcaaaaactaaaatctcgatacctaaaccgaaactctnaccaacgcgtaaacgacgaaacaatcaacctaacacacttcgaaactctccacgcctaatcccgttccccgaaaccgcgaccgttaccttaatacctccgaaccgtaacacttcctccaaaaaaacccattctcgacttcaactaatattatcctcatcctcctcgtccgaatcttctactacctcctcgaaacgccaaaaccgcttaacataaaactccaaaaactccttaactacgaccataacgaacaaaacatacgcgcgtaaaactcaacctatttccgctctaccaataacgtaattcctatcgaaacgtatcttctcccgaaaataatctaaactcccactctaacgaaacgaactaacctacgaatttcaacataaatatactactaaaatcaaatttaaaaccgttatataccgtaacgcgcgcaaataaacgtcaatcccctcgaaacccgattacc

SEQ ID NO: 28859 - DNA, 575 bp, Artificial Sequence
  chemically treated genomic DNA (Homo sapiens) CpG-island No: 28859
  misc_feature (108)..(108): n is either a, c, g or t
gtttaattcgaaattttttttttgtaaatagtagtggaaatcggcgtgggaagcgtatcgaatatatgttttagaggttgggatttcggtatttggatcggggttttnattagcgcgtaagcggcgggatagttagtttagtatatttcggaattttttacgtttgatttcgtttttcggagtcgcggtcgttattttggtgttttcgagtcgtaatattttttttaggagaatttattttcggttttaattagtattatttttatttttttcgttcggattttttattgttttttcggggcgttaaggtcgtttggtatggaattttaaaggttttttgattgcggttatggcgggtaaagtatacgcgcgtgaaatttagtttattttcgttttgttagtggcgtaatttttgtcggggcgtgttttttttcggaaatggtttaagtttttattttggcggagcgagttagtttgcgaattttagtatgagtgtattgttgaggttaggtttggggtcgttgtgtgtcgtggcgcgcgtaggtaagcgttagttttttcgaagttcggttgtt

SEQ ID NO: 28860 - DNA, 575 bp, Artificial Sequence
  chemically treated genomic DNA (Homo sapiens) CpG-island No: 28860
  misc_feature (468)..(468): n is either a, c, g or t
aacaaccgaacttcgaaaaaactaacgcttacctacgcgcgccacgacacacaacgaccccaaacctaacctcaacaatacactcatactaaaattcgcaaactaactcgctccgccaaaataaaaacttaaaccatttccgaaaaaaaacacgccccgacaaaaattacgccactaacaaaacgaaaataaactaaatttcacgcgcgtatactttacccgccataaccgcaatcaaaaaacctttaaaattccataccaaacgaccttaacgccccgaaaaaacaataaaaaatccgaacgaaaaaaataaaaataatactaattaaaaccgaaaataaattctcctaaaaaaaatattacgactcgaaaacaccaaaataacgaccgcgactccgaaaaacgaaatcaaacgtaaaaaattccgaaatatactaaactaactatcccgccgcttacgcgctaatnaaaaccccgatccaaataccgaaatcccaacctctaaaacatatattcgatacgcttcccacgccgatttccactactatttacaaaaaaaaaatttcgaattaaac

SEQ ID NO: 28861 - DNA, 720 bp, Artificial Sequence
  chemically treated genomic DNA (Homo sapiens) CpG-island No: 28861
agcgggggtagtttttcgttgtcgtcggtattggcgtatagtaggacgtttaggcgttgggtggtttgacgcggtcgttcgtcgttttcgtatagtttcgcggtttggtcgggtaggaagtcgtattatagattggtttcggtggcgttgaatacgttttgcgaggcgtagttttcggttatcgacggcggttgtttttttcgagcgcgttaattagtagtgttttcgttattgtttttcgagggtatcgcggtcggattggtaggcgtcgtcggggtgcggggggtagcgtttcgcgcgcgggcgcgggttacgtcgttgtaggatattacgtcgtggcgtcggcggaagcggtttagttagtcgttggaggcggtgaagtcgtttatgtttagtttttcggttatgcgtagcgttttttttttgaggatgatgtttttgatcggtaggtcggcggcgcggatttgttggaattaggcgatgagtaagttttcgagtttgtcgtagggagatagtttgttggttttgcggtaggtggaggttatttcgtatttgcgtttcgacgttaggatggcgcgtttgttttttaggatcgtgtttagcgtggacggcgggatgttgaagcgtcgcgcgatttcgtttttgcgtaggttcggatttttttttattttttggatgattcgtgatttttttcggaacgttagttgtcgttttttgggg

SEQ ID NO: 28862 - DNA, 720 bp, Artificial Sequence
  chemically treated genomic DNA (Homo sapiens) CpG-island No: 28862
ccccaaaaaacgacaactaacgttccgaaaaaaatcacgaatcatccaaaaaataaaaaaaaatccgaacctacgcaaaaacgaaatcgcgcgacgcttcaacatcccgccgtccacgctaaacacgatcctaaaaaacaaacgcgccatcctaacgtcgaaacgcaaatacgaaataacctccacctaccgcaaaaccaacaaactatctccctacgacaaactcgaaaacttactcatcgcctaattccaacaaatccgcgccgccgacctaccgatcaaaaacatcatcctcaaaaaaaaaacgctacgcataaccgaaaaactaaacataaacgacttcaccgcctccaacgactaactaaaccgcttccgccgacgccacgacgtaatatcctacaacgacgtaacccgcgcccgcgcgcgaaacgctaccccccgcaccccgacgacgcctaccaatccgaccgcgataccctcgaaaaacaataacgaaaacactactaattaacgcgctcgaaaaaaacaaccgccgtcgataaccgaaaactacgcctcgcaaaacgtattcaacgccaccgaaaccaatctataatacgacttcctacccgaccaaaccgcgaaactatacgaaaacgacgaacgaccgcgtcaaaccacccaacgcctaaacgtcctactatacgccaataccgacgacaacgaaaaactacccccgct

SEQ ID NO: 28863 - DNA, 720 bp, Artificial Sequence
  chemically treated genomic DNA (Homo sapiens) CpG-island No: 28863
ttttaagaggcgatagttgacgtttcgggagaagttacggattatttaggaggtggaggagaattcggatttgcgtaagggcgagatcgcgcggcgttttaatatttcgtcgtttacgttgagtacgattttgaagaataagcgcgttattttggcgtcggagcgtaagtacggggtggtttttatttgtcgtaagattaataagttgtttttttacgataagttcgagggtttgtttatcgtttggttttagtagattcgcgtcgtcggtttgtcggttaagggtattatttttaaggagaaggcgttgcgtatagtcgaggagttgggtatggacgattttatcgtttttaacggttggttggatcgttttcgtcggcgttacggcgtggtgttttgtagcggcgtggttcgcgttcgcgcgcgaaacgttgtttttcgtatttcggcggcgtttgttagttcggtcgcggtgttttcggagggtagtggcgggagtattattggttggcgcgttcgggaggagtagtcgtcgtcggtggtcgagggttacgtttcgtaggacgtgtttagcgttatcgagattagtttatggtacgattttttgttcgattaggtcgcggggttgtgcggaggcgacggacggtcgcgttaagttatttagcgtttgagcgttttgttatgcgttaatgtcgacggtagcgagaagttgttttcgtt

SEQ ID NO: 28864 - DNA, 720 bp, Artificial Sequence
  chemically treated genomic DNA (Homo sapiens) CpG-island No: 28864
aacgaaaacaacttctcgctaccgtcgacattaacgcataacaaaacgctcaaacgctaaataacttaacgcgaccgtccgtcgcctccgcacaaccccgcgacctaatcgaacaaaaaatcgtaccataaactaatctcgataacgctaaacacgtcctacgaaacgtaaccctcgaccaccgacgacgactactcctcccgaacgcgccaaccaataatactcccgccactaccctccgaaaacaccgcgaccgaactaacaaacgccgccgaaatacgaaaaacaacgtttcgcgcgcgaacgcgaaccacgccgctacaaaacaccacgccgtaacgccgacgaaaacgatccaaccaaccgttaaaaacgataaaatcgtccatacccaactcctcgactatacgcaacgccttctccttaaaaataatacccttaaccgacaaaccgacgacgcgaatctactaaaaccaaacgataaacaaaccctcgaacttatcgtaaaaaaacaacttattaatcttacgacaaataaaaaccaccccgtacttacgctccgacgccaaaataacgcgcttattcttcaaaatcgtactcaacgtaaacgacgaaatattaaaacgccgcgcgatctcgcccttacgcaaatccgaattctcctccacctcctaaataatccgtaacttctcccgaaacgtcaactatcgcctcttaaaa

SEQ ID NO: 28865 - DNA, 537 bp, Artificial Sequence
  chemically treated genomic DNA (Homo sapiens) CpG-island No: 28865
gttgttcgagattgcgcgtttttagtaaaaaattaggtcggtttttcgagtttagtttagcgtttttcgattcgtaaattaaggtttagtgatcgttttcgttgcgtagtcgtttgcgtcgttagttaattacgcgcggtcgagtagtttcgtttttttatatggttaatggtcgcgcgttttgttcgtttcgttttttcgttgcgggaagggttttgggtttcgggcggcggtcgttaggttttagggtcgggggtattcgaggtaagatcgtttttcgggcgttgggttttttcggtttagtacgtacggacgtttttagggaaggtggttgtagcggtaggacggagttcgtcgggacgttttgggtttggggtgcgcggggggtttaggaggggataggacgcgcggggattcggaagagcgggttttgtcgtaagagtttcgggaatattgagggttttaggcgtcgtatttagtattcggggaaaagggggtaggtggcgttgggcgtttgtttaggttgggggaaaggta

SEQ ID NO: 28866 - DNA, 537 bp, Artificial Sequence
  chemically treated genomic DNA (Homo sapiens) CpG-island No: 28866
tacctttcccccaacctaaacaaacgcccaacgccacctacccccttttccccgaatactaaatacgacgcctaaaaccctcaatattcccgaaactcttacgacaaaacccgctcttccgaatccccgcgcgtcctatcccctcctaaaccccccgcgcaccccaaacccaaaacgtcccgacgaactccgtcctaccgctacaaccaccttccctaaaaacgtccgtacgtactaaaccgaaaaaacccaacgcccgaaaaacgatcttacctcgaatacccccgaccctaaaacctaacgaccgccgcccgaaacccaaaacccttcccgcaacgaaaaaacgaaacgaacaaaacgcgcgaccattaaccatataaaaaaacgaaactactcgaccgcgcgtaattaactaacgacgcaaacgactacgcaacgaaaacgatcactaaaccttaatttacgaatcgaaaaacgctaaactaaactcgaaaaaccgacctaattttttactaaaaacgcgcaatctcgaacaac

SEQ ID NO: 28867 - DNA, 537 bp, Artificial Sequence
  chemically treated genomic DNA (Homo sapiens) CpG-island No: 28867
tattttttttttagtttgagtagacgtttagcgttatttattttttttttttcggatgttggatgcggcgtttggagtttttagtgttttcgaaatttttgcgatagggttcgttttttcggattttcgcgcgttttgtttttttttgggtttttcgcgtattttagatttagggcgtttcggcggatttcgttttgtcgttgtagttattttttttaaaggcgttcgtgcgtgttgagtcgaaaggatttaacgttcgggaagcgattttatttcgggtattttcggttttgagatttggcgatcgtcgttcggggtttaggatttttttcgtagcgaggaggcggggcgggtagagcgcgcggttattggttatgtggaggggcggggttattcggtcgcgcgtggttggttggcgacgtaggcggttgcgtagcggggacggttattgggttttggtttgcgggtcgggaagcgttagattgggttcggagaatcgatttgattttttgttgggggcgcgtagtttcgagtaat

SEQ ID NO: 28868 - DNA, 537 bp, Artificial Sequence
  chemically treated genomic DNA (Homo sapiens) CpG-island No: 28868
attactcgaaactacgcgcccccaacaaaaaatcaaatcgattctccgaacccaatctaacgcttcccgacccgcaaaccaaaacccaataaccgtccccgctacgcaaccgcctacgtcgccaaccaaccacgcgcgaccgaataaccccgcccctccacataaccaataaccgcgcgctctacccgccccgcctcctcgctacgaaaaaaatcctaaaccccgaacgacgatcgccaaatctcaaaaccgaaaatacccgaaataaaatcgcttcccgaacgttaaatcctttcgactcaacacgcacgaacgcctttaaaaaaaataactacaacgacaaaacgaaatccgccgaaacgccctaaatctaaaatacgcgaaaaacccaaaaaaaaacaaaacgcgcgaaaatccgaaaaaacgaaccctatcgcaaaaatttcgaaaacactaaaaactccaaacgccgcatccaacatccgaaaaaaaaaaaataaataacgctaaacgtctactcaaactaaaaaaaaaata

SEQ ID NO: 28869 - DNA, 762 bp, Artificial Sequence
  chemically treated genomic DNA (Homo sapiens) CpG-island No: 28869
tcgtttcgtaggtttttgaatcgaaagagggcggggtcgggtagacggcgttggtatcgcgtcggcgcgtttttagttggaaagaaagtcgatggacgcgcgtacggagcgattggtgttgacgtcgacggcggtgattttaatttcggtgtcgttaaattgtatggcggcgcggatttcgcggcggtcgggaggcgcgtcggcggtgttttggtcgtagtcggcgggtttaagttcgaggttgagcgcgtcgtatttgcgtacgtcggggtcggtgatgaagcgcgtattttttgtcgcgtagtagtataggttgatgagtacgcgtcgttggtcgggacgcgtcgggtagtagttgcgtcgtattttttcgtttagggttatcgattgttcggcggttacgaagcgttcgaagacgtcggtgtattagcggcggtcgtcgcgaattagtagtttttcgggcgggtggcgtttaggtataaagcggttgagtacgtttacgttataggtgagcggcgagcggcggattcgtattacgttcggcgtttggtcgaatagtatcgcgtttttgaggatggtgaggtttacgtcgtgcgggattacgatacgtagatcgcgggcgtttagcgtcgtttgtatcgcgtgttgtagtatcgttgattcggcgaagtcgtttattaggaatagtagttttatattttgtattttcggtcgtgttagtagggtttttgcgggataggacggggggacgcgggtgaaggg

SEQ ID NO: 28870 - DNA, 762 bp, Artificial Sequence
  chemically treated genomic DNA (Homo sapiens) CpG-island No: 28870
cccttcacccgcgtccccccgtcctatcccgcaaaaaccctactaacacgaccgaaaatacaaaatataaaactactattcctaataaacgacttcgccgaatcaacgatactacaacacgcgatacaaacgacgctaaacgcccgcgatctacgtatcgtaatcccgcacgacgtaaacctcaccatcctcaaaaacgcgatactattcgaccaaacgccgaacgtaatacgaatccgccgctcgccgctcacctataacgtaaacgtactcaaccgctttatacctaaacgccacccgcccgaaaaactactaattcgcgacgaccgccgctaatacaccgacgtcttcgaacgcttcgtaaccgccgaacaatcgataaccctaaacgaaaaaatacgacgcaactactacccgacgcgtcccgaccaacgacgcgtactcatcaacctatactactacgcgacaaaaaatacgcgcttcatcaccgaccccgacgtacgcaaatacgacgcgctcaacctcgaacttaaacccgccgactacgaccaaaacaccgccgacgcgcctcccgaccgccgcgaaatccgcgccgccatacaatttaacgacaccgaaattaaaatcaccgccgtcgacgtcaacaccaatcgctccgtacgcgcgtccatcgactttctttccaactaaaaacgcgccgacgcgataccaacgccgtctacccgaccccgccctctttcgattcaaaaacctacgaaacga

SEQ ID NO: 28871 - DNA, 762 bp, Artificial Sequence
  chemically treated genomic DNA (Homo sapiens) CpG-island No: 28871
ttttttattcgcgttttttcgttttgtttcgtagaggttttgttggtacggtcggaggtgtagggtgtgaagttgttgtttttagtgggcggtttcgtcgagttagcggtgttgtagtacgcggtgtaggcggcgttgggcgttcgcggtttgcgtgtcgtggtttcgtacgacgtgggttttattatttttaaaggcgcggtgttgttcggttaggcgtcgggcgtggtgcgggttcgtcgttcgtcgtttatttatggcgtgggcgtgtttaatcgttttgtgtttgggcgttattcgttcgaaaagttgttggttcgcgacggtcgtcgttggtgtatcgacgttttcgagcgtttcgtggtcgtcgagtagtcggtggttttgggcgaggaggtgcggcgtagttattgttcggcgcgtttcggttagcggcgcgtatttattaatttgtattgttgcgcggtagaggatgcgcgttttattatcgatttcggcgtgcgtaaatgcggcgcgtttagtttcgagtttgagttcgtcgattgcggttaggatatcgtcggcgcgtttttcggtcgtcgcgagattcgcgtcgttatgtagtttggcgatatcgaaattaaggttatcgtcgtcgacgttagtattaatcgtttcgtgcgcgcgtttatcgattttttttttaattgagggcgcgtcggcgcggtgttagcgtcgtttgttcggtttcgttttttttcggtttaggggtttgcggagcgg

SEQ ID NO: 28872 - DNA, 762 bp, Artificial Sequence
  chemically treated genomic DNA (Homo sapiens) CpG-island No: 28872
ccgctccgcaaacccctaaaccgaaaaaaaacgaaaccgaacaaacgacgctaacaccgcgccgacgcgccctcaattaaaaaaaaaatcgataaacgcgcgcacgaaacgattaatactaacgtcgacgacgataaccttaatttcgatatcgccaaactacataacgacgcgaatctcgcgacgaccgaaaaacgcgccgacgatatcctaaccgcaatcgacgaactcaaactcgaaactaaacgcgccgcatttacgcacgccgaaatcgataataaaacgcgcatcctctaccgcgcaacaatacaaattaataaatacgcgccgctaaccgaaacgcgccgaacaataactacgccgcacctcctcgcccaaaaccaccgactactcgacgaccacgaaacgctcgaaaacgtcgatacaccaacgacgaccgtcgcgaaccaacaacttttcgaacgaataacgcccaaacacaaaacgattaaacacgcccacgccataaataaacgacgaacgacgaacccgcaccacgcccgacgcctaaccgaacaacaccgcgcctttaaaaataataaaacccacgtcgtacgaaaccacgacacgcaaaccgcgaacgcccaacgccgcctacaccgcgtactacaacaccgctaactcgacgaaaccgcccactaaaaacaacaacttcacaccctacacctccgaccgtaccaacaaaacctctacgaaacaaaacgaaaaaacgcgaataaaaaa

SEQ ID NO: 28873 - DNA, 505 bp, Artificial Sequence
  chemically treated genomic DNA (Homo sapiens) CpG-island No: 28873
agatcgcgtttttggggttaattttagtagcgagaggcggtttttgtttatcgttttattttattacgtcgcggttttttaagaatttttttagcggtttttttttttttttaggagtagaggttttttgagatcgacggggagggacggttcgggtcggttattcgaggggtcgtacggattttttttttcgtttagttttattttttcgaggggcggcggttcgggagtggcgattcggtttttttatggcgcgcgtcgtcggggtttttggttaggtttcgagcggggttggcggggaggggaggcgggagcgagggcgggcggtgggaggtgggggcgggaaggttcgaaggcggcggtttgaggttgtatcgggtacgggtcggtcgtaatttagtttgggcggagtcggagttgcgagtcgttgtttagaggtcgaggagtttatagttatgggttggaggtttcggagagttcgggggatttcgttgttgttgttgtt

SEQ ID NO: 28874 - DNA, 505 bp, Artificial Sequence
  chemically treated genomic DNA (Homo sapiens) CpG-island No: 28874
aacaacaacaacaacgaaatcccccgaactctccgaaacctccaacccataactataaactcctcgacctctaaacaacgactcgcaactccgactccgcccaaactaaattacgaccgacccgtacccgatacaacctcaaaccgccgccttcgaaccttcccgcccccacctcccaccgcccgccctcgctcccgcctcccctccccgccaaccccgctcgaaacctaaccaaaaaccccgacgacgcgcgccataaaaaaaccgaatcgccactcccgaaccgccgcccctcgaaaaaataaaactaaacgaaaaaaaaaatccgtacgacccctcgaataaccgacccgaaccgtccctccccgtcgatctcaaaaaacctctactcctaaaaaaaaaaaaaaaccgctaaaaaaattcttaaaaaaccgcgacgtaataaaataaaacgataaacaaaaaccgcctctcgctactaaaattaaccccaaaaacgcgatct

SEQ ID NO: 28875 - DNA, 505 bp, Artificial Sequence
  chemically treated genomic DNA (Homo sapiens) CpG-island No: 28875
agtagtagtagtaacggggtttttcgagtttttcggggtttttagtttatagttgtgagtttttcggtttttaggtagcggttcgtaatttcggtttcgtttaggttggattgcggtcgattcgtgttcggtgtagttttaggtcgtcgttttcggattttttcgtttttattttttatcgttcgttttcgttttcgtttttttttttcgttaatttcgttcggagtttggttaggggtttcgacggcgcgcgttatgggggagtcgggtcgttattttcggatcgtcgtttttcgagggggtggagttgggcggaggagggaattcgtgcggtttttcggatgatcggttcgagtcgttttttttcgtcggttttagagggtttttatttttgagaggaggagagaatcgttgggaaggtttttggaggatcgcggcgtggtgggatgaggcggtgggtaaaggtcgtttttcgttgttgaagttggttttaggagcgcgattt

SEQ ID NO: 28876 - DNA, 505 bp, Artificial Sequence
  chemically treated genomic DNA (Homo sapiens) CpG-island No: 28876
aaatcgcgctcctaaaaccaacttcaacaacgaaaaacgacctttacccaccgcctcatcccaccacgccgcgatcctccaaaaaccttcccaacgattctctcctcctctcaaaaataaaaaccctctaaaaccgacgaaaaaaaacgactcgaaccgatcatccgaaaaaccgcacgaattccctcctccgcccaactccaccccctcgaaaaacgacgatccgaaaataacgacccgactcccccataacgcgcgccgtcgaaacccctaaccaaactccgaacgaaattaacgaaaaaaaaaaacgaaaacgaaaacgaacgataaaaaataaaaacgaaaaaatccgaaaacgacgacctaaaactacaccgaacacgaatcgaccgcaatccaacctaaacgaaaccgaaattacgaaccgctacctaaaaaccgaaaaactcacaactataaactaaaaaccccgaaaaactcgaaaaaccccgttactactactact

SEQ ID NO: 28877 - DNA, 507 bp, Artificial Sequence
  chemically treated genomic DNA (Homo sapiens) CpG-island No: 28877
gcgggaggtgcggtcgcggttcgggtttggtaggcgttgcgcgcggggttggggtagcggtaatcgtaattgtggtcgcggtcgtcgtaggcgtatagcgcgcgtttaagtggagaataaagtgatttttagaatttttttaatttttttcggcgttttcgcgagggttacgcgtcgagggtagcggagggcggcgcgcgatcggttttatcgagttcggcgcgcgattcgaggtaaggggcgttcgggtgagggcgtaggagggcgacgattcgcgttggttggcggcggttttaggttttttgcgggcggggcggcgcgcggtcggcggttttttttttttttttttgttggtcgtttttttttgttttcgtttttttgggagtttcgcggaaggtcgcggttgcggggcgcggtttggtatttttttttcggagggcggtagcgttcgggtatagtttggtacgggggacgaagtattttttagaaggttttgaaattaggttt

SEQ ID NO: 28878 - DNA, 507 bp, Artificial Sequence
  chemically treated genomic DNA (Homo sapiens) CpG-island No: 28878
aaacctaatttcaaaaccttctaaaaaatacttcgtcccccgtaccaaactatacccgaacgctaccgccctccgaaaaaaaaataccaaaccgcgccccgcaaccgcgaccttccgcgaaactcccaaaaaaacgaaaacaaaaaaaaacgaccaacaaaaaaaaaaaaaaaaaaccgccgaccgcgcgccgccccgcccgcaaaaaacctaaaaccgccgccaaccaacgcgaatcgtcgccctcctacgccctcacccgaacgccccttacctcgaatcgcgcgccgaactcgataaaaccgatcgcgcgccgccctccgctaccctcgacgcgtaaccctcgcgaaaacgccgaaaaaaattaaaaaaattctaaaaatcactttattctccacttaaacgcgcgctatacgcctacgacgaccgcgaccacaattacgattaccgctaccccaaccccgcgcgcaacgcctaccaaacccgaaccgcgaccgcacctcccgc

SEQ ID NO: 28879 - DNA, 507 bp, Artificial Sequence
  chemically treated genomic DNA (Homo sapiens) CpG-island No: 28879
ggatttagttttagagttttttggaaagtgtttcgtttttcgtgttaggttgtgttcggacgttgtcgtttttcggggagagggtgttaggtcgcgtttcgtagtcgcgatttttcgcgggatttttaggaaagcgggggtagagaggggcggttaataaaggggaagggaggggatcgtcggtcgcgcgtcgtttcgttcgtaggggatttggagtcgtcgttaattagcgcgggtcgtcgtttttttgcgtttttattcgggcgttttttatttcgggtcgcgcgtcgggttcggtggggtcggtcgcgcgtcgtttttcgttattttcggcgcgtggttttcgcgggaacgtcgggaggagttggagaagttttgggggttattttgttttttatttggacgcgcgttgtgcgtttgcggcggtcgcggttatagttacggttatcgttgttttagtttcgcgcgtagcgtttgttaggttcgagtcgcgatcgtatttttcgt

SEQ ID NO: 28880 - DNA, 507 bp, Artificial Sequence
  chemically treated genomic DNA (Homo sapiens) CpG-island No: 28880
acgaaaaatacgatcgcgactcgaacctaacaaacgctacgcgcgaaactaaaacaacgataaccgtaactataaccgcgaccgccgcaaacgcacaacgcgcgtccaaataaaaaacaaaataacccccaaaacttctccaactcctcccgacgttcccgcgaaaaccacgcgccgaaaataacgaaaaacgacgcgcgaccgaccccaccgaacccgacgcgcgacccgaaataaaaaacgcccgaataaaaacgcaaaaaaacgacgacccgcgctaattaacgacgactccaaatcccctacgaacgaaacgacgcgcgaccgacgatcccctcccttcccctttattaaccgcccctctctacccccgctttcctaaaaatcccgcgaaaaatcgcgactacgaaacgcgacctaacaccctctccccgaaaaacgacaacgtccgaacacaacctaacacgaaaaacgaaacactttccaaaaaactctaaaactaaatcc

SEQ ID NO: 28881 - DNA, 535 bp, Artificial Sequence
  chemically treated genomic DNA (Homo sapiens) CpG-island No: 28881
gcgggtgagggtgcgggtgagggtgttggtggagcgggtgagggtgcgggtgagggtgttggtggagcgggtgagggtgagggtgagggtgttggtggagcgggtgagggtgcgggtgagggtgttggtggagcgggtgcgggtgcgggtgtaggtgagggtgttgatggagcgggtgagggtgagggtgagggtgttgatgaagcgggtgagggtgcgggtgagggtgttgatggagcgggtgagggtgcgggtgagggtgttgatggagcgggtgagggtgagggtgagggtgagggtgttgacggagcgggtgagggtgagggtgagggtgttgatggagcgggtgagggtgagggtgagggtgttgatggagcgggcgagggtgagggtgagggtgttgatggagcgggtgagggtgcgggtgagggtgttggtggagcgggtgagggtgttaatgaagcgggtgcgggtgagggtgttgatggagcgggtgcgggtgagggggtcgtatatttatttttttgtttggttt

SEQ ID NO: 28882 - DNA, 535 bp, Artificial Sequence
  chemically treated genomic DNA (Homo sapiens) CpG-island No: 28882
aaaccaaacaaaaaaataaatatacgaccccctcacccgcacccgctccatcaacaccctcacccgcacccgcttcattaacaccctcacccgctccaccaacaccctcacccgcaccctcacccgctccatcaacaccctcaccctcaccctcgcccgctccatcaacaccctcaccctcaccctcacccgctccatcaacaccctcaccctcaccctcacccgctccgtcaacaccctcaccctcaccctcaccctcacccgctccatcaacaccctcacccgcaccctcacccgctccatcaacaccctcacccgcaccctcacccgcttcatcaacaccctcaccctcaccctcacccgctccatcaacaccctcacctacacccgcacccgcacccgctccaccaacaccctcacccgcaccctcacccgctccaccaacaccctcaccctcaccctcacccgctccaccaacaccctcacccgcaccctcacccgctccaccaacaccctcacccgcaccctcacccgc

SEQ ID NO: 28883 - DNA, 535 bp, Artificial Sequence
  chemically treated genomic DNA (Homo sapiens) CpG-island No: 28883
ggattaggtaaggggatgagtatgcggtttttttattcgtattcgttttattagtatttttattcgtattcgttttattaatatttttattcgttttattagtatttttattcgtatttttattcgttttattagtatttttatttttattttcgttcgttttattagtatttttatttttatttttattcgttttattagtatttttatttttatttttattcgtttcgttaatatttttatttttatttttatttttattcgttttattagtatttttattcgtatttttattcgttttattagtatttttattcgtatttttattcgttttattagtatttttatttttatttttattcgttttattagtatttttatttgtattcgtattcgtattcgttttattagtatttttattcgtatttttattcgttttattagtatttttatttttatttttattcgttttattagtatttttattcgtatttttattcgttttattagtatttttattcgtatttttattcgt

SEQ ID NO: 28884 - DNA, 535 bp, Artificial Sequence
  chemically treated genomic DNA (Homo sapiens) CpG-island No: 28884
acgaataaaaatacgaataaaaatactaataaaacgaataaaaatacgaataaaaatactaataaaacgaataaaaataaaaataaaaatactaataaaacgaataaaaatacgaataaaaatactaataaaacgaatacgaatacgaatacaaataaaaatactaataaaacgaataaaaataaaaataaaaatactaataaaacgaataaaaatacgaataaaaatactaataaaacgaataaaaatacgaataaaaatactaataaaacgaataaaaataaaaataaaaataaaaatattaacgaaacgaataaaaataaaaataaaaatactaataaaacgaataaaaataaaaataaaaatactaataaaacgaacgaaaataaaaataaaaatactaataaaacgaataaaaatacgaataaaaatactaataaaacgaataaaaatattaataaaacgaatacgaataaaaatactaataaaacgaatacgaataaaaaaaccgcatactcatccccttacctaatcc

SEQ ID NO: 28885 - DNA, 961 bp, Artificial Sequence
  chemically treated genomic DNA (Homo sapiens) CpG-island No: 28885
agcggggtcgaatttcgtcggggggaagcggtagtacgtgttaaggttacgatttttttttgtcgtcgggagggttcggtcgtcgtagggggcggggagcgtgggaggggacggcgtttatttggcggttgggtcggatcgcggcgggagagcgggtagcgggtttagttggtcggggtttaggtgagggcggcgggtcgcgttttttagcgggggaggttttttggtcgggaaaggtataattgtgtgtagttatttttggtatgttaagcgggtcgggcggtcgcgagtcgggaggggcgtcgtttttaggggttcgggagagggtaggggttaggcgggcgggtgcgggaaggatgcgggcgcgggggcgtattttttcggggcggagtcgcgggttgtgcgggaattttagcggggttcgggtcgcggtttttggcggattgtggtatttttcgggttagatagtttgattatagaggcggtcgcggtcgggagttcggggagttaagggaggggtagacggaagcggcgattcggcgggtttcgggagggcggtggggtgggtcggggcggggttatcgcggggaggacggcggcggcgttgcgatttttgaagtttaaattgtcgtcggggttggtgtcgcgcgttgtcgttgggtattcgtttcgtttttcgcgttttgtttgattgttcgggttttcgcgggttttgggtcgtttttaggagtttagagaaagttaggtttttacgttcgtgtaggttcgagattttaacgaattgtagagcgtaataaagggaattagagtttcggcgttttcgtagtcggagcggaagtcggagttgtgggaggttcgcgtgtttttttcgttcgtggggtttagacgcgcggggataattttttttttttacgtatttcgagttttttttttttttttttgttttagttatggaagggtt

SEQ ID NO: 28886 - DNA, 961 bp, Artificial Sequence
  chemically treated genomic DNA (Homo sapiens) CpG-island No: 28886
aacccttccataactaaaacaaaaaaaaaaaaaaaaaactcgaaatacgtaaaaaaaaaaaattatccccgcgcgtctaaaccccacgaacgaaaaaaacacgcgaacctcccacaactccgacttccgctccgactacgaaaacgccgaaactctaattccctttattacgctctacaattcgttaaaatctcgaacctacacgaacgtaaaaacctaactttctctaaactcctaaaaacgacccaaaacccgcgaaaacccgaacaatcaaacaaaacgcgaaaaacgaaacgaatacccaacgacaacgcgcgacaccaaccccgacgacaatttaaacttcaaaaatcgcaacgccgccgccgtcctccccgcgataaccccgccccgacccaccccaccgccctcccgaaacccgccgaatcgccgcttccgtctacccctcccttaactccccgaactcccgaccgcgaccgcctctataatcaaactatctaacccgaaaaataccacaatccgccaaaaaccgcgacccgaaccccgctaaaattcccgcacaacccgcgactccgccccgaaaaaatacgcccccgcgcccgcatccttcccgcacccgcccgcctaacccctaccctctcccgaacccctaaaaacgacgcccctcccgactcgcgaccgcccgacccgcttaacataccaaaaataactacacacaattatacctttcccgaccaaaaaacctcccccgctaaaaaacgcgacccgccgccctcacctaaaccccgaccaactaaacccgctacccgctctcccgccgcgatccgacccaaccgccaaataaacgccgtcccctcccacgctccccgccccctacgacgaccgaaccctcccgacgacaaaaaaaaatcgtaaccttaacacgtactaccgcttccccccgacgaaattcgaccccgct

SEQ ID NO: 28887 - DNA, 961 bp, Artificial Sequence
  chemically treated genomic DNA (Homo sapiens) CpG-island No: 28887
agtttttttatggttaggataagggagggagagagagattcgggatgcgtggaggggaggggttgttttcgcgcgtttgggttttacgggcggggagggtacgcgggttttttataatttcggttttcgtttcggttgcgaaggcgtcggggttttagttttttttgttgcgttttgtagttcgttaaggtttcgaatttatacgaacgtgaagatttggttttttttaaatttttgaaagcgatttaaggttcgcggggattcgggtagttaggtaggacgcgggaagcgaagcgggtgtttagcggtagcgcgcggtattagtttcgacgatagtttggattttaaaagtcgtagcgtcgtcgtcgtttttttcgcggtggtttcgtttcggtttattttatcgttttttcggggttcgtcgagtcgtcgttttcgtttgttttttttttggtttttcgggttttcggtcgcggtcgtttttgtggttagattgtttggttcgggagatgttatagttcgttaggggtcgcggttcgggtttcgttggggttttcgtatagttcgcggtttcgtttcgagaggatgcgttttcgcgttcgtatttttttcgtattcgttcgtttggtttttgttttttttcgggtttttgagagcggcgtttttttcggttcgcggtcgttcggttcgtttgatatattagaaatagttgtatataattgtatttttttcggttaagaaatttttttcgttggggagcgcggttcgtcgtttttatttgagtttcggttagttgagttcgttattcgttttttcgtcgcgattcggtttagtcgttaggtgagcgtcgtttttttttacgtttttcgttttttgcggcggtcgggttttttcggcggtagaggagggtcgtggttttggtacgtgttgtcgttttttttcggcggagttcggtttcgtt

SEQ ID NO: 28888 - DNA, 961 bp, Artificial Sequence
  chemically treated genomic DNA (Homo sapiens) CpG-island No: 28888
aacgaaaccgaactccgccgaaaaaaaacgacaacacgtaccaaaaccacgaccctcctctaccgccgaaaaaacccgaccgccgcaaaaaacgaaaaacgtaaaaaaaaacgacgctcacctaacgactaaaccgaatcgcgacgaaaaaacgaataacgaactcaactaaccgaaactcaaataaaaacgacgaaccgcgctccccaacgaaaaaaatttcttaaccgaaaaaaatacaattatatacaactatttctaatatatcaaacgaaccgaacgaccgcgaaccgaaaaaaacgccgctctcaaaaacccgaaaaaaaacaaaaaccaaacgaacgaatacgaaaaaaatacgaacgcgaaaacgcatcctctcgaaacgaaaccgcgaactatacgaaaaccccaacgaaacccgaaccgcgacccctaacgaactataacatctcccgaaccaaacaatctaaccacaaaaacgaccgcgaccgaaaacccgaaaaaccaaaaaaaaaacaaacgaaaacgacgactcgacgaaccccgaaaaaacgataaaataaaccgaaacgaaaccaccgcgaaaaaaacgacgacgacgctacgacttttaaaatccaaactatcgtcgaaactaataccgcgcgctaccgctaaacacccgcttcgcttcccgcgtcctacctaactacccgaatccccgcgaaccttaaatcgctttcaaaaatttaaaaaaaaccaaatcttcacgttcgtataaattcgaaaccttaacgaactacaaaacgcaacaaaaaaaactaaaaccccgacgccttcgcaaccgaaacgaaaaccgaaattataaaaaacccgcgtaccctccccgcccgtaaaacccaaacgcgcgaaaacaacccctcccctccacgcatcccgaatctctctctccctcccttatcctaaccataaaaaaact

SEQ ID NO: 28889 - DNA, 1431 bp, Artificial Sequence
  chemically treated genomic DNA (Homo sapiens) CpG-island No: 28889
cggtttttcggcgggggtcggtagtttggttttttatttcggcgtgcgtttagtttttaagttcgtcggtttagcgagggcggcggcggtcgtttacggcgatttttatcgggaggagagtagtagtaagtaaggagtcggtttcgttttgggtaggttgttgggcgggggtcgggcgtgcgggcgtttcgggagcggggagaattcggcggcgggcggcgcgggttattattattattattacgcgtattattattattattttaagtgtttgttcgttggggattcgtcgtcgtcgtcgtcgtttggtttgttttgttttggggttttgcgcggtttttttttgtttttcgttttttcggaagaggcgttcgtttttaagtacgtggagcgcgtttcgttcgtagtcgtcgcgttgttaggagcgcgttatgcgtagttgttttttgcgtcggggttgtttttcgagcgttgcgcgttgtcgtttttcgattcgggcggttttaaagtttattcgggtggtgagtgtagttatttgttcgtcgttatgtcggtttttatagtttataacggggagttgttttacggtttatcggttattatcgtttattattcgtttaaattgtatttcggcgggttgttgaagtattcggagtttattttttattttagcgggtttgtagcggtcgttttaagtttcgtcgagttggggtcgttggttagtatcgatcgagagatcgttatgtataattagtagttgttcgagatggttgtcgggaagggtcgcggacgtttggattcggggacgttgttatcggtcgtcgcggcggcgggaggtatcgggggcggcggtagcggaggtagcggcgtaggtaagtttaagatcggttatttgtgtttttattgtggtaagttgtattcgcgtaagtatgggtttaagatttatatgcggacgtatacgggttataagttatttaagtgtaaagtttgtttgcggtttttcggcgattttagtaattttaataagtatattcggttgtacgtcgagggtaatacgttttatcgttgcgagttttgcggtaaggtatttgtgcgtcgtcgggatttggagcgatatgttaagtttcgttattttggttagagtttgttcgttaaagcgggcgacggttcgggtgtcgagttcggttatttttcggagtttggggattttaagagcgacgatagtgacgtggacgtttgttttatagacgattagagcgatttcgaggttgggggcggcggggagcgcgatttgtaacgagttttttcgggaaggggcggggtgaggatagagaggagtcgagggtttattttcgtagtagaggaatttttggtggtgggaagagggatttaatggataaaatcgtttttgtttttgagagggcgttagat

SEQ ID NO: 28890 - DNA, 1431 bp, Artificial Sequence
  chemically treated genomic DNA (Homo sapiens) CpG-island No: 28890
atctaacgccctctcaaaaacaaaaacgattttatccattaaatccctcttcccaccaccaaaaattcctctactacgaaaataaaccctcgactcctctctatcctcaccccgccccttcccgaaaaaactcgttacaaatcgcgctccccgccgcccccaacctcgaaatcgctctaatcgtctataaaacaaacgtccacgtcactatcgtcgctcttaaaatccccaaactccgaaaaataaccgaactcgacacccgaaccgtcgcccgctttaacgaacaaactctaaccaaaataacgaaacttaacatatcgctccaaatcccgacgacgcacaaataccttaccgcaaaactcgcaacgataaaacgtattaccctcgacgtacaaccgaatatacttattaaaattactaaaatcgccgaaaaaccgcaaacaaactttacacttaaataacttataacccgtatacgtccgcatataaatcttaaacccatacttacgcgaatacaacttaccacaataaaaacacaaataaccgatcttaaacttacctacgccgctacctccgctaccgccgcccccgatacctcccgccgccgcgacgaccgataacaacgtccccgaatccaaacgtccgcgacccttcccgacaaccatctcgaacaactactaattatacataacgatctctcgatcgatactaaccaacgaccccaactcgacgaaacttaaaacgaccgctacaaacccgctaaaataaaaaataaactccgaatacttcaacaacccgccgaaatacaatttaaacgaataataaacgataataaccgataaaccgtaaaacaactccccgttataaactataaaaaccgacataacgacgaacaaataactacactcaccacccgaataaactttaaaaccgcccgaatcgaaaaacgacaacgcgcaacgctcgaaaaacaaccccgacgcaaaaaacaactacgcataacgcgctcctaacaacgcgacgactacgaacgaaacgcgctccacgtacttaaaaacgaacgcctcttccgaaaaaacgaaaaacaaaaaaaaaccgcgcaaaaccccaaaacaaaacaaaccaaacgacgacgacgacgacgaatccccaacgaacaaacacttaaaataataataataatacgcgtaataataataataataacccgcgccgcccgccgccgaattctccccgctcccgaaacgcccgcacgcccgacccccgcccaacaacctacccaaaacgaaaccgactccttacttactactactctcctcccgataaaaatcgccgtaaacgaccgccgccgccctcgctaaaccgacgaacttaaaaactaaacgcacgccgaaataaaaaaccaaactaccgacccccgccgaaaaaccg

SEQ ID NO: 28891 - DNA, 1431 bp, Artificial Sequence
  chemically treated genomic DNA (Homo sapiens) CpG-island No: 28891
atttggcgtttttttaaaaataaaaacggttttgtttattgggtttttttttttattattaggagtttttttattgcgagaataaattttcgatttttttttgtttttatttcgttttttttcgggaagattcgttataagtcgcgtttttcgtcgtttttaatttcggggtcgttttggtcgtttgtgaagtagacgtttacgttattgtcgtcgtttttgggatttttaggtttcgggggatagtcgggttcggtattcgggtcgtcgttcgttttggcgagtagattttggttagggtggcgggatttgatatgtcgttttaggtttcggcggcgtataagtattttgtcgtagaattcgtagcggtagggcgtattgttttcggcgtgtagtcggatgtgtttgttgagattgttggggtcgtcgaagggtcgtagatagattttgtatttgagtggtttgtagttcgtgtgcgttcgtatgtggattttgagtttatatttgcgcgagtatagtttgttatagtagaggtataggtggtcggttttgggtttatttgcgtcgttgttttcgttgtcgtcgttttcggtgtttttcgtcgtcgcgacggtcggtggtaacgttttcgagtttaggcgttcgcgatttttttcggtagttatttcggatagttgttgattgtgtatggcgatttttcggtcgatgttggttagcgattttagttcggcggggtttagggcggtcgttgtaggttcgttgaagtaggagatggatttcggatattttagtagttcgtcgaagtgtaatttgagcgggtaataagcggtggtggtcggtgagtcgtagagtagtttttcgttgtagattgtaaaggtcggtatgacggcgggtaggtggttgtatttattattcggataggttttgagatcgttcgggtcgaggggcggtagcgcgtagcgttcgaggggtaatttcggcgtagggggtagttgcgtataacgcgtttttggtagcgcggcggttgcgggcggggcgcgttttacgtgtttgaaggcggacgtttttttcggggggacggagagtagagggaagtcgcgtagggttttagagtagggtaggttaggcggcggcggcggcggcgggtttttagcgagtaggtatttgggatggtggtggtggtgcgcgtggtggtgatggtggtgattcgcgtcgttcgtcgtcgagtttttttcgttttcggggcgttcgtacgttcggttttcgtttagtagtttgtttaaagcgaggtcggttttttgtttgttgttgtttttttttcggtaggggtcgtcgtgagcggtcgtcgtcgttttcgttaggtcggcgggtttgaaagttgagcgtacgtcggggtagaaagttaggttgtcgattttcgtcgaggagtcg

SEQ ID NO: 28892 - DNA, 1431 bp, Artificial Sequence
  chemically treated genomic DNA (Homo sapiens) CpG-island No: 28892
cgactcctcgacgaaaatcgacaacctaactttctaccccgacgtacgctcaactttcaaacccgccgacctaacgaaaacgacgacgaccgctcacgacgacccctaccgaaaaaaaaacaacaacaaacaaaaaaccgacctcgctttaaacaaactactaaacgaaaaccgaacgtacgaacgccccgaaaacgaaaaaaactcgacgacgaacgacgcgaatcaccaccatcaccaccacgcgcaccaccaccaccatcccaaatacctactcgctaaaaacccgccgccgccgccgccgcctaacctaccctactctaaaaccctacgcgacttccctctactctccgtccccccgaaaaaaacgtccgccttcaaacacgtaaaacgcgccccgcccgcaaccgccgcgctaccaaaaacgcgttatacgcaactaccccctacgccgaaattacccctcgaacgctacgcgctaccgcccctcgacccgaacgatctcaaaacctatccgaataataaatacaaccacctacccgccgtcataccgacctttacaatctacaacgaaaaactactctacgactcaccgaccaccaccgcttattacccgctcaaattacacttcgacgaactactaaaatatccgaaatccatctcctacttcaacgaacctacaacgaccgccctaaaccccgccgaactaaaatcgctaaccaacatcgaccgaaaaatcgccatacacaatcaacaactatccgaaataactaccgaaaaaaatcgcgaacgcctaaactcgaaaacgttaccaccgaccgtcgcgacgacgaaaaacaccgaaaacgacgacaacgaaaacaacgacgcaaataaacccaaaaccgaccacctatacctctactataacaaactatactcgcgcaaatataaactcaaaatccacatacgaacgcacacgaactacaaaccactcaaatacaaaatctatctacgacccttcgacgaccccaacaatctcaacaaacacatccgactacacgccgaaaacaatacgccctaccgctacgaattctacgacaaaatacttatacgccgccgaaacctaaaacgacatatcaaatcccgccaccctaaccaaaatctactcgccaaaacgaacgacgacccgaataccgaacccgactatcccccgaaacctaaaaatcccaaaaacgacgacaataacgtaaacgtctacttcacaaacgaccaaaacgaccccgaaattaaaaacgacgaaaaacgcgacttataacgaatcttcccgaaaaaaaacgaaataaaaacaaaaaaaaatcgaaaatttattctcgcaataaaaaaactcctaataataaaaaaaaaaacccaataaacaaaaccgtttttatttttaaaaaaacgccaaat

SEQ ID NO: 28893 - DNA, 748 bp, Artificial Sequence
  chemically treated genomic DNA (Homo sapiens) CpG-island No: 28893
cgtagttttacggtttttttggcgggtttttttttttttttttttttcgagttgttgtggtagggtaggtcgcggtcgcggtaggacgggtcgcgggttagttttagttcgttgtagggcggtagcgcgtcgtcggacgcgtttttttggtcgttttgcgacgagtcggttttgtaggtgtcgggcggcgattaagcgtagtaggaggcgttgcgcgggtcgagttgcgcgtttcgtttggatggcgtttttaggttgttatcgcggttggcgttttcgggtcgcgtttggcgttttcgcgcgttgtttaggtacgagtggtcgtatttgggtgcggtgtttggcgtgcggtttattagtcgcggtaggtgcgcgttttcggcgggtttgcggcgcgcggggttgaaggtttagtcgcggttagtatcggttaggggttcgcggttgcggttgcgttgatcgtagtatttttttaaggagtcgttttggtagaagtcgttgtgcgttcgcgatttcgagcgttcgaagcggttttcgtttcgcgtttcgtgattgttgtcgtttgttcggcggggtcgttggtcgtaggagttagcgaaggtcgttagttcgtttatggaaacggtcggtattttcgtggcgaagttttttcgcgatagtattttcgatttggagcgcggttggttgcgggtagagaaggagggggttagacggtcggtttttttttggagttttaggtagggttttt

SEQ ID NO: 28894 - DNA, 748 bp, Artificial Sequence
  chemically treated genomic DNA (Homo sapiens) CpG-island No: 28894
aaaaaccctacctaaaactccaaaaaaaaaccgaccgtctaaccccctccttctctacccgcaaccaaccgcgctccaaatcgaaaatactatcgcgaaaaaacttcgccacgaaaataccgaccgtttccataaacgaactaacgaccttcgctaactcctacgaccaacgaccccgccgaacaaacgacaacaatcacgaaacgcgaaacgaaaaccgcttcgaacgctcgaaatcgcgaacgcacaacgacttctaccaaaacgactccttaaaaaaatactacgatcaacgcaaccgcaaccgcgaacccctaaccgatactaaccgcgactaaaccttcaaccccgcgcgccgcaaacccgccgaaaacgcgcacctaccgcgactaataaaccgcacgccaaacaccgcacccaaatacgaccactcgtacctaaacaacgcgcgaaaacgccaaacgcgacccgaaaacgccaaccgcgataacaacctaaaaacgccatccaaacgaaacgcgcaactcgacccgcgcaacgcctcctactacgcttaatcgccgcccgacacctacaaaaccgactcgtcgcaaaacgaccaaaaaaacgcgtccgacgacgcgctaccgccctacaacgaactaaaactaacccgcgacccgtcctaccgcgaccgcgacctaccctaccacaacaactcgaaaaaaaaaaaaaaaaaaaaacccgccaaaaaaaccgtaaaactacg

SEQ ID NO: 28895 - DNA, 748 bp, Artificial Sequence
  chemically treated genomic DNA (Homo sapiens) CpG-island No: 28895
gggagttttatttggagttttagggagggatcggtcgtttgattttttttttttttgttcgtagttagtcgcgttttaagtcggagatgttgtcgcggaagaatttcgttacgggggtgtcggtcgtttttatggacgagttggcggttttcgttgatttttacggttagcggtttcgtcgggtagacggtaatagttacgaggcgcggggcgggagtcgtttcgagcgttcggagtcgcgggcgtatagcggtttttattaggacgattttttggaggagtattacggttagcgtagtcgtagtcgcgagtttttgatcgatgttgatcgcggttgggtttttagtttcgcgcgtcgtagattcgtcgaggacgcgtatttgtcgcggttggtgagtcgtacgttaggtatcgtatttaaatacgattattcgtatttgggtagcgcgcgggagcgttaggcgcggttcgagggcgttagtcgcggtggtagtttggagacgttatttaagcggagcgcgtagttcggttcgcgtagcgttttttattacgtttggtcgtcgttcggtatttataaggtcggttcgtcgtaggacgattaggaggacgcgttcgacgacgcgttgtcgttttatagcgagttggagttgattcgcggttcgttttatcgcggtcgcgatttgttttattatagtaattcggagaagaagaggaaaaaggagttcgttaagaaaatcgtgagattgcg

SEQ ID NO: 28896 - DNA, 748 bp, Artificial Sequence
  chemically treated genomic DNA (Homo sapiens) CpG-island No: 28896
cgcaatctcacgattttcttaacgaactcctttttcctcttcttctccgaattactataataaaacaaatcgcgaccgcgataaaacgaaccgcgaatcaactccaactcgctataaaacgacaacgcgtcgtcgaacgcgtcctcctaatcgtcctacgacgaaccgaccttataaataccgaacgacgaccaaacgtaataaaaaacgctacgcgaaccgaactacgcgctccgcttaaataacgtctccaaactaccaccgcgactaacgccctcgaaccgcgcctaacgctcccgcgcgctacccaaatacgaataatcgtatttaaatacgatacctaacgtacgactcaccaaccgcgacaaatacgcgtcctcgacgaatctacgacgcgcgaaactaaaaacccaaccgcgatcaacatcgatcaaaaactcgcgactacgactacgctaaccgtaatactcctccaaaaaatcgtcctaataaaaaccgctatacgcccgcgactccgaacgctcgaaacgactcccgccccgcgcctcgtaactattaccgtctacccgacgaaaccgctaaccgtaaaaatcaacgaaaaccgccaactcgtccataaaaacgaccgacacccccgtaacgaaattcttccgcgacaacatctccgacttaaaacgcgactaactacgaacaaaaaaaaaaaaaatcaaacgaccgatccctccctaaaactccaaataaaactccc

SEQ ID NO: 28897 - DNA, 692 bp, Artificial Sequence
  chemically treated genomic DNA (Homo sapiens) CpG-island No: 28897
cgcggtagcgggcggcggcggagcggcgggtatcgggcgtttttgggcgtagcgttcgtcgggtcggtcgcgtaggcggggtcgggggttggatcgcgtcgtcggttgagcgcgcgttgtcgcgggttttcggggttcgcgtagcgttcggcggcgtattcgtatgtttaggtagcgcggtacggggcgagcgttttttcgtcgtagagttcgtcgcgcgggggagttcggtcgtcgtatcgtttttcgcgttttcgtttcgtcgttcgttgtcgcgattgttaaagtttttcggttacgtgttggttttcggcggtttaaaggttagcgtggagtgattgaggttacgcggagagagggggtttttgggtggtaggtagcgagaggcgcgggggaggtcgtttcgcgggtcgcgtcgagcggggagcgattatcgcggttttttttagggacgttcgcgttcgggaattcgggcgagaacgttggttggggattcgagtaggggagtttgtgtttgcgggtagttatagttaatttgaacggggagagagtgatagcggcgagggtgggggacggcggggatttggcgtaattttttataggatttaattagtaagttttttaggttagaatgttcgtttttgcggtattttcgttttttcgtttggttttttttttgatagtgtaaggaa

SEQ ID NO: 28898 - DNA, 692 bp, Artificial Sequence
  chemically treated genomic DNA (Homo sapiens) CpG-island No: 28898
ttccttacactatcaaaaaaaaaaccaaacgaaaaaacgaaaataccgcaaaaacgaacattctaacctaaaaaacttactaattaaatcctataaaaaattacgccaaatccccgccgtcccccaccctcgccgctatcactctctccccgttcaaattaactataactacccgcaaacacaaactcccctactcgaatccccaaccaacgttctcgcccgaattcccgaacgcgaacgtccctaaaaaaaaccgcgataatcgctccccgctcgacgcgacccgcgaaacgacctcccccgcgcctctcgctacctaccacccaaaaaccccctctctccgcgtaacctcaatcactccacgctaacctttaaaccgccgaaaaccaacacgtaaccgaaaaactttaacaatcgcgacaacgaacgacgaaacgaaaacgcgaaaaacgatacgacgaccgaactcccccgcgcgacgaactctacgacgaaaaaacgctcgccccgtaccgcgctacctaaacatacgaatacgccgccgaacgctacgcgaaccccgaaaacccgcgacaacgcgcgctcaaccgacgacgcgatccaacccccgaccccgcctacgcgaccgacccgacgaacgctacgcccaaaaacgcccgatacccgccgctccgccgccgcccgctaccgcg

SEQ ID NO: 28899 - DNA, 692 bp, Artificial Sequence
  chemically treated genomic DNA (Homo sapiens) CpG-island No: 28899
ttttttgtattgttaaaaaggaaattagacggaggggcgggggtatcgtagaagcgaatattttagtttagaggatttgttagttaagttttgtaagaagttacgttaagttttcgtcgttttttattttcgtcgttgttatttttttttcgtttaggttggttgtggttgttcgtagatataggtttttttgttcgagtttttagttagcgttttcgttcgggttttcgagcgcgggcgtttttgggagaagtcgcgatggtcgtttttcgttcggcgcggttcgcggggcggtttttttcgcgtttttcgttgtttgttatttagagatttttttttttcgcgtggttttaattattttacgttgatttttgggtcgtcgggggttagtacgtgatcgagaaattttggtagtcgcggtagcgggcggcggggcggaggcgcgggaggcggtgcggcggtcgagttttttcgcgcggcgggttttgcggcggggagacgttcgtttcgtgtcgcgttgtttgggtatgcggatgcgtcgtcgagcgttgcgcggatttcggaagttcgcggtagcgcgcgtttagtcggcggcgcgatttagttttcggtttcgtttgcgcggtcggttcggcgggcgttgcgtttagggacgttcggtgttcgtcgtttcgtcgtcgttcgttgtcgcg

SEQ ID NO: 28900 - DNA, 692 bp, Artificial Sequence
  chemically treated genomic DNA (Homo sapiens) CpG-island No: 28900
cgcgacaacgaacgacgacgaaacgacgaacaccgaacgtccctaaacgcaacgcccgccgaaccgaccgcgcaaacgaaaccgaaaactaaatcgcgccgccgactaaacgcgcgctaccgcgaacttccgaaatccgcgcaacgctcgacgacgcatccgcatacccaaacaacgcgacacgaaacgaacgtctccccgccgcaaaacccgccgcgcgaaaaaactcgaccgccgcaccgcctcccgcgcctccgccccgccgcccgctaccgcgactaccaaaatttctcgatcacgtactaacccccgacgacccaaaaatcaacgtaaaataattaaaaccacgcgaaaaaaaaaaatctctaaataacaaacaacgaaaaacgcgaaaaaaaccgccccgcgaaccgcgccgaacgaaaaacgaccatcgcgacttctcccaaaaacgcccgcgctcgaaaacccgaacgaaaacgctaactaaaaactcgaacaaaaaaacctatatctacgaacaaccacaaccaacctaaacgaaaaaaaaataacaacgacgaaaataaaaaacgacgaaaacttaacgtaacttcttacaaaacttaactaacaaatcctctaaactaaaatattcgcttctacgatacccccgcccctccgtctaatttcctttttaacaatacaaaaaa

SEQ ID NO: 28901 - DNA, 523 bp, Artificial Sequence
  chemically treated genomic DNA (Homo sapiens) CpG-island No: 28901
tttcggcgggaagttttttttgggattttgtacgtcgacgttcggaattcggcgtggtgcgttgggaaattgagcggtggaggaaggcggagcggttaggggcgggattttaggggaggggttgggggagggttttgacgttagggcggggttaagggcgagatttcgtcgagttttatcgttgcgttcgttacgttttttttagcgagttcgttggggatacgtagggggagggaaaattgagcggggcgggaattattttttttcgcgagagttggcgacggcggcggtagcggtagaggtggcggcggcgtgttcgtgagagtggcgtgggggcggggaggagaggcggcggcggtagtgtttaagttacgttattcgggtcggggcgttgggagcgggagtgtagagcgtggtcgtggcggcggcggtgagaagagcgaggcggaggagggggtgttatggtcgggtagtagttttagtacgatgatagtgggaatatttttttttatttttttatttt

SEQ ID NO: 28902 - DNA, 523 bp, Artificial Sequence
  chemically treated genomic DNA (Homo sapiens) CpG-island No: 28902
aaaataaaaaaataaaaaaaaatattcccactatcatcgtactaaaactactacccgaccataacaccccctcctccgcctcgctcttctcaccgccgccgccacgaccacgctctacactcccgctcccaacgccccgacccgaataacgtaacttaaacactaccgccgccgcctctcctccccgcccccacgccactctcacgaacacgccgccgccacctctaccgctaccgccgccgtcgccaactctcgcgaaaaaaaataattcccgccccgctcaattttccctccccctacgtatccccaacgaactcgctaaaaaaaacgtaacgaacgcaacgataaaactcgacgaaatctcgcccttaaccccgccctaacgtcaaaaccctcccccaacccctcccctaaaatcccgcccctaaccgctccgccttcctccaccgctcaatttcccaacgcaccacgccgaattccgaacgtcgacgtacaaaatcccaaaaaaaacttcccgccgaaa

SEQ ID NO: 28903 - DNA, 523 bp, Artificial Sequence
  chemically treated genomic DNA (Homo sapiens) CpG-island No: 28903
gaggtgaggaagtagaagaaggtgtttttattgttatcgtattggaattgttgttcggttatggtattttttttttcgtttcgttttttttatcgtcgtcgttacgattacgttttgtattttcgtttttaacgtttcggttcgagtggcgtagtttggatattgtcgtcgtcgtttttttttttcgtttttacgttatttttacggatacgtcgtcgttatttttgtcgttgtcgtcgtcgtcgttagttttcgcgagaggagatagttttcgtttcgtttagttttttttttttttgcgtgtttttagcgagttcgttaagggagacgtggcgagcgtaacggtggaattcggcgaggtttcgtttttagtttcgttttaacgttaaagtttttttttaattttttttttagggtttcgtttttaatcgtttcgtttttttttatcgtttagttttttagcgtattacgtcggatttcgggcgtcggcgtataggattttagagaaggtttttcgtcggag

SEQ ID NO: 28904 - DNA, 523 bp, Artificial Sequence
  chemically treated genomic DNA (Homo sapiens) CpG-island No: 28904
ctccgacgaaaaaccttctctaaaatcctatacgccgacgcccgaaatccgacgtaatacgctaaaaaactaaacgataaaaaaaaacgaaacgattaaaaacgaaaccctaaaaaaaaaattaaaaaaaaactttaacgttaaaacgaaactaaaaacgaaacctcgccgaattccaccgttacgctcgccacgtctcccttaacgaactcgctaaaaacacgcaaaaaaaaaaaaaactaaacgaaacgaaaactatctcctctcgcgaaaactaacgacgacgacgacaacgacaaaaataacgacgacgtatccgtaaaaataacgtaaaaacgaaaaaaaaaaacgacgacgacaatatccaaactacgccactcgaaccgaaacgttaaaaacgaaaatacaaaacgtaatcgtaacgacgacgataaaaaaaacgaaacgaaaaaaaaaataccataaccgaacaacaattccaatacgataacaataaaaacaccttcttctacttcctcacctc

SEQ ID NO: 28905 - DNA, 961 bp, Artificial Sequence
  chemically treated genomic DNA (Homo sapiens) CpG-island No: 28905
atcgaattttacgcgagttgaagtttagggatattttagaattttttttaggattaatttttcgttttttatcggttttgcgttttcgtagtatcgggttttgggcgcgcgtttttgtttcgttgtggttaaggttcgtttcggtgacgtttggtttttttttcgggttggcgtcgcgtgcgatttatcgaggtagtggtagtattggtcgcggtttggagtttagcgttaggtcggagttcggtttttttgaatcgggagatcggcgtagttttagttacgatcgtttttattttcgcggtcgtcggatcgcgtttagtagcgattttttttgagagcgttgttagaggggtcgcgggagtcgtagagcgcgcgtgggcgcggcgttcgcgagttttcgggagggtcgagtgtatcgttggagcgattttcgttcggttcggttatcgtcgtagtcgttattacggcggggcggggtacgggtcgggggcggggcgtcgggcgggcgcggcgttatttttagtttcgtcggaggtttcgtttttatttcgttgggagttttttcggcgcgtaagtcggattcggtagtgttgcggggaggagagaggacgaggcggcggcggtagtaggaggtgggggatcgatcgcgtcgggggtcgaagaggaacgtcgtttcgcgttttttcgtttttcgtacgtttcggttgtcggttttacgttgttcgtttatagatcgtattgggtttcgtttggagcgggcggaggtatcgggttcgagttgggtcggaggtttttttcgtcgtttgcgcgttttaagtagaggattcgtcgcggagaatcgttttcggattggaggcgttcgcggtttcgggtgcgttcgttgcgttaggtaagtggttgcgtttttgttttatttttgttttcgttttgcgtaggtttttggtttgtagagacgttagga

SEQ ID NO: 28906 - DNA, 961 bp, Artificial Sequence
  chemically treated genomic DNA (Homo sapiens) CpG-island No: 28906
tcctaacgtctctacaaaccaaaaacctacgcaaaacgaaaacaaaaataaaacaaaaacgcaaccacttacctaacgcaacgaacgcacccgaaaccgcgaacgcctccaatccgaaaacgattctccgcgacgaatcctctacttaaaacgcgcaaacgacgaaaaaaacctccgacccaactcgaacccgatacctccgcccgctccaaacgaaacccaatacgatctataaacgaacaacgtaaaaccgacaaccgaaacgtacgaaaaacgaaaaaacgcgaaacgacgttcctcttcgacccccgacgcgatcgatcccccacctcctactaccgccgccgcctcgtcctctctcctccccgcaacactaccgaatccgacttacgcgccgaaaaaactcccaacgaaataaaaacgaaacctccgacgaaactaaaaataacgccgcgcccgcccgacgccccgcccccgacccgtaccccgccccgccgtaataacgactacgacgataaccgaaccgaacgaaaatcgctccaacgatacactcgaccctcccgaaaactcgcgaacgccgcgcccacgcgcgctctacgactcccgcgacccctctaacaacgctctcaaaaaaaatcgctactaaacgcgatccgacgaccgcgaaaataaaaacgatcgtaactaaaactacgccgatctcccgattcaaaaaaaccgaactccgacctaacgctaaactccaaaccgcgaccaatactaccactacctcgataaatcgcacgcgacgccaacccgaaaaaaaaaccaaacgtcaccgaaacgaaccttaaccacaacgaaacaaaaacgcgcgcccaaaacccgatactacgaaaacgcaaaaccgataaaaaacgaaaaattaatcctaaaaaaaattctaaaatatccctaaacttcaactcgcgtaaaattcgat

SEQ ID NO: 28907 - DNA, 961 bp, Artificial Sequence
  chemically treated genomic DNA (Homo sapiens) CpG-island No: 28907
ttttggcgtttttgtaggttaggagtttgcgtagggcgggaataggggtggggtaggggcgtagttatttatttggcgtagcggacgtattcgaggtcgcgggcgtttttagttcgggagcggtttttcgcggcggattttttgtttggggcgcgtaggcggcggagaggattttcgatttagttcgggttcggtgttttcgttcgttttaagcggaatttagtgcgatttgtgggcgagtagcgtggggtcggtagtcggagcgtgcggggagcgagagggcgcggggcggcgttttttttcggttttcggcgcgatcggttttttattttttgttgtcgtcgtcgtttcgttttttttttttttcgtagtattgtcggattcggtttgcgcgtcgggaaggtttttagcgaagtgagagcgaagttttcggcgaggttggaaatagcgtcgcgttcgttcggcgtttcgttttcggttcgtgtttcgtttcgtcgtggtggcggttacggcggtggtcgggtcgggcggggatcgttttagcgatgtattcggttttttcgggggttcgcgggcgtcgcgtttacgcgcgttttgcggttttcgcggtttttttggtagcgtttttagaaagagtcgttgttgggcgcggttcggcggtcgcgggggtgggagcggtcgtggttggggttgcgtcggtttttcggtttaggagagtcggatttcggtttgacgttaggttttagatcgcggttagtgttgttattgtttcggtgggtcgtacgcggcgttaattcgggaaaaggattaggcgttatcggggcgggttttgattatagcggggtaggggcgcgcgtttaggattcgatgttgcgggggcgtagggtcggtgaaaggcggaagattgattttgaggaagattttgggatatttttgggttttagttcgcgtggaattcggt

SEQ ID NO: 28908 - DNA, 961 bp, Artificial Sequence
  chemically treated genomic DNA (Homo sapiens) CpG-island No: 28908
accgaattccacgcgaactaaaacccaaaaatatcccaaaatcttcctcaaaatcaatcttccgcctttcaccgaccctacgcccccgcaacatcgaatcctaaacgcgcgcccctaccccgctataatcaaaacccgccccgataacgcctaatccttttcccgaattaacgccgcgtacgacccaccgaaacaataacaacactaaccgcgatctaaaacctaacgtcaaaccgaaatccgactctcctaaaccgaaaaaccgacgcaaccccaaccacgaccgctcccacccccgcgaccgccgaaccgcgcccaacaacgactctttctaaaaacgctaccaaaaaaaccgcgaaaaccgcaaaacgcgcgtaaacgcgacgcccgcgaacccccgaaaaaaccgaatacatcgctaaaacgatccccgcccgacccgaccaccgccgtaaccgccaccacgacgaaacgaaacacgaaccgaaaacgaaacgccgaacgaacgcgacgctatttccaacctcgccgaaaacttcgctctcacttcgctaaaaaccttcccgacgcgcaaaccgaatccgacaatactacgaaaaaaaaaaaaaacgaaacgacgacgacaacaaaaaataaaaaaccgatcgcgccgaaaaccgaaaaaaaacgccgccccgcgccctctcgctccccgcacgctccgactaccgaccccacgctactcgcccacaaatcgcactaaattccgcttaaaacgaacgaaaacaccgaacccgaactaaatcgaaaatcctctccgccgcctacgcgccccaaacaaaaaatccgccgcgaaaaaccgctcccgaactaaaaacgcccgcgacctcgaatacgtccgctacgccaaataaataactacgcccctaccccacccctattcccgccctacgcaaactcctaacctacaaaaacgccaaaa

SEQ ID NO: 28909 - DNA, 705 bp, Artificial Sequence
  chemically treated genomic DNA (Homo sapiens) CpG-island No: 28909
gttcgttattttcgttatcgtacgcgaatgggagttcgaagttgcgggcggaggtgggcgcgcggggttcgggtttggttgtattttggggatcggtttcggtagcgggaattttaattagattttttttttttggattttattcgttgtcgcgtttttgggaattgtcgtttttcgggtttttttggtttttgcggattttcgtttcgttttttggttttcggtgttgttcgcggggaggcggcgtcgggcgttgagtagcgagcgtcgagggttaggtaggagcgttcggggcgttggggttttttggcgcgttcggagtcggggtttcggacgggttgcggcgggtagagattatgggggaagtttaagtggttttggttttttatttagcggtttcgtcgcgcgcgttttcgattcgtaattttttagggtatcggtttgtgagtgttggaggcgagtgtgcgtgcgttagcgatggtgtgaaggtgtgtgcgtgcgtgtgtcgggagtgcgggagtcggagtttggggcggttttagggggcggggaaatgattcgtttggtcgcgggatcgagtcgagttttgacggcggttgtaatttcggttatcgattttgtagattcgttttggtttcgttggaggttagtcgggttaggagggcgattacgggttttggtagtgttcgatgttggggtttgggt

SEQ ID NO: 28910 - DNA, 705 bp, Artificial Sequence
  chemically treated genomic DNA (Homo sapiens) CpG-island No: 28910
acccaaaccccaacatcgaacactaccaaaacccgtaatcgccctcctaacccgactaacctccaacgaaaccaaaacgaatctacaaaatcgataaccgaaattacaaccgccgtcaaaactcgactcgatcccgcgaccaaacgaatcatttccccgccccctaaaaccgccccaaactccgactcccgcactcccgacacacgcacgcacacaccttcacaccatcgctaacgcacgcacactcgcctccaacactcacaaaccgataccctaaaaaattacgaatcgaaaacgcgcgcgacgaaaccgctaaataaaaaaccaaaaccacttaaacttcccccataatctctacccgccgcaacccgtccgaaaccccgactccgaacgcgccaaaaaaccccaacgccccgaacgctcctacctaaccctcgacgctcgctactcaacgcccgacgccgcctccccgcgaacaacaccgaaaaccaaaaaacgaaacgaaaatccgcaaaaaccaaaaaaacccgaaaaacgacaattcccaaaaacgcgacaacgaataaaatccaaaaaaaaaaaatctaattaaaattcccgctaccgaaaccgatccccaaaatacaaccaaacccgaaccccgcgcgcccacctccgcccgcaacttcgaactcccattcgcgtacgataacgaaaataacgaac

SEQ ID NO: 28911 - DNA, 705 bp, Artificial Sequence
  chemically treated genomic DNA (Homo sapiens) CpG-island No: 28911
atttaagttttagtatcgggtattgttaaaattcgtgatcgtttttttggttcggttggtttttagcgaggttagagcgggtttgtagagtcggtagtcggagttgtagtcgtcgttagagttcggttcggtttcgcggttaaacggattattttttcgttttttggagtcgttttaggtttcgattttcgtattttcgatatacgtacgtatatatttttatattatcgttgacgtacgtatattcgtttttagtatttataggtcggtgttttggagagttgcgggtcggggacgcgcgcgacggagtcgttgggtaggaagttaaggttatttaaattttttttatagtttttgttcgtcgtaattcgttcggagtttcggtttcgagcgcgttaggaagttttagcgtttcgagcgtttttgtttggttttcggcgttcgttgtttagcgttcgacgtcgttttttcgcgggtagtatcgagggttaggaggcggagcgggagttcgtagggattaagagggttcgagggacggtagtttttagaagcgcggtagcgagtgagatttaaggagagaaagtttaattaaagttttcgttatcggggtcggtttttaaagtgtaattagattcgagtttcgcgcgtttattttcgttcgtagtttcggatttttattcgcgtgcggtggcggggatggcgagt

SEQ ID NO: 28912 - DNA, 705 bp, Artificial Sequence
  chemically treated genomic DNA (Homo sapiens) CpG-island No: 28912
actcgccatccccgccaccgcacgcgaataaaaatccgaaactacgaacgaaaataaacgcgcgaaactcgaatctaattacactttaaaaaccgaccccgataacgaaaactttaattaaactttctctccttaaatctcactcgctaccgcgcttctaaaaactaccgtccctcgaaccctcttaatccctacgaactcccgctccgcctcctaaccctcgatactacccgcgaaaaaacgacgtcgaacgctaaacaacgaacgccgaaaaccaaacaaaaacgctcgaaacgctaaaacttcctaacgcgctcgaaaccgaaactccgaacgaattacgacgaacaaaaactataaaaaaaatttaaataaccttaacttcctacccaacgactccgtcgcgcgcgtccccgacccgcaactctccaaaacaccgacctataaatactaaaaacgaatatacgtacgtcaacgataatataaaaatatatacgtacgtatatcgaaaatacgaaaatcgaaacctaaaacgactccaaaaaacgaaaaaataatccgtttaaccgcgaaaccgaaccgaactctaacgacgactacaactccgactaccgactctacaaacccgctctaacctcgctaaaaaccaaccgaaccaaaaaaacgatcacgaattttaacaatacccgatactaaaacttaaat

SEQ ID NO: 28913 - DNA, 551 bp, Artificial Sequence
  chemically treated genomic DNA (Homo sapiens) CpG-island No: 28913
gggtcgtcgttaggcgcgttggttgggtagtttttgggagatgaagcgacgtaggcgttttaggtattggttgtagagttcgatgtcgttgtgttcggcgttttttatttatagcggttttatcgttttggggtagcgttcgtagagcgttagttcgtgcgagaagtcgattatttcgttttttttgtcgtggatgatgagtacgggagacgtgattttggatattttttcgatgttagggaaggcgtcgaagtagtaggtttttttggtgtcgcggaaggcgacgcgtatgttcgaggtgagcggcgagtgtagtattatcgcggtatattcgtagcgcgaggttaggtttatggtgggtatcgtgtcgatgttttgttcgtataggatgatgttgttcgggttgatgtcgtatttggcggcgtcggagtagggttagtcgcggtttttaacgcgcgcgtattttttttattagcgggcgttttcgggtttagtttcggatgcgattttttagtttttttatttagttaagttagtgggttaggtttagg

SEQ ID NO: 28914 - DNA, 551 bp, Artificial Sequence
  chemically treated genomic DNA (Homo sapiens) CpG-island No: 28914
cctaaacctaacccactaacttaactaaataaaaaaactaaaaaatcgcatccgaaactaaacccgaaaacgcccgctaataaaaaaaatacgcgcgcgttaaaaaccgcgactaaccctactccgacgccgccaaatacgacatcaacccgaacaacatcatcctatacgaacaaaacatcgacacgatacccaccataaacctaacctcgcgctacgaatataccgcgataatactacactcgccgctcacctcgaacatacgcgtcgccttccgcgacaccaaaaaaacctactacttcgacgccttccctaacatcgaaaaaatatccaaaatcacgtctcccgtactcatcatccacgacaaaaaaaacgaaataatcgacttctcgcacgaactaacgctctacgaacgctaccccaaaacgataaaaccgctataaataaaaaacgccgaacacaacgacatcgaactctacaaccaatacctaaaacgcctacgtcgcttcatctcccaaaaactacccaaccaacgcgcctaacgacgaccc

SEQ ID NO: 28915 - DNA, 551 bp, Artificial Sequence
  chemically treated genomic DNA (Homo sapiens) CpG-island No: 28915
tttgagtttgatttattgatttggttgagtggggagattggagggtcgtattcggagttgggttcggggacgttcgttggtgggaagggtgcgcgcgcgttggaggtcgcggttgattttgtttcggcgtcgttaggtacggtattagttcggatagtattattttgtacgggtagagtatcggtacggtgtttattatggatttggtttcgcgttacgagtgtgtcgcggtggtgttgtattcgtcgtttatttcgggtatgcgcgtcgtttttcgcgatattaagaagatttattgtttcgacgttttttttaatatcgagaaggtgtttaagattacgtttttcgtgtttattatttacggtagggaggacgaggtgatcgatttttcgtacgggttggcgttttacgagcgttgttttaaggcggtggagtcgttgtgggtggagggcgtcgggtataacgatatcgagttttatagttagtatttggagcgtttgcgtcgttttattttttaggagttgtttagttagcgcgtttagcggcggttt

SEQ ID NO: 28916 - DNA, 551 bp, Artificial Sequence
  chemically treated genomic DNA (Homo sapiens) CpG-island No: 28916
aaaccgccgctaaacgcgctaactaaacaactcctaaaaaataaaacgacgcaaacgctccaaatactaactataaaactcgatatcgttatacccgacgccctccacccacaacgactccaccgccttaaaacaacgctcgtaaaacgccaacccgtacgaaaaatcgatcacctcgtcctccctaccgtaaataataaacacgaaaaacgtaatcttaaacaccttctcgatattaaaaaaaacgtcgaaacaataaatcttcttaatatcgcgaaaaacgacgcgcatacccgaaataaacgacgaatacaacaccaccgcgacacactcgtaacgcgaaaccaaatccataataaacaccgtaccgatactctacccgtacaaaataatactatccgaactaataccgtacctaacgacgccgaaacaaaatcaaccgcgacctccaacgcgcgcgcacccttcccaccaacgaacgtccccgaacccaactccgaatacgaccctccaatctccccactcaaccaaatcaataaatcaaactcaaa

SEQ ID NO: 28917 - DNA, 584 bp, Artificial Sequence
  chemically treated genomic DNA (Homo sapiens) CpG-island No: 28917
gcgagcgcggaggtcgggcgattttaatcggttcgtttcgtgtttagttcgtatttaggtcgtttttcgtacggggagggtttttttcgtttttgggtaggtttaaatttttattttttttaaggtcggcgtcgacgttgttagttcggtagagtttttttttgtcggtcgttttttattttcgttttcggtcgtattcgtttcggggcgagtatcgttcgacgtttaggtttttttcggacggaggagcgcgatttatttacggtggtcgggtagagtttgtttcgaattcggttttttttcgacgttttttttttagtttcgggatttaatcgggtggggttgttttcgagggtttcggagttaggcgcgttttgttcgcgagggtcggggtttcgggtttcgtcgtcgcgttttatttcggggcgtagttggggtggaggcggtggtcgggatcgtcgcgcggggttcgtgcgcgtataaatgtcgtttttagaataggtggttcgggttagggcggcggtttagttttttcgtttttgtttttgttttttcgaggcgttttttttttattgcgagtcgta

SEQ ID NO: 28918 - DNA, 584 bp, Artificial Sequence
  chemically treated genomic DNA (Homo sapiens) CpG-island No: 28918
tacgactcgcaataaaaaaaaaacgcctcgaaaaaacaaaaacaaaaacgaaaaaactaaaccgccgccctaacccgaaccacctattctaaaaacgacatttatacgcgcacgaaccccgcgcgacgatcccgaccaccgcctccaccccaactacgccccgaaataaaacgcgacgacgaaacccgaaaccccgaccctcgcgaacaaaacgcgcctaactccgaaaccctcgaaaacaaccccacccgattaaatcccgaaactaaaaaaaaaacgtcgaaaaaaaaccgaattcgaaacaaactctacccgaccaccgtaaataaatcgcgctcctccgtccgaaaaaaacctaaacgtcgaacgatactcgccccgaaacgaatacgaccgaaaacgaaaataaaaaacgaccgacaaaaaaaaactctaccgaactaacaacgtcgacgccgaccttaaaaaaaataaaaatttaaacctacccaaaaacgaaaaaaaccctccccgtacgaaaaacgacctaaatacgaactaaacacgaaacgaaccgattaaaatcgcccgacctccgcgctcgc

SEQ ID NO: 28919 - DNA, 584 bp, Artificial Sequence
  chemically treated genomic DNA (Homo sapiens) CpG-island No: 28919
tgcggttcgtagtggggaggaggcgtttcgggaaggtaggggtaggggcggaggggttgggtcgtcgttttagttcgggttatttgttttggaggcgatatttgtgcgcgtacgaatttcgcgcggcggtttcggttatcgtttttattttaattgcgtttcgaagtggagcgcggcggcgggattcggagtttcggttttcgcgggtaggacgcgtttggtttcggagttttcgagggtagttttattcggttgggtttcggggttggagagagggcgtcggggagaagtcgggttcgaggtaggttttgttcggttatcgtgggtgagtcgcgttttttcgttcgggggaagtttgggcgtcgggcggtgttcgtttcggagcggatgcgatcggggacggggatggagagcggtcggtaggagggggttttgtcgggttggtagcgtcggcgtcggttttagggagggtgaggatttggatttgtttagaagcgggaagggtttttttcgtgcgggaaacggtttgggtacgagttgggtacggggcgagtcggttggagtcgttcggttttcgcgttcgt

SEQ ID NO: 28920 - DNA, 584 bp, Artificial Sequence
  chemically treated genomic DNA (Homo sapiens) CpG-island No: 28920
acgaacgcgaaaaccgaacgactccaaccgactcgccccgtacccaactcgtacccaaaccgtttcccgcacgaaaaaaacccttcccgcttctaaacaaatccaaatcctcaccctccctaaaaccgacgccgacgctaccaacccgacaaaaccccctcctaccgaccgctctccatccccgtccccgatcgcatccgctccgaaacgaacaccgcccgacgcccaaacttcccccgaacgaaaaaacgcgactcacccacgataaccgaacaaaacctacctcgaacccgacttctccccgacgccctctctccaaccccgaaacccaaccgaataaaactaccctcgaaaactccgaaaccaaacgcgtcctacccgcgaaaaccgaaactccgaatcccgccgccgcgctccacttcgaaacgcaattaaaataaaaacgataaccgaaaccgccgcgcgaaattcgtacgcgcacaaatatcgcctccaaaacaaataacccgaactaaaacgacgacccaacccctccgcccctacccctaccttcccgaaacgcctcctccccactacgaaccgca

SEQ ID NO: 28921 - DNA, 1056 bp, Artificial Sequence
  chemically treated genomic DNA (Homo sapiens) CpG-island No: 28921
gttcgaggagttaagtcggttttaataggcggggtcgagttttagggtggcgttgggggagtcgcgtttttttcgtattcggcgttagtagtcggggttttcgagtcgggagtttttttttcgtagcgttttcgaggatgttttcgttttcgttttcgtttagagtcgtcggtgttcgtttttcgttttaagagttcgtcggggggtgtgttcgcgtcgtcgttttcgggaacgtttttcggttcgcgtgaggattttcgcgttgcggtttttcgttcgggttttttagttgttcggtttcgttcgtttcggttcggttaggttgtcgcggttttatagtgcgacgtgttataggtcgcgtcggtttcgttttttaagttacgggtattggcgttcgcggggtttttcgtcggttttcgtagggatgttaggtaggttcgtattcgttcgcggtcgttattttgttagtgggtatcgagcggaggcgtttgaagatggttaagatgttttgtttgttggggttttttatcgttagttgtgagtcgcggcgtagttggtttagttaatcggtaagagtcgacgaaaagcggttatcgttttagtaggagcgacgaggtcgcgggggcggggttgcgcgtaacggttaggtttcgttttaattttcgtttacgatcgggttcgtttatcgtcggggcgtaggcgtcgttcgtttttttttttcgttttcgttttagtcgcgtcgttggttcgattttaggcgttgtacgcgcgtgcgtaggaggttcgcgcgttatttgcggcgcggttttacgtttttagcgttgggcgaagtcgggttcgggtgtggttgtttgttacgcgcgttgttataggatttattaacgtttcgtttggtcgatcgttatttcgtttaacgggttgtttttatggaaaggttagaggtaggggaaggggcgtacgcgttttttttcggtacgagacggacggagggttcgtgttttgacgtcggattttagttggtggttttttttttttttttttttttttttgagacgg

SEQ ID NO: 28922 - DNA, 1056 bp, Artificial Sequence
  chemically treated genomic DNA (Homo sapiens) CpG-island No: 28922
ccgtctcaaaaaaaaaaaaaaaaaaaaaaaaaaccaccaactaaaatccgacgtcaaaacacgaaccctccgtccgtctcgtaccgaaaaaaaacgcgtacgccccttcccctacctctaacctttccataaaaacaacccgttaaacgaaataacgatcgaccaaacgaaacgttaataaatcctataacaacgcgcgtaacaaacaaccacacccgaacccgacttcgcccaacgctaaaaacgtaaaaccgcgccgcaaataacgcgcgaacctcctacgcacgcgcgtacaacgcctaaaatcgaaccaacgacgcgactaaaacgaaaacgaaaaaaaaaaacgaacgacgcctacgccccgacgataaacgaacccgatcgtaaacgaaaattaaaacgaaacctaaccgttacgcgcaaccccgcccccgcgacctcgtcgctcctactaaaacgataaccgcttttcgtcgactcttaccgattaactaaaccaactacgccgcgactcacaactaacgataaaaaaccccaacaaacaaaacatcttaaccatcttcaaacgcctccgctcgatacccactaacaaaataacgaccgcgaacgaatacgaacctacctaacatccctacgaaaaccgacgaaaaaccccgcgaacgccaatacccgtaacttaaaaaacgaaaccgacgcgacctataacacgtcgcactataaaaccgcgacaacctaaccgaaccgaaacgaacgaaaccgaacaactaaaaaacccgaacgaaaaaccgcaacgcgaaaatcctcacgcgaaccgaaaaacgttcccgaaaacgacgacgcgaacacaccccccgacgaactcttaaaacgaaaaacgaacaccgacgactctaaacgaaaacgaaaacgaaaacatcctcgaaaacgctacgaaaaaaaaactcccgactcgaaaaccccgactactaacgccgaatacgaaaaaaacgcgactcccccaacgccaccctaaaactcgaccccgcctattaaaaccgacttaactcctcgaac

SEQ ID NO: 28923 - DNA, 1056 bp, Artificial Sequence
  chemically treated genomic DNA (Homo sapiens) CpG-island No: 28923
tcgttttaaaaaaaaaaaaaaaaaaagggaaggttattagttaaggttcggcgttaaggtacgggtttttcgttcgtttcgtgtcgaaggagggcgcgtgcgtttttttttttgtttttgatttttttatggaagtagttcgttaggcgaaatggcgatcgattaggcgaaacgttggtggattttatggtagcgcgcgtggtaggtagttatattcgggttcggtttcgtttagcgttaagggcgtggagtcgcgtcgtaaatggcgcgcgagttttttgcgtacgcgcgtgtagcgtttggggtcgggttagcggcgcggttgaagcgagggcggggagggaaagcgagcggcgtttgcgtttcggcggtggacgggttcggtcgtgggcggggattggggcggagtttgatcgttacgcgtagtttcgttttcgcggtttcgtcgtttttgttgaggcggtagtcgtttttcgtcgatttttatcggttggttgggttagttgcgtcgcggtttatagttgacgatgggggattttagtaagtaggatattttgattatttttaagcgttttcgttcggtgtttattaataaggtagcggtcgcgggcgagtgcgggtttgtttggtatttttgcgggaatcggcgggaggtttcgcgggcgttagtgttcgtggtttgggaggcggggtcggcgcggtttgtgatacgtcgtattgtggggtcgcggtagtttggtcgggtcggggcgggcggggtcgggtagttgagaggttcgggcgggaggtcgtagcgcgggggtttttacgcgagtcggggagcgttttcgggggcggcggcgcgggtatatttttcggcgagtttttggggcggggggcgagtatcggcggttttgagcggaggcgggggcgggggtattttcgggggcgttgcgaggagggagttttcggttcggaaatttcggttgttggcgtcggatgcggggaaagcgcggtttttttagcgttattttggagttcgatttcgtttgttggagtcggtttggtttttcgggt

SEQ ID NO: 28924 - DNA, 1056 bp, Artificial Sequence
  chemically treated genomic DNA (Homo sapiens) CpG-island No: 28924
acccgaaaaaccaaaccgactccaacaaacgaaatcgaactccaaaataacgctaaaaaaaccgcgctttccccgcatccgacgccaacaaccgaaatttccgaaccgaaaactccctcctcgcaacgcccccgaaaatacccccgcccccgcctccgctcaaaaccgccgatactcgccccccgccccaaaaactcgccgaaaaatatacccgcgccgccgcccccgaaaacgctccccgactcgcgtaaaaacccccgcgctacgacctcccgcccgaacctctcaactacccgaccccgcccgccccgacccgaccaaactaccgcgaccccacaatacgacgtatcacaaaccgcgccgaccccgcctcccaaaccacgaacactaacgcccgcgaaacctcccgccgattcccgcaaaaataccaaacaaacccgcactcgcccgcgaccgctaccttattaataaacaccgaacgaaaacgcttaaaaataatcaaaatatcctacttactaaaatcccccatcgtcaactataaaccgcgacgcaactaacccaaccaaccgataaaaatcgacgaaaaacgactaccgcctcaacaaaaacgacgaaaccgcgaaaacgaaactacgcgtaacgatcaaactccgccccaatccccgcccacgaccgaacccgtccaccgccgaaacgcaaacgccgctcgctttccctccccgccctcgcttcaaccgcgccgctaacccgaccccaaacgctacacgcgcgtacgcaaaaaactcgcgcgccatttacgacgcgactccacgcccttaacgctaaacgaaaccgaacccgaatataactacctaccacgcgcgctaccataaaatccaccaacgtttcgcctaatcgatcgccatttcgcctaacgaactacttccataaaaaaatcaaaaacaaaaaaaaaaacgcacgcgccctccttcgacacgaaacgaacgaaaaacccgtaccttaacgccgaaccttaactaataaccttccctttttttttttttttttttaaaacga

SEQ ID NO: 28925 - DNA, 639 bp, Artificial Sequence
  chemically treated genomic DNA (Homo sapiens) CpG-island No: 28925
cgttttttgattttttcgtttcgttttcgttttttgtatttttttaattggcgggaggagggcgtttttttagttaattaacgttttatagggttcgtttttcgcgcgttttttaaaggttttttaggaattagttagcgattagaggtcgagttttcggttatttaaaggcggagtaagaaattagaagcggatttgattggttgttggaagacgtcgcgtttattttatagaaggacgaattagtgagttaagttgcggggcgcgggttcggtcggggtatcggtgagtcgtcggcgttgtagagggaggcggtattggtttcgacgtggggcggttagcgatgaagtcggtgagtcggacgtgttggggtttggaggagcgaggcggtagggacgtaagcggtttcggggattcgattttgggtcggagggtagttttagtttggtagtagtgcgattggcgtcgtaatcgttttgcgggtcggggaggtgattcgtacgggtttagtacgggtacgagagacgaaggagtagggtcggtggtcgacgaaggaaagacggatattcgttgtgtatttgttgtgggttgttatttgttttttgcggggttttataagttttttagtcgtttagttaa

SEQ ID NO: 28926 - DNA, 639 bp, Artificial Sequence
  chemically treated genomic DNA (Homo sapiens) CpG-island No: 28926
ttaactaaacgactaaaaaacttataaaaccccgcaaaaaacaaataacaacccacaacaaatacacaacgaatatccgtctttccttcgtcgaccaccgaccctactccttcgtctctcgtacccgtactaaacccgtacgaatcacctccccgacccgcaaaacgattacgacgccaatcgcactactaccaaactaaaactaccctccgacccaaaatcgaatccccgaaaccgcttacgtccctaccgcctcgctcctccaaaccccaacacgtccgactcaccgacttcatcgctaaccgccccacgtcgaaaccaataccgcctccctctacaacgccgacgactcaccgataccccgaccgaacccgcgccccgcaacttaactcactaattcgtccttctataaaataaacgcgacgtcttccaacaaccaatcaaatccgcttctaatttcttactccgcctttaaataaccgaaaactcgacctctaatcgctaactaattcctaaaaaacctttaaaaaacgcgcgaaaaacgaaccctataaaacgttaattaactaaaaaaacgccctcctcccgccaattaaaaaaatacaaaaaacgaaaacgaaacgaaaaaatcaaaaaacg

SEQ ID NO: 28927 - DNA, 639 bp, Artificial Sequence
  chemically treated genomic DNA (Homo sapiens) CpG-island No: 28927
ttggttgggcggttgggaggtttatgagatttcgtaggggataggtgatagtttatagtaggtgtatagcgaatgttcgtttttttttcgtcggttatcgattttgttttttcgtttttcgtgttcgtgttgggttcgtgcgagttattttttcgattcgtagaacggttacggcgttagtcgtattgttattaggttagggttgtttttcggtttaggatcgggttttcgggatcgtttgcgtttttgtcgtttcgtttttttaaattttagtacgttcgatttatcggttttatcgttggtcgttttacgtcgagattagtgtcgtttttttttgtagcgtcggcgatttatcggtgtttcggtcgagttcgcgtttcgtagtttagtttattggttcgtttttttgtgaggtgggcgcggcgttttttagtaattaattagattcgtttttggttttttatttcgtttttgggtggtcgaagattcggtttttaatcgttgattggtttttagaagatttttgaaagacgcgcgggaggcgggttttgtgggacgttgattggttgggagggcgtttttttttcgttagttgggagagtgtagggggcggaggcggggcggaagagttagaaggcg

SEQ ID NO: 28928 - DNA, 639 bp, Artificial Sequence
  chemically treated genomic DNA (Homo sapiens) CpG-island No: 28928
cgccttctaactcttccgccccgcctccgccccctacactctcccaactaacgaaaaaaaaacgccctcccaaccaatcaacgtcccacaaaacccgcctcccgcgcgtctttcaaaaatcttctaaaaaccaatcaacgattaaaaaccgaatcttcgaccacccaaaaacgaaataaaaaaccaaaaacgaatctaattaattactaaaaaacgccgcgcccacctcacaaaaaaacgaaccaataaactaaactacgaaacgcgaactcgaccgaaacaccgataaatcgccgacgctacaaaaaaaaacgacactaatctcgacgtaaaacgaccaacgataaaaccgataaatcgaacgtactaaaatttaaaaaaacgaaacgacaaaaacgcaaacgatcccgaaaacccgatcctaaaccgaaaaacaaccctaacctaataacaatacgactaacgccgtaaccgttctacgaatcgaaaaaataactcgcacgaacccaacacgaacacgaaaaacgaaaaaacaaaatcgataaccgacgaaaaaaaaacgaacattcgctatacacctactataaactatcacctatcccctacgaaatctcataaacctcccaaccgcccaaccaa

SEQ ID NO: 28929 - DNA, 876 bp, Artificial Sequence
  chemically treated genomic DNA (Homo sapiens) CpG-island No: 28929
tttaaagcgcgtagggttgcgttttttacggcgtggtttattttcgttttatcggttttcgtcgtttttagtagtcgttcgggtattttttgtaggtttttatggaggtcgcggaagatttcgtgtagtttttcgaaatgtttcgaggaggcggcggaggaggttatggcgtaggtcgcgttggagtagcggttatcgagattcggggttttgggtttttttttagttcggcggttagtcgtttagtttagtggttataacggcgatcgtcgtattatcgtcgtttaggacgaggttttttcggagtcgcggtagggttttttcgagtcggaacgtttattttttttagttagtgattgttggagcgtcggcgcgaaagtttgacgagaagtcgggagattgcgcggtttaggcgatttttgagggagcggtgtcgcgtcggggcgatcggtagtcgcggaattcgagaagtgtcgggttcgggttggggaaaggtcgtagcgaaaggggtttaggggatttgcgggattggtagcgcggtcgtttttttttcgggtttcgtcggtcggcgaggggcgggcgttgtagtgtacgtcgggggatgtagtttggttcggacgagagcgtttcgtttcggggtcgcgcgttgtttcgggtgttaggtttagttcgcgcggcgatagcgggtttcggttcgatttgatgtatgtttgcgtttagacgtcgtttttattgttatcgcgttttgttttgttattttgattcgaatttttcgtttcgcgttttgattgttagttttcggttttggaaagatagtcgggttaggggttttgtttgtcgtcgggaggtggagtattttttttggaaggtttagcg

SEQ ID NO: 28930 - DNA, 876 bp, Artificial Sequence
  chemically treated genomic DNA (Homo sapiens) CpG-island No: 28930
cgctaaaccttccaaaaaaaatactccacctcccgacgacaaacaaaacccctaacccgactatctttccaaaaccgaaaactaacaatcaaaacgcgaaacgaaaaattcgaatcaaaataacaaaacaaaacgcgataacaataaaaacgacgtctaaacgcaaacatacatcaaatcgaaccgaaacccgctatcgccgcgcgaactaaacctaacacccgaaacaacgcgcgaccccgaaacgaaacgctctcgtccgaaccaaactacatcccccgacgtacactacaacgcccgcccctcgccgaccgacgaaacccgaaaaaaaaacgaccgcgctaccaatcccgcaaatcccctaaacccctttcgctacgacctttccccaacccgaacccgacacttctcgaattccgcgactaccgatcgccccgacgcgacaccgctccctcaaaaatcgcctaaaccgcgcaatctcccgacttctcgtcaaactttcgcgccgacgctccaacaatcactaactaaaaaaaataaacgttccgactcgaaaaaaccctaccgcgactccgaaaaaacctcgtcctaaacgacgataatacgacgatcgccgttataaccactaaactaaacgactaaccgccgaactaaaaaaaaacccaaaaccccgaatctcgataaccgctactccaacgcgacctacgccataacctcctccgccgcctcctcgaaacatttcgaaaaactacacgaaatcttccgcgacctccataaaaacctacaaaaaatacccgaacgactactaaaaacgacgaaaaccgataaaacgaaaataaaccacgccgtaaaaaacgcaaccctacgcgctttaaa

SEQ ID NO: 28931 - DNA, 876 bp, Artificial Sequence
  chemically treated genomic DNA (Homo sapiens) CpG-island No: 28931
cgttgggttttttaagaaaagtgttttatttttcgacggtaggtagagtttttggttcggttatttttttagggtcgaaagttaatagttaagacgcgaaacgaggaattcgggttagggtggtaaagtaaagcgcgatgatagtgaggacgacgtttagacgtaaatatatattaaatcgggtcgaagttcgttgtcgtcgcgcgggttgaatttggtattcggagtaacgcgcgatttcgggacgagacgttttcgttcgagttaaattatatttttcggcgtgtattgtagcgttcgtttttcgtcggtcggcggggttcgggaggaaggcggtcgcgttgttagtttcgtaggttttttaggtttttttcgttgcggtttttttttaattcggattcggtatttttcgggtttcgcgattgtcgatcgtttcggcgcggtatcgtttttttaggagtcgtttaggtcgcgtagtttttcgatttttcgttaggttttcgcgtcggcgttttagtaattattggttggagaaggtgggcgtttcggttcgagaggattttgtcgcggtttcggaagagtttcgttttgggcggcggtggtgcggcggtcgtcgttatggttattgggttgggcggttgatcgtcgggttaggaaagggtttagggtttcgaatttcggtggtcgttgttttagcgcggtttgcgttatggtttttttcgtcgttttttcggagtatttcgagaagttgtacgagatttttcgcggtttttatgaagatttataaggggtgttcgagcggttgttggggacggcggggatcggtgaggcgggggtgggttacgtcgtggggagcgtagttttgcgcgttttgga

SEQ ID NO: 28932 - DNA, 876 bp, Artificial Sequence
  chemically treated genomic DNA (Homo sapiens) CpG-island No: 28932
tccaaaacgcgcaaaactacgctccccacgacgtaacccacccccgcctcaccgatccccgccgtccccaacaaccgctcgaacaccccttataaatcttcataaaaaccgcgaaaaatctcgtacaacttctcgaaatactccgaaaaaacgacgaaaaaaaccataacgcaaaccgcgctaaaacaacgaccaccgaaattcgaaaccctaaaccctttcctaacccgacgatcaaccgcccaacccaataaccataacgacgaccgccgcaccaccgccgcccaaaacgaaactcttccgaaaccgcgacaaaatcctctcgaaccgaaacgcccaccttctccaaccaataattactaaaacgccgacgcgaaaacctaacgaaaaatcgaaaaactacgcgacctaaacgactcctaaaaaaacgataccgcgccgaaacgatcgacaatcgcgaaacccgaaaaataccgaatccgaattaaaaaaaaaccgcaacgaaaaaaacctaaaaaacctacgaaactaacaacgcgaccgccttcctcccgaaccccgccgaccgacgaaaaacgaacgctacaatacacgccgaaaaatataatttaactcgaacgaaaacgtctcgtcccgaaatcgcgcgttactccgaataccaaattcaacccgcgcgacgacaacgaacttcgacccgatttaatatatatttacgtctaaacgtcgtcctcactatcatcgcgctttactttaccaccctaacccgaattcctcgtttcgcgtcttaactattaactttcgaccctaaaaaaataaccgaaccaaaaactctacctaccgtcgaaaaataaaacacttttcttaaaaaacccaacg

SEQ ID NO: 28933 - DNA, 666 bp, Artificial Sequence
  chemically treated genomic DNA (Homo sapiens) CpG-island No: 28933
cgtcggcggaggtaggtcggttttattcgcgttgttttagcggtggttcgtgatgatttggcgtagtaattttagggtttttcgagttattttttcggagttgcgcggtttattatttcgttttagggtttttacgaagttttcgattttttttgataatttcgagtttttcgttgcggatttcggtatttttaaggtagttgtttttagtttttatcggcggaatttatatttgttagattatatagtttgtattttcggggcgggcgaggtcggttttcgttgtgaggggatggggggaaattttaagtttgagtggaagtcggttacgtttttcgttgtcgatttttcgttttttttttttgtttgagttaattagagacgtggggttcgggttgtttagttataatcgggcgttcgcgcgttttcgcgtttcgggggttggaggatcggaagcggttttttttggtttagtcgacggtgaacggaagtaattcgttaggtttgtagagggtggttggtttcgttgttatgggagtagtaagtttttacgcgttttttatcgcgatttaaggttatattgaagaagttgcggtatttttttttgtttttttagttcggtgattgttcgagttgttattttcgagtgttagttgatattgacgt

SEQ ID NO: 28934 - DNA, 666 bp, Artificial Sequence
  chemically treated genomic DNA (Homo sapiens) CpG-island No: 28934
acgtcaatatcaactaacactcgaaaataacaactcgaacaatcaccgaactaaaaaaacaaaaaaaaataccgcaacttcttcaatataaccttaaatcgcgataaaaaacgcgtaaaaacttactactcccataacaacgaaaccaaccaccctctacaaacctaacgaattacttccgttcaccgtcgactaaaccaaaaaaaaccgcttccgatcctccaacccccgaaacgcgaaaacgcgcgaacgcccgattataactaaacaacccgaaccccacgtctctaattaactcaaacaaaaaaaaaaaacgaaaaatcgacaacgaaaaacgtaaccgacttccactcaaacttaaaatttccccccatcccctcacaacgaaaaccgacctcgcccgccccgaaaatacaaactatataatctaacaaatataaattccgccgataaaaactaaaaacaactaccttaaaaataccgaaatccgcaacgaaaaactcgaaattatcaaaaaaaatcgaaaacttcgtaaaaaccctaaaacgaaataataaaccgcgcaactccgaaaaaataactcgaaaaaccctaaaattactacgccaaatcatcacgaaccaccgctaaaacaacgcgaataaaaccgacctacctccgccgacg

SEQ ID NO: 28935 - DNA, 666 bp, Artificial Sequence
  chemically treated genomic DNA (Homo sapiens) CpG-island No: 28935
gcgttagtgttagttgatattcgggagtgatagttcgggtagttatcgagttgggaagataggagggagtgtcgtaatttttttagtgtagttttaagtcgcggtgaggggcgcgtagagatttgttgtttttatagtaacgggattagttattttttataggtttgacgggttattttcgtttatcgtcggttgagttaagaaaggtcgttttcgattttttagttttcgaggcgcgggggcgcgcggacgttcggttataattgaataattcgagttttacgtttttgattggtttaggtagaggaagggggcgggagatcggtaacgaagggcgtagtcggtttttatttaaatttgaggtttttttttatttttttatagcggaagtcgatttcgttcgtttcggaagtgtaaattgtgtggtttggtaggtgtggatttcgtcggtgaaggttgaaggtagttattttaaagatgtcgggattcgtagcgaagggttcggagttgttagagaggatcgagagtttcgtggagattttgaagcggggtggtgggtcgcgtagtttcgaggaaatggttcgggagattttagggttgttgcgttagattattacggattatcgttggagtaacgcgggtgaggtcggtttgttttcgtcggcg

SEQ ID NO: 28936 - DNA, 666 bp, Artificial Sequence
  chemically treated genomic DNA (Homo sapiens) CpG-island No: 28936
cgccgacgaaaacaaaccgacctcacccgcgttactccaacgataatccgtaataatctaacgcaacaaccctaaaatctcccgaaccatttcctcgaaactacgcgacccaccaccccgcttcaaaatctccacgaaactctcgatcctctctaacaactccgaacccttcgctacgaatcccgacatctttaaaataactaccttcaaccttcaccgacgaaatccacacctaccaaaccacacaatttacacttccgaaacgaacgaaatcgacttccgctataaaaaaataaaaaaaaacctcaaatttaaataaaaaccgactacgcccttcgttaccgatctcccgcccccttcctctacctaaaccaatcaaaaacgtaaaactcgaattattcaattataaccgaacgtccgcgcgcccccgcgcctcgaaaactaaaaaatcgaaaacgacctttcttaactcaaccgacgataaacgaaaataacccgtcaaacctataaaaaataactaatcccgttactataaaaacaacaaatctctacgcgcccctcaccgcgacttaaaactacactaaaaaaattacgacactccctcctatcttcccaactcgataactacccgaactatcactcccgaatatcaactaacactaacgc

SEQ ID NO: 28937 - DNA, 520 bp, Artificial Sequence
  chemically treated genomic DNA (Homo sapiens) CpG-island No: 28937
  misc_feature (498)..(498): n is either a, c, g or t
atcgagtttcgcggggttgttgggttgacggattcgcgggtcggtatttgaagcgagcgggacgtagcgcggttagggttttcgggtatacgtaggttggtttttaaggttcgcggtcgtcgttatgtcggtgttgggcgagtacgagcgatattgcgattttattaattcggattttgggagcgagttcgggggttgcggggattcgagttcggggtttagcgttagttaggggtcgcgagtcggcggcggcgcggcggagtaggaggaattgtattatatttttattcgcgttttgggtcgcggcgttttcggggaagttacgttgtatcgtcgtatcgaggtagcggttttcggcgtcggtcgttttgtttggcgttgtcgggtcgtttcgagtttttttttttcggtttcgtttttttagcgtcgtgagtttagtgttttaggcgtttacggggtatatgttttagggtttttattattttttttatttatcgnattagaaattggttagattatt

SEQ ID NO: 28938 - DNA, 520 bp, Artificial Sequence
  chemically treated genomic DNA (Homo sapiens) CpG-island No: 28938
  misc_feature (23)..(23): n is either a, c, g or t
aataatctaaccaatttctaatncgataaataaaaaaaataataaaaaccctaaaacatataccccgtaaacgcctaaaacactaaactcacgacgctaaaaaaacgaaaccgaaaaaaaaaaactcgaaacgacccgacaacgccaaacaaaacgaccgacgccgaaaaccgctacctcgatacgacgatacaacgtaacttccccgaaaacgccgcgacccaaaacgcgaataaaaatataatacaattcctcctactccgccgcgccgccgccgactcgcgacccctaactaacgctaaaccccgaactcgaatccccgcaacccccgaactcgctcccaaaatccgaattaataaaatcgcaatatcgctcgtactcgcccaacaccgacataacgacgaccgcgaaccttaaaaaccaacctacgtatacccgaaaaccctaaccgcgctacgtcccgctcgcttcaaataccgacccgcgaatccgtcaacccaacaaccccgcgaaactcgat

SEQ ID NO: 28939 - DNA, 520 bp, Artificial Sequence
  chemically treated genomic DNA (Homo sapiens) CpG-island No: 28939
  misc_feature (23)..(23): n is either a, c, g or t
aatgatttagttaatttttagtncggtgagtgggaagagtggtgaagattttaagatatatatttcgtgggcgtttaaagtattaagtttacgacgttgggaaagcggggtcgagaaggagggattcggggcgattcgatagcgttagatagggcggtcggcgtcgagggtcgttatttcggtgcggcggtatagcgtggttttttcgaaggcgtcgcggtttaggacgcggatggggatgtagtgtagttttttttgtttcgtcgcgtcgtcgtcggttcgcggtttttgattggcgttaggtttcggattcgagttttcgtaattttcggattcgtttttaaagttcgagttgatggaatcgtagtgtcgttcgtattcgtttagtatcgatatggcggcggtcgcgggttttggggattagtttgcgtatgttcggaggttttggtcgcgttgcgtttcgttcgttttagatgtcggttcgcggattcgttagtttagtaatttcgcgaagttcgat

SEQ ID NO: 28940 - DNA, 520 bp, Artificial Sequence
  chemically treated genomic DNA (Homo sapiens) CpG-island No: 28940
  misc_feature (498)..(498): n is either a, c, g or t
atcgaacttcgcgaaattactaaactaacgaatccgcgaaccgacatctaaaacgaacgaaacgcaacgcgaccaaaacctccgaacatacgcaaactaatccccaaaacccgcgaccgccgccatatcgatactaaacgaatacgaacgacactacgattccatcaactcgaactttaaaaacgaatccgaaaattacgaaaactcgaatccgaaacctaacgccaatcaaaaaccgcgaaccgacgacgacgcgacgaaacaaaaaaaactacactacatccccatccgcgtcctaaaccgcgacgccttcgaaaaaaccacgctataccgccgcaccgaaataacgaccctcgacgccgaccgccctatctaacgctatcgaatcgccccgaatccctccttctcgaccccgctttcccaacgtcgtaaacttaatactttaaacgcccacgaaatatatatcttaaaatcttcaccactcttcccactcaccgnactaaaaattaactaaatcatt

SEQ ID NO: 28941 - DNA, 564 bp, Artificial Sequence
  chemically treated genomic DNA (Homo sapiens) CpG-island No: 28941
tttgtcggggcgttcgttttcgaggtcgttttcgtttcgttttttttagtaagtttcgcgtcggcgtcggttattgattggttgaggcgggagtaggcggttggtcggtagtagttattcggggttttcggtgcgaggttagaggtggggaagttatcggacgtcggcggtgaggtacgtgtagcggcggtcggtgggcgagattatttgagagtgtgcgggtcgggatgttttcggtttgtggggaaattacgttaatttttcgcgtgggtcgggggttgtttggggatatgcgtatgcgcgggcgtgtttcgcggtttgagggcgcgcggggcgtgggtggttgcgcgcgcggggggcgtacgtggggtttgaggggcgggggcggtgtcgggagtttcgttacgttagttttcggttttgagttaatttcgcgttcggtttgtcgcgagggggtcggttgtgtcgggaagtggttttagggagaagaggtttttttttttattcgttgtgggagttgcgtttcgaaagtttgtttcggtacgtcgggtttttttgattcgt

SEQ ID NO: 28942 - DNA, 564 bp, Artificial Sequence
  chemically treated genomic DNA (Homo sapiens) CpG-island No: 28942
acgaatcaaaaaaacccgacgtaccgaaacaaactttcgaaacgcaactcccacaacgaataaaaaaaaaaacctcttctccctaaaaccacttcccgacacaaccgaccccctcgcgacaaaccgaacgcgaaattaactcaaaaccgaaaactaacgtaacgaaactcccgacaccgcccccgcccctcaaaccccacgtacgccccccgcgcgcgcaaccacccacgccccgcgcgccctcaaaccgcgaaacacgcccgcgcatacgcatatccccaaacaacccccgacccacgcgaaaaattaacgtaatttccccacaaaccgaaaacatcccgacccgcacactctcaaataatctcgcccaccgaccgccgctacacgtacctcaccgccgacgtccgataacttccccacctctaacctcgcaccgaaaaccccgaataactactaccgaccaaccgcctactcccgcctcaaccaatcaataaccgacgccgacgcgaaacttactaaaaaaaacgaaacgaaaacgacctcgaaaacgaacgccccgacaaa

SEQ ID NO: 28943 - DNA, 564 bp, Artificial Sequence
  chemically treated genomic DNA (Homo sapiens) CpG-island No: 28943
gcgggttaggagagttcgacgtgtcggggtaggttttcggggcgtagtttttatagcgggtgagggaagaggttttttttttttggagttatttttcggtataatcggttttttcgcggtaggtcgggcgcgggattggtttagggtcggagattgacgtggcgggattttcggtatcgttttcgttttttaggttttacgtgcgtttttcgcgcgcgtagttatttacgtttcgcgcgtttttaagtcgcgaggtacgttcgcgtatgcgtatatttttagatagttttcggtttacgcggggagttggcgtgatttttttataggtcgagaatatttcggttcgtatatttttaaatagtttcgtttatcggtcgtcgttgtacgtattttatcgtcgacgttcgatggtttttttatttttggtttcgtatcggaaatttcgagtaattgttgtcggttagtcgtttgttttcgttttagttaattaatagtcggcgtcggcgcggagtttgttgggaaggacgaagcgagggcggtttcggaggcgggcgtttcggtagg

SEQ ID NO: 28944 - DNA, 564 bp, Artificial Sequence
  chemically treated genomic DNA (Homo sapiens) CpG-island No: 28944
cctaccgaaacgcccgcctccgaaaccgccctcgcttcgtccttcccaacaaactccgcgccgacgccgactattaattaactaaaacgaaaacaaacgactaaccgacaacaattactcgaaatttccgatacgaaaccaaaaataaaaaaaccatcgaacgtcgacgataaaatacgtacaacgacgaccgataaacgaaactatttaaaaatatacgaaccgaaatattctcgacctataaaaaaatcacgccaactccccgcgtaaaccgaaaactatctaaaaatatacgcatacgcgaacgtacctcgcgacttaaaaacgcgcgaaacgtaaataactacgcgcgcgaaaaacgcacgtaaaacctaaaaaacgaaaacgataccgaaaatcccgccacgtcaatctccgaccctaaaccaatcccgcgcccgacctaccgcgaaaaaaccgattataccgaaaaataactccaaaaaaaaaaaacctcttccctcacccgctataaaaactacgccccgaaaacctaccccgacacgtcgaactctcctaacccgc

SEQ ID NO: 28945 - DNA, 901 bp, Artificial Sequence
  chemically treated genomic DNA (Homo sapiens) CpG-island No: 28945
ggttttcgcggagatagttttcggttatggaggtatcgtttgcgggattggagtgttttttgcggttgtgggaggggtagtcgggggttggggggacgtaggtacgtttgtcgttaggacgtttttattttggacggtaggaggttgtcgtgggaacggttggggtaaagtttacgttcgcgtatgtttaggagcgacgtcgattaatgacgtatttcgtaggcgcgcgggcgggtttggtagttggcgtttatggagttagagttgttggttcggaaggtgtttgtattgtaggtgcgggggcgggcgcggggtttataggattttttttttagggaaattatggggtttcgtatttggattttttagcgagatgttattacgtttagttttttaattgcgcgttaatttttggagatatcggttgtttttaatcgcgttgaggaaagttgggatttacggattttttgttttgcgcgtttttatttttattatacgttcgcgtcggattagggaaacgggaagagttttaaggcgaggaggggtatttagtttggtatcgtttttcgagtttttcggagttttagcgtatagtttatttatttttttttcgtcgttaggtttttttttgtattcgtcgggacgatttttttaggatagtttttcgagatgtttttttttttatcgtgataagggattttttttttttcgttttttatattaggtttgcgttcggggttttttggttcgacgttagttttagagtttgcgagttgagtatgaggcgattgtacgagaggtcgagggcgatttgggtacgttttagtggatcgagggtcgtatttttaggtcgcgattttttttagaggtagaatatatttaggagagaagggaaggaggg

SEQ ID NO: 28946 - DNA, 901 bp, Artificial Sequence
  chemically treated genomic DNA (Homo sapiens) CpG-island No: 28946
ccctccttcccttctctcctaaatatattctacctctaaaaaaaatcgcgacctaaaaatacgaccctcgatccactaaaacgtacccaaatcgccctcgacctctcgtacaatcgcctcatactcaactcgcaaactctaaaactaacgtcgaaccaaaaaaccccgaacgcaaacctaatataaaaaacgaaaaaaaaaaaatcccttatcacgataaaaaaaaaaacatctcgaaaaactatcctaaaaaaatcgtcccgacgaatacaaaaaaaaacctaacgacgaaaaaaaaataaataaactatacgctaaaactccgaaaaactcgaaaaacgataccaaactaaatacccctcctcgccttaaaactcttcccgtttccctaatccgacgcgaacgtataataaaaataaaaacgcgcaaaacaaaaaatccgtaaatcccaactttcctcaacgcgattaaaaacaaccgatatctccaaaaattaacgcgcaattaaaaaactaaacgtaataacatctcgctaaaaaatccaaatacgaaaccccataatttccctaaaaaaaaaatcctataaaccccgcgcccgcccccgcacctacaatacaaacaccttccgaaccaacaactctaactccataaacgccaactaccaaacccgcccgcgcgcctacgaaatacgtcattaatcgacgtcgctcctaaacatacgcgaacgtaaactttaccccaaccgttcccacgacaacctcctaccgtccaaaataaaaacgtcctaacgacaaacgtacctacgtccccccaacccccgactacccctcccacaaccgcaaaaaacactccaatcccgcaaacgatacctccataaccgaaaactatctccgcgaaaacc

SEQ ID NO: 28947 - DNA, 901 bp, Artificial Sequence
  chemically treated genomic DNA (Homo sapiens) CpG-island No: 28947
ttttttttttttttttttttaggtgtgttttatttttgggaggaatcgcggtttgggaatgcggttttcggtttattgaagcgtgtttaggtcgttttcgatttttcgtataatcgttttatatttagttcgtaggttttggaattggcgtcggattaagaagtttcggacgtaggtttggtatggagaacgagaggaaagaagttttttattacggtaagagagggggtatttcggaggattgttttgaagaggtcgtttcggcgaatgtaagaggggatttgacggcggggaaaggataggtgggttgtgcgttagggtttcggggggttcgagggacgatgttagattggatgttttttttcgttttaaggtttttttcgtttttttgattcggcgcgagcgtgtggtgggagtggggacgcgtagggtagggagttcgtgggttttagttttttttagcgcggttggggatagtcggtatttttagaggttggcgcgtagttaggggattgaacgtggtagtatttcgttgggaggtttaggtacgagattttatgatttttttaaaggaaaaattttgtgaatttcgcgttcgttttcgtatttgtaatgtagatatttttcgaattagtagttttggttttatgggcgttaattgttaggttcgttcgcgcgtttgcgaagtacgttattggtcggcgtcgtttttgagtatgcgcgggcgtgggttttgttttagtcgtttttacggtaattttttatcgtttagggtagaggcgttttggcgataggcgtatttgcgtttttttagttttcgattgttttttttatagtcgtaaggggtattttaatttcgtaggcggtatttttataatcgagggttgttttcgcggagatt

SEQ ID NO: 28948 - DNA, 901 bp, Artificial Sequence
  chemically treated genomic DNA (Homo sapiens) CpG-island No: 28948
aatctccgcgaaaacaaccctcgattataaaaataccgcctacgaaattaaaataccccttacgactataaaaaaaacaatcgaaaactaaaaaaacgcaaatacgcctatcgccaaaacgcctctaccctaaacgataaaaaattaccgtaaaaacgactaaaacaaaacccacgcccgcgcatactcaaaaacgacgccgaccaataacgtacttcgcaaacgcgcgaacgaacctaacaattaacgcccataaaaccaaaactactaattcgaaaaatatctacattacaaatacgaaaacgaacgcgaaattcacaaaatttttcctttaaaaaaatcataaaatctcgtacctaaacctcccaacgaaatactaccacgttcaatcccctaactacgcgccaacctctaaaaataccgactatccccaaccgcgctaaaaaaaactaaaacccacgaactccctaccctacgcgtccccactcccaccacacgctcgcgccgaatcaaaaaaacgaaaaaaaccttaaaacgaaaaaaaacatccaatctaacatcgtccctcgaaccccccgaaaccctaacgcacaacccacctatcctttccccgccgtcaaatcccctcttacattcgccgaaacgacctcttcaaaacaatcctccgaaataccccctctcttaccgtaataaaaaacttctttcctctcgttctccataccaaacctacgtccgaaacttcttaatccgacgccaattccaaaacctacgaactaaatataaaacgattatacgaaaaatcgaaaacgacctaaacacgcttcaataaaccgaaaaccgcattcccaaaccgcgattcctcccaaaaataaaacacacctaaaaaaaaaaaaaaaaaaaa

SEQ ID NO: 28949 - DNA, 660 bp, Artificial Sequence
  chemically treated genomic DNA (Homo sapiens) CpG-island No: 28949
ttttacgcgcgtcgtttcggttttttgcgtgtagcgcgtgagtgcgcgggttgtcgtttcggttttttcgcgttgttagagttcgttgtcgaggcgttggtatacgtgcgcgatgttttcgagtaggtgtttttgttttaggcgtagttgtttaggcgtagtatcgtatcgcgcgttttacggatttcgcggttcgtttgttgttgttgtagggtcgttgtttcgttttttaggttgcggttgtgtatttttagttgtcgttttttgtcgatgtagttcgtaaagcggttcgtcggcgtttgtagttgtttttttttattgttcgttgtagtagtcgttattacgtatttttttggttggttgtttagcgtgtttagcgagtcggtgttcgaggcggcggttgggcgaggcggatacggagtttacggacgtttacgtttacgagtggaagtcgttggaggagttagcggtcgagcgcgtttcgtttgtgtcgttttttggggttagagcgtagtggaggttgttatcgtcgtgtaacggtaggaatagggcgtttagtaacgcgttcgcgtttcggaagtttattatggttggagtaggtgcgcggggtcgggtcgggacggggcgggatatattgtttttttattttttaagtggaga

SEQ ID NO: 28950 - DNA, 660 bp, Artificial Sequence
  chemically treated genomic DNA (Homo sapiens) CpG-island No: 28950
tctccacttaaaaaataaaaaaacaatatatcccgccccgtcccgacccgaccccgcgcacctactccaaccataataaacttccgaaacgcgaacgcgttactaaacgccctattcctaccgttacacgacgataacaacctccactacgctctaaccccaaaaaacgacacaaacgaaacgcgctcgaccgctaactcctccaacgacttccactcgtaaacgtaaacgtccgtaaactccgtatccgcctcgcccaaccgccgcctcgaacaccgactcgctaaacacgctaaacaaccaaccaaaaaaatacgtaataacgactactacaacgaacaataaaaaaaaacaactacaaacgccgacgaaccgctttacgaactacatcgacaaaaaacgacaactaaaaatacacaaccgcaacctaaaaaacgaaacaacgaccctacaacaacaacaaacgaaccgcgaaatccgtaaaacgcgcgatacgatactacgcctaaacaactacgcctaaaacaaaaacacctactcgaaaacatcgcgcacgtataccaacgcctcgacaacgaactctaacaacgcgaaaaaaccgaaacgacaacccgcgcactcacgcgctacacgcaaaaaaccgaaacgacgcgcgtaaaa

SEQ ID NO: 28951 - DNA, 660 bp, Artificial Sequence
  chemically treated genomic DNA (Homo sapiens) CpG-island No: 28951
tttttatttaaaagatagagaggtagtgtgtttcgtttcgtttcggttcggtttcgcgtatttgttttagttatgatgagttttcgaagcgcggacgcgttgttgggcgttttgtttttgtcgttgtacggcggtggtagtttttattacgttttggttttaaagagcggtataggcgggacgcgttcggtcgttggtttttttagcggtttttattcgtggacgtggacgttcgtgagtttcgtgttcgtttcgtttagtcgtcgtttcgagtatcgattcgttggatacgttgagtaattagttagagggatgcgtggtggcggttgttataacgagtagtgaggaggagtagttgtaggcgtcgacggatcgttttgcgggttatatcgataaggagcggtagttggaggtgtataatcgtagtttggagggcgaggtagcggttttgtagtagtagtaggcgggtcgcgaggttcgtgagacgcgcggtgcgatgttgcgtttgggtagttgcgtttggaataggagtatttgttcgaggatatcgcgtacgtgtgttagcgtttcgataacgagttttggtagcgcgaggaggtcgaggcggtagttcgcgtatttacgcgttgtacgtaggaggtcgaggcggcgcgcgtggaa

SEQ ID NO: 28952 - DNA, 660 bp, Artificial Sequence
  chemically treated genomic DNA (Homo sapiens) CpG-island No: 28952
ttccacgcgcgccgcctcgacctcctacgtacaacgcgtaaatacgcgaactaccgcctcgacctcctcgcgctaccaaaactcgttatcgaaacgctaacacacgtacgcgatatcctcgaacaaatactcctattccaaacgcaactacccaaacgcaacatcgcaccgcgcgtctcacgaacctcgcgacccgcctactactactacaaaaccgctacctcgccctccaaactacgattatacacctccaactaccgctccttatcgatataacccgcaaaacgatccgtcgacgcctacaactactcctcctcactactcgttataacaaccgccaccacgcatccctctaactaattactcaacgtatccaacgaatcgatactcgaaacgacgactaaacgaaacgaacacgaaactcacgaacgtccacgtccacgaataaaaaccgctaaaaaaaccaacgaccgaacgcgtcccgcctataccgctctttaaaaccaaaacgtaataaaaactaccaccgccgtacaacgacaaaaacaaaacgcccaacaacgcgtccgcgcttcgaaaactcatcataactaaaacaaatacgcgaaaccgaaccgaaacgaaacgaaacacactacctctctatcttttaaataaaaa

SEQ ID NO: 28953 - DNA, 676 bp, Artificial Sequence
  chemically treated genomic DNA (Homo sapiens) CpG-island No: 28953
gattttcgttttttattttcgttttcggttttgttcgttagtttttattttcgttttcgattttgttattcgttttttattttcgttttcgattttgattttcgttttttattttcgttttcggttttgattttcgttttttattttcgttttcgattttgattttcgttttttattttcgttttcggttttgattttcgttttttattttcgttttcgattttgtttttcgttttttattttcgttttcggttttgttcgtcgttttttattttcgttttcgattttgtttttcgttttttattttagttttcgattttgttcgttagtttttattttcgttttcgattttgtttttcgttttttattttcgttttcgattttgtttttcgttttttattttcgttttcgattttgtttttcgttttttattttcgttttcggttttgtttttcgttttttattttcgttttcggttttgttcgtcgttttttattttcgttttcggttttgttcgttagtttttattttttttttcgattttgtttttcgttttttattttcgttttcgattttgttcgttcgtttttattttcgtttttgattttgttcgttagtttttttgttgtcgtgtgtcgtgtttgtgttgggatagtttttcgagatgtggtagtta

SEQ ID NO: 28954 - DNA, 676 bp, Artificial Sequence
  chemically treated genomic DNA (Homo sapiens) CpG-island No: 28954
taactaccacatctcgaaaaactatcccaacacaaacacgacacacgacaacaaaaaaactaacgaacaaaatcaaaaacgaaaataaaaacgaacgaacaaaatcgaaaacgaaaataaaaaacgaaaaacaaaatcgaaaaaaaaaataaaaactaacgaacaaaaccgaaaacgaaaataaaaaacgacgaacaaaaccgaaaacgaaaataaaaaacgaaaaacaaaaccgaaaacgaaaataaaaaacgaaaaacaaaatcgaaaacgaaaataaaaaacgaaaaacaaaatcgaaaacgaaaataaaaaacgaaaaacaaaatcgaaaacgaaaataaaaactaacgaacaaaatcgaaaactaaaataaaaaacgaaaaacaaaatcgaaaacgaaaataaaaaacgacgaacaaaaccgaaaacgaaaataaaaaacgaaaaacaaaatcgaaaacgaaaataaaaaacgaaaatcaaaaccgaaaacgaaaataaaaaacgaaaatcaaaatcgaaaacgaaaataaaaaacgaaaatcaaaaccgaaaacgaaaataaaaaacgaaaatcaaaatcgaaaacgaaaataaaaaacgaataacaaaatcgaaaacgaaaataaaaactaacgaacaaaaccgaaaacgaaaataaaaaacgaaaatc

SEQ ID NO: 28955 - DNA, 676 bp, Artificial Sequence
  chemically treated genomic DNA (Homo sapiens) CpG-island No: 28955
tggttgttatatttcggaaaattgttttagtataagtacggtatacggtagtaggagagttggcgggtagggttaaaggcgagggtgagggcgggcgggtagggtcggaggcggaggtgagggacggagggtagggtcggagaagggggtgagggttggcgggtagggtcggaggcgggggtgggggacggcgggtagggtcggaggcggaggtgagggacggagggtagggtcggaggcggaggtgagggacggagggtagggtcggaggcggaggtgagggacggagggtagggtcggaggcgggggtgagggacggagggtagggtcggaggcgggggtgagggttggcgggtagggtcggaggttggggtgggggacggagggtagggtcggaggcgggggtgggggacggcgggtagggtcggaggcggaggtgagggacggagggtagggtcggaggcggaggtgagggacggaggttagggtcggaggcgggggtgagggacggaggttagggtcggaggcggaggtgagggacggaggttagggtcggaggcgggggtgagggacggaggttagggtcggaggcggaggtgagggacggatggtagggtcggaggcgggggtgagggttggcgggtagggtcggaggcgggggtgagggacggaggtt

SEQ ID NO: 28956 - DNA, 676 bp, Artificial Sequence
  chemically treated genomic DNA (Homo sapiens) CpG-island No: 28956
aacctccgtccctcacccccgcctccgaccctacccgccaaccctcacccccgcctccgaccctaccatccgtccctcacctccgcctccgaccctaacctccgtccctcacccccgcctccgaccctaacctccgtccctcacctccgcctccgaccctaacctccgtccctcacccccgcctccgaccctaacctccgtccctcacctccgcctccgaccctaccctccgtccctcacctccgcctccgaccctacccgccgtcccccacccccgcctccgaccctaccctccgtcccccaccccaacctccgaccctacccgccaaccctcacccccgcctccgaccctaccctccgtccctcacccccgcctccgaccctaccctccgtccctcacctccgcctccgaccctaccctccgtccctcacctccgcctccgaccctaccctccgtccctcacctccgcctccgaccctacccgccgtcccccacccccgcctccgaccctacccgccaaccctcacccccttctccgaccctaccctccgtccctcacctccgcctccgaccctacccgcccgccctcaccctcgcctttaaccctacccgccaactctcctactaccgtataccgtacttatactaaaacaattttccgaaatataacaacca

SEQ ID NO: 28957 - DNA, 840 bp, Artificial Sequence
  chemically treated genomic DNA (Homo sapiens) CpG-island No: 28957
tcgtttttcggtttttattgcgcgtttatatttcgttttggttttttttgttttatttaagtttcggtttcgcggtatagcggggagattcgttcgcgtttacggaagaagtcgagttttttcgaagggagaattagtgattttacggatttcggaatttttcgggagtgggattattaggtagcgggcggaattaattttgtcgcggaggcgttgggcgaggatgagggcggcgagcgcggaggggatcgagttatatagtagttcggcggtttttgtcggtaggtttcgttcgtttttttcggttcgattcgggcgggggtttcggtgtcgttttttttatttcgtacgtaggttcgtgggggcggggatagggggacgaaaataatcgcgtttttagtttgattgaataggttcggattttttcgacggcgtcgcgtcgcgtatagatgagtttttgtgggatttcgcggaaggaggcgtcggtcgtagttatattttttttcgggtaagcgcggtcgtcgtttgtaggtatcgttcgtttcgcgcgttcgtaggttttttttggaggcgggaggcggcggtcgttcgtatagcgtgttttttaaagtttttgttgatatagtttcgcgtatatatgagtcggcgcggttagatttacgtaggtatcgagtgttttttttgcgtcgtttcgcgtcgtcgtttcgttatttcgtcgcgcgtttttaatttttgcgtttcgcgtggcgcgtttagcgtttaaggttttattttttttttattttttttggtgtattttttttttttttttaaaattattatttaaatttaaaggttgga

SEQ ID NO: 28958 - DNA, 840 bp, Artificial Sequence
  chemically treated genomic DNA (Homo sapiens) CpG-island No: 28958
tccaacctttaaatttaaataataattttaaaaaaaaaaaaaaaatacaccaaaaaaaataaaaaaaaaataaaaccttaaacgctaaacgcgccacgcgaaacgcaaaaattaaaaacgcgcgacgaaataacgaaacgacgacgcgaaacgacgcaaaaaaaacactcgatacctacgtaaatctaaccgcgccgactcatatatacgcgaaactatatcaacaaaaactttaaaaaacacgctatacgaacgaccgccgcctcccgcctccaaaaaaaacctacgaacgcgcgaaacgaacgatacctacaaacgacgaccgcgcttacccgaaaaaaaatataactacgaccgacgcctccttccgcgaaatcccacaaaaactcatctatacgcgacgcgacgccgtcgaaaaaatccgaacctattcaatcaaactaaaaacgcgattattttcgtccccctatccccgcccccacgaacctacgtacgaaataaaaaaaacgacaccgaaacccccgcccgaatcgaaccgaaaaaaacgaacgaaacctaccgacaaaaaccgccgaactactatataactcgatcccctccgcgctcgccgccctcatcctcgcccaacgcctccgcgacaaaattaattccgcccgctacctaataatcccactcccgaaaaattccgaaatccgtaaaatcactaattctcccttcgaaaaaactcgacttcttccgtaaacgcgaacgaatctccccgctataccgcgaaaccgaaacttaaataaaacaaaaaaaaccaaaacgaaatataaacgcgcaataaaaaccgaaaaacga

SEQ ID NO: 28959 - DNA, 840 bp, Artificial Sequence
  chemically treated genomic DNA (Homo sapiens) CpG-island No: 28959
tttagtttttaagtttgggtggtggttttgagagggggaaagagatgtattaaaggaagtaggggaaaaataaaattttaagcgttgggcgcgttacgcgggacgtagaggttaggggcgcgcggcgaggtagcggggcggcggcgcgagacggcgtaggggaaatattcggtgtttgcgtgagtttggtcgcgtcggtttatgtgtacgcgaagttgtgttagtagaaattttagaaaatacgttgtgcgagcggtcgtcgtttttcgtttttagaaggagtttgcgggcgcgcggggcggacggtgtttgtaggcggcggtcgcgtttgttcggaaaggaatgtggttgcggtcggcgttttttttcgcggggttttataaaggtttatttgtgcgcggcgcggcgtcgtcggaggagttcgagtttgtttagttaggttgaggacgcggttgttttcgtttttttgttttcgtttttacgagtttacgtgcggggtagggagggcggtatcggaattttcgttcgggtcgggtcgaaaggagcgagcggggtttgtcggtagaggtcgtcgggttgttgtgtgattcggtttttttcgcgttcgtcgtttttattttcgtttagcgttttcgcggtagggttaatttcgttcgttgtttggtggttttattttcgggggatttcggggttcgtggaattattggtttttttttcggaggagttcggtttttttcgtgggcgcgggcgagttttttcgttgtatcgcggggtcggggtttgaataaaataaaagaaattaaggcgaggtgtggacgcgtagtgaggatcggaaagcga

SEQ ID NO: 28960 - DNA, 840 bp, Artificial Sequence
  chemically treated genomic DNA (Homo sapiens) CpG-island No: 28960
tcgctttccgatcctcactacgcgtccacacctcgccttaatttcttttattttattcaaaccccgaccccgcgatacaacgaaaaaactcgcccgcgcccacgaaaaaaaccgaactcctccgaaaaaaaaaccaataattccacgaaccccgaaatcccccgaaaataaaaccaccaaacaacgaacgaaattaaccctaccgcgaaaacgctaaacgaaaataaaaacgacgaacgcgaaaaaaaccgaatcacacaacaacccgacgacctctaccgacaaaccccgctcgctcctttcgacccgacccgaacgaaaattccgataccgccctccctaccccgcacgtaaactcgtaaaaacgaaaacaaaaaaacgaaaacaaccgcgtcctcaacctaactaaacaaactcgaactcctccgacgacgccgcgccgcgcacaaataaacctttataaaaccccgcgaaaaaaaacgccgaccgcaaccacattcctttccgaacaaacgcgaccgccgcctacaaacaccgtccgccccgcgcgcccgcaaactccttctaaaaacgaaaaacgacgaccgctcgcacaacgtattttctaaaatttctactaacacaacttcgcgtacacataaaccgacgcgaccaaactcacgcaaacaccgaatatttcccctacgccgtctcgcgccgccgccccgctacctcgccgcgcgcccctaacctctacgtcccgcgtaacgcgcccaacgcttaaaattttatttttcccctacttcctttaatacatctctttccccctctcaaaaccaccacccaaacttaaaaactaaa

SEQ ID NO: 28961 - DNA, 712 bp, Artificial Sequence
  chemically treated genomic DNA (Homo sapiens) CpG-island No: 28961
cggagtttttttggtttcgtttatttttttcgtttttacgtttttacgtttttacgtttttgatttttttatttttttcgtttttttcggtttgatttttttggatcgttttcgttaattttggttttttttattttttttcgttatatcgggtcgtttcgttttcgggtgtttttggtgtttttcgtcgtcggtcgtaggcgtttcgttttagataaagtggatttagtttgcggtttcggagttcgttattgttcgggtgttcgggtttacgtagagtatagttacggtcgtcgttgttgttttagaattcgtgatttgttatacggtagcgtaaggcgaagagtagggcgtttttaatcggcggcgcgggtaggcggaaggcgaagcggtcggcgcgcggcgggggcggggtcggatcggcgtagtgcgtggcgtttcgcgttcgttcgttagtcgtcgggttttagcgtagtttacgcgtttttcgtaggttaggtttattacgcgcgcgttttcggttacgtttagcgggttcgtttcggcgcgttttaggtagatgcgttgcgttagtaagcgggcggcgaagtcgggttcgttggtcggttttagggcggcgcgcgttttttgggggaaagaagaagcgggaggagggagtttagggcggagagaggggagagatagggggcggtgttagagtaaggtattggat

SEQ ID NO: 28962 - DNA, 712 bp, Artificial Sequence
  chemically treated genomic DNA (Homo sapiens) CpG-island No: 28962
atccaataccttactctaacaccgccccctatctctcccctctctccgccctaaactccctcctcccgcttcttctttcccccaaaaaacgcgcgccgccctaaaaccgaccaacgaacccgacttcgccgcccgcttactaacgcaacgcatctacctaaaacgcgccgaaacgaacccgctaaacgtaaccgaaaacgcgcgcgtaataaacctaacctacgaaaaacgcgtaaactacgctaaaacccgacgactaacgaacgaacgcgaaacgccacgcactacgccgatccgaccccgcccccgccgcgcgccgaccgcttcgccttccgcctacccgcgccgccgattaaaaacgccctactcttcgccttacgctaccgtataacaaatcacgaattctaaaacaacaacgacgaccgtaactatactctacgtaaacccgaacacccgaacaataacgaactccgaaaccgcaaactaaatccactttatctaaaacgaaacgcctacgaccgacgacgaaaaacaccaaaaacacccgaaaacgaaacgacccgatataacgaaaaaaaataaaaaaaaccaaaattaacgaaaacgatccaaaaaaatcaaaccgaaaaaaacgaaaaaaataaaaaaatcaaaaacgtaaaaacgtaaaaacgtaaaaacgaaaaaaataaacgaaaccaaaaaaactccg

SEQ ID NO: 28963 - DNA, 712 bp, Artificial Sequence
  chemically treated genomic DNA (Homo sapiens) CpG-island No: 28963
gtttagtgttttgttttgatatcgttttttgtttttttttttttttcgttttgggtttttttttttcgtttttttttttttttaggaggcgcgcgtcgttttggagtcggttagcgagttcggtttcgtcgttcgtttgttgacgtagcgtatttgtttggaacgcgtcgaggcgggttcgttgggcgtggtcgggagcgcgcgcgtggtggatttggtttacgagaagcgcgtgagttgcgttggagttcgacggttggcggacgaacgcgaggcgttacgtattacgtcggttcggtttcgttttcgtcgcgcgtcgatcgtttcgtttttcgtttgttcgcgtcgtcgattgggggcgttttgtttttcgttttgcgttatcgtgtgataggttacgagttttgggataataacggcggtcgtgattatgttttacgtgggttcgagtattcgggtagtggcggatttcggagtcgtaggttggatttattttatttgagacgaggcgtttgcggtcgacggcggaaaatattaaaggtattcgggggcggggcgattcgatgtggcggggaggagtaggagagattaggattggcgggagcggtttaagggagttaagtcggggagggcgaaaagggtggggaaattaggggcgtgggggcgtgggggcgtgggggcggggggagtgagcggaattaaagaagtttcg

SEQ ID NO: 28964 - DNA, 712 bp, Artificial Sequence
  chemically treated genomic DNA (Homo sapiens) CpG-island No: 28964
cgaaacttctttaattccgctcactccccccgcccccacgcccccacgcccccacgcccctaatttccccacccttttcgccctccccgacttaactcccttaaaccgctcccgccaatcctaatctctcctactcctccccgccacatcgaatcgccccgcccccgaatacctttaatattttccgccgtcgaccgcaaacgcctcgtctcaaataaaataaatccaacctacgactccgaaatccgccactacccgaatactcgaacccacgtaaaacataatcacgaccgccgttattatcccaaaactcgtaacctatcacacgataacgcaaaacgaaaaacaaaacgcccccaatcgacgacgcgaacaaacgaaaaacgaaacgatcgacgcgcgacgaaaacgaaaccgaaccgacgtaatacgtaacgcctcgcgttcgtccgccaaccgtcgaactccaacgcaactcacgcgcttctcgtaaaccaaatccaccacgcgcgcgctcccgaccacgcccaacgaacccgcctcgacgcgttccaaacaaatacgctacgtcaacaaacgaacgacgaaaccgaactcgctaaccgactccaaaacgacgcgcgcctcctaaaaaaaaaaaaaaacgaaaaaaaaaaacccaaaacgaaaaaaaaaaaaaaacaaaaaacgatatcaaaacaaaacactaaac

SEQ ID NO: 28965 - DNA, 580 bp, Artificial Sequence
  chemically treated genomic DNA (Homo sapiens) CpG-island No: 28965
gggcgcggggttggtagggcgcgaagtggcggagggcgtttttttgtaattggatttgtacgtggcggggtattcggggtagtttatcgggacggaagcggcgtacgatagttagttttaattttagtgcgtcggcgaaacgtatttttttgcgggtgtttgggttacggttgcggggcgttcgggtttcgtcgttttcggttggtgtagatcgggttcggcggtttcgattcggtgcgtgagcgcgggatcgggtttcgaatcgcgtttcgttttcgtttggtttttttttcggttttttttcgaggttgggtcgttggttacggtagtaggcgcgtttcgttagcgcggcgatgaagtttaggttgcggggaatgtcggtgttcgggggtcgtttacgggatatggtagtttttttttcggcggggttagttcgtagcgttatcgcgtttttttttttttttttttttcgttcgtttcgcgttagcgtagaagtcgttgggttcgtttttgtagtttttcgttgttgtgtattttttttgtagatatttttaggattttttatttttcgttgttttgt

SEQ ID NO: 28966 - DNA, 580 bp, Artificial Sequence
  chemically treated genomic DNA (Homo sapiens) CpG-island No: 28966
acaaaacaacgaaaaataaaaaatcctaaaaatatctacaaaaaaaatacacaacaacgaaaaactacaaaaacgaacccaacgacttctacgctaacgcgaaacgaacgaaaaaaaaaaaaaaaaaaaaacgcgataacgctacgaactaaccccgccgaaaaaaaaactaccatatcccgtaaacgacccccgaacaccgacattccccgcaacctaaacttcatcgccgcgctaacgaaacgcgcctactaccgtaaccaacgacccaacctcgaaaaaaaaccgaaaaaaaaaccaaacgaaaacgaaacgcgattcgaaacccgatcccgcgctcacgcaccgaatcgaaaccgccgaacccgatctacaccaaccgaaaacgacgaaacccgaacgccccgcaaccgtaacccaaacacccgcaaaaaaatacgtttcgccgacgcactaaaattaaaactaactatcgtacgccgcttccgtcccgataaactaccccgaataccccgccacgtacaaatccaattacaaaaaaacgccctccgccacttcgcgccctaccaaccccgcgccc

SEQ ID NO: 28967 - DNA, 580 bp, Artificial Sequence
  chemically treated genomic DNA (Homo sapiens) CpG-island No: 28967
gtaaagtaacgggaggtggaggattttggaggtgtttgtaaggagaatatatagtagcgaggggttgtagaagcggatttagcgatttttgcgttgacgcggggcgggcgggagagaggaagagaggggagcgcggtggcgttgcgagttggtttcgtcggggaaggggttgttatgtttcgtgagcggttttcgggtatcgatatttttcgtaatttgagttttatcgtcgcgttaacggagcgcgtttattatcgtagttagcggtttagtttcgaggaggagtcggaggaggagttaggcgagggcgggacgcggttcggggttcgatttcgcgtttacgtatcgagtcggggtcgtcgggttcgatttgtattagtcggaggcggcggggttcgggcgtttcgtagtcgtagtttagatattcgtaagagagtgcgtttcgtcgacgtattggggttggagttggttgtcgtgcgtcgttttcgtttcggtgagttgtttcgggtgtttcgttacgtgtagatttaattgtagagggacgtttttcgttatttcgcgttttgttagtttcgcgttt

SEQ ID NO: 28968 - DNA, 580 bp, Artificial Sequence
  chemically treated genomic DNA (Homo sapiens) CpG-island No: 28968
aaacgcgaaactaacaaaacgcgaaataacgaaaaacgtccctctacaattaaatctacacgtaacgaaacacccgaaacaactcaccgaaacgaaaacgacgcacgacaaccaactccaaccccaatacgtcgacgaaacgcactctcttacgaatatctaaactacgactacgaaacgcccgaaccccgccgcctccgactaatacaaatcgaacccgacgaccccgactcgatacgtaaacgcgaaatcgaaccccgaaccgcgtcccgccctcgcctaactcctcctccgactcctcctcgaaactaaaccgctaactacgataataaacgcgctccgttaacgcgacgataaaactcaaattacgaaaaatatcgatacccgaaaaccgctcacgaaacataacaaccccttccccgacgaaaccaactcgcaacgccaccgcgctcccctctcttcctctctcccgcccgccccgcgtcaacgcaaaaatcgctaaatccgcttctacaacccctcgctactatatattctccttacaaacacctccaaaatcctccacctcccgttactttac

SEQ ID NO: 28969 - DNA, 587 bp, Artificial Sequence
  chemically treated genomic DNA (Homo sapiens) CpG-island No: 28969
cgggttgttgggttgtgcgcgttttgattttagacgtcgattttttcggttttgtatattatttatagtttttcgtttttttttttcgattttttttcgtaaggtagcgcgtgtgtaagaaagtagtatcgtttgtttgtgtaagtttttcgagttaggtaagtaatacgggtaagtgtttcgcggtcgttagttgttcgagtttaaatcgtttttattttttttttttttttttttcggtgacgttttcgacgacgacgttttgttttattttttcgcgtttttcgatttttttgatgaggatcgtttttgtcgtttttatttggcgcggcggtttttaaattagatttgttgcgtaacggaggataaaatagtttagattaaaggcgcgttttttttagtttcggggtattcggggagtttggtgtggcggcgggatatttcgcgtaggttaataaaaggaggggagtcgttcgttttcgttttcgcgtttttatttaattttttgggtttaaagcgttttttagtagtttgcgggtcgttatcgggatgtttttaaagtgcggggagagttaagtagggttggg

SEQ ID NO: 28970 - DNA, 587 bp, Artificial Sequence
  chemically treated genomic DNA (Homo sapiens) CpG-island No: 28970
cccaaccctacttaactctccccgcactttaaaaacatcccgataacgacccgcaaactactaaaaaacgctttaaacccaaaaaattaaataaaaacgcgaaaacgaaaacgaacgactcccctccttttattaacctacgcgaaatatcccgccgccacaccaaactccccgaataccccgaaactaaaaaaaacgcgcctttaatctaaactattttatcctccgttacgcaacaaatctaatttaaaaaccgccgcgccaaataaaaacgacaaaaacgatcctcatcaaaaaaatcgaaaaacgcgaaaaaataaaacaaaacgtcgtcgtcgaaaacgtcaccgaaaaaaaaaaaaaaaaaaaataaaaacgatttaaactcgaacaactaacgaccgcgaaacacttacccgtattacttacctaactcgaaaaacttacacaaacaaacgatactactttcttacacacgcgctaccttacgaaaaaaaatcgaaaaaaaaaaacgaaaaactataaataatatacaaaaccgaaaaaatcgacgtctaaaatcaaaacgcgcacaacccaacaacccg

SEQ ID NO: 28971 - DNA, 587 bp, Artificial Sequence
  chemically treated genomic DNA (Homo sapiens) CpG-island No: 28971
tttagttttgtttggtttttttcgtattttaaaaatatttcgatggcggttcgtaggttgttggagggcgttttaggtttaggaagttgaatgaaaacgcggaagcgggagcgagcggtttttttttttttgttggtttgcgcggggtgtttcgtcgttatattaagtttttcgggtgtttcgggattgggggaagcgcgtttttgatttgaattgttttgtttttcgttgcgtaataggtttggtttaagaatcgtcgcgttaaatggaggcggtagaagcggtttttattagaggagtcggagaacgcggagaagtggaataagacgtcgtcgtcgaaggcgttatcggagaagagggaagaggaaggtaaaagcgatttggattcggatagttgacggtcgcgggatatttgttcgtattatttatttaattcgaaggatttgtatagatagacgatgttatttttttgtatacgcgttgttttgcgggagggggtcgagaaagaggaacgaggagttgtaaatagtgtatagagtcgggagggtcggcgtttggggttagggcgcgtatagtttagtagttcg

SEQ ID NO: 28972 - DNA, 587 bp, Artificial Sequence
  chemically treated genomic DNA (Homo sapiens) CpG-island No: 28972
cgaactactaaactatacgcgccctaaccccaaacgccgaccctcccgactctatacactatttacaactcctcgttcctctttctcgaccccctcccgcaaaacaacgcgtatacaaaaaaataacatcgtctatctatacaaatccttcgaattaaataaataatacgaacaaatatcccgcgaccgtcaactatccgaatccaaatcgcttttaccttcctcttccctcttctccgataacgccttcgacgacgacgtcttattccacttctccgcgttctccgactcctctaataaaaaccgcttctaccgcctccatttaacgcgacgattcttaaaccaaacctattacgcaacgaaaaacaaaacaattcaaatcaaaaacgcgcttcccccaatcccgaaacacccgaaaaacttaatataacgacgaaacaccccgcgcaaaccaacaaaaaaaaaaaaaccgctcgctcccgcttccgcgttttcattcaacttcctaaacctaaaacgccctccaacaacctacgaaccgccatcgaaatatttttaaaatacgaaaaaaaccaaacaaaactaaa

SEQ ID NO: 28973 - DNA, 851 bp, Artificial Sequence
  chemically treated genomic DNA (Homo sapiens) CpG-island No: 28973
gcgggggcgtacggattttcgttttttcggtagatatgataaaggtcgatcgggagtcgggggcgcgatagtatcggagcggttagttttcgtttttatttttagggtaggatatttgcgtcgtttttatttatttgcggatttatgtttatttcggttttatacgcgtcgggggaatgtagtggaagagaattgggtgtcggggattttgggattcgcgttttttcgttcgttcgcgaagtagggtagagaattcgtacggtttcggtcgttattagtttcgcgttatattcgttatttttgaattttaacggttattatttatttttatcgcgttttgtacgtagggattaatcgtcgttgtcgttatagtcgagggttaatcgtagcgtttttcgttattcgaagttatatttcgttcgataggcgttttgttttttttgtttcgtaggcgtaggagaggtaggcggattaattttattttcggtgttatttatgttttttatttttttttttttttagcggtaatagtgttggattttcgttcggtttttcgtcgtcgttcgttacgttagaaaatgcgtggacgtcgtcgtacgaacgtaattggttaagcgaaattggtggcggtcggaggagaaggggcggggacgttggaggaaagaaatgacgcgtgcgtaaacgaggattcgtgtcgggagataggcgggattagcgttttttggtgattgtagtagggagcgtatttgtttttcgtcgacgtgattgaggttttagcgttgttttttttggtcgtggttgattgggttcggaagtggtttttggagtttttacgtggatgtgagtggttt

SEQ ID NO: 28974 - DNA, 851 bp, Artificial Sequence
  chemically treated genomic DNA (Homo sapiens) CpG-island No: 28974
aaaccactcacatccacgtaaaaactccaaaaaccacttccgaacccaatcaaccacgaccaaaaaaaacaacgctaaaacctcaatcacgtcgacgaaaaacaaatacgctccctactacaatcaccaaaaaacgctaatcccgcctatctcccgacacgaatcctcgtttacgcacgcgtcatttctttcctccaacgtccccgccccttctcctccgaccgccaccaatttcgcttaaccaattacgttcgtacgacgacgtccacgcattttctaacgtaacgaacgacgacgaaaaaccgaacgaaaatccaacactattaccgctaaaaaaaaaaaaaaataaaaaacataaataacaccgaaaataaaattaatccgcctacctctcctacgcctacgaaacaaaaaaaacaaaacgcctatcgaacgaaatataacttcgaataacgaaaaacgctacgattaaccctcgactataacgacaacgacgattaatccctacgtacaaaacgcgataaaaataaataataaccgttaaaattcaaaaataacgaatataacgcgaaactaataacgaccgaaaccgtacgaattctctaccctacttcgcgaacgaacgaaaaaacgcgaatcccaaaatccccgacacccaattctcttccactacattcccccgacgcgtataaaaccgaaataaacataaatccgcaaataaataaaaacgacgcaaatatcctaccctaaaaataaaaacgaaaactaaccgctccgatactatcgcgcccccgactcccgatcgacctttatcatatctaccgaaaaaacgaaaatccgtacgcccccgc

SEQ ID NO: 28975 - DNA, 851 bp, Artificial Sequence
  chemically treated genomic DNA (Homo sapiens) CpG-island No: 28975
aggttatttatatttacgtgagggttttaggagttattttcgggtttagttaattacgattaggagaggtagcgttggagttttaattacgtcgacggaaaataagtgcgttttttattgtagttattaggaggcgttagtttcgtttgtttttcggtacgggttttcgtttgcgtacgcgttattttttttttttagcgttttcgttttttttttttcggtcgttattagtttcgtttggttagttgcgttcgtgcggcgacgtttacgtattttttgacgtagcgagcgacggcggggagtcgagcggaagtttagtattattgtcgttagaggaggggaggggtgagaagtataagtggtatcggaagtggaattaattcgtttattttttttgcgtttgcgaaatagaaaagataaggcgtttgtcgggcggggtgtggtttcgggtggcggagaacgttgcgattggttttcggttgtggcgatagcgacgattggtttttgcgtgtagagcgcggtgagagtgggtggtggtcgttggaatttaaaagtggcgggtgtggcgcggggttggtagcggtcggagtcgtgcgagttttttattttgtttcgcgagcgggcgagagaacgcgagttttaggattttcggtatttagtttttttttattgtattttttcggcgcgtgtgggatcgaggtggatatggattcgtaggtgagtaggggcggcgtaggtgttttgttttggggatggggacgaaggttgatcgtttcgatgttgtcgcgttttcggttttcggtcggtttttgttatgtttatcgggagagcgaaggttcgtgcgttttcgt

SEQ ID NO: 28976 - DNA, 851 bp, Artificial Sequence
  chemically treated genomic DNA (Homo sapiens) CpG-island No: 28976
acgaaaacgcacgaaccttcgctctcccgataaacataacaaaaaccgaccgaaaaccgaaaacgcgacaacatcgaaacgatcaaccttcgtccccatccccaaaacaaaacacctacgccgcccctactcacctacgaatccatatccacctcgatcccacacgcgccgaaaaaatacaataaaaaaaaactaaataccgaaaatcctaaaactcgcgttctctcgcccgctcgcgaaacaaaataaaaaactcgcacgactccgaccgctaccaaccccgcgccacacccgccacttttaaattccaacgaccaccacccactctcaccgcgctctacacgcaaaaaccaatcgtcgctatcgccacaaccgaaaaccaatcgcaacgttctccgccacccgaaaccacaccccgcccgacaaacgccttatcttttctatttcgcaaacgcaaaaaaaataaacgaattaattccacttccgataccacttatacttctcacccctcccctcctctaacgacaataatactaaacttccgctcgactccccgccgtcgctcgctacgtcaaaaaatacgtaaacgtcgccgcacgaacgcaactaaccaaacgaaactaataacgaccgaaaaaaaaaaaacgaaaacgctaaaaaaaaaaaataacgcgtacgcaaacgaaaacccgtaccgaaaaacaaacgaaactaacgcctcctaataactacaataaaaaacgcacttattttccgtcgacgtaattaaaactccaacgctacctctcctaatcgtaattaactaaacccgaaaataactcctaaaaccctcacgtaaatataaataacct

SEQ ID NO: 28977 - DNA, 509 bp, Artificial Sequence
  chemically treated genomic DNA (Homo sapiens) CpG-island No: 28977
gtcgtatttcgatatttggagacgttttttaggattagtttgaatcgcgttcgggttgggttttggattcggattcgtagcggtgatagcggaggcggggacgggggtggataaattgcggattaatttttcgagaagacggttatttgtcggaatttgtttttttttatttcgtttaggagtttcgtagcggggcgttggtttgcggaaaggttacgggggagtatagggtttcgcgtcgtttttttgggagggttcggagtttagcgtatttcgagttttggtgggtgagttcggcgggaggcgcggtaggtgcggcgggagattggatttcgatttatttttataaagagttcgatttcggggtttttgtcgttttcgttagttgtcgtcgagtttgttatgtcgttggcgttcggggttatcgtttcgggtcggggaggcgttatttttgtagtatttgggttagtattttgcgtttttgtcgttgtttagcggggttttttttt

SEQ ID NO: 28978 - DNA, 509 bp, Artificial Sequence
  chemically treated genomic DNA (Homo sapiens) CpG-island No: 28978
aaaaaaaaaccccgctaaacaacgacaaaaacgcaaaatactaacccaaatactacaaaaataacgcctccccgacccgaaacgataaccccgaacgccaacgacataacaaactcgacgacaactaacgaaaacgacaaaaaccccgaaatcgaactctttataaaaataaatcgaaatccaatctcccgccgcacctaccgcgcctcccgccgaactcacccaccaaaactcgaaatacgctaaactccgaaccctcccaaaaaaacgacgcgaaaccctatactcccccgtaacctttccgcaaaccaacgccccgctacgaaactcctaaacgaaataaaaaaaaacaaattccgacaaataaccgtcttctcgaaaaattaatccgcaatttatccacccccgtccccgcctccgctatcaccgctacgaatccgaatccaaaacccaacccgaacgcgattcaaactaatcctaaaaaacgtctccaaatatcgaaatacgac

SEQ ID NO: 28979 - DNA, 509 bp, Artificial Sequence
  chemically treated genomic DNA (Homo sapiens) CpG-island No: 28979
gaagaggagtttcgttgggtagcggtaggagcgtagagtgttggtttaggtgttgtagaggtggcgttttttcggttcgggacggtagtttcgggcgttaacggtatgatagattcggcgatagttaacggggacgatagggatttcgagatcgagttttttgtgaaggtaggtcggggtttagtttttcgtcgtatttgtcgcgtttttcgtcgggtttatttattagggttcggggtgcgttggatttcggatttttttaggagggcggcgcggagttttgtgttttttcgtggttttttcgtaggttagcgtttcgttgcgaggtttttgggcggaatggaggaaggtaggtttcggtaggtggtcgttttttcggagagttgattcgtagtttgtttattttcgttttcgttttcgttgttatcgttgcgagttcgagtttagagtttagttcggacgcgatttaggttggttttgaaagacgtttttaggtgtcgggatgcggt

SEQ ID NO: 28980 - DNA, 509 bp, Artificial Sequence
  chemically treated genomic DNA (Homo sapiens) CpG-island No: 28980
accgcatcccgacacctaaaaacgtctttcaaaaccaacctaaatcgcgtccgaactaaactctaaactcgaactcgcaacgataacaacgaaaacgaaaacgaaaataaacaaactacgaatcaactctccgaaaaaacgaccacctaccgaaacctaccttcctccattccgcccaaaaacctcgcaacgaaacgctaacctacgaaaaaaccacgaaaaaacacaaaactccgcgccgccctcctaaaaaaatccgaaatccaacgcaccccgaaccctaataaataaacccgacgaaaaacgcgacaaatacgacgaaaaactaaaccccgacctaccttcacaaaaaactcgatctcgaaatccctatcgtccccgttaactatcgccgaatctatcataccgttaacgcccgaaactaccgtcccgaaccgaaaaaacgccacctctacaacacctaaaccaacactctacgctcctaccgctacccaacgaaactcctcttc

SEQ ID NO: 28981 - DNA, 1670 bp, Artificial Sequence
  chemically treated genomic DNA (Homo sapiens) CpG-island No: 28981
  misc_feature (1149)..(1149): n is either a, c, g or t
  misc_feature (1152)..(1152): n is either a, c, g or t
  misc_feature (1161)..(1162): n is either a, c, g or t
  misc_feature (1176)..(1176): n is either a, c, g or t
tttttattcgggcgtttttattttgagatagtcgtttttcgagcgtagtttttttagttttcgtattaagtcgttgggttcgtagtttagtattttttcggtgaggtcggagaaggtaagcgaggcgttgagcggtaagcggttgttgtttatcgacgacgcggttatcgacggttcgttcggggaggcgggcggtcgcgggggttgttgcgcggagggcgcgggttgggtcggttgtttcgtacggattttcgtcgggttttcggtcgcggattcggcgtcgttgtttagcgttagttttaggtttagtaggcgcgtttttttcgacgcgtagttcgatattttcgagttgttattcgtgaggttggggggcggcggtggcggttacggtttcgtattcgagcgcggacggtttttggtacggatttcggtgcggatttcggttattcgtataatcgtatcgcgcgtttcgggagttattgcgcgtttttttttgttcggtcgtgaggaggacgcggcgttgtaggcgattgttgagttcgggtttgggtcgcggcggtttttagttagcgattagtcggttacgtttttgggtcgggtcggcgacggcgcgcggtggttttttttttttttcggggtaggcgcgggtgtaggcgcgggttggggatcgtagtttcggatcgggggttcggtcgtcggcgtttttatcgcggtttttttcggttttagcgagttgcgcgtatggtttaggttcgttcggtttcgacgtttttggggagggattcggcgcggtttcggtcgttggggttgcggttgttttcggtttatttcggtttcgatatcgcgttttcgttttaagtttcgtcgcgcggttttttcgttgttttgggttcggagagtgcggttcgatcgtttttaggcgtttcggtttcggttgcggtttcgttcggcgttcgttttttcggtttcgtcgcgttttcggagcgcgttcgggttttcgtcgttcgtacgtcgatcgttttttcgggtttcgagttcggttgcggttcgggtttcggtttcgttcggcgtagttcgtttttcgcgtagtttcgttagtttttcgtttcgtcgtttcggttcggggcgcgcggtttcgcgaataaaagncgnacgcgcggnnagcggtaaggaggnacgtaggtagggagcgaggaagggatttgcgaggtaatagcgattttttcgagggttaggttggcgcgggtagtcgcggttcgggtttttttttttttcgtttcgtcgtttttttttttgttcgttcggggaaggtattcggcggaggcgtttttgcgttcggcgttcgggtagggtttgcgagagcggcgggagtcgggattttcgggtcgaggtcgggcggattttagttcgtaggaattcgtatttatgtacgtttagcgtttcgtttttcgtttcgtgtcgagcgtgcgcgaatttcgtttttttagtcggtatcgtcggagtcgcgattttatcgtatagatgcgtaaattgaagtttggggtgtacgcgttaagtttacggtttaggcggcgtcgatgggatttaaagtttatatttttcgggcgcgttcgggttttttttgtttcggttttttttttttggtatagggatcgtgaagttttgtgtgt

SEQ ID NO: 28982 - DNA, 1670 bp, Artificial Sequence
  chemically treated genomic DNA (Homo sapiens) CpG-island No: 28982
  misc_feature (495)..(495): n is either a, c, g or t
  misc_feature (509)..(510): n is either a, c, g or t
  misc_feature (519)..(519): n is either a, c, g or t
  misc_feature (522)..(522): n is either a, c, g or t
acacacaaaacttcacgatccctataccaaaaaaaaaaaaccgaaacaaaaaaaacccgaacgcgcccgaaaaatataaactttaaatcccatcgacgccgcctaaaccgtaaacttaacgcgtacaccccaaacttcaatttacgcatctatacgataaaatcgcgactccgacgataccgactaaaaaaacgaaattcgcgcacgctcgacacgaaacgaaaaacgaaacgctaaacgtacataaatacgaattcctacgaactaaaatccgcccgacctcgacccgaaaatcccgactcccgccgctctcgcaaaccctacccgaacgccgaacgcaaaaacgcctccgccgaataccttccccgaacgaacaaaaaaaaaaacgacgaaacgaaaaaaaaaaaaacccgaaccgcgactacccgcgccaacctaaccctcgaaaaaatcgctattacctcgcaaatcccttcctcgctccctacctacgtncctccttaccgctnnccgcgcgtncgncttttattcgcgaaaccgcgcgccccgaaccgaaacgacgaaacgaaaaactaacgaaactacgcgaaaaacgaactacgccgaacgaaaccgaaacccgaaccgcaaccgaactcgaaacccgaaaaaacgatcgacgtacgaacgacgaaaacccgaacgcgctccgaaaacgcgacgaaaccgaaaaaacgaacgccgaacgaaaccgcaaccgaaaccgaaacgcctaaaaacgatcgaaccgcactctccgaacccaaaacaacgaaaaaaccgcgcgacgaaacttaaaacgaaaacgcgatatcgaaaccgaaataaaccgaaaacaaccgcaaccccaacgaccgaaaccgcgccgaatccctccccaaaaacgtcgaaaccgaacgaacctaaaccatacgcgcaactcgctaaaaccgaaaaaaaccgcgataaaaacgccgacgaccgaacccccgatccgaaactacgatccccaacccgcgcctacacccgcgcctaccccgaaaaaaaaaaaaaaccaccgcgcgccgtcgccgacccgacccaaaaacgtaaccgactaatcgctaactaaaaaccgccgcgacccaaacccgaactcaacaatcgcctacaacgccgcgtcctcctcacgaccgaacaaaaaaaaacgcgcaataactcccgaaacgcgcgatacgattatacgaataaccgaaatccgcaccgaaatccgtaccaaaaaccgtccgcgctcgaatacgaaaccgtaaccgccaccgccgccccccaacctcacgaataacaactcgaaaatatcgaactacgcgtcgaaaaaaacgcgcctactaaacctaaaactaacgctaaacaacgacgccgaatccgcgaccgaaaacccgacgaaaatccgtacgaaacaaccgacccaacccgcgccctccgcgcaacaacccccgcgaccgcccgcctccccgaacgaaccgtcgataaccgcgtcgtcgataaacaacaaccgcttaccgctcaacgcctcgcttaccttctccgacctcaccgaaaaaatactaaactacgaacccaacgacttaatacgaaaactaaaaaaactacgctcgaaaaacgactatctcaaaataaaaacgcccgaataaaaa

SEQ ID NO: 28983 - DNA, 1670 bp, Artificial Sequence
  chemically treated genomic DNA (Homo sapiens) CpG-island No: 28983
  misc_feature (495)..(495): n is either a, c, g or t
  misc_feature (509)..(510): n is either a, c, g or t
  misc_feature (519)..(519): n is either a, c, g or t
  misc_feature (522)..(522): n is either a, c, g or t
gtatatagggttttacggtttttatgttaggagagggaagtcgaggtagggggagttcgagcgcgttcgggaggtgtgagttttgggttttatcggcgtcgtttagatcgtgagtttggcgcgtgtattttaggttttagtttacgtatttgtgcgatgggatcgcggtttcggcgatgtcggttaagggggcggagttcgcgtacgttcggtacggggcgaggggcgaggcgttgggcgtgtatggatgcgggtttttgcgaattgaggttcgttcggtttcggttcgggagtttcggttttcgtcgttttcgtaggttttgttcggacgtcgggcgtaggggcgttttcgtcgggtgtttttttcgagcgggtaggggaggaggcggcggagcggaggaggagggagttcgggtcgcggttgttcgcgttagtttgattttcgaaggggtcgttgttgtttcgtagatttttttttcgttttttgtttgcgtntttttttgtcgttnntcgcgcgtncgntttttgttcgcggaatcgcgcgtttcgagtcgaggcggcggggcggggagttggcggggttgcgcggggggcgggttgcgtcgggcggagtcggggttcgggtcgtagtcggattcggagttcgagggagcgatcggcgtgcgggcggcgggggttcgggcgcgtttcgggggcgcggcgaggtcgagggggcgggcgtcgggcggagtcgtagtcggagtcggggcgtttggaggcggtcgggtcgtatttttcgagtttagagtagcggagagatcgcgcggcggggtttgggacggggacgcggtgtcggggtcgaggtgggtcgagagtagtcgtagttttagcggtcggagtcgcgtcgggtttttttttagggacgtcgaggtcgggcgggtttgggttatgcgcgtagttcgttgaggtcgagggaggtcgcgatggaggcgtcggcggtcgagttttcggttcggggttgcggtttttagttcgcgtttgtattcgcgtttgtttcggagaggaaaaagagttatcgcgcgtcgtcgtcggttcggtttaaagacgtggtcggttggtcgttggttaagggtcgtcgcggtttaggttcgggtttagtagtcgtttgtagcgtcgcgttttttttacggtcggataagaaggggcgcgtagtggttttcggggcgcgcggtgcggttgtgcgggtggtcggggttcgtatcggggttcgtgttaagggtcgttcgcgttcgggtgcggggtcgtgatcgttatcgtcgttttttagttttacggatagtagttcggaggtgtcggattgcgcgtcggaggaggcgcgtttgttgggtttggagttggcgttgagtagcgacgtcgagttcgcggtcgggggttcggcgggggttcgtacggggtagtcggtttagttcgcgtttttcgcgtagtagttttcgcggtcgttcgttttttcggacgagtcgtcggtggtcgcgtcgtcggtgggtagtagtcgtttgtcgtttagcgtttcgtttgtttttttcgattttatcgaggagatgttggattgcgggtttagcggtttggtgcgggagttggaggagttgcgttcggagaacgattattttaaggtgggggcgttcgggtagaaa

SEQ ID NO: 28984 - DNA, 1670 bp, Artificial Sequence
  chemically treated genomic DNA (Homo sapiens) CpG-island No: 28984
  misc_feature (1149)..(1149): n is either a, c, g or t
  misc_feature (1152)..(1152): n is either a, c, g or t
  misc_feature (1161)..(1162): n is either a, c, g or t
  misc_feature (1176)..(1176): n is either a, c, g or t
tttctacccgaacgcccccaccttaaaataatcgttctccgaacgcaactcctccaactcccgcaccaaaccgctaaacccgcaatccaacatctcctcgataaaatcgaaaaaaacaaacgaaacgctaaacgacaaacgactactacccaccgacgacgcgaccaccgacgactcgtccgaaaaaacgaacgaccgcgaaaactactacgcgaaaaacgcgaactaaaccgactaccccgtacgaacccccgccgaacccccgaccgcgaactcgacgtcgctactcaacgccaactccaaacccaacaaacgcgcctcctccgacgcgcaatccgacacctccgaactactatccgtaaaactaaaaaacgacgataacgatcacgaccccgcacccgaacgcgaacgacccttaacacgaaccccgatacgaaccccgaccacccgcacaaccgcaccgcgcgccccgaaaaccactacgcgccccttcttatccgaccgtaaaaaaaacgcgacgctacaaacgactactaaacccgaacctaaaccgcgacgacccttaaccaacgaccaaccgaccacgtctttaaaccgaaccgacgacgacgcgcgataactctttttcctctccgaaacaaacgcgaatacaaacgcgaactaaaaaccgcaaccccgaaccgaaaactcgaccgccgacgcctccatcgcgacctccctcgacctcaacgaactacgcgcataacccaaacccgcccgacctcgacgtccctaaaaaaaaacccgacgcgactccgaccgctaaaactacgactactctcgacccacctcgaccccgacaccgcgtccccgtcccaaaccccgccgcgcgatctctccgctactctaaactcgaaaaatacgacccgaccgcctccaaacgccccgactccgactacgactccgcccgacgcccgccccctcgacctcgccgcgcccccgaaacgcgcccgaacccccgccgcccgcacgccgatcgctccctcgaactccgaatccgactacgacccgaaccccgactccgcccgacgcaacccgccccccgcgcaaccccgccaactccccgccccgccgcctcgactcgaaacgcgcgattccgcgaacaaaaancgnacgcgcgannaacgacaaaaaaanacgcaaacaaaaaacgaaaaaaaaatctacgaaacaacaacgaccccttcgaaaatcaaactaacgcgaacaaccgcgacccgaactccctcctcctccgctccgccgcctcctcccctacccgctcgaaaaaaacacccgacgaaaacgcccctacgcccgacgtccgaacaaaacctacgaaaacgacgaaaaccgaaactcccgaaccgaaaccgaacgaacctcaattcgcaaaaacccgcatccatacacgcccaacgcctcgcccctcgccccgtaccgaacgtacgcgaactccgcccccttaaccgacatcgccgaaaccgcgatcccatcgcacaaatacgtaaactaaaacctaaaatacacgcgccaaactcacgatctaaacgacgccgataaaacccaaaactcacacctcccgaacgcgctcgaactccccctacctcgacttccctctcctaacataaaaaccgtaaaaccctatatac

SEQ ID NO: 28985 - DNA, 716 bp, Artificial Sequence
  chemically treated genomic DNA (Homo sapiens) CpG-island No: 28985
gaggagtattgcgattgtttgtatcgtggtcgtttttttttatcgacgatgagtagtattgcgattgtttggatcgtgggagtttttttttatcgacgatgaggagtattgcgatcgtttgtatcgtggtcgtttttttttatcgacgacgaggagtattgcgattgtttgtatcgtggtcgtttttttttattgacgacgaggagtattgcgattgtttgtatcgtggtcgtttttttttatcgacggcgaggagtattgcgattgtttgtatcgtggtcgtttttttttattgacgacgaggagtattgcgattgtttgtatcgtggtcgtttttttttattaacgatgaggagtattgcgattgtttgtattatggtcgtttttttttatcgacgatgagtagtattgcgattgtttggatcgtgggagtttttttttatcgacgacgaggagtattgcgattgtttgtatcgtggtcgtttttttttattgacgacgaggagtattgcgattgtttgtattatggtcgtttttttttatcgacgacgaggagtattgcgatcgtttgtatcgtggttatttttttttatcgacgatgaggagtatcgagattgtttgtatcgtggtcgtttttttttatcgatgacgaggagtattgcgattgtttgtattttggttgtttttttttatcgatgttgaggagtattgagatt

SEQ ID NO: 28986 - DNA, 716 bp, Artificial Sequence
  chemically treated genomic DNA (Homo sapiens) CpG-island No: 28986
aatctcaatactcctcaacatcgataaaaaaaaacaaccaaaatacaaacaatcgcaatactcctcgtcatcgataaaaaaaaacgaccacgatacaaacaatctcgatactcctcatcgtcgataaaaaaaaataaccacgatacaaacgatcgcaatactcctcgtcgtcgataaaaaaaaacgaccataatacaaacaatcgcaatactcctcgtcgtcaataaaaaaaaacgaccacgatacaaacaatcgcaatactcctcgtcgtcgataaaaaaaaactcccacgatccaaacaatcgcaatactactcatcgtcgataaaaaaaaacgaccataatacaaacaatcgcaatactcctcatcgttaataaaaaaaaacgaccacgatacaaacaatcgcaatactcctcgtcgtcaataaaaaaaaacgaccacgatacaaacaatcgcaatactcctcgccgtcgataaaaaaaaacgaccacgatacaaacaatcgcaatactcctcgtcgtcaataaaaaaaaacgaccacgatacaaacaatcgcaatactcctcgtcgtcgataaaaaaaaacgaccacgatacaaacgatcgcaatactcctcatcgtcgataaaaaaaaactcccacgatccaaacaatcgcaatactactcatcgtcgataaaaaaaaacgaccacgatacaaacaatcgcaatactcctc

SEQ ID NO: 28987 - DNA, 716 bp, Artificial Sequence
  chemically treated genomic DNA (Homo sapiens) CpG-island No: 28987
agttttagtgttttttagtatcggtgagaaggggtagttagggtgtagatagtcgtagtgtttttcgttatcggtgagaaggggcggttacggtgtagatagtttcggtgttttttatcgtcggtgagaaggggtggttacggtgtagacggtcgtagtgtttttcgtcgtcggtgagaaggggcggttatggtgtagatagtcgtagtgtttttcgtcgttagtgagaaggggcggttacggtgtagatagtcgtagtgtttttcgtcgtcggtgagaaggggtttttacgatttagatagtcgtagtgttatttatcgtcggtgagaaggggcggttatggtgtagatagtcgtagtgttttttatcgttggtgagaaggggcggttacggtgtagatagtcgtagtgtttttcgtcgttagtgagaaggggcggttacggtgtagatagtcgtagtgtttttcgtcgtcggtgagaaggggcggttacggtgtagatagtcgtagtgtttttcgtcgttagtgagaaggggcggttacggtgtagatagtcgtagtgtttttcgtcgtcggtgagaaggggcggttacggtgtagacggtcgtagtgttttttatcgtcggtgagaaggggtttttacgatttagatagtcgtagtgttatttatcgtcggtgagaaggggcggttacggtgtagatagtcgtagtgtttttt

SEQ ID NO: 28988 - DNA, 716 bp, Artificial Sequence
  chemically treated genomic DNA (Homo sapiens) CpG-island No: 28988
aaaaaacactacgactatctacaccgtaaccgccccttctcaccgacgataaataacactacgactatctaaatcgtaaaaaccccttctcaccgacgataaaaaacactacgaccgtctacaccgtaaccgccccttctcaccgacgacgaaaaacactacgactatctacaccgtaaccgccccttctcactaacgacgaaaaacactacgactatctacaccgtaaccgccccttctcaccgacgacgaaaaacactacgactatctacaccgtaaccgccccttctcactaacgacgaaaaacactacgactatctacaccgtaaccgccccttctcaccaacgataaaaaacactacgactatctacaccataaccgccccttctcaccgacgataaataacactacgactatctaaatcgtaaaaaccccttctcaccgacgacgaaaaacactacgactatctacaccgtaaccgccccttctcactaacgacgaaaaacactacgactatctacaccataaccgccccttctcaccgacgacgaaaaacactacgaccgtctacaccgtaaccaccccttctcaccgacgataaaaaacaccgaaactatctacaccgtaaccgccccttctcaccgataacgaaaaacactacgactatctacaccctaactaccccttctcaccgatactaaaaaacactaaaact

SEQ ID NO: 28989 - DNA, 545 bp, Artificial Sequence
  chemically treated genomic DNA (Homo sapiens) CpG-island No: 28989
tgcgattgtttgtatcgtggtcgtttcgattgatgatgaggaatattgcgatcgtttgtatcgtggtcgtttttttttattgatgttgaggagtattacgatcgtttgtattatggtcgtttttttttatcgatgaggagtattgcgattgtttgtatcgtggtcgtttttttttattaaagacgaggagtatcgcggttgtttgtattatggtcgttttttttttttaacgatgaggaatattgtgattgtttgtatcgtggtcgtttttttttattaacgatgaggagtattgcgatcgtttgtatcgtggtcgtttttttttattgacgatgaggagtattgcgatcgtttgtatcgtggtcgtttttttttattaacgatgaggagtattgcgattgtttgtatcgtggtcgtttttttttattaacgacgaggagtatcgcggttgtttgtattatggtcgttttttttttttaacgatgaggaatattgtgattgtttgtatcgtggtcgtttttttttattaacgatgaggagtattg

SEQ ID NO: 28990 - DNA, 545 bp, Artificial Sequence
  chemically treated genomic DNA (Homo sapiens) CpG-island No: 28990
caatactcctcatcgttaataaaaaaaaacgaccacgatacaaacaatcacaatattcctcatcgttaaaaaaaaaaaacgaccataatacaaacaaccgcgatactcctcgtcgttaataaaaaaaaacgaccacgatacaaacaatcgcaatactcctcatcgttaataaaaaaaaacgaccacgatacaaacgatcgcaatactcctcatcgtcaataaaaaaaaacgaccacgatacaaacgatcgcaatactcctcatcgttaataaaaaaaaacgaccacgatacaaacaatcacaatattcctcatcgttaaaaaaaaaaaacgaccataatacaaacaaccgcgatactcctcgtctttaataaaaaaaaacgaccacgatacaaacaatcgcaatactcctcatcgataaaaaaaaacgaccataatacaaacgatcgtaatactcctcaacatcaataaaaaaaaacgaccacgatacaaacgatcgcaatattcctcatcatcaatcgaaacgaccacgatacaaacaatcgca

SEQ ID NO: 28991 - DNA, 545 bp, Artificial Sequence
  chemically treated genomic DNA (Homo sapiens) CpG-island No: 28991
taatgttttttatcgttggtgagaaggggcggttacggtgtagatagttataatgttttttatcgttggggagaaggggcggttatggtgtagatagtcgcgatgtttttcgtcgttggtgagaaggggcggttacggtgtagatagtcgtagtgttttttatcgttggtgagaaggggcggttacggtgtagacggtcgtagtgttttttatcgttagtgagaaggggcggttacggtgtagacggtcgtagtgttttttatcgttggtgagaaggggcggttacggtgtagatagttataatgttttttatcgttggggagaaggggcggttatggtgtagatagtcgcgatgtttttcgtttttggtgagaaggggcggttacggtgtagatagtcgtagtgttttttatcggtgagaaggggcggttatggtgtagacggtcgtagtgttttttagtattagtgagaaggggcggttacggtgtagacggtcgtaatgttttttattattagtcggggcggttacggtgtagatagtcgta

SEQ ID NO: 28992 - DNA, 545 bp, Artificial Sequence
  chemically treated genomic DNA (Homo sapiens) CpG-island No: 28992
tacgactatctacaccgtaaccgccccgactaataataaaaaacattacgaccgtctacaccgtaaccgccccttctcactaatactaaaaaacactacgaccgtctacaccataaccgccccttctcaccgataaaaaacactacgactatctacaccgtaaccgccccttctcaccaaaaacgaaaaacatcgcgactatctacaccataaccgccccttctccccaacgataaaaaacattataactatctacaccgtaaccgccccttctcaccaacgataaaaaacactacgaccgtctacaccgtaaccgccccttctcactaacgataaaaaacactacgaccgtctacaccgtaaccgccccttctcaccaacgataaaaaacactacgactatctacaccgtaaccgccccttctcaccaacgacgaaaaacatcgcgactatctacaccataaccgccccttctccccaacgataaaaaacattataactatctacaccgtaaccgccccttctcaccaacgataaaaaacatta

SEQ ID NO: 28993 - DNA, 936 bp, Artificial Sequence
  chemically treated genomic DNA (Homo sapiens) CpG-island No: 28993
tatatcgggtagacgtgcgtttaatattgggtagacgggtatttagttttattattgcgttatatatcgggtagacgtgtatttaatatcggttagacgggtatttagttttattattgcgttatatatcgggtagacgtgtatttaatatcggttagacgtgtatttagttttattattgtattatatatcgggtagacgtgtatttaatattgggtagacgggtatttagttttattattgtattatatatcgggtagacgtgcgtttaatattgggtagacgtgtatttagttttattattgtattatatatcgggtagacgtgtatttaatattgggtagacgtgtatttagttttattattgtattatatatcgggtagacgtgtatttaatattgggtagacgtgtatttagttttattattgcgttatatatcgggtagacgtgtatttaatattgggtagacgtgtatttagttttattattgtattatatatcgggtagacgtgtatttaatattgggtagacgggtatttagttttattattgcgttatatatcgggtagacgtgtatttaatattgggtagacgtgtatttagttttattattgcgttatatatcgggtagacgtgtatttaatattgggtagacgtgtatttagttttattattgcgttatatatcgggtagacgtgtatttaatattgggtagacgtgtatttagttttattattgtattatatatcgggtagacgtgtatttaatattgggtagacgtgtatttagttttattattgtattatatatcgggtagacgtgtatttaatattgggtagacgggtatttagttttattattgcgttatatatcgggtagacgtgcgtttagttttttgtgttatataatatgttattattggatgagagtttttt

SEQ ID NO: 28994 - DNA, 936 bp, Artificial Sequence
  chemically treated genomic DNA (Homo sapiens) CpG-island No: 28994
aaaaaactctcatccaataataacatattatataacacaaaaaactaaacgcacgtctacccgatatataacgcaataataaaactaaatacccgtctacccaatattaaatacacgtctacccgatatataatacaataataaaactaaatacacgtctacccaatattaaatacacgtctacccgatatataatacaataataaaactaaatacacgtctacccaatattaaatacacgtctacccgatatataacgcaataataaaactaaatacacgtctacccaatattaaatacacgtctacccgatatataacgcaataataaaactaaatacacgtctacccaatattaaatacacgtctacccgatatataacgcaataataaaactaaatacccgtctacccaatattaaatacacgtctacccgatatataatacaataataaaactaaatacacgtctacccaatattaaatacacgtctacccgatatataacgcaataataaaactaaatacacgtctacccaatattaaatacacgtctacccgatatataatacaataataaaactaaatacacgtctacccaatattaaatacacgtctacccgatatataatacaataataaaactaaatacacgtctacccaatattaaacgcacgtctacccgatatataatacaataataaaactaaatacccgtctacccaatattaaatacacgtctacccgatatataatacaataataaaactaaatacacgtctaaccgatattaaatacacgtctacccgatatataacgcaataataaaactaaatacccgtctaaccgatattaaatacacgtctacccgatatataacgcaataataaaactaaatacccgtctacccaatattaaacgcacgtctacccgatata

SEQ ID NO: 28995 - DNA, 936 bp, Artificial Sequence
  chemically treated genomic DNA (Homo sapiens) CpG-island No: 28995
gaaagatttttatttagtggtggtatgttgtgtgatataggaagttgaacgtacgtttgttcggtgtgtgacgtagtgatgaagttgaatgttcgtttatttagtgttgaatgtacgtttattcggtgtgtgatgtagtgatgaagttgaatgtacgtttatttagtgttgaatgtacgtttgttcggtgtgtgatgtagtgatgaagttgaatgtacgtttatttagtgttgaatgtacgtttattcggtgtgtgacgtagtgatgaagttgaatgtacgtttatttagtgttgaatgtacgtttgttcggtgtgtgacgtagtgatgaagttgaatgtacgtttatttagtgttgaatgtacgtttgttcggtgtgtgacgtagtgatgaagttgaatgttcgtttatttagtgttgaatgtacgtttgttcggtgtgtgatgtagtgatgaagttgaatgtacgtttatttagtgttgaatgtacgtttgttcggtgtgtgacgtagtgatgaagttgaatgtacgtttatttagtgttgaatgtacgtttattcggtgtgtgatgtagtgatgaagttgaatgtacgtttatttagtgttgaatgtacgtttattcggtgtgtgatgtagtgatgaagttgaatgtacgtttatttagtgttgaacgtacgtttgttcggtgtgtgatgtagtgatgaagttgaatgttcgtttatttagtgttgaatgtacgtttattcggtgtgtgatgtagtgatgaagttgaatgtacgtttaatcggtgttgaatgtacgtttgttcggtgtgtgacgtagtgatgaagttgaatgttcgtttaatcggtgttgaatgtacgtttgttcggtgtgtgacgtagtgatgaagttgaatgttcgtttatttagtgttgaacgtacgtttgttcggtgtg

SEQ ID NO: 28996 - DNA, 936 bp, Artificial Sequence
  chemically treated genomic DNA (Homo sapiens) CpG-island No: 28996
cacaccgaacaaacgtacgttcaacactaaataaacgaacattcaacttcatcactacgtcacacaccgaacaaacgtacattcaacaccgattaaacgaacattcaacttcatcactacgtcacacaccgaacaaacgtacattcaacaccgattaaacgtacattcaacttcatcactacatcacacaccgaataaacgtacattcaacactaaataaacgaacattcaacttcatcactacatcacacaccgaacaaacgtacgttcaacactaaataaacgtacattcaacttcatcactacatcacacaccgaataaacgtacattcaacactaaataaacgtacattcaacttcatcactacatcacacaccgaataaacgtacattcaacactaaataaacgtacattcaacttcatcactacgtcacacaccgaacaaacgtacattcaacactaaataaacgtacattcaacttcatcactacatcacacaccgaacaaacgtacattcaacactaaataaacgaacattcaacttcatcactacgtcacacaccgaacaaacgtacattcaacactaaataaacgtacattcaacttcatcactacgtcacacaccgaacaaacgtacattcaacactaaataaacgtacattcaacttcatcactacgtcacacaccgaataaacgtacattcaacactaaataaacgtacattcaacttcatcactacatcacacaccgaacaaacgtacattcaacactaaataaacgtacattcaacttcatcactacatcacacaccgaataaacgtacattcaacactaaataaacgaacattcaacttcatcactacgtcacacaccgaacaaacgtacgttcaacttcctatatcacacaacataccaccactaaataaaaatctttc

SEQ ID NO: 28997 - DNA, 539 bp, Artificial Sequence
  chemically treated genomic DNA (Homo sapiens) CpG-island No: 28997
gggcgcgatattaattaagggagggcgcgagattaattaagggagggcgcgagattaattaagggagggcgcgagattaattaagggagggcgcgagattaattaagggagggcgcgagattaattaagggagggcgcgagattaattaagggagggcgcgagattaattaagggagggcgcgagattaattaagggagggcgcgatattaagggagggcgcgatattaattaagggagggcgcgatattaattaagggagggcgcgatattaattaagggagggcgcgatattaattaagggagggcgcgatattaattaagggagggcgcgatattaattaagggagggcgcgatattaattaagggagggcgcgagattaattaagggagggcgcgatattaattaagtgagggttcgatattaattaagggagggcgcgatattaattaagggagggcgcgagattaattaaggtcgggggcgagattaattaaaggagggggtgagattaattaaggtcgggggcgagattaat

SEQ ID NO: 28998 - DNA, 539 bp, Artificial Sequence
  chemically treated genomic DNA (Homo sapiens) CpG-island No: 28998
attaatctcgcccccgaccttaattaatctcaccccctcctttaattaatctcgcccccgaccttaattaatctcgcgccctcccttaattaatatcgcgccctcccttaattaatatcgaaccctcacttaattaatatcgcgccctcccttaattaatctcgcgccctcccttaattaatatcgcgccctcccttaattaatatcgcgccctcccttaattaatatcgcgccctcccttaattaatatcgcgccctcccttaattaatatcgcgccctcccttaattaatatcgcgccctcccttaattaatatcgcgccctcccttaatatcgcgccctcccttaattaatctcgcgccctcccttaattaatctcgcgccctcccttaattaatctcgcgccctcccttaattaatctcgcgccctcccttaattaatctcgcgccctcccttaattaatctcgcgccctcccttaattaatctcgcgccctcccttaattaatctcgcgccctcccttaattaatatcgcgccc

SEQ ID NO: 28999 - DNA, 539 bp, Artificial Sequence
  chemically treated genomic DNA (Homo sapiens) CpG-island No: 28999
gttggtttcgttttcggttttggttggttttatttttttttttggttggtttcgttttcggttttggttggtttcgcgtttttttttggttggtgtcgcgtttttttttggttggtgtcgagtttttatttggttggtgtcgcgtttttttttggttggtttcgcgtttttttttggttggtgtcgcgtttttttttggttggtgtcgcgtttttttttggttggtgtcgcgtttttttttggttggtgtcgcgtttttttttggttggtgtcgcgtttttttttggttggtgtcgcgtttttttttggttggtgtcgcgtttttttttggtgtcgcgtttttttttggttggtttcgcgtttttttttggttggtttcgcgtttttttttggttggtttcgcgtttttttttggttggtttcgcgtttttttttggttggtttcgcgtttttttttggttggtttcgcgtttttttttggttggtttcgcgtttttttttggttggtttcgcgtttttttttggttggtgtcgcgttt

SEQ ID NO: 29000 - DNA, 539 bp, Artificial Sequence
  chemically treated genomic DNA (Homo sapiens) CpG-island No: 29000
aaacgcgacaccaaccaaaaaaaaacgcgaaaccaaccaaaaaaaaacgcgaaaccaaccaaaaaaaaacgcgaaaccaaccaaaaaaaaacgcgaaaccaaccaaaaaaaaacgcgaaaccaaccaaaaaaaaacgcgaaaccaaccaaaaaaaaacgcgaaaccaaccaaaaaaaaacgcgaaaccaaccaaaaaaaaacgcgacaccaaaaaaaaacgcgacaccaaccaaaaaaaaacgcgacaccaaccaaaaaaaaacgcgacaccaaccaaaaaaaaacgcgacaccaaccaaaaaaaaacgcgacaccaaccaaaaaaaaacgcgacaccaaccaaaaaaaaacgcgacaccaaccaaaaaaaaacgcgaaaccaaccaaaaaaaaacgcgacaccaaccaaataaaaactcgacaccaaccaaaaaaaaacgcgacaccaaccaaaaaaaaacgcgaaaccaaccaaaaccgaaaacgaaaccaaccaaaaaaaaaaataaaaccaaccaaaaccgaaaacgaaaccaac

SEQ ID NO: 29001 - DNA, 1661 bp, Artificial Sequence
  chemically treated genomic DNA (Homo sapiens) CpG-island No: 29001
gagtattgcgatcgtttgtatcgtggtcgtttttttttatcgattacgaggagtattgcgatcgtttgtatcgtggtcgtttttttttatcgacgacgaggagtattgcgatcgtttgtatcgtggtcgtttttttttatcgacgacgaggagtattgcgatcgtttgtatcgtggtcgtttttttttatcgacgacgaggagtattgcgatcgtttgtatcgtggtcgtttttttttatcgattacgaggagtattgcgatcgtttgtatcgtggtcgtttttttttatcgattacgaggagtattgcgatcgtttgtatcgtggtcgtttttttttatcgattacgaggagtattgcgatcgtttgtatcgtggtcgtttttttttatcgacgacgaggagtattgcgatcgtttgtatcgtggtcgtttttttttatcgacgacgaggagtattgcgatcgtttgtatcgtggtcgtttttttttatcgacgacgaggagtattgcgatcgtttgtatcgtggtcgtttttttttatcgattacgaggagtattgcgatcgtttgtatcgtggtcgtttttttttatcgacgacgaggagtattgcgatcgtcggtatcgtggtcgtttttttttatcgacgacgaggagtattgcgatcgtttgtatcgtggtcgtttttttttatcgacgacgaggagtattgcgattttttgtatcgtggtcgtttttttttatcgacgacgaggagtattgcgatcgtttgtatcgtggtcgttttttttttatcgacgacgaggagtattgcgatcgtttgtatcgtggtcgtttttttttatcgattacgaggagtattgcgatcgtttgtatcgtggtcgtttttttttatcgacgacgaggagtattgcgatcgtttgtatcgtggtcgtttttttttatcgattacgaggagtattgcgatcgtttgtatcgtggtcgtttttttttatcgattacgaggagtattgcgatcgtttgtatcgtggtcgtttttttttatcgacgacgaggagtattgcgatcgtttgtatcgtggtcgtttttttttatcgattacgaggagtattgcgatcgtttgtatcgtggtcgtttttttttattgacgatgaggagtattgcgattgtatgtatcgtggtcgtttttttttatcgacgacgaggagtattgcgatcgtttgtatcgtggtcgtttttttttattgacgatgaggagtattgcgatcgtttgtatcgtggtcgtttttttttatcgacgacgaggagtattgcgattgtttgtatcgtggtcgtttttttttatcgacgacgaggagtattgcgatcgtttgtatcgtggtcgtttttttttattgacgatgaggagtattgcgattgtatgtatcgtggtcgtttttttttattaacgatgaggagtattgcgattgtttgtatcgtggtcgtttttttttatcgacgatgaggagtattgcgattgtatgtatcgtggtcgtttttttttatcgacgacgaggagtattgcgatcgtttgtatcgtggtcgtttttttttattaacgatgaggagtatcgcggttgtttgtattatgggagtttttttttattgataatgaggagtatttag

SEQ ID NO: 29002 - DNA, 1661 bp, Artificial Sequence
  chemically treated genomic DNA (Homo sapiens) CpG-island No: 29002
ctaaatactcctcattatcaataaaaaaaaactcccataatacaaacaaccgcgatactcctcatcgttaataaaaaaaaacgaccacgatacaaacgatcgcaatactcctcgtcgtcgataaaaaaaaacgaccacgatacatacaatcgcaatactcctcatcgtcgataaaaaaaaacgaccacgatacaaacaatcgcaatactcctcatcgttaataaaaaaaaacgaccacgatacatacaatcgcaatactcctcatcgtcaataaaaaaaaacgaccacgatacaaacgatcgcaatactcctcgtcgtcgataaaaaaaaacgaccacgatacaaacaatcgcaatactcctcgtcgtcgataaaaaaaaacgaccacgatacaaacgatcgcaatactcctcatcgtcaataaaaaaaaacgaccacgatacaaacgatcgcaatactcctcgtcgtcgataaaaaaaaacgaccacgatacatacaatcgcaatactcctcatcgtcaataaaaaaaaacgaccacgatacaaacgatcgcaatactcctcgtaatcgataaaaaaaaacgaccacgatacaaacgatcgcaatactcctcgtcgtcgataaaaaaaaacgaccacgatacaaacgatcgcaatactcctcgtaatcgataaaaaaaaacgaccacgatacaaacgatcgcaatactcctcgtaatcgataaaaaaaaacgaccacgatacaaacgatcgcaatactcctcgtcgtcgataaaaaaaaacgaccacgatacaaacgatcgcaatactcctcgtaatcgataaaaaaaaacgaccacgatacaaacgatcgcaatactcctcgtcgtcgataaaaaaaaaacgaccacgatacaaacgatcgcaatactcctcgtcgtcgataaaaaaaaacgaccacgatacaaaaaatcgcaatactcctcgtcgtcgataaaaaaaaacgaccacgatacaaacgatcgcaatactcctcgtcgtcgataaaaaaaaacgaccacgataccgacgatcgcaatactcctcgtcgtcgataaaaaaaaacgaccacgatacaaacgatcgcaatactcctcgtaatcgataaaaaaaaacgaccacgatacaaacgatcgcaatactcctcgtcgtcgataaaaaaaaacgaccacgatacaaacgatcgcaatactcctcgtcgtcgataaaaaaaaacgaccacgatacaaacgatcgcaatactcctcgtcgtcgataaaaaaaaacgaccacgatacaaacgatcgcaatactcctcgtaatcgataaaaaaaaacgaccacgatacaaacgatcgcaatactcctcgtaatcgataaaaaaaaacgaccacgatacaaacgatcgcaatactcctcgtaatcgataaaaaaaaacgaccacgatacaaacgatcgcaatactcctcgtcgtcgataaaaaaaaacgaccacgatacaaacgatcgcaatactcctcgtcgtcgataaaaaaaaacgaccacgatacaaacgatcgcaatactcctcgtcgtcgataaaaaaaaacgaccacgatacaaacgatcgcaatactcctcgtaatcgataaaaaaaaacgaccacgatacaaacgatcgcaatactc

SEQ ID NO: 29003 - DNA, 1661 bp, Artificial Sequence
  chemically treated genomic DNA (Homo sapiens) CpG-island No: 29003
ttgaatgttttttattgttagtgagaaggggtttttatggtgtagatagtcgcgatgttttttatcgttggtgagaaggggcggttacggtgtagacggtcgtagtgtttttcgtcgtcggtgagaaggggcggttacggtgtatatagtcgtaatgttttttatcgtcggtgagaaggggcggttacggtgtagatagtcgtagtgttttttatcgttggtgagaaggggcggttacggtgtatatagtcgtaatgttttttatcgttagtgagaaggggcggttacggtgtagacggtcgtagtgtttttcgtcgtcggtgagaaggggcggttacggtgtagatagtcgtagtgtttttcgtcgtcggtgagaaggggcggttacggtgtagacggtcgtagtgttttttatcgttagtgagaaggggcggttacggtgtagacggtcgtagtgtttttcgtcgtcggtgagaaggggcggttacggtgtatatagtcgtaatgttttttatcgttagtgagaaggggcggttacggtgtagacggtcgtagtgtttttcgtggtcggtgagaaggggcggttacggtgtagacggtcgtagtgtttttcgtcgtcggtgagagggggcggttacggtgtagacggtcgtagtgtttttcgtggtcggtgagagggggcggttacggtgtagacggtcgtagtgtttttcgtggtcggtgagaaggggcggttacggtgtagacggtcgtagtgtttttcgtcgtcggtgagagggggcggttacggtgtagacggtcgtagtgtttttcgtggtcggtgagagggggcggttacggtgtagacggtcgtagtgtttttcgtcgtcggtgagagaggggcggttacggtgtagacggtcgtagtgtttttcgtcgtcggtgagagggggcggttacggtgtagagggtcgtagtgtttttcgtcgtcggtgagagggggcggttacggtgtagacggtcgtagtgtttttcgtcgtcggtgagagggggcggttacggtgtcgacggtcgtagtgtttttcgtcgtcggtgagagggggcggttacggtgtagacggtcgtagtgtttttcgtggtcggtgagagggggcggttacggtgtagacggtcgtagtgtttttcgtcgtcggtgagagggggcggttacggtgtagacggtcgtagtgtttttcgtcgtcggtgagagggggcggttacggtgtagacggtcgtagtgtttttcgtcgtcggtgagagggggcggttacggtgtagacggtcgtagtgtttttcgtggtcggtgagagggggcggttacggtgtagacggtcgtagtgtttttcgtggtcggtgagaaggggcggttacggtgtagacggtcgtagtgtttttcgtggtcggtgagagggggcggttacggtgtagacggtcgtagtgtttttcgtcgtcggtgagagggggcggttacggtgtagacggtcgtagtgtttttcgtcgtcggtgagagggggcggttacggtgtagacggtcgtagtgtttttcgtcgtcggtgagagggggcggttacggtgtagacggtcgtagtgtttttcgtggtcggtgagagggggcggttacggtgtagacggtcgtagtgttt

SEQ ID NO: 29004 - DNA, 1661 bp, Artificial Sequence
  chemically treated genomic DNA (Homo sapiens) CpG-island No: 29004
aaacactacgaccgtctacaccgtaaccgccccctctcaccgaccacgaaaaacactacgaccgtctacaccgtaaccgccccctctcaccgacgacgaaaaacactacgaccgtctacaccgtaaccgccccctctcaccgacgacgaaaaacactacgaccgtctacaccgtaaccgccccctctcaccgacgacgaaaaacactacgaccgtctacaccgtaaccgccccctctcaccgaccacgaaaaacactacgaccgtctacaccgtaaccgccccttctcaccgaccacgaaaaacactacgaccgtctacaccgtaaccgccccctctcaccgaccacgaaaaacactacgaccgtctacaccgtaaccgccccctctcaccgacgacgaaaaacactacgaccgtctacaccgtaaccgccccctctcaccgacgacgaaaaacactacgaccgtctacaccgtaaccgccccctctcaccgacgacgaaaaacactacgaccgtctacaccgtaaccgccccctctcaccgaccacgaaaaacactacgaccgtctacaccgtaaccgccccctctcaccgacgacgaaaaacactacgaccgtcgacaccgtaaccgccccctctcaccgacgacgaaaaacactacgaccgtctacaccgtaaccgccccctctcaccgacgacgaaaaacactacgaccctctacaccgtaaccgccccctctcaccgacgacgaaaaacactacgaccgtctacaccgtaaccgcccctctctcaccgacgacgaaaaacactacgaccgtctacaccgtaaccgccccctctcaccgaccacgaaaaacactacgaccgtctacaccgtaaccgccccctctcaccgacgacgaaaaacactacgaccgtctacaccgtaaccgccccttctcaccgaccacgaaaaacactacgaccgtctacaccgtaaccgccccctctcaccgaccacgaaaaacactacgaccgtctacaccgtaaccgccccctctcaccgacgacgaaaaacactacgaccgtctacaccgtaaccgccccttctcaccgaccacgaaaaacactacgaccgtctacaccgtaaccgccccttctcactaacgataaaaaacattacgactatatacaccgtaaccgccccttctcaccgacgacgaaaaacactacgaccgtctacaccgtaaccgccccttctcactaacgataaaaaacactacgaccgtctacaccgtaaccgccccttctcaccgacgacgaaaaacactacgactatctacaccgtaaccgccccttctcaccgacgacgaaaaacactacgaccgtctacaccgtaaccgccccttctcactaacgataaaaaacattacgactatatacaccgtaaccgccccttctcaccaacgataaaaaacactacgactatctacaccgtaaccgccccttctcaccgacgataaaaaacattacgactatatacaccgtaaccgccccttctcaccgacgacgaaaaacactacgaccgtctacaccgtaaccgccccttctcaccaacgataaaaaacatcgcgactatctacaccataaaaaccccttctcactaacaataaaaaacattcaa

SEQ ID NO: 29005 - DNA, 847 bp, Artificial Sequence
  chemically treated genomic DNA (Homo sapiens) CpG-island No: 29005
ttgtatcgtggtcgtttttttttatcgatgacgaggagtattgcgatcgtttgtatcgtggtcgtttttttttatcgacgacgaagagtattgcgatcgtttgtattatggtcgtttttttttattgacgacgaggagtattgcgattgtttgtatcgtggtcgtttttttttatcgacgacgaggagtattgcgattgtttgtatcgtggtcgtttttttttatcgacgatgaggagtattgcgattgtttgtattatggtcgtttttttttatcgacgatgagtagtattgcgattgtttggatcgtgggagtttttttttatcgacgatgaggagtattgcgatcgtttgtatcgtggtcgtttttttttatcgacgacgaggagtattgcgattgtttgtatcgtggtcgtttttttttattgacgacgaggagtattgcgattgtttgtatcgtggtcgtttttttttattaacgatgaggagtattgcgattgtttgtattatggtcgtttttttttatcgacgatgagttgtattgcgattgtttggatcgtgggagtttttttttatcgacgacgaggagtattgcgattgtttgtatcgtggtcgtttttttttatcgacgacgaggagtattgcgattatttgtatcgtggtcgtttttttttatcgacgacgaggagtattgcgattgtttgtatcgtggtcgtttttttttattgacgatgaggagtattgcgattgtttgtatcgtggtcgttttttttgattgatgataaggaatattgcgattgtttgtatcgtggttgtttttttttattaacgttgaggagtattgtaat

SEQ ID NO: 29006 - DNA, 847 bp, Artificial Sequence
  chemically treated genomic DNA (Homo sapiens) CpG-island No: 29006
attacaatactcctcaacgttaataaaaaaaaacaaccacgatacaaacaatcgcaatattccttatcatcaatcaaaaaaaacgaccacgatacaaacaatcgcaatactcctcatcgtcaataaaaaaaaacgaccacgatacaaacaatcgcaatactcctcgtcgtcgataaaaaaaaacgaccacgatacaaataatcgcaatactcctcgtcgtcgataaaaaaaaacgaccacgatacaaacaatcgcaatactcctcgtcgtcgataaaaaaaaactcccacgatccaaacaatcgcaatacaactcatcgtcgataaaaaaaaacgaccataatacaaacaatcgcaatactcctcatcgttaataaaaaaaaacgaccacgatacaaacaatcgcaatactcctcgtcgtcaataaaaaaaaacgaccacgatacaaacaatcgcaatactcctcgtcgtcgataaaaaaaaacgaccacgatacaaacgatcgcaatactcctcatcgtcgataaaaaaaaactcccacgatccaaacaatcgcaatactactcatcgtcgataaaaaaaaacgaccataatacaaacaatcgcaatactcctcatcgtcgataaaaaaaaacgaccacgatacaaacaatcgcaatactcctcgtcgtcgataaaaaaaaacgaccacgatacaaacaatcgcaatactcctcgtcgtcaataaaaaaaaacgaccataatacaaacgatcgcaatactcttcgtcgtcgataaaaaaaaacgaccacgatacaaacgatcgcaatactcctcgtcatcgataaaaaaaaacgaccacgatacaa

SEQ ID NO: 29007 - DNA, 847 bp, Artificial Sequence
  chemically treated genomic DNA (Homo sapiens) CpG-island No: 29007
gttgtagtgttttttagcgttggtgagaaggggtagttacggtgtagatagtcgtaatgttttttattattagttagaaagggcggttacggtgtagatagtcgtagtgttttttatcgttagtgagaaggggcggttacggtgtagatagtcgtagtgtttttcgtcgtcggtgagagggggcggttacggtgtagatggtcgtagtgtttttcgtcgtcggtgagagggggcggttacggtgtagatagtcgtagtgtttttcgtcgtcggtgagaaggggtttttacgatttagatagtcgtagtgtaatttatcgtcggtgagaaggggcggttatggtgtagatagtcgtagtgttttttatcgttggtgagaaggggcggttacggtgtagatagtcgtagtgtttttcgtcgttagtgagaaggggcggttacggtgtagatagtcgtagtgtttttcgtcgtcggtgagaaggggcggttacggtgtagacggtcgtagtgttttttatcgtcggtgagaaggggtttttacgatttagatagtcgtagtgttatttatcgtcggtgagaaggggcggttatggtgtagatagtcgtagtgttttttatcgtcggtgagaaggggcggttacggtgtagatagtcgtagtgtttttcgtcgtcggtgagaaggggcggttacggtgtagatagtcgtagtgtttttcgtcgttagtgagaaggggcggttatggtgtagacggtcgtagtgtttttcgtcgtcggtgagaaggggcggttacggtgtagacggtcgtagtgtttttcgttatcggtgagaaggggcggttacggtgtag

SEQ ID NO: 29008 - DNA, 847 bp, Artificial Sequence
  chemically treated genomic DNA (Homo sapiens) CpG-island No: 29008
ctacaccgtaaccgccccttctcaccgataacgaaaaacactacgaccgtctacaccgtaaccgccccttctcaccgacgacgaaaaacactacgaccgtctacaccataaccgccccttctcactaacgacgaaaaacactacgactatctacaccgtaaccgccccttctcaccgacgacgaaaaacactacgactatctacaccgtaaccgccccttctcaccgacgataaaaaacactacgactatctacaccataaccgccccttctcaccgacgataaataacactacgactatctaaatcgtaaaaaccccttctcaccgacgataaaaaacactacgaccgtctacaccgtaaccgccccttctcaccgacgacgaaaaacactacgactatctacaccgtaaccgccccttctcactaacgacgaaaaacactacgactatctacaccgtaaccgccccttctcaccaacgataaaaaacactacgactatctacaccataaccgccccttctcaccgacgataaattacactacgactatctaaatcgtaaaaaccccttctcaccgacgacgaaaaacactacgactatctacaccgtaaccgccccctctcaccgacgacgaaaaacactacgaccatctacaccgtaaccgccccctctcaccgacgacgaaaaacactacgactatctacaccgtaaccgccccttctcactaacgataaaaaacactacgactatctacaccgtaaccgccctttctaactaataataaaaaacattacgactatctacaccgtaactaccccttctcaccaacgctaaaaaacactacaac

SEQ ID NO: 29009 - DNA, 527 bp, Artificial Sequence
  chemically treated genomic DNA (Homo sapiens) CpG-island No: 29009
atagcggcgcgagataggggtagaacgatgaggcgtcggagttagttcgtcggtgcgggtgcgggtgcgcggcgcgtcgcggtttttttttcgcgacgcgtcgggtggttacgtgacggtcgcgcgcgttttcggtagttgcgggtttcgaggttagagagaaaagattgcgaggtggtcgtagttgtggtcggagaggtgggagtcggagcgaggttttttcgggggagtagggtgaacgtcggttattttaggatttttattcggggagaggaggtatagttcgcggtgttatttttagtcgtaacgtatttcgggtcggttttgcgttcggggtttgagaggggcggcggcggggttaggggtcggtacgtagatggacgtttttgggttggcgcggtttcggttgttcgcgtagaggcgggatgggatagtttagtttttttcgttattttcgttttggttgttggggtaggtaagacgatcgtgatagtttttgcgttgttcgagggcgtcgtagtttttgt

SEQ ID NO: 29010 - DNA, 527 bp, Artificial Sequence
  chemically treated genomic DNA (Homo sapiens) CpG-island No: 29010
acaaaaactacgacgccctcgaacaacgcaaaaactatcacgatcgtcttacctaccccaacaaccaaaacgaaaataacgaaaaaaactaaactatcccatcccgcctctacgcgaacaaccgaaaccgcgccaacccaaaaacgtccatctacgtaccgacccctaaccccgccgccgcccctctcaaaccccgaacgcaaaaccgacccgaaatacgttacgactaaaaataacaccgcgaactatacctcctctccccgaataaaaatcctaaaataaccgacgttcaccctactcccccgaaaaaacctcgctccgactcccacctctccgaccacaactacgaccacctcgcaatcttttctctctaacctcgaaacccgcaactaccgaaaacgcgcgcgaccgtcacgtaaccacccgacgcgtcgcgaaaaaaaaaccgcgacgcgccgcgcacccgcacccgcaccgacgaactaactccgacgcctcatcgttctacccctatctcgcgccgctat

SEQ ID NO: 29011 - DNA, 527 bp, Artificial Sequence
  chemically treated genomic DNA (Homo sapiens) CpG-island No: 29011
gtaggggttgcggcgttttcgggtagcgtaggggttgttacggtcgttttgtttgttttagtagttaaggcgggggtggcggaaagggttgaattgttttatttcgtttttgcgcggatagtcggggtcgcgttagtttaagggcgtttatttacgtatcggtttttgatttcgtcgtcgttttttttaggtttcgagcgtaaggtcgattcggagtacgttgcggttggaggtgatatcgcgagttatgtttttttttttcgagtgaggattttagagtggtcggcgtttattttgttttttcgagagggtttcgtttcgatttttattttttcggttatagttgcggttatttcgtagttttttttttttggtttcggagttcgtagttgtcgggaacgcgcgcggtcgttacgtgattattcggcgcgtcgcggaggaggggtcgcgacgcgtcgcgtattcgtattcgtatcggcgagttaatttcggcgttttatcgttttgtttttgtttcgcgtcgttgt

SEQ ID NO: 29012 - DNA, 527 bp, Artificial Sequence
  chemically treated genomic DNA (Homo sapiens) CpG-island No: 29012
acaacgacgcgaaacaaaaacaaaacgataaaacgccgaaattaactcgccgatacgaatacgaatacgcgacgcgtcgcgacccctcctccgcgacgcgccgaataatcacgtaacgaccgcgcgcgttcccgacaactacgaactccgaaaccaaaaaaaaaaaactacgaaataaccgcaactataaccgaaaaaataaaaatcgaaacgaaaccctctcgaaaaaacaaaataaacgccgaccactctaaaatcctcactcgaaaaaaaaaaacataactcgcgatatcacctccaaccgcaacgtactccgaatcgaccttacgctcgaaacctaaaaaaaacgacgacgaaatcaaaaaccgatacgtaaataaacgcccttaaactaacgcgaccccgactatccgcgcaaaaacgaaataaaacaattcaaccctttccgccacccccgccttaactactaaaacaaacaaaacgaccgtaacaacccctacgctacccgaaaacgccgcaacccctac

SEQ ID NO: 29013 - DNA, 604 bp, Artificial Sequence
  chemically treated genomic DNA (Homo sapiens) CpG-island No: 29013
ttttcgtttttttttttcggtcggcgtatagtcggttcgtggcgttcggtatcgcgtttttacgtttagcgcggggtaggtttgcgcggcgtttgtaagggataagtcgcggagtcggggaggttcgtcgtttgggatacgtttggagaagcgagcggtatagtttattttacggcgatattttaggatttttttattgataatattaaattgaagcgttaagattaatttttacgattatttatcgtcgtaggttacggtggtgattttttttttcgtttttttatatacgttttttcgttttgcgtgtttttgttttcgtttttttcgggattatcgtgcgtttttgtttttcgtttttgtaggtttttttttttttttcgcgtttttttttttattattttacgtttttttttttttttttcgggaattttatttcgtttttttgtcggttttcgtgatttcggaaatttcgtttttgtcgcgaggcgtttttcgtttcgcgttttttcgtgttacgagggagttagggtgggcggttttttattgtatttggtttttgaattttcgtttttgtagtataaaggtagggttgggaaaggag

SEQ ID NO: 29014 - DNA, 604 bp, Artificial Sequence
  chemically treated genomic DNA (Homo sapiens) CpG-island No: 29014
ctcctttcccaaccctacctttatactacaaaaacgaaaattcaaaaaccaaatacaataaaaaaccgcccaccctaactccctcgtaacacgaaaaaacgcgaaacgaaaaacgcctcgcgacaaaaacgaaatttccgaaatcacgaaaaccgacaaaaaaacgaaataaaattcccgaaaaaaaaaaaaaaaaacgtaaaataataaaaaaaaaaacgcgaaaaaaaaaaaaaaacctacaaaaacgaaaaacaaaaacgcacgataatcccgaaaaaaacgaaaacaaaaacacgcaaaacgaaaaaacgtatataaaaaaacgaaaaaaaaaatcaccaccgtaacctacgacgataaataatcgtaaaaattaatcttaacgcttcaatttaatattatcaataaaaaaatcctaaaatatcgccgtaaaataaactataccgctcgcttctccaaacgtatcccaaacgacgaacctccccgactccgcgacttatcccttacaaacgccgcgcaaacctaccccgcgctaaacgtaaaaacgcgataccgaacgccacgaaccgactatacgccgaccgaaaaaaaaaaacgaaaa

SEQ ID NO: 29015 - DNA, 604 bp, Artificial Sequence
  chemically treated genomic DNA (Homo sapiens) CpG-island No: 29015
ttttttttttagttttatttttgtgttgtaaaagcgaaaatttaaaagttaagtataataggagatcgtttattttggttttttcgtgatacgagggagcgcgaagcggagggcgtttcgcggtaggagcgggattttcggggttacgggaatcggtaggggaacgggataaagttttcggagaaaggaaaggagagcgtgggatagtaaaagagaagacgcggagaagaggagaggatttataagaacggaggataggggcgtacgatggtttcggggggagcggaaataaaggtacgtaaaacggaaaagcgtgtgtaggggagcggaaaaggaagttattatcgtggtttgcgacggtaagtggtcgtaagggttggttttagcgttttagtttagtgttgttagtgggagaattttaaaatgtcgtcgtggaatggattgtatcgttcgtttttttaaacgtgttttagacggcgagttttttcggtttcgcggtttgttttttgtaagcgtcgcgtaggtttgtttcgcgttggacgtggagacgcggtgtcgagcgttacgggtcggttgtgcgtcggtcggggaaagagggcgaggg

SEQ ID NO: 29016 - DNA, 604 bp, Artificial Sequence
  chemically treated genomic DNA (Homo sapiens) CpG-island No: 29016
ccctcgccctctttccccgaccgacgcacaaccgacccgtaacgctcgacaccgcgtctccacgtccaacgcgaaacaaacctacgcgacgcttacaaaaaacaaaccgcgaaaccgaaaaaactcgccgtctaaaacacgtttaaaaaaacgaacgatacaatccattccacgacgacattttaaaattctcccactaacaacactaaactaaaacgctaaaaccaacccttacgaccacttaccgtcgcaaaccacgataataacttccttttccgctcccctacacacgcttttccgttttacgtacctttatttccgctccccccgaaaccatcgtacgcccctatcctccgttcttataaatcctctcctcttctccgcgtcttctcttttactatcccacgctctcctttcctttctccgaaaactttatcccgttcccctaccgattcccgtaaccccgaaaatcccgctcctaccgcgaaacgccctccgcttcgcgctccctcgtatcacgaaaaaaccaaaataaacgatctcctattatacttaacttttaaattttcgcttttacaacacaaaaataaaactaaaaaaaaaa

SEQ ID NO: 29017 - DNA, 882 bp, Artificial Sequence
  chemically treated genomic DNA (Homo sapiens) CpG-island No: 29017
tatcgtcgcgggatttttagtggtcgttaagatcggtttcgtagtcgttataattttagtttcgggcgttattttttgttcggtagttgtgtgtttagtattgcgtttgcgcgggggtggggtgagtagggagacgttttcggttaaagggtagagttcgcgttatttttgagggagtcggattcgggatcggtcgagagtgtgcggagtttatttgtattagcgaagcgtttgcggtagtcggaagcgaaagtttttggtttttttgcgtttaggtcggcgcgcgagtattcggaagtcgtttgcgggttttcggaagcggcgttttttagcgttttcgagtcgtatgaggcggttgttgttttcgcggtgcgggagggcgagttgcgcgtggtttgggtttttttcgaatggtggcgtttttgagcgttagttcgaggaggagtcggaggaggagtttgaatgtttggagatagattttaagtttcggattttattcgtgcgtcgtttcggtttgtaggtgatttttgcgtgcgggcgttttttttgattgattttgatgagttgtagttttgatggtttttttttcgggaatgattagggtgacggttggtcggggttcgttcgagtggcgttcggtcggtggtgattcgaataggagagcgggacggcgattattttttcgggaggggtttatttggagaaagttttttcgtttggttaaattaggagggcgatagtatcggttttattgcgacgatgataaagtataatatatcgtttggcgcgaaggagatgttcgagaattttttgttgttgttatttttcgcgtgtttttcgaaattaagggaaatgcggttttgtgggttttgttaacgttag

SEQ ID NO: 29018 - DNA, 882 bp, Artificial Sequence
  chemically treated genomic DNA (Homo sapiens) CpG-island No: 29018
ctaacgttaacaaaacccacaaaaccgcatttcccttaatttcgaaaaacacgcgaaaaataacaacaacaaaaaattctcgaacatctccttcgcgccaaacgatatattatactttatcatcgtcgcaataaaaccgatactatcgccctcctaatttaaccaaacgaaaaaactttctccaaataaacccctcccgaaaaaataatcgccgtcccgctctcctattcgaatcaccaccgaccgaacgccactcgaacgaaccccgaccaaccgtcaccctaatcattcccgaaaaaaaaaccatcaaaactacaactcatcaaaatcaatcaaaaaaaacgcccgcacgcaaaaatcacctacaaaccgaaacgacgcacgaataaaatccgaaacttaaaatctatctccaaacattcaaactcctcctccgactcctcctcgaactaacgctcaaaaacgccaccattcgaaaaaaacccaaaccacgcgcaactcgccctcccgcaccgcgaaaacaacaaccgcctcatacgactcgaaaacgctaaaaaacgccgcttccgaaaacccgcaaacgacttccgaatactcgcgcgccgacctaaacgcaaaaaaaccaaaaactttcgcttccgactaccgcaaacgcttcgctaatacaaataaactccgcacactctcgaccgatcccgaatccgactccctcaaaaataacgcgaactctaccctttaaccgaaaacgtctccctactcaccccacccccgcgcaaacgcaatactaaacacacaactaccgaacaaaaaataacgcccgaaactaaaattataacgactacgaaaccgatcttaacgaccactaaaaatcccgcgacgata

SEQ ID NO: 29019 - DNA, 882 bp, Artificial Sequence
  chemically treated genomic DNA (Homo sapiens) CpG-island No: 29019
ttgacgttaatagaatttatagagtcgtattttttttggtttcggaggatacgcgaaaaataataatagtaaagggttttcgagtatttttttcgcgttagacggtgtgttgtattttgttatcgtcgtagtaaggtcggtgttatcgtttttttagtttgattaagcgagaggattttttttagatgggtttttttcgagagaatggtcgtcgtttcgtttttttgttcgggttattatcggtcgggcgttattcgaacgagtttcggttagtcgttattttaattattttcgaaggaggggttattagagttatagtttattagggttaattagaaggggcgttcgtacgtaaaggttatttgtaaatcgaagcggcgtacggataaggttcgggatttgaagtttatttttaaatatttaggtttttttttcgattttttttcgaattggcgtttagaggcgttattattcggaaggagtttaggttacgcgtagttcgttttttcgtatcgcgagggtagtagtcgttttatgcgattcgagaacgttagagggcgtcgttttcgggagttcgtaagcggttttcgggtgttcgcgcgtcgatttggacgtagagaagttagagattttcgttttcggttgtcgtaggcgtttcgttggtgtaggtaagtttcgtatattttcggtcggtttcgagttcgatttttttaagggtgacgcgagttttgttttttaatcggaaacgtttttttgtttattttattttcgcgtagacgtagtgttgagtatatagttatcggataaagagtgacgttcggagttggagttatggcggttacggagtcgattttggcggttattgggagtttcgcggcggtg

SEQ ID NO: 29020 - DNA, 882 bp, Artificial Sequence
  chemically treated genomic DNA (Homo sapiens) CpG-island No: 29020
caccgccgcgaaactcccaataaccgccaaaatcgactccgtaaccgccataactccaactccgaacgtcactctttatccgataactatatactcaacactacgtctacgcgaaaataaaataaacaaaaaaacgtttccgattaaaaaacaaaactcgcgtcacccttaaaaaaatcgaactcgaaaccgaccgaaaatatacgaaacttacctacaccaacgaaacgcctacgacaaccgaaaacgaaaatctctaacttctctacgtccaaatcgacgcgcgaacacccgaaaaccgcttacgaactcccgaaaacgacgccctctaacgttctcgaatcgcataaaacgactactaccctcgcgatacgaaaaaacgaactacgcgtaacctaaactccttccgaataataacgcctctaaacgccaattcgaaaaaaaatcgaaaaaaaaacctaaatatttaaaaataaacttcaaatcccgaaccttatccgtacgccgcttcgatttacaaataacctttacgtacgaacgccccttctaattaaccctaataaactataactctaataacccctccttcgaaaataattaaaataacgactaaccgaaactcgttcgaataacgcccgaccgataataacccgaacaaaaaaacgaaacgacgaccattctctcgaaaaaaacccatctaaaaaaaatcctctcgcttaatcaaactaaaaaaacgataacaccgaccttactacgacgataacaaaatacaacacaccgtctaacgcgaaaaaaatactcgaaaaccctttactattattatttttcgcgtatcctccgaaaccaaaaaaaatacgactctataaattctattaacgtcaa

SEQ ID NO: 29021 - DNA, 528 bp, Artificial Sequence
  chemically treated genomic DNA (Homo sapiens) CpG-island No: 29021
gaggacgcggagggtgagtaagggagggtaggggcgagggtggattgggggtttcgcgcggtttgggggtgggagagagggaacgtttttgtcgtttggtttgggttcgaattttgtttcggtttttgtgtttttaaagggaatgcgtaagtttcgcgtttgtgataagtgaggttggatttttttttttttgaggtgaaggatgttcggaggttttcgtaggacggcgtagaaacgggttttttgtttaatagatgcgcgttttttttattttttttttttagaatttcgttgtttttataattatttgtggtcggcgtcgtcgcggtgttattgcgatgtcgaggcgaatggggtggggggaagcgttcgcggggcggggagggattttgtaggcgcggattttatatttagtttttggttagcgttattcggtttgttgtgttttcgtaggtcgtagttttattgtttgatgttttcgggaagtattttgaagttatcgtggttgtggattggggaattttttgt

SEQ ID NO: 29022 - DNA, 528 bp, Artificial Sequence
  chemically treated genomic DNA (Homo sapiens) CpG-island No: 29022
acaaaaaattccccaatccacaaccacgataacttcaaaatacttcccgaaaacatcaaacaataaaactacgacctacgaaaacacaacaaaccgaataacgctaaccaaaaactaaatataaaatccgcgcctacaaaatccctccccgccccgcgaacgcttccccccaccccattcgcctcgacatcgcaataacaccgcgacgacgccgaccacaaataattataaaaacaacgaaattctaaaaaaaaaaaataaaaaaaacgcgcatctattaaacaaaaaacccgtttctacgccgtcctacgaaaacctccgaacatccttcacctcaaaaaaaaaaaaatccaacctcacttatcacaaacgcgaaacttacgcattccctttaaaaacacaaaaaccgaaacaaaattcgaacccaaaccaaacgacaaaaacgttccctctctcccacccccaaaccgcgcgaaacccccaatccaccctcgcccctaccctcccttactcaccctccgcgtcctc

SEQ ID NO: 29023 - DNA, 528 bp, Artificial Sequence
  chemically treated genomic DNA (Homo sapiens) CpG-island No: 29023
ataagaaattttttaatttatagttacgatgattttaaaatatttttcgaagatattaggtaatgaagttgcgatttgcgaggatatagtaagtcgagtgacgttggttagaggttgggtgtggagttcgcgtttgtagggttttttttcgtttcgcgggcgtttttttttattttattcgtttcggtatcgtagtgatatcgcggcgacgtcgattataggtggttgtgaggatagcgagattttgaggggaaagaatgagagaagcgcgtatttattgggtagaaggttcgtttttgcgtcgttttgcggaggttttcgggtattttttattttagggaagagaaaatttaattttatttgttataggcgcgggatttgcgtattttttttgggagtataagaatcgaggtaggattcggatttaggttaggcggtaaaggcgtttttttttttttatttttaggtcgcgcggaatttttagtttattttcgtttttgtttttttttatttatttttcgcgttttt

SEQ ID NO: 29024 - DNA, 528 bp, Artificial Sequence
  chemically treated genomic DNA (Homo sapiens) CpG-island No: 29024
aaaaacgcgaaaaataaataaaaaaaaacaaaaacgaaaataaactaaaaattccgcgcgacctaaaaataaaaaaaaaaaaacgcctttaccgcctaacctaaatccgaatcctacctcgattcttatactcccaaaaaaaatacgcaaatcccgcgcctataacaaataaaattaaattttctcttccctaaaataaaaaatacccgaaaacctccgcaaaacgacgcaaaaacgaaccttctacccaataaatacgcgcttctctcattctttcccctcaaaatctcgctatcctcacaaccacctataatcgacgtcgccgcgatatcactacgataccgaaacgaataaaataaaaaaaaacgcccgcgaaacgaaaaaaaaccctacaaacgcgaactccacacccaacctctaaccaacgtcactcgacttactatatcctcgcaaatcgcaacttcattacctaatatcttcgaaaaatattttaaaatcatcgtaactataaattaaaaaatttcttat

SEQ ID NO: 29025 - DNA, 1215 bp, Artificial Sequence
  chemically treated genomic DNA (Homo sapiens) CpG-island No: 29025
aatatcgcgtttagggattacgtagttttggttttagtattcggagatgcgggtaggaaatgaatatcgcgtttagggagtacgtagttttggttttagtattcggggatgcgggtaggaaatgaatatcgcgtttagggagtacgtagttttggttttagtattcggggatgcgggtaggaaatgaatatcgcgtttagggagtacgtagttttggttttagtattcggggatgcggggaggaaatgaatatcgcgtttagggagtatatagttttggtttcggtattcggggatgcggggaggaagtgaatatcgcgtttagggagtacgtagttttggttttagtattcggggatgcggggaggaaatgaatatcgcgtttagggagtacgtagttttggtttcggtattcggggatgcggggaggaagtgaatatcgcgtttagggagtacgtagttttggttttagtattcggggatgcggggaggaaatgaatatcgcgtttagggagtacgtagttttggtttcggtattcggggatgcggggaggaaatgaatatcgcgtttagggagtatatagttttggtttcggtattcggggatgcggggagaaagtgaatattgcgtttagggagtacgtagttttggtttcggtattcggggatgcggggaggaagtgaatatcgcgtttagggattacgtagttttggtttcggtattcggagatgcggggaggaaatgaatatcgcgtttagggagtacgtagttttggtttcggtattcggggatgcggggaggaaatgaatatcgcgtttagggagtacgtagttttggtttcggtattcggggatgcggggaggaaatgaatatcgcgtttagggagtacgtagttttggtttcggtattcggggatgcggggaggaagtgaatatcgcgtttagggagtacgtagttttggtttcggtattcggggatgcggggaggaagtgaatatcgcgtttagggagtacgtagttttggttttcgtattcggggatgcggggaggaaatgaatatcgcgtttagggagtacgtagttttggttttagtatttagggatgcggggagaaagtgaatattgcgtttagtgaataaataaatgaggatttaacgtcggaaatattagtttttttcggtagggtatttttatgagtttttaggaaatttattttg

SEQ ID NO: 29026 - DNA, 1215 bp, Artificial Sequence
  chemically treated genomic DNA (Homo sapiens) CpG-island No: 29026
caaaataaatttcctaaaaactcataaaaataccctaccgaaaaaaactaatatttccgacgttaaatcctcatttatttattcactaaacgcaatattcactttctccccgcatccctaaatactaaaaccaaaactacgtactccctaaacgcgatattcatttcctccccgcatccccgaatacgaaaaccaaaactacgtactccctaaacgcgatattcacttcctccccgcatccccgaataccgaaaccaaaactacgtactccctaaacgcgatattcacttcctccccgcatccccgaataccgaaaccaaaactacgtactccctaaacgcgatattcatttcctccccgcatccccgaataccgaaaccaaaactacgtactccctaaacgcgatattcatttcctccccgcatccccgaataccgaaaccaaaactacgtactccctaaacgcgatattcatttcctccccgcatctccgaataccgaaaccaaaactacgtaatccctaaacgcgatattcacttcctccccgcatccccgaataccgaaaccaaaactacgtactccctaaacgcaatattcactttctccccgcatccccgaataccgaaaccaaaactatatactccctaaacgcgatattcatttcctccccgcatccccgaataccgaaaccaaaactacgtactccctaaacgcgatattcatttcctccccgcatccccgaatactaaaaccaaaactacgtactccctaaacgcgatattcacttcctccccgcatccccgaataccgaaaccaaaactacgtactccctaaacgcgatattcatttcctccccgcatccccgaatactaaaaccaaaactacgtactccctaaacgcgatattcacttcctccccgcatccccgaataccgaaaccaaaactatatactccctaaacgcgatattcatttcctccccgcatccccgaatactaaaaccaaaactacgtactccctaaacgcgatattcatttcctacccgcatccccgaatactaaaaccaaaactacgtactccctaaacgcgatattcatttcctacccgcatccccgaatactaaaaccaaaactacgtactccctaaacgcgatattcatttcctacccgcatctccgaatactaaaaccaaaactacgtaatccctaaacgcgatatt

SEQ ID NO: 29027 - DNA, 1215 bp, Artificial Sequence
  chemically treated genomic DNA (Homo sapiens) CpG-island No: 29027
taggatggattttttggggatttatggaggtgttttgtcgagggagattgatgttttcgacgttgagtttttatttgtttgtttattgaacgtaatgtttatttttttttcgtatttttgggtgttgggattagggttgcgtgttttttgaacgcgatgtttatttttttttcgtattttcgggtgcggggattagggttgcgtgttttttgaacgcgatgtttatttttttttcgtattttcgggtgtcgggattagggttgcgtgttttttgaacgcgatgtttatttttttttcgtattttcgggtgtcgggattagggttgcgtgttttttgaacgcgatgtttatttttttttcgtattttcgggtgtcgggattagggttgcgtgttttttgaacgcgatgtttatttttttttcgtattttcgggtgtcgggattagggttgcgtgttttttgaacgcgatgtttatttttttttcgtattttcgggtgtcgggattagggttgcgtggtttttgaacgcgatgtttatttttttttcgtattttcgggtgtcgggattagggttgcgtgttttttgaacgtaatgtttatttttttttcgtattttcgggtgtcgggattagggttgtgtgttttttgaacgcgatgtttatttttttttcgtattttcgggtgtcgggattagggttgcgtgttttttgaacgcgatgtttatttttttttcgtattttcgggtgttgggattagggttgcgtgttttttgaacgcgatgtttatttttttttcgtattttcgggtgtcgggattagggttgcgtgttttttgaacgcgatgtttatttttttttcgtattttcgggtgttgggattagggttgcgtgttttttgaacgcgatgtttatttttttttcgtattttcgggtgtcgggattagggttgtgtgttttttgaacgcgatgtttatttttttttcgtattttcgggtgttgggattagggttgcgtgttttttgaacgcgatgtttattttttgttcgtattttcgggtgttgggattagggttgcgtgttttttgaacgcgatgtttattttttgttcgtattttcgggtgttgggattagggttgcgtgttttttgaacgcgatgtttattttttgttcgtattttcgggtgttgggattagggttgcgtggtttttgaacgcgatgtt

SEQ ID NO: 29028 - DNA, 1215 bp, Artificial Sequence
  chemically treated genomic DNA (Homo sapiens) CpG-island No: 29028
aacatcgcgttcaaaaaccacgcaaccctaatcccaacacccgaaaatacgaacaaaaaataaacatcgcgttcaaaaaacacgcaaccctaatcccaacacccgaaaatacgaacaaaaaataaacatcgcgttcaaaaaacacgcaaccctaatcccaacacccgaaaatacgaacaaaaaataaacatcgcgttcaaaaaacacgcaaccctaatcccaacacccgaaaatacgaaaaaaaaataaacatcgcgttcaaaaaacacacaaccctaatcccgacacccgaaaatacgaaaaaaaaataaacatcgcgttcaaaaaacacgcaaccctaatcccaacacccgaaaatacgaaaaaaaaataaacatcgcgttcaaaaaacacgcaaccctaatcccgacacccgaaaatacgaaaaaaaaataaacatcgcgttcaaaaaacacgcaaccctaatcccaacacccgaaaatacgaaaaaaaaataaacatcgcgttcaaaaaacacgcaaccctaatcccgacacccgaaaatacgaaaaaaaaataaacatcgcgttcaaaaaacacacaaccctaatcccgacacccgaaaatacgaaaaaaaaataaacattacgttcaaaaaacacgcaaccctaatcccgacacccgaaaatacgaaaaaaaaataaacatcgcgttcaaaaaccacgcaaccctaatcccgacacccgaaaatacgaaaaaaaaataaacatcgcgttcaaaaaacacgcaaccctaatcccgacacccgaaaatacgaaaaaaaaataaacatcgcgttcaaaaaacacgcaaccctaatcccgacacccgaaaatacgaaaaaaaaataaacatcgcgttcaaaaaacacgcaaccctaatcccgacacccgaaaatacgaaaaaaaaataaacatcgcgttcaaaaaacacgcaaccctaatcccgacacccgaaaatacgaaaaaaaaataaacatcgcgttcaaaaaacacgcaaccctaatccccgcacccgaaaatacgaaaaaaaaataaacatcgcgttcaaaaaacacgcaaccctaatcccaacacccaaaaatacgaaaaaaaaataaacattacgttcaataaacaaacaaataaaaactcaacgtcgaaaacatcaatctccctcgacaaaacacctccataaatccccaaaaaatccatccta

SEQ ID NO: 29029 - DNA, 697 bp, Artificial Sequence
  chemically treated genomic DNA (Homo sapiens) CpG-island No: 29029
gtattcgggttatttttcgaggaagaacgtagttttgtttttcggagcgtacgcgtagtttggttttgcgtttaggtcggttgaaaacgcggggcgttcggatttatttcgtttaaggaacgtgtcgttgagatttaggatttcgagcgtgattaggggcgcgttattttttttagcgaacgtcgtttcggcgatgtttttttgggtttcgcgatttagcgcggtgtaggagaggttgaggagttgtagcgcggggaagtaggcgaaggttcggggttgtagcgttcgtagcggattttcggcgagcgttagggcgcggaggttgtttagcgcgggttcggtgtacggcggtagagcggttagttggttgtagttgaggtttagggtgtgtagtttcgtcggtttattcgggttttagcgtagcgcggcgatgcggttgtggcgtagggttagtatttgtagttgttttaggtggtcgagttcggaagtgtttagggcgcgtagtaggttgtggttggcgtcgaggttgcgtagtgtgcgcggtaggtagtcgggtaggcgttttaggttgcggttcgttagggttaaggtcgtcgtattcgcggcgggtagtttttcgtagggcgagtcggtggcgttgttgttattgtttttttaggggttttgttgagtgattcggaagagcgggatttttttt

SEQ ID NO: 29030 - DNA, 697 bp, Artificial Sequence
  chemically treated genomic DNA (Homo sapiens) CpG-island No: 29030
aaaaaaaatcccgctcttccgaatcactcaacaaaacccctaaaaaaacaataacaacaacgccaccgactcgccctacgaaaaactacccgccgcgaatacgacgaccttaaccctaacgaaccgcaacctaaaacgcctacccgactacctaccgcgcacactacgcaacctcgacgccaaccacaacctactacgcgccctaaacacttccgaactcgaccacctaaaacaactacaaatactaaccctacgccacaaccgcatcgccgcgctacgctaaaacccgaataaaccgacgaaactacacaccctaaacctcaactacaaccaactaaccgctctaccgccgtacaccgaacccgcgctaaacaacctccgcgccctaacgctcgccgaaaatccgctacgaacgctacaaccccgaaccttcgcctacttccccgcgctacaactcctcaacctctcctacaccgcgctaaatcgcgaaacccaaaaaaacatcgccgaaacgacgttcgctaaaaaaaataacgcgcccctaatcacgctcgaaatcctaaatctcaacgacacgttccttaaacgaaataaatccgaacgccccgcgttttcaaccgacctaaacgcaaaaccaaactacgcgtacgctccgaaaaacaaaactacgttcttcctcgaaaaataacccgaatac

SEQ ID NO: 29031 - DNA, 697 bp, Artificial Sequence
  chemically treated genomic DNA (Homo sapiens) CpG-island No: 29031
ggagaaggtttcgttttttcgggttatttagtagggtttttgggggagtagtggtagtaacgttatcgattcgttttgcgaggggttgttcgtcgcggatgcgacggttttgattttggcgaatcgtaatttggagcgtttgttcggttgtttatcgcgtatattgcgtagtttcgacgttagttataatttgttgcgcgttttgagtattttcgagttcggttatttggagtagttgtaggtgttgattttgcgttataatcgtatcgtcgcgttgcgttggggttcgggtgggtcggcggggttgtatattttggattttagttataattagttggtcgttttgtcgtcgtgtatcgggttcgcgttgagtagttttcgcgttttggcgttcgtcgggaattcgttgcgggcgttgtagtttcgggttttcgtttgttttttcgcgttgtagttttttaattttttttgtatcgcgttgggtcgcggagtttaggggggtatcgtcgaggcggcgttcgttggagaggatggcgcgtttttggttacgttcgaagttttggattttagcggtacgttttttgaacggggtgagttcgggcgtttcgcgtttttagtcggtttgagcgtagagttaggttgcgcgtgcgtttcggggggtagggttgcgttttttttcgaggggtgattcgggtgt

SEQ ID NO: 29032 - DNA, 697 bp, Artificial Sequence
  chemically treated genomic DNA (Homo sapiens) CpG-island No: 29032
acacccgaatcacccctcgaaaaaaaacgcaaccctaccccccgaaacgcacgcgcaacctaactctacgctcaaaccgactaaaaacgcgaaacgcccgaactcaccccgttcaaaaaacgtaccgctaaaatccaaaacttcgaacgtaaccaaaaacgcgccatcctctccaacgaacgccgcctcgacgatacccccctaaactccgcgacccaacgcgatacaaaaaaaattaaaaaactacaacgcgaaaaaacaaacgaaaacccgaaactacaacgcccgcaacgaattcccgacgaacgccaaaacgcgaaaactactcaacgcgaacccgatacacgacgacaaaacgaccaactaattataactaaaatccaaaatatacaaccccgccgacccacccgaaccccaacgcaacgcgacgatacgattataacgcaaaatcaacacctacaactactccaaataaccgaactcgaaaatactcaaaacgcgcaacaaattataactaacgtcgaaactacgcaatatacgcgataaacaaccgaacaaacgctccaaattacgattcgccaaaatcaaaaccgtcgcatccgcgacgaacaacccctcgcaaaacgaatcgataacgttactaccactactcccccaaaaaccctactaaataacccgaaaaaacgaaaccttctcc

SEQ ID NO: 29033 - DNA, 545 bp, Artificial Sequence
  chemically treated genomic DNA (Homo sapiens) CpG-island No: 29033
gtttttttggttcgatttcggagttcgttttcggttttttcggtaggttgggtcgggtaggtaggagttaagtcgcgttcgttttcgattcgtaggtggcgtcgttttgttttggtgttcggtttcgggcgtttcgaagtgcgggatagaatagtagcgagcgcggagtcgaagtttagtttcgatttgttgatttcgtttaggtagtcgtcgtcgtcgtcgtcgcgggagtaggaggaggaggaggtggaggaggtgtcgcgcggtcgcggttttgttttcgcgttttcggcgttcgtcggcgtttttcgtttcggagagcgcgtttcggtttcgcggcgtttgtagttcgggcgagttgtttgttcggtcggggtaggttcggtttagttcggtttcgggatcgtcgttgtttacgggcgggggcgttcgggcggtcgggacgatgcgcggtttttggttttaggaggcggtcgttttgggggtgagtgttggggcgtacggtttttcgtgggggtgtatggggatacggatagggggtttgt

SEQ ID NO: 29034 - DNA, 545 bp, Artificial Sequence
  chemically treated genomic DNA (Homo sapiens) CpG-island No: 29034
acaaaccccctatccgtatccccatacacccccacgaaaaaccgtacgccccaacactcacccccaaaacgaccgcctcctaaaaccaaaaaccgcgcatcgtcccgaccgcccgaacgcccccgcccgtaaacaacgacgatcccgaaaccgaactaaaccgaacctaccccgaccgaacaaacaactcgcccgaactacaaacgccgcgaaaccgaaacgcgctctccgaaacgaaaaacgccgacgaacgccgaaaacgcgaaaacaaaaccgcgaccgcgcgacacctcctccacctcctcctcctcctactcccgcgacgacgacgacgacgactacctaaacgaaatcaacaaatcgaaactaaacttcgactccgcgctcgctactattctatcccgcacttcgaaacgcccgaaaccgaacaccaaaacaaaacgacgccacctacgaatcgaaaacgaacgcgacttaactcctacctacccgacccaacctaccgaaaaaaccgaaaacgaactccgaaatcgaaccaaaaaaac

SEQ ID NO: 29035 - DNA, 545 bp, Artificial Sequence
  chemically treated genomic DNA (Homo sapiens) CpG-island No: 29035
gtaaattttttgttcgtgtttttatgtatttttacggaaggtcgtacgttttaatatttatttttagggcggtcgttttttggggttagggatcgcgtatcgtttcggtcgttcgggcgttttcgttcgtgggtagcggcggtttcggggtcgggttgagtcgggtttatttcggtcgggtaggtaattcgttcgggttgtaggcgtcgcggggtcggggcgcgtttttcgaggcggggggcgtcggcgggcgtcgggggcgcgggggtaggatcgcggtcgcgcggtattttttttatttttttttttttttgttttcgcggcggcggcggcggcggttgtttgggcgagattaataagtcggggttgagtttcggtttcgcgttcgttgttattttgtttcgtatttcggagcgttcggagtcgggtattaaggtaggacggcgttatttgcgggtcggaagcgagcgcggtttaatttttgtttgttcggtttagtttgtcggggaggtcgggggcgggtttcgggatcgggttaaggagat

SEQ ID NO: 29036 - DNA, 545 bp, Artificial Sequence
  chemically treated genomic DNA (Homo sapiens) CpG-island No: 29036
atctccttaacccgatcccgaaacccgcccccgacctccccgacaaactaaaccgaacaaacaaaaattaaaccgcgctcgcttccgacccgcaaataacgccgtcctaccttaatacccgactccgaacgctccgaaatacgaaacaaaataacaacgaacgcgaaaccgaaactcaaccccgacttattaatctcgcccaaacaaccgccgccgccgccgccgcgaaaacaaaaaaaaaaaaaaataaaaaaaataccgcgcgaccgcgatcctacccccgcgcccccgacgcccgccgacgccccccgcctcgaaaaacgcgccccgaccccgcgacgcctacaacccgaacgaattacctacccgaccgaaataaacccgactcaacccgaccccgaaaccgccgctacccacgaacgaaaacgcccgaacgaccgaaacgatacgcgatccctaaccccaaaaaacgaccgccctaaaaataaatattaaaacgtacgaccttccgtaaaaatacataaaaacacgaacaaaaaatttac

SEQ ID NO: 29037 - DNA, 861 bp, Artificial Sequence
  chemically treated genomic DNA (Homo sapiens) CpG-island No: 29037
ttagttttcggggttttatttcgatgaaagatttgcggcgttttcgtttttcggttcggtttaggtcgaaggtttcgcggggatttttttaagacgttttcggcgtcgtagcggttttttcgttttcgaggttgttcgggtcgtcgtaggtttcgcggttttcgttcgtcgtaatcgcggtttagtttttcgcgttttcgtcgtcgttttagttcgaatcgggttttcgtcgttttcgttagttagttttattttagaagcgaatcgtgggtagcgcgcgggatttcggggttttagtgcggttatcgttcgtcggtttcggtttcggtttcgttttcgttttttggttcgtagtagcggttcgttaggttttttcgttttttagttttttcgttcgtttttatcgttcgatttgggtgcggtttgcggcgttgtagtttaataacgcgtcgttttataggttaagtcgcgtagtattgtcgagtaacgtattttgcgattggcgggatttatgaggggcgggttttttgcgggtagggcgattggattcgttaggttcgtttcggggcgatttcgtcggggtttgcggaggtttagggtttcgcgcggagtatatttcggtcggtagtttcgggcgttaggttatggttttacggtggttaggtagattgcggcgagtttttgtcgggttcgttggatacggttttattgtgattgattttcgtcggaggggttgtcggagtttagggattttgttttttcgtcgtcgtttagcgtatttttttagtagacgggttttgtttcgcgtagtttcgttttgtgtagtttttaggtcgagttttggggttcgggtggggttaa

SEQ ID NO: 29038 - DNA, 861 bp, Artificial Sequence
  chemically treated genomic DNA (Homo sapiens) CpG-island No: 29038
ttaaccccacccgaaccccaaaactcgacctaaaaactacacaaaacgaaactacgcgaaacaaaacccgtctactaaaaaaatacgctaaacgacgacgaaaaaacaaaatccctaaactccgacaacccctccgacgaaaatcaatcacaataaaaccgtatccaacgaacccgacaaaaactcgccgcaatctacctaaccaccgtaaaaccataacctaacgcccgaaactaccgaccgaaatatactccgcgcgaaaccctaaacctccgcaaaccccgacgaaatcgccccgaaacgaacctaacgaatccaatcgccctacccgcaaaaaacccgcccctcataaatcccgccaatcgcaaaatacgttactcgacaatactacgcgacttaacctataaaacgacgcgttattaaactacaacgccgcaaaccgcacccaaatcgaacgataaaaacgaacgaaaaaactaaaaaacgaaaaaacctaacgaaccgctactacgaaccaaaaaacgaaaacgaaaccgaaaccgaaaccgacgaacgataaccgcactaaaaccccgaaatcccgcgcgctacccacgattcgcttctaaaataaaactaactaacgaaaacgacgaaaacccgattcgaactaaaacgacgacgaaaacgcgaaaaactaaaccgcgattacgacgaacgaaaaccgcgaaacctacgacgacccgaacaacctcgaaaacgaaaaaaccgctacgacgccgaaaacgtcttaaaaaaatccccgcgaaaccttcgacctaaaccgaaccgaaaaacgaaaacgccgcaaatctttcatcgaaataaaaccccgaaaactaa

SEQ ID NO: 29039 - DNA, 861 bp, Artificial Sequence
  chemically treated genomic DNA (Homo sapiens) CpG-island No: 29039
ttgattttattcgggttttaaaattcggtttggggattgtataaggcggggttacgcggggtagggttcgtttgttgggggagtgcgttgggcggcggcgggagggtagggtttttgggtttcgatagttttttcggcggaggttaattataatgaaatcgtgtttagcggattcggtaggggttcgtcgtagtttatttggttatcgtgaagttatgatttggcgttcgaagttgtcggtcggggtgtatttcgcgcgggattttgggttttcgtaggtttcggcggggtcgtttcgaggcgggtttggcgagtttaatcgttttgttcgtaggggattcgttttttatgggtttcgttaatcgtagggtacgttgttcggtagtgttgcgcggtttggtttatgggacggcgcgttgttgggttgtagcgtcgtaggtcgtatttaggtcgggcggtgggggcgagcggaggggttgaggggcggagaggtttggcgggtcgttgttgcgggttaggggacgggggcggagtcggagtcggagtcgacgggcggtggtcgtattgggatttcggaatttcgcgcgttgtttacgattcgtttttgaggtgaggttagttagcgggggcggcgggggttcggttcgggttgaggcggcggcgggggcgcggggaattgggtcgcggttgcggcgggcgggggtcgcggggtttgcggcggttcgggtagtttcgggggcggggaggtcgttgcggcgtcgagggcgttttggaggggttttcgcggggttttcggtttgggtcgagtcggggagcgagggcgtcgtagattttttatcgggataggatttcggggattag

SEQ ID NO: 29040 - DNA, 861 bp, Artificial Sequence
  chemically treated genomic DNA (Homo sapiens) CpG-island No: 29040
ctaatccccgaaatcctatcccgataaaaaatctacgacgccctcgctccccgactcgacccaaaccgaaaaccccgcgaaaacccctccaaaacgccctcgacgccgcaacgacctccccgcccccgaaactacccgaaccgccgcaaaccccgcgacccccgcccgccgcaaccgcgacccaattccccgcgcccccgccgccgcctcaacccgaaccgaacccccgccgcccccgctaactaacctcacctcaaaaacgaatcgtaaacaacgcgcgaaattccgaaatcccaatacgaccaccgcccgtcgactccgactccgactccgcccccgtcccctaacccgcaacaacgacccgccaaacctctccgcccctcaacccctccgctcgcccccaccgcccgacctaaatacgacctacgacgctacaacccaacaacgcgccgtcccataaaccaaaccgcgcaacactaccgaacaacgtaccctacgattaacgaaacccataaaaaacgaatcccctacgaacaaaacgattaaactcgccaaacccgcctcgaaacgaccccgccgaaacctacgaaaacccaaaatcccgcgcgaaatacaccccgaccgacaacttcgaacgccaaatcataacttcacgataaccaaataaactacgacgaacccctaccgaatccgctaaacacgatttcattataattaacctccgccgaaaaaactatcgaaacccaaaaaccctaccctcccgccgccgcccaacgcactcccccaacaaacgaaccctaccccgcgtaaccccgccttatacaatccccaaaccgaattttaaaacccgaataaaatcaa

SEQ ID NO: 29041 - DNA, 646 bp, Artificial Sequence
  chemically treated genomic DNA (Homo sapiens) CpG-island No: 29041
  misc_feature (3)..(3): n is either a, c, g or t
  misc_feature (69)..(69): n is either a, c, g or t
  misc_feature (78)..(78): n is either a, c, g or t
  misc_feature (98)..(98): n is either a, c, g or t
  misc_feature (111)..(111): n is either a, c, g or t
  misc_feature (139)..(139): n is either a, c, g or t
  misc_feature (151)..(152): n is either a, c, g or t
  misc_feature (156)..(157): n is either a, c, g or t
  misc_feature (163)..(164): n is either a, c, g or t
  misc_feature (576)..(576): n is either a, c, g or t
  misc_feature (580)..(580): n is either a, c, g or t
agnggtggggtcgggcgagaaggggttgggcgggttgtcgtcgggcggggttgcgcggggaagggcggngttgcgcgnggggcggggttgcgtggggnagggcggggtcgngttgttgtgggtgggcggggcgtatcgnggaaagtttcgnnaagnncggtanncggcggggttcgggcgcggaagttgtcggcggtcgcgcggtttttcgggcgggtttatagttatgtttcgggattcggggtcgggcggttgggaggaggtttcgcgcgtagttgtcgcgttttgtattttgtattacgaggtcggatagcggttgcgtcgtttgtaggattagttcgttgttcgcgacgtttttatcgttcgttttcgcgttcgtttggtcgcgttggagggggacgtcgcgtcgtttttagtggacgcgttgttggagtaggttgcgcgttttcgggagtagttgcgaaggtaggagggcggcgtcgtcgaggtttagatgcgttaggtacgagggcgggtattagaggagttgcgggagcgagagtgcgtgtggcggtcgtcgggttttgggtgggtgancgancgggtttcgggttttgaggggttgagggggtattgggttttggggttgagttggtttcgggttttg

SEQ ID NO: 29042 - DNA, 646 bp, Artificial Sequence
  chemically treated genomic DNA (Homo sapiens) CpG-island No: 29042
  misc_feature (67)..(67): n is either a, c, g or t
  misc_feature (71)..(71): n is either a, c, g or t
  misc_feature (483)..(484): n is either a, c, g or t
  misc_feature (490)..(491): n is either a, c, g or t
  misc_feature (495)..(496): n is either a, c, g or t
  misc_feature (508)..(508): n is either a, c, g or t
  misc_feature (536)..(536): n is either a, c, g or t
  misc_feature (549)..(549): n is either a, c, g or t
  misc_feature (569)..(569): n is either a, c, g or t
  misc_feature (578)..(578): n is either a, c, g or t
  misc_feature (644)..(644): n is either a, c, g or t
caaaacccgaaaccaactcaaccccaaaacccaataccccctcaacccctcaaaacccgaaacccgntcgntcacccacccaaaacccgacgaccgccacacgcactctcgctcccgcaactcctctaatacccgccctcgtacctaacgcatctaaacctcgacgacgccgccctcctaccttcgcaactactcccgaaaacgcgcaacctactccaacaacgcgtccactaaaaacgacgcgacgtccccctccaacgcgaccaaacgaacgcgaaaacgaacgataaaaacgtcgcgaacaacgaactaatcctacaaacgacgcaaccgctatccgacctcgtaatacaaaatacaaaacgcgacaactacgcgcgaaacctcctcccaaccgcccgaccccgaatcccgaaacataactataaacccgcccgaaaaaccgcgcgaccgccgacaacttccgcgcccgaaccccgccgnntaccgnncttnncgaaactttccncgatacgccccgcccacccacaacaacncgaccccgccctnccccacgcaaccccgccccncgcgcaacnccgcccttccccgcgcaaccccgcccgacgacaacccgcccaaccccttctcgcccgaccccaccnct

SEQ ID NO: 29043 - DNA, 646 bp, Artificial Sequence
  chemically treated genomic DNA (Homo sapiens) CpG-island No: 29043
  misc_feature (67)..(67): n is either a, c, g or t
  misc_feature (71)..(71): n is either a, c, g or t
  misc_feature (483)..(484): n is either a, c, g or t
  misc_feature (490)..(491): n is either a, c, g or t
  misc_feature (495)..(496): n is either a, c, g or t
  misc_feature (508)..(508): n is either a, c, g or t
  misc_feature (536)..(536): n is either a, c, g or t
  misc_feature (549)..(549): n is either a, c, g or t
  misc_feature (569)..(569): n is either a, c, g or t
  misc_feature (578)..(578): n is either a, c, g or t
  misc_feature (644)..(644): n is either a, c, g or t
taggattcgaggttaatttaattttaggatttagtatttttttaattttttaggattcggggttcgntcgnttatttatttaggattcggcggtcgttatacgtattttcgttttcgtagtttttttggtattcgttttcgtatttggcgtatttgggtttcggcggcgtcgtttttttgttttcgtagttgttttcggaagcgcgtaatttgttttagtagcgcgtttattagggacggcgcggcgtttttttttagcgcggttaggcgggcgcggaggcgagcgatgagggcgtcgcgggtagcgagttggttttgtaggcggcgtagtcgttgttcggtttcgtggtatagggtgtagagcgcggtagttgcgcgcggggtttttttttagtcgttcgatttcgggtttcgggatatggttgtaggttcgttcgggaggtcgcgcggtcgtcggtaattttcgcgttcgggtttcgtcgnntgtcgnntttnncggaattttttncggtgcgtttcgtttatttataatagtncggtttcgttttnttttacgtagtttcgttttncgcgtagtntcgttttttttcgcgtagtttcgttcgacggtagttcgtttagttttttttcgttcggttttattntt

SEQ ID NO: 29044 - DNA, 646 bp, Artificial Sequence
  chemically treated genomic DNA (Homo sapiens) CpG-island No: 29044
  misc_feature (3)..(3): n is either a, c, g or t
  misc_feature (69)..(69): n is either a, c, g or t
  misc_feature (78)..(78): n is either a, c, g or t
  misc_feature (98)..(98): n is either a, c, g or t
  misc_feature (111)..(111): n is either a, c, g or t
  misc_feature (139)..(139): n is either a, c, g or t
  misc_feature (151)..(152): n is either a, c, g or t
  misc_feature (156)..(157): n is either a, c, g or t
  misc_feature (163)..(164): n is either a, c, g or t
  misc_feature (576)..(576): n is either a, c, g or t
  misc_feature (580)..(580): n is either a, c, g or t
aanaataaaaccgaacgaaaaaaaactaaacgaactaccgtcgaacgaaactacgcgaaaaaaaacganactacgcgnaaaacgaaactacgtaaaanaaaacgaaaccgnactattataaataaacgaaacgcaccgnaaaaaattccgnnaaanncgacanncgacgaaacccgaacgcgaaaattaccgacgaccgcgcgacctcccgaacgaacctacaaccatatcccgaaacccgaaatcgaacgactaaaaaaaaaccccgcgcgcaactaccgcgctctacaccctataccacgaaaccgaacaacgactacgccgcctacaaaaccaactcgctacccgcgacgccctcatcgctcgcctccgcgcccgcctaaccgcgctaaaaaaaaacgccgcgccgtccctaataaacgcgctactaaaacaaattacgcgcttccgaaaacaactacgaaaacaaaaaaacgacgccgccgaaacccaaatacgccaaatacgaaaacgaataccaaaaaaactacgaaaacgaaaatacgtataacgaccgccgaatcctaaataaataancgancgaaccccgaatcctaaaaaattaaaaaaatactaaatcctaaaattaaattaacctcgaatccta

SEQ ID NO: 29045 - DNA, 568 bp, Artificial Sequence
  chemically treated genomic DNA (Homo sapiens) CpG-island No: 29045
gatatcgcgttaagggagagaggagagggtatcgagcgttcgttttttcgacgtggttcgtttcggttttacgacgtttcgtttttgttacgtttttttttcgttttatgtaggttttcgtttcgttttttataaagtcggttttcgtttcgttttttagcggcgtttcgtttttacggcgttttgtttcgttttttgtaggcggttcggcgcggtgtttattcgcggtgtatggtggggcggtttttttcggtaatttcggtcgaacggttatttagaggttgtgttgagttggcgtagcggtagtagtatgagtcggattttcgtatcggtcgtgtttttgtcgagtttcgattattacgagaggttgggttaattttagtacgggttgcgggataggtaagggtattggggcgggggtggggagtcggttcgcgtcgggggtttttcgcgtgttttgttttattttttttttcgttttttcgttcgaggtttttcggggtttaggttcgcgcgtaacgttttttaggtttttagtggggtttggaggatagtgtttattagagtt

SEQ ID NO: 29046 - DNA, 568 bp, Artificial Sequence
  chemically treated genomic DNA (Homo sapiens) CpG-island No: 29046
aactctaataaacactatcctccaaaccccactaaaaacctaaaaaacgttacgcgcgaacctaaaccccgaaaaacctcgaacgaaaaaacgaaaaaaaaaataaaacaaaacacgcgaaaaacccccgacgcgaaccgactccccacccccgccccaatacccttacctatcccgcaacccgtactaaaattaacccaacctctcgtaataatcgaaactcgacaaaaacacgaccgatacgaaaatccgactcatactactaccgctacgccaactcaacacaacctctaaataaccgttcgaccgaaattaccgaaaaaaaccgccccaccatacaccgcgaataaacaccgcgccgaaccgcctacaaaaaacgaaacaaaacgccgtaaaaacgaaacgccgctaaaaaacgaaacgaaaaccgactttataaaaaacgaaacgaaaacctacataaaacgaaaaaaaaacgtaacaaaaacgaaacgtcgtaaaaccgaaacgaaccacgtcgaaaaaacgaacgctcgataccctctcctctctcccttaacgcgatatc

SEQ ID NO: 29047 - DNA, 568 bp, Artificial Sequence
  chemically treated genomic DNA (Homo sapiens) CpG-island No: 29047
ggttttagtaaatattgttttttaggttttattgggagtttggggggcgttgcgcgcgggtttgggtttcggggaatttcggacgggggagcgggaaggaaaatggggtagggtacgcggaagattttcggcgcgggtcgattttttattttcgttttagtgtttttatttgtttcgtagttcgtgttggagttggtttagtttttcgtagtagtcgggattcgataggggtacggtcgatgcgagggttcggtttatgttgttgtcgttgcgttagtttagtatagtttttgggtggtcgttcggtcggggttgtcgaaggagatcgttttattatgtatcgcgggtaaatatcgcgtcgggtcgtttgtaggaggcggggtaagacgtcgtgggggcggggcgtcgttgagggacggggcggaagtcggttttgtggggggcgggacgaagatttgtatggggcggggaagaggcgtggtagaggcggggcgtcgtgaggtcggggcggattacgtcggaggggcgggcgttcggtgttttttttttttttttttgacgcggtgtt

SEQ ID NO: 29048 - DNA, 568 bp, Artificial Sequence
  chemically treated genomic DNA (Homo sapiens) CpG-island No: 29048
aacaccgcgtcaaaaaaaaaaaaaaaaaacaccgaacgcccgcccctccgacgtaatccgccccgacctcacgacgccccgcctctaccacgcctcttccccgccccatacaaatcttcgtcccgccccccacaaaaccgacttccgccccgtccctcaacgacgccccgcccccacgacgtcttaccccgcctcctacaaacgacccgacgcgatatttacccgcgatacataataaaacgatctccttcgacaaccccgaccgaacgaccacccaaaaactatactaaactaacgcaacgacaacaacataaaccgaaccctcgcatcgaccgtacccctatcgaatcccgactactacgaaaaactaaaccaactccaacacgaactacgaaacaaataaaaacactaaaacgaaaataaaaaatcgacccgcgccgaaaatcttccgcgtaccctaccccattttccttcccgctcccccgtccgaaattccccgaaacccaaacccgcgcgcaacgccccccaaactcccaataaaacctaaaaaacaatatttactaaaacc

SEQ ID NO: 29049 - DNA, 1108 bp, Artificial Sequence
  chemically treated genomic DNA (Homo sapiens) CpG-island No: 29049
ataggcggtatattatgaatacgtcggcggttattatggtcgtcgcgtggattagcgtcgatatcggggtcgggttttttatcgcgttcggtagttaggtgtggagttcgagttgcgtcgatttgtttatcgcgtcgacgaatagtagtaggtagagtacggttatcgtgtcgaagcgatagtttaggaaatcgatggtcgaattcgttatgttcggcgcggcggttaggatcgtcgggatcgagacggtttcgaatattaggaaggtgtcgaagatgtcgagtatgaaatcgaggtcgtcgacgcggttgacgacgaacgttttgatcgcggcggtattggtcgaaggtttgcggaattagaagtcgattagtaggtaggacgcgagatttacgttttgttagtcgaagaatatttggattagattgttcgtcgttacgagtattagtatcgcgaaggtgaagaggtagagataggcgaagaagcgcggttgattcggtttttcgtttatatagtataagttatagaggtggacgagtgtagatacgttggtgatgattattagtatgatcgcggttagcgagtcgacgcgtagcgtttagtcgatcgatatggtgtcgttggtgatatagtgaagtataggtgtgatagttacgacgttatggttcgatagatagtcgatgaagatcggttatgatagtgcgtagaaaatgaatagcgcgtcggtcgtgacgattttggcgggtacgttttcgatggttttgttgtcgaattttgtaatggcggcggttagtaacggtaggaagacgatagcgaggattaattcgattatttttttattcggttgacgtcgtcgatcgcgatggtgtcgcggttacggaaatagatgattaggatcgttagatcgatcgtcgatttatcggcggttacggttagtacgaatatggcgaagatttgatttattagatcgtgaagcgcgatcgagaaggcgacgaggtttaggtttacggcgagtaggataagttcgatcgttatgaggatgacgattaggttttttcggttgaggaagatatttagtatttttatggtgaataggatcgtcgcgacg

SEQ ID NO: 29050 - DNA, 1108 bp, Artificial Sequence
  chemically treated genomic DNA (Homo sapiens) CpG-island No: 29050
cgtcgcgacgatcctattcaccataaaaatactaaatatcttcctcaaccgaaaaaacctaatcgtcatcctcataacgatcgaacttatcctactcgccgtaaacctaaacctcgtcgccttctcgatcgcgcttcacgatctaataaatcaaatcttcgccatattcgtactaaccgtaaccgccgataaatcgacgatcgatctaacgatcctaatcatctatttccgtaaccgcgacaccatcgcgatcgacgacgtcaaccgaataaaaaaataatcgaattaatcctcgctatcgtcttcctaccgttactaaccgccgccattacaaaattcgacaacaaaaccatcgaaaacgtacccgccaaaatcgtcacgaccgacgcgctattcattttctacgcactatcataaccgatcttcatcgactatctatcgaaccataacgtcgtaactatcacacctatacttcactatatcaccaacgacaccatatcgatcgactaaacgctacgcgtcgactcgctaaccgcgatcatactaataatcatcaccaacgtatctacactcgtccacctctataacttatactatataaacgaaaaaccgaatcaaccgcgcttcttcgcctatctctacctcttcaccttcgcgatactaatactcgtaacgacgaacaatctaatccaaatattcttcgactaacaaaacgtaaatctcgcgtcctacctactaatcgacttctaattccgcaaaccttcgaccaataccgccgcgatcaaaacgttcgtcgtcaaccgcgtcgacgacctcgatttcatactcgacatcttcgacaccttcctaatattcgaaaccgtctcgatcccgacgatcctaaccgccgcgccgaacataacgaattcgaccatcgatttcctaaactatcgcttcgacacgataaccgtactctacctactactattcgtcgacgcgataaacaaatcgacgcaactcgaactccacacctaactaccgaacgcgataaaaaacccgaccccgatatcgacgctaatccacgcgacgaccataataaccgccgacgtattcataatataccgcctat

SEQ ID NO: 29051 - DNA, 1108 bp, Artificial Sequence
  chemically treated genomic DNA (Homo sapiens) CpG-island No: 29051
cgtcgcggcgattttgtttattatgggggtgttgggtattttttttaatcggaagaatttgatcgttatttttatggcgatcgaatttattttgttcgtcgtgaatttgaatttcgtcgttttttcggtcgcgttttacgatttggtgggttaggttttcgttatgttcgtgttgatcgtggtcgtcggtgaatcggcgatcggtttggcgattttggttatttattttcgtggtcgcggtattatcgcggtcgacgacgttaatcggatgaaggggtaatcgggttgattttcgttatcgtttttttgtcgttgttggtcgtcgttattgtagagttcggtaataaggttatcgagaacgtgttcgttaaggtcgttacgatcggcgcgttgtttattttttgcgtattgttatggtcgatttttatcggttatttgtcgggttatagcgtcgtgattgttatatttgtgttttattgtattattagcggtattatgtcggtcgattgggcgttgcgcgtcgattcgttgatcgcgattatgttggtggttattattagcgtatttgtattcgtttatttttatagtttgtgttatatgagcgaggagtcggattagtcgcgttttttcgtttatttttgtttttttattttcgcgatgttgatgttcgtgacggcggataatttggtttagatgtttttcggttggtaaggcgtgggtttcgcgttttatttgttgatcggtttttggtttcgtaagttttcggttaatgtcgtcgcgattaaggcgttcgtcgttaatcgcgtcggcgatttcggttttatgttcggtattttcggtatttttttggtgttcgggatcgtttcgatttcggcgattttggtcgtcgcgtcgggtatggcgggttcgattatcggttttttgggttatcgtttcgatacgatgatcgtgttttgtttgttgttgttcgtcggcgcgatgggtaagtcggcgtagttcgggttttatatttggttgtcggacgcgatggaaggttcgatttcggtgtcggcgttgatttacgcggcgattatggtgatcgtcggcgtgtttatggtgtgtcgtttgt

SEQ ID NO: 29052 - DNA, 1108 bp, Artificial Sequence
  chemically treated genomic DNA (Homo sapiens) CpG-island No: 29052
acaaacgacacaccataaacacgccgacgatcaccataatcgccgcgtaaatcaacgccgacaccgaaatcgaaccttccatcgcgtccgacaaccaaatataaaacccgaactacgccgacttacccatcgcgccgacgaacaacaacaaacaaaacacgatcatcgtatcgaaacgataacccaaaaaaccgataatcgaacccgccatacccgacgcgacgaccaaaatcgccgaaatcgaaacgatcccgaacaccaaaaaaataccgaaaataccgaacataaaaccgaaatcgccgacgcgattaacgacgaacgccttaatcgcgacgacattaaccgaaaacttacgaaaccaaaaaccgatcaacaaataaaacgcgaaacccacgccttaccaaccgaaaaacatctaaaccaaattatccgccgtcacgaacatcaacatcgcgaaaataaaaaaacaaaaataaacgaaaaaacgcgactaatccgactcctcgctcatataacacaaactataaaaataaacgaatacaaatacgctaataataaccaccaacataatcgcgatcaacgaatcgacgcgcaacgcccaatcgaccgacataataccgctaataatacaataaaacacaaatataacaatcacgacgctataacccgacaaataaccgataaaaatcgaccataacaatacgcaaaaaataaacaacgcgccgatcgtaacgaccttaacgaacacgttctcgataaccttattaccgaactctacaataacgacgaccaacaacgacaaaaaaacgataacgaaaatcaacccgattaccccttcatccgattaacgtcgtcgaccgcgataataccgcgaccacgaaaataaataaccaaaatcgccaaaccgatcgccgattcaccgacgaccacgatcaacacgaacataacgaaaacctaacccaccaaatcgtaaaacgcgaccgaaaaaacgacgaaattcaaattcacgacgaacaaaataaattcgatcgccataaaaataacgatcaaattcttccgattaaaaaaaatacccaacacccccataataaacaaaatcgccgcgacg

SEQ ID NO: 29053 - DNA, 911 bp, Artificial Sequence
  chemically treated genomic DNA (Homo sapiens) CpG-island No: 29053
taaagggaaattattaggtcggtatttagcggatcgtcgaatgggtgatcgtataggttaggaaggcgatgagggttagtaggaggaagaattggcgttgcggcggtatgttcggcgacgatttagttttcgtcggcgaacgaaaagaaggcgaggaagaaatagatgtagtttacgatcggaaatttttagtcggtatttagatcgattgtatagatgtttttggtcgaaagttattttattatttaattcgtcggtatcgtgacgacgtcgcgggtaacgttattgtcgatacggtggaaaggatagtcgtcgttgacgatcgatagtagcgattattatagggcgagtaattggtaggtgacgttgtttagttagtagttatgatcgatggaggtattcgtggcggtgtcgatcggttaatgtcggagtaatgatattgattatgaagtaattggttatagttatgcgagtatattagtattaggttagacgatcgatgcgtttcggtcggaacggggcgcgattcggaatgagtgtcgttggggtatattatttattttgtattcgggttatgatcgtattttagttttgtatcggggacgacgaagttgttttgttatagtttcgtttagtagtaatatgtttgtgcgtatgcgagatttaaaatcggtgtttttaggatatttttattgtggcgattgtttttatgcgatgttatagtggtatattagtttgtgtggcgttcggtggttacgatcgcgtcgcgttttttcgtagtagcgattggtacgcgagtttgttaattttcgtgattaatttatacgaaggagagttttgatgaaagcgttgcgtttttatgtcgttaaggatttgcggatcgaagatattttcgaaatcgatcgcgaaat

SEQ ID NO: 29054 - DNA, 911 bp, Artificial Sequence
  chemically treated genomic DNA (Homo sapiens) CpG-island No: 29054
atttcgcgatcgatttcgaaaatatcttcgatccgcaaatccttaacgacataaaaacgcaacgctttcatcaaaactctccttcgtataaattaatcacgaaaattaacaaactcgcgtaccaatcgctactacgaaaaaacgcgacgcgatcgtaaccaccgaacgccacacaaactaatataccactataacatcgcataaaaacaatcgccacaataaaaatatcctaaaaacaccgattttaaatctcgcatacgcacaaacatattactactaaacgaaactataacaaaacaacttcgtcgtccccgatacaaaactaaaatacgatcataacccgaatacaaaataaataatataccccaacgacactcattccgaatcgcgccccgttccgaccgaaacgcatcgatcgtctaacctaatactaatatactcgcataactataaccaattacttcataatcaatatcattactccgacattaaccgatcgacaccgccacgaatacctccatcgatcataactactaactaaacaacgtcacctaccaattactcgccctataataatcgctactatcgatcgtcaacgacgactatcctttccaccgtatcgacaataacgttacccgcgacgtcgtcacgataccgacgaattaaataataaaataactttcgaccaaaaacatctatacaatcgatctaaataccgactaaaaatttccgatcgtaaactacatctatttcttcctcgccttcttttcgttcgccgacgaaaactaaatcgtcgccgaacataccgccgcaacgccaattcttcctcctactaaccctcatcgccttcctaacctatacgatcacccattcgacgatccgctaaataccgacctaataatttcccttta

SEQ ID NO: 29055 - DNA, 911 bp, Artificial Sequence
  chemically treated genomic DNA (Homo sapiens) CpG-island No: 29055
gtttcgcgatcggtttcgggggtattttcgattcgtagatttttggcggtatgaaaacgtaacgtttttattagggttttttttcgtgtgagttgattacgagggttggtaagttcgcgtgttaatcgttgttacgaaggggcgcggcgcggtcgtggttatcgaacgttatataggttgatgtgttattgtggtatcgtatgggggtaatcgttatagtagaggtgttttaaaggtatcgattttggatttcgtatgcgtataagtatgttgttgttgagcgaggttatagtaagatagtttcgtcgttttcggtataagattgaagtgcggttataattcgaatataggatgagtagtatgttttaacggtatttatttcggatcgcgtttcgtttcggtcgggacgtatcgatcgtttgatttgatgttgatatattcgtataattatggttagttgttttatggttaatattattgtttcggtattggtcgatcggtatcgttacgggtgtttttatcgattataattattggttggataacgttatttgttaattgttcgttttatggtggtcgttgttgtcggtcgttaacggcggttattttttttatcgtatcgataatggcgttattcgcggcgtcgttacggtgtcgacgagttgggtgatgggatggttttcggttaagggtatttatgtagtcggtttggatatcgattgggaattttcgatcgtgggttgtatttatttttttttcgtttttttttcgttcgtcggcgagaattgggtcgtcgtcgggtatgtcgtcgtagcgttaatttttttttttgttgatttttatcgtttttttgatttatgcggttatttattcggcgattcgttggatatcggtttggtggtttttttttg

SEQ ID NO: 29056 - DNA, 911 bp, Artificial Sequence
  chemically treated genomic DNA (Homo sapiens) CpG-island No: 29056
caaaaaaaaaccaccaaaccgatatccaacgaatcgccgaataaataaccgcataaatcaaaaaaacgataaaaatcaacaaaaaaaaaaattaacgctacgacgacatacccgacgacgacccaattctcgccgacgaacgaaaaaaaaacgaaaaaaaaataaatacaacccacgatcgaaaattcccaatcgatatccaaaccgactacataaatacccttaaccgaaaaccatcccatcacccaactcgtcgacaccgtaacgacgccgcgaataacgccattatcgatacgataaaaaaaataaccgccgttaacgaccgacaacaacgaccaccataaaacgaacaattaacaaataacgttatccaaccaataattataatcgataaaaacacccgtaacgataccgatcgaccaataccgaaacaataatattaaccataaaacaactaaccataattatacgaatatatcaacatcaaatcaaacgatcgatacgtcccgaccgaaacgaaacgcgatccgaaataaataccgttaaaacatactactcatcctatattcgaattataaccgcacttcaatcttataccgaaaacgacgaaactatcttactataacctcgctcaacaacaacatacttatacgcatacgaaatccaaaatcgatacctttaaaacacctctactataacgattacccccatacgataccacaataacacatcaacctatataacgttcgataaccacgaccgcgccgcgccccttcgtaacaacgattaacacgcgaacttaccaaccctcgtaatcaactcacacgaaaaaaaaccctaataaaaacgttacgttttcataccgccaaaaatctacgaatcgaaaatacccccgaaaccgatcgcgaaac

SEQ ID NO: 29057 - DNA, 719 bp, Artificial Sequence
  chemically treated genomic DNA (Homo sapiens) CpG-island No: 29057
atatttcgtttcggtttcgggcgttttcgagtttcggtttcgcgtttttagtattgtttttgcggggtttcggggcgcgcgtcgtaggggagttgagatttcggcgttttacggttgtgggtgtaaagggggcgttcgttttcgtcgggttttttttcgtttcgcgtttcgttgttgttttcggattcgcggttttttgggagggcgggaaatattatcggtttcgttgcgtttttgggtgggtttttttttcgtcgttcgtgggaggggtcggtgggcgcgcggttttaaaagttcgagttcggtttattcggaggagttcggcggtttgcgcggcgttcgttgtaggttttgggggacggcggggtttgggggcgcgggtaggtgtgggatttgagttcggagttcggagcggagggttagaggcgtagtcgtaattttcggcgggaagtcgcggggcggggtttcgaggggcggggttgagaatagtcggtgtttgcggggtcgggggtcgtgagaggagcggttttgggggcgggggcggggaggagcgggtttttagagtgggtggtagaagcggtggggtggaattaggtagagtttgtagggtatagacgcgagatgggcggagttgggaagtggttttgtgggcggagttaagaggggcggggttttatggggcggggtttgtggggtttttttagatagaagtacgtggg

SEQ ID NO: 29058 - DNA, 719 bp, Artificial Sequence
  chemically treated genomic DNA (Homo sapiens) CpG-island No: 29058
cccacgtacttctatctaaaaaaaccccacaaaccccgccccataaaaccccgcccctcttaactccgcccacaaaaccacttcccaactccgcccatctcgcgtctataccctacaaactctacctaattccaccccaccgcttctaccacccactctaaaaacccgctcctccccgcccccgcccccaaaaccgctcctctcacgacccccgaccccgcaaacaccgactattctcaaccccgcccctcgaaaccccgccccgcgacttcccgccgaaaattacgactacgcctctaaccctccgctccgaactccgaactcaaatcccacacctacccgcgcccccaaaccccgccgtcccccaaaacctacaacgaacgccgcgcaaaccgccgaactcctccgaataaaccgaactcgaacttttaaaaccgcgcgcccaccgacccctcccacgaacgacgaaaaaaaaacccacccaaaaacgcaacgaaaccgataatatttcccgccctcccaaaaaaccgcgaatccgaaaacaacaacgaaacgcgaaacgaaaaaaaacccgacgaaaacgaacgccccctttacacccacaaccgtaaaacgccgaaatctcaactcccctacgacgcgcgccccgaaaccccgcaaaaacaatactaaaaacgcgaaaccgaaactcgaaaacgcccgaaaccgaaacgaaatat

SEQ ID NO: 29059 - DNA, 719 bp, Artificial Sequence
  chemically treated genomic DNA (Homo sapiens) CpG-island No: 29059
tttacgtgtttttgtttggaaaagttttataagtttcgttttataagatttcgttttttttagtttcgtttataaggttattttttagtttcgtttatttcgcgtttgtattttataggttttgtttggttttattttatcgtttttgttatttattttaaggattcgttttttttcgttttcgtttttaaagtcgttttttttacggttttcgatttcgtaggtatcgattgtttttagtttcgtttttcgaggtttcgtttcgcggtttttcgtcggggattgcggttgcgtttttgatttttcgtttcgggtttcgggtttaggttttatatttgttcgcgtttttaggtttcgtcgttttttagagtttgtagcgggcgtcgcgtaggtcgtcgggttttttcgggtgggtcgggttcgggtttttggagtcgcgcgtttatcgattttttttacgggcggcggggggagagtttatttagaggcgtagcggggtcggtggtgtttttcgtttttttagggggtcgcgggttcgggggtagtagcggggcgcggggcggagggaggttcggcgggaacgggcgttttttttgtatttatagtcgtggaacgtcgaggttttagtttttttacggcgcgcgtttcgagatttcgtaagggtagtgttggggacgcggggtcgagattcgaggacgttcgaggtcgggacggggtgt

SEQ ID NO: 29060 - DNA, 719 bp, Artificial Sequence
  chemically treated genomic DNA (Homo sapiens) CpG-island No: 29060
acaccccgtcccgacctcgaacgtcctcgaatctcgaccccgcgtccccaacactacccttacgaaatctcgaaacgcgcgccgtaaaaaaactaaaacctcgacgttccacgactataaatacaaaaaaaacgcccgttcccgccgaacctccctccgccccgcgccccgctactacccccgaacccgcgaccccctaaaaaaacgaaaaacaccaccgaccccgctacgcctctaaataaactctccccccgccgcccgtaaaaaaaatcgataaacgcgcgactccaaaaacccgaacccgacccacccgaaaaaacccgacgacctacgcgacgcccgctacaaactctaaaaaacgacgaaacctaaaaacgcgaacaaatataaaacctaaacccgaaacccgaaacgaaaaatcaaaaacgcaaccgcaatccccgacgaaaaaccgcgaaacgaaacctcgaaaaacgaaactaaaaacaatcgatacctacgaaatcgaaaaccgtaaaaaaaacgactttaaaaacgaaaacgaaaaaaaacgaatccttaaaataaataacaaaaacgataaaataaaaccaaacaaaacctataaaatacaaacgcgaaataaacgaaactaaaaaataaccttataaacgaaactaaaaaaaacgaaatcttataaaacgaaacttataaaacttttccaaacaaaaacacgtaaa

SEQ ID NO: 29061 - DNA, 515 bp, Artificial Sequence
  chemically treated genomic DNA (Homo sapiens) CpG-island No: 29061
gtttttcgggttttcgcgttttcgtgtgtaggtttttcgggttttcgcgttttcgtgtgtaggtttttcgggttttcgcgtttgtgtgtgtaggtttttcgggttttcgcgttttcgtgtgtaggtttttcgggttttcgcgttttcgtgtgtaggtttttcgggttttcgcgttttcgtgtgtaggtttttcgggttttcgcgttttcgtgtgtaggtttttcgggttttcgcgttttcgtgtgtaggtttttcgggttttcgcgttttcgtgtgtaggtttttcgggttttcgcgttttcgtgtgtaggtttttcgggttttcgcgtttgtgtgtgtaggtttttcgggttttcgcgttttcgtgtgtaggtttttcgggttttcgcgttttcgtgtgtaggtttttcgggttttcgcgttttcgtgtgtaggtttttcgggtttttgcgtttttgtgtgtaggtttaagtttgttaacgtttatgtacgttttagttttttagtttggattg

SEQ ID NO: 29062 - DNA, 515 bp, Artificial Sequence
  chemically treated genomic DNA (Homo sapiens) CpG-island No: 29062
caatccaaactaaaaaactaaaacgtacataaacgttaacaaacttaaacctacacacaaaaacgcaaaaacccgaaaaacctacacacgaaaacgcgaaaacccgaaaaacctacacacgaaaacgcgaaaacccgaaaaacctacacacgaaaacgcgaaaacccgaaaaacctacacacacaaacgcgaaaacccgaaaaacctacacacgaaaacgcgaaaacccgaaaaacctacacacgaaaacgcgaaaacccgaaaaacctacacacgaaaacgcgaaaacccgaaaaacctacacacgaaaacgcgaaaacccgaaaaacctacacacgaaaacgcgaaaacccgaaaaacctacacacgaaaacgcgaaaacccgaaaaacctacacacgaaaacgcgaaaacccgaaaaacctacacacacaaacgcgaaaacccgaaaaacctacacacgaaaacgcgaaaacccgaaaaacctacacacgaaaacgcgaaaacccgaaaaac

SEQ ID NO: 29063 - DNA, 515 bp, Artificial Sequence
  chemically treated genomic DNA (Homo sapiens) CpG-island No: 29063
tagtttaggttgagaggttgagacgtgtatggacgttggtaaatttgagtttgtatatagagacgtagaggttcgggggatttgtatacggagacgcggaggttcgggggatttgtatacggaggcgcggaggttcgggggatttgtatacggaggcgcggaggttcgggggatttgtatatatagacgcggaggttcgggggatttgtatacggaggcgcggaggttcgggggatttgtatacggaggcgcggaggttcgggggatttgtatacggaggcgcggaggttcgggggatttgtatacggaggcgcggaggttcgggggatttgtatacggaggcgcggaggttcgggggatttgtatacggaggcgcggaggttcgggggatttgtatacggaggcgcggaggttcgggggatttgtatatatagacgcggaggttcgggggatttgtatacggaggcgcggaggttcgggggatttgtatacggaggcgcggaggttcgggggat

SEQ ID NO: 29064 - DNA, 515 bp, Artificial Sequence
  chemically treated genomic DNA (Homo sapiens) CpG-island No: 29064
atcccccgaacctccgcgcctccgtatacaaatcccccgaacctccgcgcctccgtatacaaatcccccgaacctccgcgtctatatatacaaatcccccgaacctccgcgcctccgtatacaaatcccccgaacctccgcgcctccgtatacaaatcccccgaacctccgcgcctccgtatacaaatcccccgaacctccgcgcctccgtatacaaatcccccgaacctccgcgcctccgtatacaaatcccccgaacctccgcgcctccgtatacaaatcccccgaacctccgcgcctccgtatacaaatcccccgaacctccgcgtctatatatacaaatcccccgaacctccgcgcctccgtatacaaatcccccgaacctccgcgcctccgtatacaaatcccccgaacctccgcgtctccgtatacaaatcccccgaacctctacgtctctatatacaaactcaaatttaccaacgtccatacacgtctcaacctctcaacctaaacta

SEQ ID NO: 29065 - DNA, 694 bp, Artificial Sequence
  chemically treated genomic DNA (Homo sapiens) CpG-island No: 29065
tattgcggatcgggaatgttaggggaacgcgggtatcgtggatcgggaatgttaggggatcgtgggtatcgtcgatcgggaatgttaggggaatacgggtattgtcgatcgggaatgttaggggaacgggggtattgtagatcgggaatgttaggggaacgtgggtattgcggatcgggaatgttaggggaacgtgggtacggttgatcgggaatgttaggggaacgcgggtacggtcgatcgggaatgttaggggaacgtgggtattgtggatcgggaatgttaggggaacgcgggtacggttgatcgggaatgttaggggaacgcgggtattgcggatcgggaatgttaggggaatacgggtattgtcgatcgggaatgttaggggaacgtgggtacggtcgatcgggaatgttaggggaatacgggtattgtggatcgggaatgttaggggattatgggtattgtggattgggaatgttaggggaatacgggtacggcggatcgggaatgttaggggaacgtaggtacggttgatcgggaatgttaggggatcgcgggtattgtcgatcgggaatgtcgggaacgtaggtattgcggatcgggaatgttagtagaacgggggtattgcggatcgggaatgttagggtaagagggaagttgtttgttagtttgttatatgtttagttaatta

SEQ ID NO: 29066 - DNA, 694 bp, Artificial Sequence
  chemically treated genomic DNA (Homo sapiens) CpG-island No: 29066
taattaactaaacatataacaaactaacaaacaacttccctcttaccctaacattcccgatccgcaatacccccgttctactaacattcccgatccgcaatacctacgttcccgacattcccgatcgacaatacccgcgatcccctaacattcccgatcaaccgtacctacgttcccctaacattcccgatccgccgtacccgtattcccctaacattcccaatccacaatacccataatcccctaacattcccgatccacaatacccgtattcccctaacattcccgatcgaccgtacccacgttcccctaacattcccgatcgacaatacccgtattcccctaacattcccgatccgcaatacccgcgttcccctaacattcccgatcaaccgtacccgcgttcccctaacattcccgatccacaatacccacgttcccctaacattcccgatcgaccgtacccgcgttcccctaacattcccgatcaaccgtacccacgttcccctaacattcccgatccgcaatacccacgttcccctaacattcccgatctacaatacccccgttcccctaacattcccgatcgacaatacccgtattcccctaacattcccgatcgacgatacccacgatcccctaacattcccgatccacgatacccgcgttcccctaacattcccgatccgcaata

SEQ ID NO: 29067 - DNA, 694 bp, Artificial Sequence
  chemically treated genomic DNA (Homo sapiens) CpG-island No: 29067
taattagttaaatatatgataagttagtaaataattttttttttgttttgatattttcggttcgtagtgttttcgttttgttgatattttcggttcgtagtgtttgcgttttcgatattttcggtcggtagtgttcgcgattttttgatattttcggttagtcgtgtttgcgtttttttgatattttcggttcgtcgtgttcgtgtttttttggtatttttagtttatagtgtttatgattttttgatattttcggtttatagtgttcgtgtttttttggtattttcggtcggtcgtgtttacgtttttttgatattttcggtcggtagtgttcgtgtttttttggtattttcggttcgtagtgttcgcgtttttttggtattttcggttagtcgtgttcgcgtttttttgatattttcggtttatagtgtttacgtttttttgatattttcggtcggtcgtgttcgcgtttttttgatattttcggttagtcgtgtttacgtttttttgatattttcggttcgtagtgtttacgtttttttgatattttcggtttgtagtgttttcgtttttttgatattttcggtcggtagtgttcgtgtttttttgatattttcggtcggcggtgtttacgattttttggtattttcggtttacggtgttcgcgtttttttgatattttcggttcgtagtg

SEQ ID NO: 29068 - DNA, 694 bp, Artificial Sequence
  chemically treated genomic DNA (Homo sapiens) CpG-island No: 29068
cactacgaaccgaaaatatcaaaaaaacgcgaacaccgtaaaccgaaaataccaaaaaatcgtaaacaccgccgaccgaaaatatcaaaaaaacacgaacactaccgaccgaaaatatcaaaaaaacgaaaacactacaaaccgaaaatatcaaaaaaacgtaaacactacgaaccgaaaatatcaaaaaaacgtaaacacgactaaccgaaaatatcaaaaaaacgcgaacacgaccgaccgaaaatatcaaaaaaacgtaaacactataaaccgaaaatatcaaaaaaacgcgaacacgactaaccgaaaataccaaaaaaacgcgaacactacgaaccgaaaataccaaaaaaacacgaacactaccgaccgaaaatatcaaaaaaacgtaaacacgaccgaccgaaaataccaaaaaaacacgaacactataaaccgaaaatatcaaaaaatcataaacactataaactaaaaataccaaaaaaacacgaacacgacgaaccgaaaatatcaaaaaaacgcaaacacgactaaccgaaaatatcaaaaaatcgcgaacactaccgaccgaaaatatcgaaaacgcaaacactacgaaccgaaaatatcaacaaaacgaaaacactacgaaccgaaaatatcaaaacaaaaaaaaaattatttactaacttatcatatatttaactaatta

SEQ ID NO: 29069 - DNA, 1059 bp, Artificial Sequence
  chemically treated genomic DNA (Homo sapiens) CpG-island No: 29069
gttttcgcggtttaaaatcgaagcgggggcgagggggaggtagagttcgttttttgcgcgtcgcggttgggagggagaggaggtgggagagaaggaagaggcggaggaggtagcgggcgtcgaggttttgggattcgtaggtaagttagatcgacgcgtagagtcgggagttttatcgtagcggtagcggtagcggcgggttcgggtcggtttcgggggttgtttatttatatgagtattcgtttattcggcgagttttcgagtttaggcggcgcggttatggtcgagtttaagtcgttgtcgggggacgcgtatttggtattaagttacggttacgcggcggcggttgcgggtttcgtttacggggcggcgcgagaattcgaagcggttcgcggttacggtatttcgggttcgggcggcgattttttcgcggcgtttgtatttcgcgttttagtttaggcggcggagagtagcggcgaatagagcggggacgaggacgacgttttcgagtagcggcggcggcggcgcgggttagggagcgcggcggacgggcggcggcggtcgcgagagtagcggtttttgcggtttagtattaacgcgcgcgagcggcggcgtatgtacgatttaaacgacgcgttggacgggttgcgagtcgttattttttacgcgtatagttcgtcggtgcgtaagttttttaagatcgttacgttgttgttcgttaagaattatatttttatgtaggcgtaggttttggacgagatgcggcgtttggtggttttttttaattagggttagggtttggtcgcgttcgtaaacgtcgcgtttttgacgtttttcggttaggttattgtgtgtttttttttcgtaggcgtcgttttggggttttgttttgataagtgcgtcgtttttttcgggacgtttttcgcgttttgtaaatattgttacgagaagtcgtgatcgcgcgggttttcggttttttcgtacgcgtttttcgatcgtttttgtgattgtttttttgttcggataggaaaggtttggagggattttgtagattaggag

SEQ ID NO: 29070 - DNA, 1059 bp, Artificial Sequence
  chemically treated genomic DNA (Homo sapiens) CpG-island No: 29070
ctcctaatctacaaaatccctccaaacctttcctatccgaacaaaaaaacaatcacaaaaacgatcgaaaaacgcgtacgaaaaaaccgaaaacccgcgcgatcacgacttctcgtaacaatatttacaaaacgcgaaaaacgtcccgaaaaaaacgacgcacttatcaaaacaaaaccccaaaacgacgcctacgaaaaaaaaacacacaataacctaaccgaaaaacgtcaaaaacgcgacgtttacgaacgcgaccaaaccctaaccctaattaaaaaaaaccaccaaacgccgcatctcgtccaaaacctacgcctacataaaaatataattcttaacgaacaacaacgtaacgatcttaaaaaacttacgcaccgacgaactatacgcgtaaaaaataacgactcgcaacccgtccaacgcgtcgtttaaatcgtacatacgccgccgctcgcgcgcgttaatactaaaccgcaaaaaccgctactctcgcgaccgccgccgcccgtccgccgcgctccctaacccgcgccgccgccgccgctactcgaaaacgtcgtcctcgtccccgctctattcgccgctactctccgccgcctaaactaaaacgcgaaatacaaacgccgcgaaaaaatcgccgcccgaacccgaaataccgtaaccgcgaaccgcttcgaattctcgcgccgccccgtaaacgaaacccgcaaccgccgccgcgtaaccgtaacttaataccaaatacgcgtcccccgacaacgacttaaactcgaccataaccgcgccgcctaaactcgaaaactcgccgaataaacgaatactcatataaataaacaacccccgaaaccgacccgaacccgccgctaccgctaccgctacgataaaactcccgactctacgcgtcgatctaacttacctacgaatcccaaaacctcgacgcccgctacctcctccgcctcttccttctctcccacctcctctccctcccaaccgcgacgcgcaaaaaacgaactctacctccccctcgcccccgcttcgattttaaaccgcgaaaac

SEQ ID NO: 29071 - DNA, 1059 bp, Artificial Sequence
  chemically treated genomic DNA (Homo sapiens) CpG-island No: 29071
tttttggtttgtagggtttttttaggttttttttgttcgggtagagagatagttataggggcgatcggaggacgcgtgcgggagggtcgggggttcgcgcggttacggtttttcgtgatagtgtttgtaaagcgcggagggcgtttcggagaaggcggcgtatttgttagggtagggttttagggcggcgtttgcggagaaggggtatatagtggtttggtcgaagggcgttaagggcgcggcgtttacgggcgcggttaggttttggttttggttgaggaaggttattaggcgtcgtatttcgtttagggtttgcgtttgtatgaggatatagtttttggcgagtagtagcgtggcgattttggagagtttgcgtatcgacgggttgtgcgcgtaggggatgacggttcgtagttcgtttagcgcgtcgtttaggtcgtgtatgcgtcgtcgttcgcgcgcgttgatgttgagtcgtagagatcgttgttttcgcggtcgtcgtcgttcgttcgtcgcgttttttggttcgcgtcgtcgtcgtcgttgttcgaaggcgtcgttttcgttttcgttttgttcgtcgttgtttttcgtcgtttgagttggggcgcgaggtgtaggcgtcgcggggaggtcgtcgttcgggttcggagtgtcgtagtcgcgggtcgtttcgggttttcgcgtcgtttcgtaggcgagattcgtagtcgtcgtcgcgtagtcgtggtttagtgttaggtacgcgtttttcgatagcgatttgagttcggttatggtcgcgtcgtttgggttcgggggttcgtcgggtgggcggatgtttatgtgggtgagtagttttcgaggtcggttcgagttcgtcgttgtcgttgtcgttgcgatgaggttttcggttttgcgcgtcggtttggtttgtttgcgggttttagagtttcggcgttcgttgtttttttcgtttttttttttttttttatttttttttttttttagtcgcgacgcgtagggggcgggttttatttttttttcgttttcgtttcggttttaagtcgcggaggt

SEQ ID NO: 29072 - DNA, 1059 bp, Artificial Sequence
  chemically treated genomic DNA (Homo sapiens) CpG-island No: 29072
acctccgcgacttaaaaccgaaacgaaaacgaaaaaaaaataaaacccgccccctacgcgtcgcgactaaaaaaaaaaaaaaataaaaaaaaaaaaaaaaacgaaaaaaacaacgaacgccgaaactctaaaacccgcaaacaaaccaaaccgacgcgcaaaaccgaaaacctcatcgcaacgacaacgacaacgacgaactcgaaccgacctcgaaaactactcacccacataaacatccgcccacccgacgaacccccgaacccaaacgacgcgaccataaccgaactcaaatcgctatcgaaaaacgcgtacctaacactaaaccacgactacgcgacgacgactacgaatctcgcctacgaaacgacgcgaaaacccgaaacgacccgcgactacgacactccgaacccgaacgacgacctccccgcgacgcctacacctcgcgccccaactcaaacgacgaaaaacaacgacgaacaaaacgaaaacgaaaacgacgccttcgaacaacgacgacgacgacgcgaaccaaaaaacgcgacgaacgaacgacgacgaccgcgaaaacaacgatctctacgactcaacatcaacgcgcgcgaacgacgacgcatacacgacctaaacgacgcgctaaacgaactacgaaccgtcatcccctacgcgcacaacccgtcgatacgcaaactctccaaaatcgccacgctactactcgccaaaaactatatcctcatacaaacgcaaaccctaaacgaaatacgacgcctaataaccttcctcaaccaaaaccaaaacctaaccgcgcccgtaaacgccgcgcccttaacgcccttcgaccaaaccactatataccccttctccgcaaacgccgccctaaaaccctaccctaacaaatacgccgccttctccgaaacgccctccgcgctttacaaacactatcacgaaaaaccgtaaccgcgcgaacccccgaccctcccgcacgcgtcctccgatcgcccctataactatctctctacccgaacaaaaaaaacctaaaaaaaccctacaaaccaaaaa

SEQ ID NO: 29073 - DNA, 729 bp, Artificial Sequence
  chemically treated genomic DNA (Homo sapiens) CpG-island No: 29073
gcgggaagcgttaaggtcgtcggggcgcgggattgagttcgagagtcggacgttggattttgcgttcgggaattcgcggtatttattgggtattgtcgggatttagtaagtttaggaacgggggtgggtagagtatttttcgggtattgtcgttcgtttttaaaagaagattatcgcggggttttagggttacggcgaggacgggtattggttagatttcggataggcggttttggtttcgggcgtacgaaaggtggagacgaagaaaagtcggatttattggtttttgatttttttgtagtgggtttcgcgttttcgttttagtcggtttttcgtgttaaattgtagggtagtgttttgtttttgaggacgcgcgtggtcggtattttttatttcggtgatttcgagatttcgtagttttgcggagagtttacgatggtcgtttgtagaggagttggatcgcgggcgtaggaagatttcggggaaggttttttttaagtaggagtttgttttatttatttgggaattggacgtcgtcgtcggttgtttcgaagtttgaggaatttgttttttaaatgttttttggtttttttttttcgtcgttattcgttgtttgggacgttcgcggggtggagttggatggagatcgttttgcgggttttttgtttcggggggttgcgtggaggagggtttttatagttcgcgttttatttaattttgacggttagg

SEQ ID NO: 29074 - DNA, 729 bp, Artificial Sequence
  chemically treated genomic DNA (Homo sapiens) CpG-island No: 29074
cctaaccgtcaaaattaaataaaacgcgaactataaaaaccctcctccacgcaaccccccgaaacaaaaaacccgcaaaacgatctccatccaactccaccccgcgaacgtcccaaacaacgaataacgacgaaaaaaaaaaaccaaaaaacatttaaaaaacaaattcctcaaacttcgaaacaaccgacgacgacgtccaattcccaaataaataaaacaaactcctacttaaaaaaaaccttccccgaaatcttcctacgcccgcgatccaactcctctacaaacgaccatcgtaaactctccgcaaaactacgaaatctcgaaatcaccgaaataaaaaataccgaccacgcgcgtcctcaaaaacaaaacactaccctacaatttaacacgaaaaaccgactaaaacgaaaacgcgaaacccactacaaaaaaatcaaaaaccaataaatccgacttttcttcgtctccacctttcgtacgcccgaaaccaaaaccgcctatccgaaatctaaccaatacccgtcctcgccgtaaccctaaaaccccgcgataatcttcttttaaaaacgaacgacaatacccgaaaaatactctacccacccccgttcctaaacttactaaatcccgacaatacccaataaataccgcgaattcccgaacgcaaaatccaacgtccgactctcgaactcaatcccgcgccccgacgaccttaacgcttcccgc

SEQ ID NO: 29075 - DNA, 729 bp, Artificial Sequence
  chemically treated genomic DNA (Homo sapiens) CpG-island No: 29075
tttgatcgttagggttaagtagggcgcgggttgtgaggatttttttttacgtagtttttcgaggtagagggttcgtaaagcggtttttatttaattttatttcgcggacgttttaggtagcggatggcggcgggggggggaggttaggggatatttaggggataaattttttagatttcgaggtagtcggcgacggcgtttaatttttaaataaatagaataaatttttatttggaaaaggtttttttcggggtttttttgcgttcgcggtttagtttttttgtagacggttatcgtgggtttttcgtagggttgcggagtttcggagttatcgaggtgggaggtgtcggttacgcgcgtttttaggaatagagtattgttttgtagtttagtacgaagggtcggttggagcgggagcgcgaggtttattgtaagaggattaggagttagtaagttcggttttttttcgtttttatttttcgtgcgttcggggttaggatcgtttgttcggaatttgattagtgttcgttttcgtcgtggttttgggatttcgcggtggtttttttttggggacgaacggtagtgttcgaaggatgttttatttattttcgtttttagatttgttgggtttcgataatatttagtgggtgtcgcgagttttcgggcgtagagtttagcgttcggttttcgagtttaatttcgcgtttcgacggttttggcgtttttcgt

SEQ ID NO: 29076 - DNA, 729 bp, Artificial Sequence
  chemically treated genomic DNA (Homo sapiens) CpG-island No: 29076
acgaaaaacgccaaaaccgtcgaaacgcgaaattaaactcgaaaaccgaacgctaaactctacgcccgaaaactcgcgacacccactaaatattatcgaaacccaacaaatctaaaaacgaaaataaataaaacatccttcgaacactaccgttcgtccccaaaaaaaaaccaccgcgaaatcccaaaaccacgacgaaaacgaacactaatcaaattccgaacaaacgatcctaaccccgaacgcacgaaaaataaaaacgaaaaaaaaccgaacttactaactcctaatcctcttacaataaacctcgcgctcccgctccaaccgacccttcgtactaaactacaaaacaatactctattcctaaaaacgcgcgtaaccgacacctcccacctcgataactccgaaactccgcaaccctacgaaaaacccacgataaccgtctacaaaaaaactaaaccgcgaacgcaaaaaaaccccgaaaaaaaccttttccaaataaaaatttattctatttatttaaaaattaaacgccgtcgccgactacctcgaaatctaaaaaatttatcccctaaatatcccctaacctcccccccccgccgccatccgctacctaaaacgtccgcgaaataaaattaaataaaaaccgctttacgaaccctctacctcgaaaaactacgtaaaaaaaaatcctcacaacccgcgccctacttaaccctaacgatcaaa

SEQ ID NO: 29077 - DNA, 1174 bp, Artificial Sequence
  chemically treated genomic DNA (Homo sapiens) CpG-island No: 29077
ggggttatcgcggcggcgaacgtttcggatttcgtatttcggtgattttttgggatgaatcgaagtcggattcgtattttggtcgtaataagcgcgttttacgtcgttacgtattagcggtgattttcgagttttttgtcgttttggttttttcgtaggcgggtttcgaggttttcgtagggagtttagggttacggttacgtgtagtcgttttcgagttcgagtttgtaggttcggggttcggttcgcgttttggtggcgttcggcgaggttgtagcgcgtaaagtttttattttaagttttcgtcgcggcgttttcgtttcggagttggttcggtcgcggttttcgtttttttcggttgtttacgggttcggggcgaggacgcgagaggggtttggaagtcgttcggggagttcgttttgtttttcggagtcgtcgttaaatttcggtttcggggttcggtttagttttcgttttcggagttacggtcgtttcgtttttgtttttcggttttcgtcgggtttcgagtgcgtcgggagcgcggcgtagtagtcgtcgagggagggagcgaggtaggaggcgggacggagggaggggattgagcgcggggcggggagaaggggcgggtagtcgaaagcgtagcgtttggtttcgtttcgtttcgggatagtggtagcggcgttatcgttacggggcgtttaggcgtttaatcgggatttcgtattttggattcgggggttttggcgcgtttgttggattgcgtttttcgcggttagtttttgagttcgcgttcgggattgttcgcgttacgttttttttttcgttgttttttttttcgtttgtttttttaggagcgattattttgcggttttttcgtttgtacgcgatagtttttaaggttttcgcgtttcgttgttttggagttttacgtattaggcggcgcggtagttttttagggtcgcgcgttttgttagtttttttcgcggtgtaagtgtttcggtggtttcgggttcgcgtttttagtagtatcgttttagggtttatatgtgttagatattaaaattttatttttcgttgtttcggggtcgcgttttacgcgtttatatattttgggaattatatgcgttatgttttttgtttttttttggaagttttggaagtttaagtgtattgt

SEQ ID NO: 29078 - DNA, 1174 bp, Artificial Sequence
  chemically treated genomic DNA (Homo sapiens) CpG-island No: 29078
acaatacacttaaacttccaaaacttccaaaaaaaaacaaaaaacataacgcatataattcccaaaatatataaacgcgtaaaacgcgaccccgaaacaacgaaaaataaaattttaatatctaacacatataaaccctaaaacgatactactaaaaacgcgaacccgaaaccaccgaaacacttacaccgcgaaaaaaactaacaaaacgcgcgaccctaaaaaactaccgcgccgcctaatacgtaaaactccaaaacaacgaaacgcgaaaaccttaaaaactatcgcgtacaaacgaaaaaaccgcaaaataatcgctcctaaaaaaacaaacgaaaaaaaaaacaacgaaaaaaaaaacgtaacgcgaacaatcccgaacgcgaactcaaaaactaaccgcgaaaaacgcaatccaacaaacgcgccaaaacccccgaatccaaaatacgaaatcccgattaaacgcctaaacgccccgtaacgataacgccgctaccactatcccgaaacgaaacgaaaccaaacgctacgctttcgactacccgccccttctccccgccccgcgctcaatcccctccctccgtcccgcctcctacctcgctccctccctcgacgactactacgccgcgctcccgacgcactcgaaacccgacgaaaaccgaaaaacaaaaacgaaacgaccgtaactccgaaaacgaaaactaaaccgaaccccgaaaccgaaatttaacgacgactccgaaaaacaaaacgaactccccgaacgacttccaaacccctctcgcgtcctcgccccgaacccgtaaacaaccgaaaaaaacgaaaaccgcgaccgaaccaactccgaaacgaaaacgccgcgacgaaaacttaaaataaaaactttacgcgctacaacctcgccgaacgccaccaaaacgcgaaccgaaccccgaacctacaaactcgaactcgaaaacgactacacgtaaccgtaaccctaaactccctacgaaaacctcgaaacccgcctacgaaaaaaccaaaacgacaaaaaactcgaaaatcaccgctaatacgtaacgacgtaaaacgcgcttattacgaccaaaatacgaatccgacttcgattcatcccaaaaaatcaccgaaatacgaaatccgaaacgttcgccgccgcgataacccc

SEQ ID NO: 29079 - DNA, 1174 bp, Artificial Sequence
  chemically treated genomic DNA (Homo sapiens) CpG-island No: 29079
gtagtgtatttggatttttaggatttttagggaaaggtaggagatatggcgtatgtggtttttaggatgtgtaagcgcgtggagcgcggtttcggggtagcggagagtggggttttaatatttagtatatgtagattttggggcggtgttgttaggggcgcggattcgggattatcggagtatttgtatcgcggggaaagttgatagggcgcgcgattttaggaggttgtcgcgtcgtttggtgcgtgaagttttagggtagcggagcgcggggattttgaaggttgtcgcgtgtaggcgaaggggtcgtagggtggtcgtttttgggagagtagacggggaagaaggtaacgggagggagggcgtagcgcgagtagtttcggacgcgggtttaggaattggtcgcgaggagcgtaatttagtaggcgcgttagggttttcggatttaaggtgcggggtttcgattgggcgtttggacgtttcgtgacggtggcgtcgttgttattgtttcgaagcgaggcgaggttaggcgttgcgttttcggttgttcgtttttttttttcgtttcgcgtttagtttttttttttcgtttcgttttttgtttcgttttttttttcggcggttgttgcgtcgcgttttcggcgtattcggagttcggcggggatcgggaggtaaagacggggcggtcgtggtttcgagggcgggagttgagtcgggtttcgggatcgaagtttggcggcggtttcgggaggtagagcgggtttttcgggcgatttttaggtttttttcgcgttttcgtttcggattcgtgggtagtcggggggaacggaagtcgcggtcgggttaatttcgaggcggggacgtcgcgacgggaatttgaggtgggaattttgcgcgttgtagtttcgtcgggcgttattaaagcgcgaatcggatttcgagtttgtaaattcgggttcgggggcggttgtacgtggtcgtggttttgaattttttgcgggggtttcgaaattcgtttgcggggaggttagggcgatagaggattcgggagttatcgttggtgcgtggcggcgtggagcgcgtttgttacggttaaggtgcgggttcggtttcggtttattttaaggggttatcgggatgcgaagttcgggacgttcgtcgtcgcggtgatttt

SEQ ID NO: 29080 - DNA, 1174 bp, Artificial Sequence
  chemically treated genomic DNA (Homo sapiens) CpG-island No: 29080
aaaatcaccgcgacgacgaacgtcccgaacttcgcatcccgataaccccttaaaataaaccgaaaccgaacccgcaccttaaccgtaacaaacgcgctccacgccgccacgcaccaacgataactcccgaatcctctatcgccctaacctccccgcaaacgaatttcgaaacccccgcaaaaaattcaaaaccacgaccacgtacaaccgcccccgaacccgaatttacaaactcgaaatccgattcgcgctttaataacgcccgacgaaactacaacgcgcaaaattcccacctcaaattcccgtcgcgacgtccccgcctcgaaattaacccgaccgcgacttccgttccccccgactacccacgaatccgaaacgaaaacgcgaaaaaaacctaaaaatcgcccgaaaaacccgctctacctcccgaaaccgccgccaaacttcgatcccgaaacccgactcaactcccgccctcgaaaccacgaccgccccgtctttacctcccgatccccgccgaactccgaatacgccgaaaacgcgacgcaacaaccgccgaaaaaaaaaacgaaacaaaaaacgaaacgaaaaaaaaaaactaaacgcgaaacgaaaaaaaaaaacgaacaaccgaaaacgcaacgcctaacctcgcctcgcttcgaaacaataacaacgacgccaccgtcacgaaacgtccaaacgcccaatcgaaaccccgcaccttaaatccgaaaaccctaacgcgcctactaaattacgctcctcgcgaccaattcctaaacccgcgtccgaaactactcgcgctacgccctccctcccgttaccttcttccccgtctactctcccaaaaacgaccaccctacgaccccttcgcctacacgcgacaaccttcaaaatccccgcgctccgctaccctaaaacttcacgcaccaaacgacgcgacaacctcctaaaatcgcgcgccctatcaactttccccgcgatacaaatactccgataatcccgaatccgcgcccctaacaacaccgccccaaaatctacatatactaaatattaaaaccccactctccgctaccccgaaaccgcgctccacgcgcttacacatcctaaaaaccacatacgccatatctcctacctttccctaaaaatcctaaaaatccaaatacactac

SEQ ID NO: 29081 - DNA, 561 bp, Artificial Sequence
  chemically treated genomic DNA (Homo sapiens) CpG-island No: 29081
ataagtcgtgttttatcgggttggatttaagacgatagttatcggataaggcgtagcggtcgggttgaacggggggggattttttagagtcgatttgtaggtatgtaagtttggtattggtcgtcgttttataacgtcgtgattgggaaaaattttggcgttatttaatttaatcgttttgtagtatatttttttttcgttagttggcgtaatagcgaagaaggttcgtatcgatcgttttttttaatagttgcgtagtttgaatggggaatggcgttttgatgcgggattttttttttacgtatttgtgcgggattttatatcgtatatggggtatttttagtataatttgttttgatgtcgtatagataagttagtttcgatattcgttaatattcgttgacgcgttttgacgggtttgtttgttttcggtattcgtttatagataagttgtgatcgttttcgggagttgtatgtgttagaggatgttatcgttattatcgaaacgcgcgagacgaaagggtttcgtgatacgttttattattataggttaatgtcgtg

SEQ ID NO: 29082 - DNA, 561 bp, Artificial Sequence
  chemically treated genomic DNA (Homo sapiens) CpG-island No: 29082
cacgacattaacctataataataaaacgtatcacgaaaccctttcgtctcgcgcgtttcgataataacgataacatcctctaacacatacaactcccgaaaacgatcacaacttatctataaacgaataccgaaaacaaacaaacccgtcaaaacgcgtcaacgaatattaacgaatatcgaaactaacttatctatacgacatcaaaacaaattatactaaaaataccccatatacgatataaaatcccgcacaaatacgtaaaaaaaaaatcccgcatcaaaacgccattccccattcaaactacgcaactattaaaaaaaacgatcgatacgaaccttcttcgctattacgccaactaacgaaaaaaaaatatactacaaaacgattaaattaaataacgccaaaatttttcccaatcacgacgttataaaacgacgaccaataccaaacttacatacctacaaatcgactctaaaaaatccccccccgttcaacccgaccgctacgccttatccgataactatcgtcttaaatccaacccgataaaacacgacttat

SEQ ID NO: 29083 - DNA, 561 bp, Artificial Sequence
  chemically treated genomic DNA (Homo sapiens) CpG-island No: 29083
tacgatattaatttataataatagggcgtattacgaggttttttcgtttcgcgcgtttcggtgatgacggtgatattttttgatatatgtagttttcgaagacggttatagtttgtttgtaagcggatgtcgggagtagataagttcgttagggcgcgttagcgggtgttggcgggtgtcggggttggtttatttatgcggtattagagtagattgtattgagagtgttttatatgcggtgtaaaatttcgtatagatgcgtaagaagaaaatttcgtattagggcgttattttttatttaggttgcgtaattgttggaaagggcgatcggtgcgggtttttttcgttattacgttagttggcgaaagggggatgtgttgtaaggcgattaagttgggtaacgttagggttttttttagttacgacgttgtaaaacgacggttagtgttaagtttgtatgtttgtaggtcgattttagaggattttttttcgtttagttcgatcgttgcgttttattcggtaattatcgttttgagtttaattcggtaagatacgatttat

SEQ ID NO: 29084 - DNA, 561 bp, Artificial Sequence
  chemically treated genomic DNA (Homo sapiens) CpG-island No: 29084
ataaatcgtatcttaccgaattaaactcaaaacgataattaccgaataaaacgcaacgatcgaactaaacgaaaaaaaatcctctaaaatcgacctacaaacatacaaacttaacactaaccgtcgttttacaacgtcgtaactaaaaaaaaccctaacgttacccaacttaatcgccttacaacacatccccctttcgccaactaacgtaataacgaaaaaaacccgcaccgatcgccctttccaacaattacgcaacctaaataaaaaataacgccctaatacgaaattttcttcttacgcatctatacgaaattttacaccgcatataaaacactctcaatacaatctactctaataccgcataaataaaccaaccccgacacccgccaacacccgctaacgcgccctaacgaacttatctactcccgacatccgcttacaaacaaactataaccgtcttcgaaaactacatatatcaaaaaatatcaccgtcatcaccgaaacgcgcgaaacgaaaaaacctcgtaatacgccctattattataaattaatatcgta

SEQ ID NO: 29085 - DNA, 1026 bp, Artificial Sequence
  chemically treated genomic DNA (Homo sapiens) CpG-island No: 29085
tttttttcgttttcgcgtagttttacgtcgggcggaatggggggcggcgggggcgggcgggttcggtttgttcgcgggtgggtaggacgtttttatttttcgttttttatattcgtaaattcgtaggtatagttttcgttatcgttttattcgaattttagaatcggaatttggtcgtttattcggcgttcggggtcggttgcgggaaacgttcgtatagatagagataggcgcgtattcgggggcgtattcggggttatatacgtttttttaggcgatggggtttaggcggtttcgttcgaaggttttcgttcggttagtttatttagtcgttgtttcgtatttgttttcgtcgtttcgattcgcggtcgtttttcgcgtacgtatatcggggacgggattcggcgtcgcgattttttacgtttcgtaggcgacgttattttcggtcgtagtagttcggggttcgaggtattttttttcggagttggcgcgggatttagcgaacgggtttcggggcggagggacgtttcgggattttatagtcgtcgtgggtcgggtatcgggggttttaggaggttcgcggaggggtcgttatttattagttgaaaagcgtaaaggacgacgagcgcgtagcggtcggagtaggagtttattggtgttcgtttatataggaggttttcgggtgtttcgcgtttggttttcgttttcgtttcgttcgttttatacgcgtagtagtttcgatttcgtttttttcgtatttcgtttttttttttttttcgtaattttcggtttagttttagtttcgggtaatagttgcgttgcgtttttttttttattttcgtttgcggtttttgggggtttcgcgtcggtcggagagggggatcgtttttaaaggggcgatggcgcggtttttcgggtagcgaggggcggcgtcgcggttttaggatagatttgtagttgaggggagttcgttttggacgcggtagggatgatcggcgttcgtttttttttgtaggatgatttgtt

SEQ ID NO: 29086 - DNA, 1026 bp, Artificial Sequence
  chemically treated genomic DNA (Homo sapiens) CpG-island No: 29086
aacaaatcatcctacaaaaaaaaacgaacgccgatcatccctaccgcgtccaaaacgaactcccctcaactacaaatctatcctaaaaccgcgacgccgcccctcgctacccgaaaaaccgcgccatcgcccctttaaaaacgatccccctctccgaccgacgcgaaacccccaaaaaccgcaaacgaaaataaaaaaaaaaacgcaacgcaactattacccgaaactaaaactaaaccgaaaattacgaaaaaaaaaaaaaaacgaaatacgaaaaaaacgaaatcgaaactactacgcgtataaaacgaacgaaacgaaaacgaaaaccaaacgcgaaacacccgaaaacctcctatataaacgaacaccaataaactcctactccgaccgctacgcgctcgtcgtcctttacgcttttcaactaataaataacgacccctccgcgaacctcctaaaacccccgatacccgacccacgacgactataaaatcccgaaacgtccctccgccccgaaacccgttcgctaaatcccgcgccaactccgaaaaaaaatacctcgaaccccgaactactacgaccgaaaataacgtcgcctacgaaacgtaaaaaatcgcgacgccgaatcccgtccccgatatacgtacgcgaaaaacgaccgcgaatcgaaacgacgaaaacaaatacgaaacaacgactaaataaactaaccgaacgaaaaccttcgaacgaaaccgcctaaaccccatcgcctaaaaaaacgtatataaccccgaatacgcccccgaatacgcgcctatctctatctatacgaacgtttcccgcaaccgaccccgaacgccgaataaacgaccaaattccgattctaaaattcgaataaaacgataacgaaaactatacctacgaatttacgaatataaaaaacgaaaaataaaaacgtcctacccacccgcgaacaaaccgaacccgcccgcccccgccgccccccattccgcccgacgtaaaactacgcgaaaacgaaaaaaa

SEQ ID NO: 29087 - DNA, 1026 bp, Artificial Sequence
  chemically treated genomic DNA (Homo sapiens) CpG-island No: 29087
ggtaggttattttgtaggagggggcggacgtcggttatttttgtcgcgtttagggcgggttttttttagttgtaggtttgttttggggtcgcggcgtcgtttttcgttattcgagaggtcgcgttatcgtttttttaagaacggttttttttttcggtcggcgcgaagtttttaggggtcgtaggcgggggtgggaggggagacgtagcgtagttgttattcggggttggggttgggtcgggggttgcggggaggaggggggaacgggatgcggagggggcggggtcgaggttgttgcgcgtgtggagcgggcggagcgggggcgggggttaagcgcggggtattcgggggttttttgtataggcgggtattaatgggtttttgtttcggtcgttgcgcgttcgtcgttttttgcgttttttagttggtgagtggcgattttttcgcgagttttttggagttttcggtgttcgatttacggcggttgtggggtttcgaagcgttttttcgtttcggggttcgttcgttgggtttcgcgttagtttcgaggggggatgtttcggatttcgggttgttacggtcgaaggtggcgtcgtttgcggggcgtggggagtcgcggcgtcgggtttcgttttcggtgtgcgtgcgcggggggcggtcgcgggtcggagcggcggggataggtgcggggtagcggttggatgggttggtcggacggaagttttcgggcggggtcgtttggattttatcgtttggggaggcgtgtgtggtttcgggtgcgttttcgggtgcgcgtttgtttttgtttgtgcgagcgtttttcgtagtcggtttcgggcgtcgagtgagcggttaagtttcgattttgagattcgggtggggcgatgacggaggttgtgtttgcgagtttgcgagtgtagggggcggggggtgagaacgttttgtttattcgcgagtaaatcggattcgttcgttttcgtcgttttttatttcgttcggcgtggagttacgcggaggcgagaaggg

SEQ ID NO: 29088 - DNA, 1026 bp, Artificial Sequence
  chemically treated genomic DNA (Homo sapiens) CpG-island No: 29088
cccttctcgcctccgcgtaactccacgccgaacgaaataaaaaacgacgaaaacgaacgaatccgatttactcgcgaataaacaaaacgttctcaccccccgccccctacactcgcaaactcgcaaacacaacctccgtcatcgccccacccgaatctcaaaatcgaaacttaaccgctcactcgacgcccgaaaccgactacgaaaaacgctcgcacaaacaaaaacaaacgcgcacccgaaaacgcacccgaaaccacacacgcctccccaaacgataaaatccaaacgaccccgcccgaaaacttccgtccgaccaacccatccaaccgctaccccgcacctatccccgccgctccgacccgcgaccgccccccgcgcacgcacaccgaaaacgaaacccgacgccgcgactccccacgccccgcaaacgacgccaccttcgaccgtaacaacccgaaatccgaaacatcccccctcgaaactaacgcgaaacccaacgaacgaaccccgaaacgaaaaaacgcttcgaaaccccacaaccgccgtaaatcgaacaccgaaaactccaaaaaactcgcgaaaaaatcgccactcaccaactaaaaaacgcaaaaaacgacgaacgcgcaacgaccgaaacaaaaacccattaatacccgcctatacaaaaaacccccgaataccccgcgcttaacccccgcccccgctccgcccgctccacacgcgcaacaacctcgaccccgccccctccgcatcccgttcccccctcctccccgcaacccccgacccaaccccaaccccgaataacaactacgctacgtctcccctcccacccccgcctacgacccctaaaaacttcgcgccgaccgaaaaaaaaaaccgttcttaaaaaaacgataacgcgacctctcgaataacgaaaaacgacgccgcgaccccaaaacaaacctacaactaaaaaaaacccgccctaaacgcgacaaaaataaccgacgtccgccccctcctacaaaataacctacc

SEQ ID NO: 29089 - DNA, 656 bp, Artificial Sequence
  chemically treated genomic DNA (Homo sapiens) CpG-island No: 29089
tcgtttcgtagatttcgtttttttgtcggttttttatggttttcggtttttttatttgcgtttttttgttcggttgttttagtttcgtagttttcgttttaggtttttattcgtttcgttttcgttgttaggttttcggtgaacgcgtcgttttaaaagtattttagtttggtttcgtaggatgaacggacgtttttttcgttcggtttttaaaagttgtcgtttttcgcggttattacgattagttgcggttcggggttcggggtgggagttggattgcgtggttgcgcgtttttatggcgatcgggcgggtgcgcgcgttaggggttggggtattgaggcggaagtttcgtttttgtcgttttcgtgagattttgtaaagcgtaacgtagtcggaagttggtggcggttggtgggcgatcgggcgtatttttattgtagtgcggcggttttatttcggttttggtttgatataggcggttttgttcgtttttttttttaggtaagcgcgcggttcggcggcgcgggttcggtttgaggtttcggttgtcgcggcgtcgttttcggttttcgcgggcggatttttttgtcgtagttttttttattcggatttcgttttattttgaggttgttgttttagagtttgggggcgttta

SEQ ID NO: 29090 - DNA, 656 bp, Artificial Sequence
  chemically treated genomic DNA (Homo sapiens) CpG-island No: 29090
taaacgcccccaaactctaaaacaacaacctcaaaataaaacgaaatccgaataaaaaaaactacgacaaaaaaatccgcccgcgaaaaccgaaaacgacgccgcgacaaccgaaacctcaaaccgaacccgcgccgccgaaccgcgcgcttacctaaaaaaaaaaacgaacaaaaccgcctatatcaaaccaaaaccgaaataaaaccgccgcactacaataaaaatacgcccgatcgcccaccaaccgccaccaacttccgactacgttacgctttacaaaatctcacgaaaacgacaaaaacgaaacttccgcctcaataccccaacccctaacgcgcgcacccgcccgatcgccataaaaacgcgcaaccacgcaatccaactcccaccccgaaccccgaaccgcaactaatcgtaataaccgcgaaaaacgacaacttttaaaaaccgaacgaaaaaaacgtccgttcatcctacgaaaccaaactaaaatacttttaaaacgacgcgttcaccgaaaacctaacaacgaaaacgaaacgaataaaaacctaaaacgaaaactacgaaactaaaacaaccgaacaaaaaaacgcaaataaaaaaaccgaaaaccataaaaaaccgacaaaaaaacgaaatctacgaaacga

SEQ ID NO: 29091 - DNA, 656 bp, Artificial Sequence
  chemically treated genomic DNA (Homo sapiens) CpG-island No: 29091
tgggcgtttttaagttttggggtagtagttttagggtggagcggggttcgggtggaggaggttgcggtagggaggttcgttcgcgaaggtcggggacgacgtcgcggtagtcggggttttaggtcgagttcgcgtcgtcgagtcgcgcgtttatttggagggaggggcgggtagggtcgtttgtgttaggttagggtcgaggtagggtcgtcgtattgtaatgaggatgcgttcggtcgtttattagtcgttattagttttcggttacgttgcgttttgtaaggttttacgggagcggtaagggcgggattttcgttttagtgttttagtttttgacgcgcgtattcgttcggtcgttatggggacgcgtagttacgtagtttaatttttatttcgggtttcggatcgtagttggtcgtagtggtcgcggaggacggtagtttttgggggtcgggcgggagaagcgttcgtttattttgcggaattaagttgaggtgtttttgggacggcgcgtttatcgggggtttgataacgggggcggggcgggtgggggtttggggcgggagttgcggggttgggatagtcgggtaggaggacgtaggtaggaggatcgggggttatggaggatcggtaggggagcgaggtttacggggcgg

SEQ ID NO: 29092 - DNA, 656 bp, Artificial Sequence
  chemically treated genomic DNA (Homo sapiens) CpG-island No: 29092
ccgccccgtaaacctcgctcccctaccgatcctccataacccccgatcctcctacctacgtcctcctacccgactatcccaaccccgcaactcccgccccaaacccccacccgccccgcccccgttatcaaacccccgataaacgcgccgtcccaaaaacacctcaacttaattccgcaaaataaacgaacgcttctcccgcccgacccccaaaaactaccgtcctccgcgaccactacgaccaactacgatccgaaacccgaaataaaaattaaactacgtaactacgcgtccccataacgaccgaacgaatacgcgcgtcaaaaactaaaacactaaaacgaaaatcccgcccttaccgctcccgtaaaaccttacaaaacgcaacgtaaccgaaaactaataacgactaataaacgaccgaacgcatcctcattacaatacgacgaccctacctcgaccctaacctaacacaaacgaccctacccgcccctccctccaaataaacgcgcgactcgacgacgcgaactcgacctaaaaccccgactaccgcgacgtcgtccccgaccttcgcgaacgaacctccctaccgcaacctcctccacccgaaccccgctccaccctaaaactactaccccaaaacttaaaaacgccca

SEQ ID NO: 29093 - DNA, 1204 bp, Artificial Sequence
  chemically treated genomic DNA (Homo sapiens) CpG-island No: 29093
gtttatttggatggatgcgtggtttttggtatcgatgatgcgattgttagcggagttgtggagaaagggcgtagtgagtagaggggatttgggcggtaagaatgaaagaggggacgagggaggttgggggtatatgaatggaaaagagtaacgtcgggggtaggataagttagggacgtgacgaggtaaggacgggaggggtgtgggggaataagggtaggcgaggggacgtggtggttaggtaaggacggaagagaggtatgtggggggcgtttattattttcgcggtacgtataggtttacgaattcgtcggcgtcgttttgtatttcgaggttgggttgcgtttggggagttatcgcgcggcgtcgtgagtacggtcggaatcgtgtttcggttttcggcgtaaatcggtttttagggttacggttttagtcgtatttagtatttcgtatttcgtttttcgcgtttaagtttttattttcgttttagttttagttttgagttcgaagttcgcgtcgcgcgttatatttgttgttattatatcgcgcgcgagagagaaaggaagtagttagttattcggtagagatatcggcgggtaaggaggggtttcggcgagcgttttcgggttacgttattatagcgagtttgcgcggtgcgtgtttgtcggtcgtcgtcgtgacgtattttcgttttcggtaaggaggttttcggattttagtttgttggttttggggcgcggggcgtcgtgggggtcgttgtcgttgagggtcgttgtcgtgtgtggcgttttagtttggtttttgggttgtgttttacggacgtagtcgatttttttgagcgtttcgggagtttcgaatagtagttgggagaaggggcgaggattgagtttcgttgttcgttgtcggtcgggttagagatacgggcgtgttttttattgtgcgtttttcgtttttcggtttttttattttgcggttatttggggcgtggggcggtgtttttgttcgtgtacgtagtcgttgcgagcggaggtttgtttatttggtgtttgttatttattttttcgggtcggtgggcgaaggatattcgtaggaattcggtagaggagaaatttagacggttttcgagggtaggaaaagatttcggtttatcgtggaatttgaaatattcgattattttgttattttatgttttattagttagatt

SEQ ID NO: 29094 - DNA, 1204 bp, Artificial Sequence
  chemically treated genomic DNA (Homo sapiens) CpG-island No: 29094
aatctaactaataaaacataaaataacaaaataatcgaatatttcaaattccacgataaaccgaaatcttttcctaccctcgaaaaccgtctaaatttctcctctaccgaattcctacgaatatccttcgcccaccgacccgaaaaaataaataacaaacaccaaataaacaaacctccgctcgcaacgactacgtacacgaacaaaaacaccgccccacgccccaaataaccgcaaaataaaaaaaccgaaaaacgaaaaacgcacaataaaaaacacgcccgtatctctaacccgaccgacaacgaacaacgaaactcaatcctcgccccttctcccaactactattcgaaactcccgaaacgctcaaaaaaatcgactacgtccgtaaaacacaacccaaaaaccaaactaaaacgccacacacgacaacgaccctcaacgacaacgacccccacgacgccccgcgccccaaaaccaacaaactaaaatccgaaaacctccttaccgaaaacgaaaatacgtcacgacgacgaccgacaaacacgcaccgcgcaaactcgctataataacgtaacccgaaaacgctcgccgaaacccctccttacccgccgatatctctaccgaataactaactacttcctttctctctcgcgcgcgatataataacaacaaatataacgcgcgacgcgaacttcgaactcaaaactaaaactaaaacgaaaataaaaacttaaacgcgaaaaacgaaatacgaaatactaaatacgactaaaaccgtaaccctaaaaaccgatttacgccgaaaaccgaaacacgattccgaccgtactcacgacgccgcgcgataactccccaaacgcaacccaacctcgaaatacaaaacgacgccgacgaattcgtaaacctatacgtaccgcgaaaataataaacgccccccacatacctctcttccgtccttacctaaccaccacgtcccctcgcctacccttattcccccacacccctcccgtccttacctcgtcacgtccctaacttatcctacccccgacgttactcttttccattcatatacccccaacctccctcgtcccctctttcattcttaccgcccaaatcccctctactcactacgccctttctccacaactccgctaacaatcgcatcatcgataccaaaaaccacgcatccatccaaataaac

SEQ ID NO: 29095 - DNA, 1204 bp, Artificial Sequence
  chemically treated genomic DNA (Homo sapiens) CpG-island No: 29095
ggtttgattggtgaaatatgggatggtagagtggtcgggtgttttagattttacggtgggtcggggtttttttttattttcgggagtcgtttgaattttttttttgtcgagtttttgcgggtgtttttcgtttatcggttcgggggagtgagtagtaggtattaggtgagtaggttttcgttcgtagcggttacgtgtacgggtaggagtatcgttttacgttttaggtggtcgtagggtgaggggatcggagggcgggaggcgtataatggggggtacgttcgtatttttagttcggtcggtagcgggtagcgaggtttagttttcgtttttttttttagttgttattcggggttttcgaggcgtttagaggggtcgattgcgttcgtggggtataatttaggggttaggttaagacgttatatacggtaacgatttttaacgataacgatttttacgacgtttcgcgttttagggttagtaggttggggttcgagaatttttttgtcggaagcggaagtgcgttacggcgacggtcggtaagtacgtatcgcgtagattcgttgtggtggcgtgattcggaagcgttcgtcgaggtttttttttgttcgtcgatatttttgtcgggtgattagttgttttttttttttttcgcgcgcggtgtggtggtagtaggtgtggcgcgcggcgcgggtttcgggtttagggttggggttggggcgggagtgggggtttggacgcgggggacggggtgcggggtgttgggtgcggttggggtcgtgattttaggggtcggtttgcgtcgggagtcggggtacggtttcggtcgtatttacggcgtcgcgcggtgattttttaggcgtagtttagtttcgaaatgtagaacgacgtcggcgagttcgtggatttgtacgtgtcgcggaaatggtaagcgttttttatatgtttttttttcgtttttatttaattattacgttttttcgtttgtttttgtttttttatatttttttcgtttttatttcgttacgtttttaatttgttttgttttcgacgttatttttttttatttatatatttttaatttttttcgtttttttttttatttttatcgtttaagttttttttgtttattgcgttttttttttatagtttcgttagtaatcgtattatcggtgttaaggattacgtatttatttagatgaat

SEQ ID NO: 29096 - DNA, 1204 bp, Artificial Sequence
  chemically treated genomic DNA (Homo sapiens) CpG-island No: 29096
attcatctaaataaatacgtaatccttaacaccgataatacgattactaacgaaactataaaaaaaaaacgcaataaacaaaaaaaacttaaacgataaaaataaaaaaaaaaacgaaaaaaattaaaaatatataaataaaaaaaaataacgtcgaaaacaaaacaaattaaaaacgtaacgaaataaaaacgaaaaaaatataaaaaaacaaaaacaaacgaaaaaacgtaataattaaataaaaacgaaaaaaaaacatataaaaaacgcttaccatttccgcgacacgtacaaatccacgaactcgccgacgtcgttctacatttcgaaactaaactacgcctaaaaaatcaccgcgcgacgccgtaaatacgaccgaaaccgtaccccgactcccgacgcaaaccgacccctaaaatcacgaccccaaccgcacccaacaccccgcaccccgtcccccgcgtccaaacccccactcccgccccaaccccaaccctaaacccgaaacccgcgccgcgcgccacacctactaccaccacaccgcgcgcgaaaaaaaaaaaaaacaactaatcacccgacaaaaatatcgacgaacaaaaaaaaacctcgacgaacgcttccgaatcacgccaccacaacgaatctacgcgatacgtacttaccgaccgtcgccgtaacgcacttccgcttccgacaaaaaaattctcgaaccccaacctactaaccctaaaacgcgaaacgtcgtaaaaatcgttatcgttaaaaatcgttaccgtatataacgtcttaacctaacccctaaattataccccacgaacgcaatcgacccctctaaacgcctcgaaaaccccgaataacaactaaaaaaaaaaacgaaaactaaacctcgctacccgctaccgaccgaactaaaaatacgaacgtaccccccattatacgcctcccgccctccgatcccctcaccctacgaccacctaaaacgtaaaacgatactcctacccgtacacgtaaccgctacgaacgaaaacctactcacctaatacctactactcactcccccgaaccgataaacgaaaaacacccgcaaaaactcgacaaaaaaaaaattcaaacgactcccgaaaataaaaaaaaaccccgacccaccgtaaaatctaaaacacccgaccactctaccatcccatatttcaccaatcaaacc

SEQ ID NO: 29097 - DNA, 697 bp, Artificial Sequence
  chemically treated genomic DNA (Homo sapiens) CpG-island No: 29097
taacgtttcgcgtttaggttttttataggagggttcgagttttttagtatcggaggtttgggggcgtacgagtcgttttttttttggagaagtttcggatcgagaggatatcggatattgcgtagcgtcgagtttcgcgcgtagttcgggacgttttagttagggtcgatcgcgtagaggaagtttttagagttcgttttaagatcgtagttaatagttttaggcgtatacggcggtttcggagcgagtacgcgtagtaacgtttttcgtttcggttcgttttcggtttcgttttcggtttcgttttcggtttcgtttcgtaagggttataggttacggggcggggtcgaggcggaagcgttcgtagttcggtatcggttttttttgggttttttttagcgtttttttttcggttcgatttcgttggttagcgttaagtgatttacgttttcgattttgagttcggatcgttaggcgaggaggattagattttcgttcgagaatttgaaggtgttttggttttggaggagtttcgttttagttcgcggtttttcggtattgtcgggtttcggttttttggagttttaggaggcggtcgttagggtcggggagtatttgggttcggggttttagggaagggcggcgtttgggtttgcggtatcggaaagagtttgttggagttaagtagttttttttt

SEQ ID NO: 29098 - DNA, 697 bp, Artificial Sequence
  chemically treated genomic DNA (Homo sapiens) CpG-island No: 29098
aaaaaaaaactacttaactccaacaaactctttccgataccgcaaacccaaacgccgcccttccctaaaaccccgaacccaaatactccccgaccctaacgaccgcctcctaaaactccaaaaaaccgaaacccgacaataccgaaaaaccgcgaactaaaacgaaactcctccaaaaccaaaacaccttcaaattctcgaacgaaaatctaatcctcctcgcctaacgatccgaactcaaaatcgaaaacgtaaatcacttaacgctaaccaacgaaatcgaaccgaaaaaaaaacgctaaaaaaaacccaaaaaaaaccgataccgaactacgaacgcttccgcctcgaccccgccccgtaacctataacccttacgaaacgaaaccgaaaacgaaaccgaaaacgaaaccgaaaacgaaccgaaacgaaaaacgttactacgcgtactcgctccgaaaccgccgtatacgcctaaaactattaactacgatcttaaaacgaactctaaaaacttcctctacgcgatcgaccctaactaaaacgtcccgaactacgcgcgaaactcgacgctacgcaatatccgatatcctctcgatccgaaacttctccaaaaaaaaaacgactcgtacgcccccaaacctccgatactaaaaaactcgaaccctcctataaaaaacctaaacgcgaaacgtta

SEQ ID NO: 29099 - DNA, 697 bp, Artificial Sequence
  chemically treated genomic DNA (Homo sapiens) CpG-island No: 29099
gagggagggttatttggttttagtaggtttttttcgatatcgtagatttaggcgtcgtttttttttgagatttcggatttaaatatttttcgattttgacggtcgttttttgaagttttagagggtcggggttcgatagtatcgggagatcgcgggttgggacggaatttttttaggattagggtatttttagattttcgagcggagatttgatttttttcgtttagcggttcgggtttagggtcgggggcgtaagttatttggcgttgattagcggagtcgggtcggggggaaggcgttagagggagtttaggaggagtcggtatcgggttgcgggcgttttcgtttcggtttcgtttcgtgatttgtgatttttgcggggcggggtcgggggcggggtcgggggcggggtcgggggcgggtcggggcgaggggcgttgttgcgcgtgttcgtttcgaggtcgtcgtgtgcgtttgaggttgttggttgcggttttgaaacgggttttgggagttttttttgcgcggtcggttttggttgaggcgtttcgggttgcgcgcggggttcggcgttgcgtagtgttcggtgttttttcggttcggagtttttttagaggaggagcggttcgtgcgtttttagattttcggtattgggagattcgggtttttttgtaagagatttgagcgcggagcgtta

SEQ ID NO: 29100 - DNA, 697 bp, Artificial Sequence
  chemically treated genomic DNA (Homo sapiens) CpG-island No: 29100
taacgctccgcgctcaaatctcttacaaaaaaacccgaatctcccaataccgaaaatctaaaaacgcacgaaccgctcctcctctaaaaaaactccgaaccgaaaaaacaccgaacactacgcaacgccgaaccccgcgcgcaacccgaaacgcctcaaccaaaaccgaccgcgcaaaaaaaactcccaaaacccgtttcaaaaccgcaaccaacaacctcaaacgcacacgacgacctcgaaacgaacacgcgcaacaacgcccctcgccccgacccgcccccgaccccgcccccgaccccgcccccgaccccgccccgcaaaaatcacaaatcacgaaacgaaaccgaaacgaaaacgcccgcaacccgataccgactcctcctaaactccctctaacgccttccccccgacccgactccgctaatcaacgccaaataacttacgcccccgaccctaaacccgaaccgctaaacgaaaaaaatcaaatctccgctcgaaaatctaaaaataccctaatcctaaaaaaattccgtcccaacccgcgatctcccgatactatcgaaccccgaccctctaaaacttcaaaaaacgaccgtcaaaatcgaaaaatatttaaatccgaaatctcaaaaaaaaacgacgcctaaatctacgatatcgaaaaaaacctactaaaaccaaataaccctccctc

SEQ ID NO: 29101 - DNA, 1167 bp, Artificial Sequence
  chemically treated genomic DNA (Homo sapiens) CpG-island No: 29101
tcgagatttgatcgtcgtttagtagcgtcgcgttcgtttttttttcgttggttttttcgtcgttgtttttttcgttgtcgtggtttagtttagtatagcgtcgtaggtttattagttttagttgcgtgtgtttatttattattagcgtgtatttgatcgcgtcgtatattagcgacgcgtttcgcggcgtcgaggggttcgtgtttttgttttcgggggatttcgtattgttttcggtatttttttttttttcgtcgtttttttcgttttttttttcggagtaggcggcggagtaggttcgtttcgggcgggcggcgcggtcgggcgcggtttatagcggcgtgatggtgttacgcgtggggttgttgaggaataggtagggttcgggttgcgcggggtcgggtcgaggcgcggcgggcgcgggcggcggcggcgcgtatagcgtttttatgtttattagttttacgtcgtcgggtttcgcggtcgtttcggggttttgggagttttgggcggtttcgtcggtcggcgatacgggtttttcgggcgggcgcggcgtaggagataggtattggtcggggtagcggatgggcgaggagttttcggagattatgcggtttattaggttgttgagtagttagggcgagttcgcgttttcgttgaggttcggtttcgatttcgatttcgattcgtattcgttgttggtgtcgtcggggtttacgggtaggaaggcggggcggcgcgggggttcgcgcgggggtttcggtttcgaggcgggcgacgaggttttttcgatggagttggtgaggtgcgaggagcggtcgttgttgttgttttcgttatcgttgtttagttttagtttcgttttcgagatggacgagattatgcgttttaggcggcgtcgttcgcgtttttcgagtcggagtcgggcgaggatagtttttggttgttgcgacgtttttcgcggtcgtcgttcgagcggttttttaggttagtttcgatgtcgggatttgaggagggcgaagttttttttggcgtagggggtttcgtaggtcggtttttttcgtagtcgtaattcgggcgtattggcgattgcgtttcgtcgggttcggtgttcgtggtagggagggggttcgggagttttgttgggtagggaggtggggttatttt

SEQ ID NO: 29102 - DNA, 1167 bp, Artificial Sequence
  chemically treated genomic DNA (Homo sapiens) CpG-island No: 29102
aaaataaccccacctccctacccaacaaaactcccgaaccccctccctaccacgaacaccgaacccgacgaaacgcaatcgccaatacgcccgaattacgactacgaaaaaaaccgacctacgaaaccccctacgccaaaaaaaacttcgccctcctcaaatcccgacatcgaaactaacctaaaaaaccgctcgaacgacgaccgcgaaaaacgtcgcaacaaccaaaaactatcctcgcccgactccgactcgaaaaacgcgaacgacgccgcctaaaacgcataatctcgtccatctcgaaaacgaaactaaaactaaacaacgataacgaaaacaacaacaacgaccgctcctcgcacctcaccaactccatcgaaaaaacctcgtcgcccgcctcgaaaccgaaacccccgcgcgaacccccgcgccgccccgccttcctacccgtaaaccccgacgacaccaacaacgaatacgaatcgaaatcgaaatcgaaaccgaacctcaacgaaaacgcgaactcgccctaactactcaacaacctaataaaccgcataatctccgaaaactcctcgcccatccgctaccccgaccaatacctatctcctacgccgcgcccgcccgaaaaacccgtatcgccgaccgacgaaaccgcccaaaactcccaaaaccccgaaacgaccgcgaaacccgacgacgtaaaactaataaacataaaaacgctatacgcgccgccgccgcccgcgcccgccgcgcctcgacccgaccccgcgcaacccgaaccctacctattcctcaacaaccccacgcgtaacaccatcacgccgctataaaccgcgcccgaccgcgccgcccgcccgaaacgaacctactccgccgcctactccgaaaaaaaaaacgaaaaaaacgacgaaaaaaaaaaaaataccgaaaacaatacgaaatcccccgaaaacaaaaacacgaacccctcgacgccgcgaaacgcgtcgctaatatacgacgcgatcaaatacacgctaataataaataaacacacgcaactaaaactaataaacctacgacgctatactaaactaaaccacgacaacgaaaaaaacaacgacgaaaaaaccaacgaaaaaaaaacgaacgcgacgctactaaacgacgatcaaatctcga

SEQ ID NO: 29103 - DNA, 1167 bp, Artificial Sequence
  chemically treated genomic DNA (Homo sapiens) CpG-island No: 29103
agggtgattttatttttttgtttagtagagttttcgggttttttttttgttacggatatcgggttcggcggggcgtagtcgttagtgcgttcgggttgcgattgcgaagggaatcggtttgcggaattttttgcgttaggggggatttcgttttttttagatttcggtatcgaggttgatttgagaagtcgttcgagcggcggtcgcgggggacgtcgtagtagttaggagttgttttcgttcggtttcgattcggaggacgcgggcggcgtcgtttggggcgtatgatttcgtttatttcggagacggagttggagttgagtagcgatggcggaagtagtagtagcggtcgtttttcgtattttattaattttatcgaggaggtttcgtcgttcgtttcggagtcggagttttcgcgcgaattttcgcgtcgtttcgtttttttgttcgtgggtttcgacgatattaatagcgagtacgagtcggggtcggagtcggagtcggattttagcgaggacgcggattcgttttggttgtttagtaatttggtgagtcgtatgattttcgagggtttttcgtttattcgttgtttcggttagtgtttgttttttgcgtcgcgttcgttcggggagttcgtgtcgtcggtcggcggggtcgtttaggatttttaggatttcgaggcggtcgcggggttcggcggcgtggagttggtggatatggagacgttgtgcgcgtcgtcgtcgttcgcgttcgtcgcgtttcgattcggtttcgcgtagttcgggttttgtttattttttagtaattttacgcgtgatattattacgtcgttgtgggtcgcgttcggtcgcgtcgttcgttcgggacgagtttgtttcgtcgtttgtttcgaggaggaggacgaagaggacgacgaggaagaggaggatgtcgaggatagtgcggggtttttcgggggtaggggtacgggtttttcggcgtcgcgggacgcgtcgttggtgtacgacgcggttaagtatacgttggtggtggatgagtatacgtagttggagttggtgagtttgcggcgttgtgttgggttgggttacgatagcgaagaggatagcggcggggaggttagcgaggaggaggcgggcgcggcgttgttaggcggcggttaggtttcgg

SEQ ID NO: 29104 - DNA, 1167 bp, Artificial Sequence
  chemically treated genomic DNA (Homo sapiens) CpG-island No: 29104
ccgaaacctaaccgccgcctaacaacgccgcgcccgcctcctcctcgctaacctccccgccgctatcctcttcgctatcgtaacccaacccaacacaacgccgcaaactcaccaactccaactacgtatactcatccaccaccaacgtatacttaaccgcgtcgtacaccaacgacgcgtcccgcgacgccgaaaaacccgtacccctacccccgaaaaaccccgcactatcctcgacatcctcctcttcctcgtcgtcctcttcgtcctcctcctcgaaacaaacgacgaaacaaactcgtcccgaacgaacgacgcgaccgaacgcgacccacaacgacgtaataatatcacgcgtaaaattactaaaaaataaacaaaacccgaactacgcgaaaccgaatcgaaacgcgacgaacgcgaacgacgacgacgcgcacaacgtctccatatccaccaactccacgccgccgaaccccgcgaccgcctcgaaatcctaaaaatcctaaacgaccccgccgaccgacgacacgaactccccgaacgaacgcgacgcaaaaaacaaacactaaccgaaacaacgaataaacgaaaaaccctcgaaaatcatacgactcaccaaattactaaacaaccaaaacgaatccgcgtcctcgctaaaatccgactccgactccgaccccgactcgtactcgctattaatatcgtcgaaacccacgaacaaaaaaacgaaacgacgcgaaaattcgcgcgaaaactccgactccgaaacgaacgacgaaacctcctcgataaaattaataaaatacgaaaaacgaccgctactactacttccgccatcgctactcaactccaactccgtctccgaaataaacgaaatcatacgccccaaacgacgccgcccgcgtcctccgaatcgaaaccgaacgaaaacaactcctaactactacgacgtcccccgcgaccgccgctcgaacgacttctcaaatcaacctcgataccgaaatctaaaaaaaacgaaatcccccctaacgcaaaaaattccgcaaaccgattcccttcgcaatcgcaacccgaacgcactaacgactacgccccgccgaacccgatatccgtaacaaaaaaaaaacccgaaaactctactaaacaaaaaaataaaatcaccct

SEQ ID NO: 29105 - DNA, 1098 bp, Artificial Sequence
  chemically treated genomic DNA (Homo sapiens) CpG-island No: 29105
tcgggatacgtcgcgtcgggagggtgtgttcgtatttcgttcgtattttttttcgtagagggtcggtttagggtttttatttttgataggttagtcgtttaggtcgggcgcggtttagaatttcggcggggttcgggggttattgaggttggggacgcgcggtgaagatggagggagtgggagcggggtgggggtggggcgttcgagtcgaggtttagggatcgtagggggtcggggtcgggttcgcgtcggcggcggggttggggcggcggggacgggggttcgggtcgggtcggggtcgggggggtgcgtagggagcggagggttcgttcggttcgggcgtcgaggggggtatttgtagttcggcggcgatagcgagtggaaggtggagagagaaaatattttcgcgcgattcgttatttttttcgggagaggttcgcgattgcggcggggggtgcgggagtttcgtcgcgtttcgcgtcggcgttcggttcgtttcgtttatttcgtgatacgttttgcggcgttcgtttcgcgtatttcgttcggatttcgcggcggcgcggggagggcggcgggggaggcgggggagggacgcggtcggggacgttggttggaggagaggcggcggttttattgtcgggcgttggttggggaagggtcgggcgtgcgatgaggatttttttcggggaggggcgggagggaaggggcgggcgggtgggcgtcgggtttcgttttggaggattcgcgcggggcgggaggtcgaggaggtagcgtcggggttcgcgggtttcgggttcgtcgtgggttgttttttttgggcgagaggtcggggcggtttcgggagttgcgtcgtcgcgtttaggatttttttaggaattttaattcgggtgcggttcggagcggggtggcgggcgaggcgggaggcgcgggaggagttgttcgtcgtcgggtgttgatcggagttgtttttacggggtgttgatcggggttgtacggggacgtttgtacgagggtcgtcgagtagggttggatttagaatcgagtataaggtatttagaggatgttggttggggttaaaagtggattttgagtatt

SEQ ID NO: 29106 - DNA, 1098 bp, Artificial Sequence
  chemically treated genomic DNA (Homo sapiens) CpG-island No: 29106
aatactcaaaatccacttttaaccccaaccaacatcctctaaataccttatactcgattctaaatccaaccctactcgacgaccctcgtacaaacgtccccgtacaaccccgatcaacaccccgtaaaaacaactccgatcaacacccgacgacgaacaactcctcccgcgcctcccgcctcgcccgccaccccgctccgaaccgcacccgaattaaaattcctaaaaaaatcctaaacgcgacgacgcaactcccgaaaccgccccgacctctcgcccaaaaaaaacaacccacgacgaacccgaaacccgcgaaccccgacgctacctcctcgacctcccgccccgcgcgaatcctccaaaacgaaacccgacgcccacccgcccgccccttccctcccgcccctccccgaaaaaaatcctcatcgcacgcccgacccttccccaaccaacgcccgacaataaaaccgccgcctctcctccaaccaacgtccccgaccgcgtccctcccccgcctcccccgccgccctccccgcgccgccgcgaaatccgaacgaaatacgcgaaacgaacgccgcaaaacgtatcacgaaataaacgaaacgaaccgaacgccgacgcgaaacgcgacgaaactcccgcaccccccgccgcaatcgcgaacctctcccgaaaaaaataacgaatcgcgcgaaaatattttctctctccaccttccactcgctatcgccgccgaactacaaatacccccctcgacgcccgaaccgaacgaaccctccgctccctacgcacccccccgaccccgacccgacccgaacccccgtccccgccgccccaaccccgccgccgacgcgaacccgaccccgaccccctacgatccctaaacctcgactcgaacgccccacccccaccccgctcccactccctccatcttcaccgcgcgtccccaacctcaataacccccgaaccccgccgaaattctaaaccgcgcccgacctaaacgactaacctatcaaaaataaaaaccctaaaccgaccctctacgaaaaaaaatacgaacgaaatacgaacacaccctcccgacgcgacgtatcccga

SEQ ID NO: 29107 - DNA, 1098 bp, Artificial Sequence
  chemically treated genomic DNA (Homo sapiens) CpG-island No: 29107
agtgtttaaagtttatttttagttttagttagtattttttgagtattttgtgttcgattttgaatttagttttgttcggcgattttcgtgtagacgttttcgtgtagtttcggttagtatttcgtggggatagtttcgattagtattcgacggcggatagtttttttcgcgtttttcgtttcgttcgttatttcgtttcgggtcgtattcgggttagggtttttggggggattttgggcgcggcggcgtagttttcggggtcgtttcggtttttcgtttagaggaaatagtttacggcgaattcgaggttcgcggatttcggcgttgttttttcggtttttcgtttcgcgcgggttttttagggcggggttcgacgtttattcgttcgttttttttttttcgttttttttcgggaaaaatttttatcgtacgttcggtttttttttaattagcgttcggtagtgaagtcgtcgttttttttttaattagcgttttcggtcgcgtttttttttcgtttttttcgtcgtttttttcgcgtcgtcgcggagttcgggcgaggtgcgcggggcggacgtcgtagggcgtgttacgaggtgagcggggcgggtcgagcgtcggcgcggggcgcggcgaggttttcgtatttttcgtcgtagtcgcgggtttttttcggagaagatggcggatcgcgcggagatgttttttttttttattttttattcgttgtcgtcgtcgggttgtaggtatttttttcggcgttcgggtcgggcggatttttcgttttttgcgtattttttcgatttcgattcggttcggattttcgttttcgtcgttttagtttcgtcgtcggcgcggattcggtttcggttttttgcggtttttgagtttcggttcgggcgttttatttttatttcgtttttattttttttatttttatcgcgcgtttttagttttagtgattttcgggtttcgtcgggattttgagtcgcgttcggtttggacggttgatttgttaagggtggaggttttgggtcgattttttgcgggggaggatgcgggcgggatgcgggtatattttttcggcgcggcgtgtttcgg

SEQ ID NO: 29108 - DNA, 1098 bp, Artificial Sequence
  chemically treated genomic DNA (Homo sapiens) CpG-island No: 29108
ccgaaacacgccgcgccgaaaaaatatacccgcatcccgcccgcatcctcccccgcaaaaaatcgacccaaaacctccacccttaacaaatcaaccgtccaaaccgaacgcgactcaaaatcccgacgaaacccgaaaatcactaaaactaaaaacgcgcgataaaaataaaaaaaataaaaacgaaataaaaataaaacgcccgaaccgaaactcaaaaaccgcaaaaaaccgaaaccgaatccgcgccgacgacgaaactaaaacgacgaaaacgaaaatccgaaccgaatcgaaatcgaaaaaatacgcaaaaaacgaaaaatccgcccgacccgaacgccgaaaaaaatacctacaacccgacgacgacaacgaataaaaaataaaaaaaaaaaacatctccgcgcgatccgccatcttctccgaaaaaaacccgcgactacgacgaaaaatacgaaaacctcgccgcgccccgcgccgacgctcgacccgccccgctcacctcgtaacacgccctacgacgtccgccccgcgcacctcgcccgaactccgcgacgacgcgaaaaaaacgacgaaaaaaacgaaaaaaaaacgcgaccgaaaacgctaattaaaaaaaaaacgacgacttcactaccgaacgctaattaaaaaaaaaccgaacgtacgataaaaatttttcccgaaaaaaaacgaaaaaaaaaaaacgaacgaataaacgtcgaaccccgccctaaaaaacccgcgcgaaacgaaaaaccgaaaaaacaacgccgaaatccgcgaacctcgaattcgccgtaaactatttcctctaaacgaaaaaccgaaacgaccccgaaaactacgccgccgcgcccaaaatccccccaaaaaccctaacccgaatacgacccgaaacgaaataacgaacgaaacgaaaaacgcgaaaaaaactatccgccgtcgaatactaatcgaaactatccccacgaaatactaaccgaaactacacgaaaacgtctacacgaaaatcgccgaacaaaactaaattcaaaatcgaacacaaaatactcaaaaaatactaactaaaactaaaaataaactttaaacact

SEQ ID NO: 29109 - DNA, 1030 bp, Artificial Sequence
  chemically treated genomic DNA (Homo sapiens) CpG-island No: 29109
cggacgtcgtagatttgtgggagtagcgcggaatgtttcgttttttttttcgaggatatttaatgagggcgagaggttattttcggggagggttcgttaacggaaagggcggggtatttttttcgaggagcggttttgttttttaagcggtcgttgggggcgttagagtaggatcggagcgcgggttaagttggaggtgagcgaggtcgcgtttttttgggtttcggtttttttaacgcgttttgacggttgggtttcgtttgattttgttttagcgttcgcggtggtattaattttaagttagatttttgatttcgatttaattttatttattcgattttatttattttatattttatgtttttttttcgacgttttttatttcgttttattttttattttttatcgtttacgttatcgtttattcgtttttttatttagtttcgttttttattttttatttcgttttattttttatttcgttttattttttattttttatttcgttttattttttattttttatttcgttttattttttatttttttttatttcgttttattcgtttcgttttttattttttatttttttttatttcgttttattttttattttttatttcgttttattttttatttcgttttattttttatttcgttttattttttattttttatttcgttttattttttattttttatttcgttttattttttattttttatttcgttttattttttattttttatttcgttttattttttattttttatttcgttttatttttttttatttcgttttattcgtttcgttttttattttttatcgtttacgttatcgtttattcgtttttttatttagttttattttttatttcgttttattttttatttcgttttattttttatttttttttatttcgttttatttcgttttatttttttttcgttttttttattgtatattttatattttattttttttattttatattttttattttagttttttatttttttaatttaattt

SEQ ID NO: 29110 - DNA, 1030 bp, Artificial Sequence
  chemically treated genomic DNA (Homo sapiens) CpG-island No: 29110
aaattaaattaaaaaaataaaaaactaaaataaaaaatataaaataaaaaaaataaaatataaaatatacaataaaaaaaacgaaaaaaaaataaaacgaaataaaacgaaataaaaaaaaataaaaaataaaacgaaataaaaaataaaacgaaataaaaaataaaactaaataaaaaaacgaataaacgataacgtaaacgataaaaaataaaaaacgaaacgaataaaacgaaataaaaaaaaataaaacgaaataaaaaataaaaaataaaacgaaataaaaaataaaaaataaaacgaaataaaaaataaaaaataaaacgaaataaaaaataaaaaataaaacgaaataaaaaataaaaaataaaacgaaataaaaaataaaacgaaataaaaaataaaacgaaataaaaaataaaaaataaaacgaaataaaaaaaaataaaaaataaaaaacgaaacgaataaaacgaaataaaaaaaaataaaaaataaaacgaaataaaaaataaaaaataaaacgaaataaaaaataaaaaataaaacgaaataaaaaataaaacgaaataaaaaataaaaaacgaaactaaataaaaaaacgaataaacgataacgtaaacgataaaaaataaaaaataaaacgaaataaaaaacgtcgaaaaaaaaacataaaatataaaataaataaaatcgaataaataaaattaaatcgaaatcaaaaatctaacttaaaattaataccaccgcgaacgctaaaacaaaatcaaacgaaacccaaccgtcaaaacgcgttaaaaaaaccgaaacccaaaaaaacgcgacctcgctcacctccaacttaacccgcgctccgatcctactctaacgcccccaacgaccgcttaaaaaacaaaaccgctcctcgaaaaaaataccccgccctttccgttaacgaaccctccccgaaaataacctctcgccctcattaaatatcctcgaaaaaaaaaacgaaacattccgcgctactcccacaaatctacgacgtccg

SEQ ID NO: 29111 - DNA, 1030 bp, Artificial Sequence
  chemically treated genomic DNA (Homo sapiens) CpG-island No: 29111
agattaggttaagggggtgaaggattgaggtgagggatgtaaggtggggagagtggggtatggagtgtgtagtgaggggagcgggggaggggtgaggcggggtgaggcggggtgaggaggggtgaggggtgaggcggggtgaggggtgaggcggggtgaggggtgaggttgggtgaggaggcgggtgaacggtgacgtgagcgatgaggggtgaggggcgaggcgggtgaggcggggtaaggaggggtgaggcggggtgaggggtgaagggtgaggcggggtgaggggtgaagggtgaggcggggtgaggggtgaggggtgaggcggggtgaggggtgaagggtgaggcggggtgaggggtgaagggtgaggcggggtgaggggtgaggcggggtgaggggtgaggcggggtgaggggtgaggggtgaggcggggtgaggaggggtgaggggtgaggggcgaggcgggtgaggcggggtgaggaggggtgaggggtgaggcgggatgaggggtgaggggtgaggcgggatgaggggtgaggggtgaggcggggtgaggggtgaggcggggtgaggggtgaggggcgaggttgggtgaggaggcgggtgagcggtgacgtgagcgatgaggggtgaagggtgaggcggggtgaggggcgtcgggggaggggtatggggtgtggagtgagtggagtcgggtgagtggagttgggtcgaagttaagggtttggtttgaggttggtgttatcgcgaacgttaggatagggttaggcggagtttagtcgttagggcgcgttgggagggtcggggtttaggggggcgcggtttcgtttatttttagtttggttcgcgtttcggttttgttttggcgtttttagcggtcgtttgaggaataaggtcgtttttcgagagggatgtttcgtttttttcgttagcgaatttttttcggaagtgatttttcgtttttattgggtgttttcgggaaaaggggcggggtatttcgcgttgtttttataggtttgcggcgttcg

SEQ ID NO: 29112 - DNA, 1030 bp, Artificial Sequence
  chemically treated genomic DNA (Homo sapiens) CpG-island No: 29112
cgaacgccgcaaacctataaaaacaacgcgaaataccccgccccttttcccgaaaacacccaataaaaacgaaaaatcacttccgaaaaaaattcgctaacgaaaaaaacgaaacatccctctcgaaaaacgaccttattcctcaaacgaccgctaaaaacgccaaaacaaaaccgaaacgcgaaccaaactaaaaataaacgaaaccgcgcccccctaaaccccgaccctcccaacgcgccctaacgactaaactccgcctaaccctatcctaacgttcgcgataacaccaacctcaaaccaaacccttaacttcgacccaactccactcacccgactccactcactccacaccccatacccctcccccgacgcccctcaccccgcctcacccttcacccctcatcgctcacgtcaccgctcacccgcctcctcacccaacctcgcccctcacccctcaccccgcctcacccctcaccccgcctcacccctcacccctcatcccgcctcacccctcacccctcatcccgcctcacccctcacccctcctcaccccgcctcacccgcctcgcccctcacccctcacccctcctcaccccgcctcacccctcacccctcaccccgcctcacccctcaccccgcctcacccctcaccccgcctcacccttcacccctcaccccgcctcacccttcacccctcaccccgcctcacccctcacccctcaccccgcctcacccttcacccctcaccccgcctcacccttcacccctcaccccgcctcacccctccttaccccgcctcacccgcctcgcccctcacccctcatcgctcacgtcaccgttcacccgcctcctcacccaacctcacccctcaccccgcctcacccctcaccccgcctcacccctcacccctcctcaccccgcctcaccccgcctcacccctcccccgctcccctcactacacactccataccccactctccccaccttacatccctcacctcaatccttcacccccttaacctaatct

SEQ ID NO: 29113 - DNA, 983 bp, Artificial Sequence
  chemically treated genomic DNA (Homo sapiens) CpG-island No: 29113
cggtttcgcgaggttagcggtgttttcgggttcgtagtatcggaagtttcgcggttggagtttcgggattcggtattcggattatttggtttcgttggtgatcgacgcggataattgattcgttaggcgggagcggttttatacgtgtttgtttaaagtttgcgagttcgtatcgtgttcgtttttttttttttttttttgcgcgttttggcgtaaggtttggggtggagttacggttggggtcgtgttttaatttcgaatttagcggggcggggttcgagcgtcgggcgaggtcgggattttagcgttgcgtcgcgttcgaacgtcgagattttatcgagggcgggagggggattttcgggagttatagacgttcgagatttacgtcgggcgggatcggttagggattattttcgtcgacggtttcgggtttcgacggttcggaagtttcgcgtgttcgggggtatcgggggattggtcggggcgcggcgtgtaaggtttttcgggggcggcgattgtcgagtttcgttttttaggcggttttattcgtttgtcgttttggggcgtcgtcgtttcgtcgtcggtagtggatcgttgtgcgcgaattttgaattttacggtttcgattcgcgggcgaggtcgggtatttgggttgggattcggagtaagcgggcgagggtagcgttttaagtaggtacgggcggggtttaagtcgcgaggcggggaagcgggaggtagatacggacgagggcgatatagatacgggatcgaggggcggatatcggagagatacgggaaaggggtcgggataggagtacgtggtttagatatcgacgtcgggaggtcgtagatttcggacgtgttaggtattttcgtaggttcggagcgatggtagttttgatgatttcgggaatcggggttttattcgcgtttggtgattttttcggggaagggagttagggatttttcgatttttcgttaga

SEQ ID NO: 29114 - DNA, 983 bp, Artificial Sequence
  chemically treated genomic DNA (Homo sapiens) CpG-island No: 29114
tctaacgaaaaatcgaaaaatccctaactcccttccccgaaaaaatcaccaaacgcgaataaaaccccgattcccgaaatcatcaaaactaccatcgctccgaacctacgaaaatacctaacacgtccgaaatctacgacctcccgacgtcgatatctaaaccacgtactcctatcccgacccctttcccgtatctctccgatatccgcccctcgatcccgtatctatatcgccctcgtccgtatctacctcccgcttccccgcctcgcgacttaaaccccgcccgtacctacttaaaacgctaccctcgcccgcttactccgaatcccaacccaaatacccgacctcgcccgcgaatcgaaaccgtaaaattcaaaattcgcgcacaacgatccactaccgacgacgaaacgacgacgccccaaaacgacaaacgaataaaaccgcctaaaaaacgaaactcgacaatcgccgcccccgaaaaaccttacacgccgcgccccgaccaatcccccgatacccccgaacacgcgaaacttccgaaccgtcgaaacccgaaaccgtcgacgaaaataatccctaaccgatcccgcccgacgtaaatctcgaacgtctataactcccgaaaatccccctcccgccctcgataaaatctcgacgttcgaacgcgacgcaacgctaaaatcccgacctcgcccgacgctcgaaccccgccccgctaaattcgaaattaaaacacgaccccaaccgtaactccaccccaaaccttacgccaaaacgcgcaaaaaaaaaaaaaaaaaaacgaacacgatacgaactcgcaaactttaaacaaacacgtataaaaccgctcccgcctaacgaatcaattatccgcgtcgatcaccaacgaaaccaaataatccgaataccgaatcccgaaactccaaccgcgaaacttccgatactacgaacccgaaaacaccgctaacctcgcgaaaccg

SEQ ID NO: 29115 - DNA, 983 bp, Artificial Sequence
  chemically treated genomic DNA (Homo sapiens) CpG-island No: 29115
tttggcgaagggtcgggaagtttttggttttttttttcggagaagttattaggcgcgggtggggtttcggttttcggggttattaaggttgttatcgtttcgggtttgcggggatgtttgatacgttcggggtttgcggtttttcggcgtcggtgtttgagttacgtgtttttgtttcgatttttttttcgtgttttttcggtgttcgtttttcggtttcgtgtttgtgtcgttttcgttcgtgtttgtttttcgttttttcgtttcgcgatttgagtttcgttcgtatttgtttagggcgttgttttcgttcgtttgtttcggattttagtttaggtattcggtttcgttcgcgggtcgggatcgtagggtttagggttcgcgtatagcggtttattgtcggcggcggggcggcggcgttttaggacggtaggcgggtggggtcgtttggagggcggagttcggtagtcgtcgttttcgggaagttttgtacgtcgcgtttcggttaatttttcggtgttttcggatacgcggaattttcgggtcgtcggggttcggggtcgtcggcgggggtgatttttggtcggtttcgttcggcgtgggtttcgggcgtttgtggttttcgagagtttttttttcgttttcggtggggtttcgacgttcggacgcggcgtagcgttggggtttcggtttcgttcgacgttcgggtttcgtttcgttgggttcggagttgggatacggttttagtcgtggttttattttaggttttgcgttaggacgcgtagagagagagagagagaggcggatacgatgcggattcgtagattttaagtaaatacgtgtggggtcgttttcgtttggcgggttagttgttcgcgtcggttattagcggggttaggtagttcgagtgtcggatttcgaaattttagtcgcggggttttcggtgttgcgggttcggagatatcgttgatttcgcggggtcg

SEQ ID NO: 29116 - DNA, 983 bp, Artificial Sequence
  chemically treated genomic DNA (Homo sapiens) CpG-island No: 29116
cgaccccgcgaaatcaacgatatctccgaacccgcaacaccgaaaaccccgcgactaaaatttcgaaatccgacactcgaactacctaaccccgctaataaccgacgcgaacaactaacccgccaaacgaaaacgaccccacacgtatttacttaaaatctacgaatccgcatcgtatccgcctctctctctctctctctacgcgtcctaacgcaaaacctaaaataaaaccacgactaaaaccgtatcccaactccgaacccaacgaaacgaaacccgaacgtcgaacgaaaccgaaaccccaacgctacgccgcgtccgaacgtcgaaaccccaccgaaaacgaaaaaaaaactctcgaaaaccacaaacgcccgaaacccacgccgaacgaaaccgaccaaaaatcacccccgccgacgaccccgaaccccgacgacccgaaaattccgcgtatccgaaaacaccgaaaaattaaccgaaacgcgacgtacaaaacttcccgaaaacgacgactaccgaactccgccctccaaacgaccccacccgcctaccgtcctaaaacgccgccgccccgccgccgacaataaaccgctatacgcgaaccctaaaccctacgatcccgacccgcgaacgaaaccgaatacctaaactaaaatccgaaacaaacgaacgaaaacaacgccctaaacaaatacgaacgaaactcaaatcgcgaaacgaaaaaacgaaaaacaaacacgaacgaaaacgacacaaacacgaaaccgaaaaacgaacaccgaaaaaacacgaaaaaaaaatcgaaacaaaaacacgtaactcaaacaccgacgccgaaaaaccgcaaaccccgaacgtatcaaacatccccgcaaacccgaaacgataacaaccttaataaccccgaaaaccgaaaccccacccgcgcctaataacttctccgaaaaaaaaaaccaaaaacttcccgacccttcgccaaa

SEQ ID NO: 29117 - DNA, 1217 bp, Artificial Sequence
  chemically treated genomic DNA (Homo sapiens) CpG-island No: 29117
attacgttcggtgagggggacggggtgtaggggagcggaggcggcggggggtgtttttcgttggggtcgtttcgattcggtcgcgtttaagattcgttttcgttcgtagggggcgttttgttttggtttagcggatacgcggggatttaggtttagggcgttgttcgggtggtcgcggcgttggacgacggttcggtttttggtcgtttcgagcggatgttggcggcgtagggcgtggatttcggtttggttcgagttttgtgttcgggaagtttcgtagaacgtcggtagttgttgtttcgcgttcgggagtaggaggagttgttggcgttcgtagatggtgagcgtcgggggagttttcgttttttcgttttcgttattttttttttttttcgaggtttcgttttttttcgagttcgcgttttttagttttttttttcgtaggtatcgtggagttggttcgggcgttgtcgttggcgttggtgttgtacgagttcggggtcgggcgtagtcgcgttggggagtcgtttcgtttgggggtgggcgtagagttgttggtcgacgtgggttagaggttgcgtcgtggtgagcgtcgttttcgttttgttggtttcgtattttcgtttagtttcggtcgcgcggtttttaatagtttttcgttttgtagggattttttggtttcgcgtgtatcgggacggtttcgcgtttagcggttcgtagagtcgcgttttgtaggaggcgttcgtatttttcgatcgcgcgttattcgtcgttttttcgtttttcgtagagttcgttttgtcgtcgtagtaataaagtttttttgtcgcgaaattttgttagtgtttgggcgggagcggaaggatttagggttgcggaggcgggggtcgtttcgatgaatacgtgattttcggcgggtttcgtttttcgcgtacgcgttgagagtttgttagcggttgcgttcgtgtgcgtatgcgtagtttcggggacgtttgcgttttgtttgtgagcgtgtggcgttcgttttttttgagtcggcggggtagagcgtagggagttggaggtcggcgttttttttcgtgtttggtttattgacgcgcggtttcgtcgcgaggtgcggacgtcggggttgggaggggaggaggtagttttgaggattcgttggatttcggggtagttttttagtttcggttattgcgcggggttggcggggtata

SEQ ID NO: 29118 - DNA, 1217 bp, Artificial Sequence
  chemically treated genomic DNA (Homo sapiens) CpG-island No: 29118
tataccccgccaaccccgcgcaataaccgaaactaaaaaactaccccgaaatccaacgaatcctcaaaactacctcctcccctcccaaccccgacgtccgcacctcgcgacgaaaccgcgcgtcaataaaccaaacacgaaaaaaaacgccgacctccaactccctacgctctaccccgccgactcaaaaaaaacgaacgccacacgctcacaaacaaaacgcaaacgtccccgaaactacgcatacgcacacgaacgcaaccgctaacaaactctcaacgcgtacgcgaaaaacgaaacccgccgaaaatcacgtattcatcgaaacgacccccgcctccgcaaccctaaatccttccgctcccgcccaaacactaacaaaatttcgcgacaaaaaaactttattactacgacgacaaaacgaactctacgaaaaacgaaaaaacgacgaataacgcgcgatcgaaaaatacgaacgcctcctacaaaacgcgactctacgaaccgctaaacgcgaaaccgtcccgatacacgcgaaaccaaaaaatccctacaaaacgaaaaactattaaaaaccgcgcgaccgaaactaaacgaaaatacgaaaccaacaaaacgaaaacgacgctcaccacgacgcaacctctaacccacgtcgaccaacaactctacgcccacccccaaacgaaacgactccccaacgcgactacgcccgaccccgaactcgtacaacaccaacgccaacgacaacgcccgaaccaactccacgatacctacgaaaaaaaaaactaaaaaacgcgaactcgaaaaaaaacgaaacctcgaaaaaaaaaaaaaataacgaaaacgaaaaaacgaaaactcccccgacgctcaccatctacgaacgccaacaactcctcctactcccgaacgcgaaacaacaactaccgacgttctacgaaacttcccgaacacaaaactcgaaccaaaccgaaatccacgccctacgccgccaacatccgctcgaaacgaccaaaaaccgaaccgtcgtccaacgccgcgaccacccgaacaacgccctaaacctaaatccccgcgtatccgctaaaccaaaacaaaacgccccctacgaacgaaaacgaatcttaaacgcgaccgaatcgaaacgaccccaacgaaaaacaccccccgccgcctccgctcccctacaccccgtccccctcaccgaacgtaat

SEQ ID NO: 29119 - DNA, 1217 bp, Artificial Sequence
  chemically treated genomic DNA (Homo sapiens) CpG-island No: 29119
tgtgtttcgttagtttcgcgtagtagtcggagttgggaaattatttcggagtttagcgagtttttagggttattttttttttttttagtttcggcgttcgtatttcgcggcggggtcgcgcgttagtggattaagtacgagaggaagcgtcgatttttagttttttgcgttttgtttcgtcggtttagggaaagcgggcgttatacgtttataggtagggcgtaggcgttttcggagttgcgtatgcgtatacgggcgtagtcgttgataggtttttagcgcgtgcgcggaaggcggagttcgtcgggggttacgtgtttatcgagacggttttcgttttcgtagttttggattttttcgttttcgtttaagtattgataaggtttcgcggtaaaggagttttattgttgcggcggtagaacgagttttgcgaagggcgagggggcggcgaatggcgcgcggtcggagagtacgagcgttttttgtagggcgcggttttgcgggtcgttgagcgcggggtcgtttcggtgtacgcggagttagggggtttttgtagagcgaggggttgttagaggtcgcgcggtcggagttgggcgggggtgcggggttagtagggcgggggcggcgtttattacggcgtagtttttgatttacgtcgattagtagttttgcgtttatttttaggcggagcggttttttagcgcggttgcgttcggtttcgagttcgtgtagtattagcgttagcggtagcgttcggattagttttacggtgtttgcggggagaggggttgagaggcgcgggttcgggaaggggcggggtttcgggaagggaaggggatggcggaggcggaaggacggggattttttcgacgtttattatttgcgggcgttagtagttttttttgttttcgggcgcgaggtagtagttgtcggcgttttgcgggatttttcgagtatagggttcgggttagatcgggatttacgttttgcgtcgttagtattcgttcgaagcggttaagggtcgagtcgtcgtttagcgtcgcggttattcgggtagcgttttgggtttgagttttcgcgtgttcgttgagttagagtagggcgttttttgcgggcggggacgggttttaggcgcggtcgggtcggggcggttttagcgggaagtatttttcgtcgttttcgtttttttatatttcgttttttttatcgagcgtggt

SEQ ID NO: 29120 - DNA, 1217 bp, Artificial Sequence
  chemically treated genomic DNA (Homo sapiens) CpG-island No: 29120
accacgctcgataaaaaaaacgaaatataaaaaaacgaaaacgacgaaaaatacttcccgctaaaaccgccccgacccgaccgcgcctaaaacccgtccccgcccgcaaaaaacgccctactctaactcaacgaacacgcgaaaactcaaacccaaaacgctacccgaataaccgcgacgctaaacgacgactcgacccttaaccgcttcgaacgaatactaacgacgcaaaacgtaaatcccgatctaacccgaaccctatactcgaaaaatcccgcaaaacgccgacaactactacctcgcgcccgaaaacaaaaaaaactactaacgcccgcaaataataaacgtcgaaaaaatccccgtccttccgcctccgccatccccttcccttcccgaaaccccgccccttcccgaacccgcgcctctcaacccctctccccgcaaacaccgtaaaactaatccgaacgctaccgctaacgctaatactacacgaactcgaaaccgaacgcaaccgcgctaaaaaaccgctccgcctaaaaataaacgcaaaactactaatcgacgtaaatcaaaaactacgccgtaataaacgccgcccccgccctactaaccccgcacccccgcccaactccgaccgcgcgacctctaacaacccctcgctctacaaaaaccccctaactccgcgtacaccgaaacgaccccgcgctcaacgacccgcaaaaccgcgccctacaaaaaacgctcgtactctccgaccgcgcgccattcgccgccccctcgcccttcgcaaaactcgttctaccgccgcaacaataaaactcctttaccgcgaaaccttatcaatacttaaacgaaaacgaaaaaatccaaaactacgaaaacgaaaaccgtctcgataaacacgtaacccccgacgaactccgccttccgcgcacgcgctaaaaacctatcaacgactacgcccgtatacgcatacgcaactccgaaaacgcctacgccctacctataaacgtataacgcccgctttccctaaaccgacgaaacaaaacgcaaaaaactaaaaatcgacgcttcctctcgtacttaatccactaacgcgcgaccccgccgcgaaatacgaacgccgaaactaaaaaaaaaaaaaataaccctaaaaactcgctaaactccgaaataatttcccaactccgactactacgcgaaactaacgaaacaca

SEQ ID NO: 29121 - DNA, 1013 bp, Artificial Sequence
  chemically treated genomic DNA (Homo sapiens) CpG-island No: 29121
gcggttagagcgttagatagttataggcgtggagacggtggggcgtttatagtttcgggttcggagttttcgtttcgtagttttattcgtcggtttatttcgcgttattttttcgtcgtttttattttttttagatattcgtttagttgggtcgttacgtttattttttagtttttggtgaggtcgcggatgggttgtaagaggtgggcgaagcgcgtttttacgttttttatgttcgggagggaacgggcggtaaagggatcgtagggttgtttttcgaggggtacggcgtttttagttcgttattagttttggcgttattttgttgttttcgtttaggaaaatgcgtaggcgcggcgtcgcgcgtatgtttatgacgtaacgtgggtaaaagttagagaggcgaatttcggcgtcgcgtagcgggagtttatcggaagagtcgcggggcggggtcgaagttttcgggaggggggggtgggcggagttttgggttgttattagtttggacgggagggtttttggggtcgtcgtgggtcgggcggggcggggtggggcggggtttggagttgtcgcgggcgagcgggtcgaggaggcggggtttgggggttgttacgggttgggggggcggggcggtgaggaggcggggtttggggtagtcgcgggcgggcggacgggtcgaggaggcggggtttggggttgttacgggttgggcgggcggggcggtgaggaggcggggtttgggattgtcgcgggcgggcgggcgggtcgaggaggcggggtttggggttgttacggattgggcgggcggggcggtgaggaggcggggtttggggttgtcgcgggcgggcggacgcggagggcgggttttgttttagcgggtcgcgtagcggatatggcgggttttcggttttcgcggtagttttttttttagggcgtggcggtcgtttttatgtttgttttcgtttttttttatacgtaaattttaggtgaaggtatttagggtgggatat

SEQ ID NO: 29122 - DNA, 1013 bp, Artificial Sequence
  chemically treated genomic DNA (Homo sapiens) CpG-island No: 29122
atatcccaccctaaataccttcacctaaaatttacgtataaaaaaaaacgaaaacaaacataaaaacgaccgccacgccctaaaaaaaaaactaccgcgaaaaccgaaaacccgccatatccgctacgcgacccgctaaaacaaaacccgccctccgcgtccgcccgcccgcgacaaccccaaaccccgcctcctcaccgccccgcccgcccaatccgtaacaaccccaaaccccgcctcctcgacccgcccgcccgcccgcgacaatcccaaaccccgcctcctcaccgccccgcccgcccaacccgtaacaaccccaaaccccgcctcctcgacccgtccgcccgcccgcgactaccccaaaccccgcctcctcaccgccccgcccccccaacccgtaacaacccccaaaccccgcctcctcgacccgctcgcccgcgacaactccaaaccccgccccaccccgccccgcccgacccacgacgaccccaaaaaccctcccgtccaaactaataacaacccaaaactccgcccacccccccctcccgaaaacttcgaccccgccccgcgactcttccgataaactcccgctacgcgacgccgaaattcgcctctctaacttttacccacgttacgtcataaacatacgcgcgacgccgcgcctacgcattttcctaaacgaaaacaacaaaataacgccaaaactaataacgaactaaaaacgccgtacccctcgaaaaacaaccctacgatccctttaccgcccgttccctcccgaacataaaaaacgtaaaaacgcgcttcgcccacctcttacaacccatccgcgacctcaccaaaaactaaaaaataaacgtaacgacccaactaaacgaatatctaaaaaaaataaaaacgacgaaaaaataacgcgaaataaaccgacgaataaaactacgaaacgaaaactccgaacccgaaactataaacgccccaccgtctccacgcctataactatctaacgctctaaccgc

SEQ ID NO: 29123 - DNA, 1013 bp, Artificial Sequence
  chemically treated genomic DNA (Homo sapiens) CpG-island No: 29123
gtgttttattttgggtgtttttatttgggatttgcgtgtagagggaagcgaaagtaaatatgaagacggtcgttacgttttggaggaagagttgtcgcgggagtcgggagttcgttatgttcgttacgcggttcgttagagtagggttcgtttttcgcgttcgttcgttcgcggtagttttaggtttcgtttttttatcgtttcgttcgtttaattcgtggtagttttaagtttcgttttttcggttcgttcgttcgttcgcggtagttttaggtttcgtttttttatcgtttcgttcgtttaattcgtggtagttttaagtttcgttttttcggttcgttcgttcgttcgcggttgttttaggtttcgtttttttatcgtttcgtttttttaattcgtggtagtttttaagtttcgttttttcggttcgttcgttcgcggtagttttaggtttcgttttatttcgtttcgttcgatttacggcggttttaaaagttttttcgtttaaattggtggtagtttaaagtttcgtttatttttttttttcggaggtttcgatttcgtttcgcgattttttcggtgagttttcgttgcgcggcgtcggggttcgtttttttggtttttgtttacgttacgttatagatatgcgcgcgacgtcgcgtttacgtatttttttgggcgggaatagtaaaatggcgttagaattagtggcgggttgaggacgtcgtatttttcggaaggtagttttgcggtttttttgtcgttcgttttttttcggatatggaggacgtggaggcgcgtttcgtttattttttgtagtttattcgcgattttattaagaattgggaggtggacgtggcggtttagttgggcgagtatttggaggaggtaagggcggcgggggagtgacgcggggtgggtcggcgggtggggttgcggggcgggggtttcgggttcggggttgtgggcgttttatcgtttttacgtttatggttatttggcgttttggtcgt

SEQ ID NO: 29124 - DNA, 1013 bp, Artificial Sequence
  chemically treated genomic DNA (Homo sapiens) CpG-island No: 29124
acgaccaaaacgccaaataaccataaacgtaaaaacgataaaacgcccacaaccccgaacccgaaacccccgccccgcaaccccacccgccgacccaccccgcgtcactcccccgccgcccttacctcctccaaatactcgcccaactaaaccgccacgtccacctcccaattcttaataaaatcgcgaataaactacaaaaaataaacgaaacgcgcctccacgtcctccatatccgaaaaaaaacgaacgacaaaaaaaccgcaaaactaccttccgaaaaatacgacgtcctcaacccgccactaattctaacgccattttactattcccgcccaaaaaaatacgtaaacgcgacgtcgcgcgcatatctataacgtaacgtaaacaaaaaccaaaaaaacgaaccccgacgccgcgcaacgaaaactcaccgaaaaaatcgcgaaacgaaatcgaaacctccgaaaaaaaaaaataaacgaaactttaaactaccaccaatttaaacgaaaaaacttttaaaaccgccgtaaatcgaacgaaacgaaataaaacgaaacctaaaactaccgcgaacgaacgaaccgaaaaaacgaaacttaaaaactaccacgaattaaaaaaacgaaacgataaaaaaacgaaacctaaaacaaccgcgaacgaacgaacgaaccgaaaaaacgaaacttaaaactaccacgaattaaacgaacgaaacgataaaaaaacgaaacctaaaactaccgcgaacgaacgaacgaaccgaaaaaacgaaacttaaaactaccacgaattaaacgaacgaaacgataaaaaaacgaaacctaaaactaccgcgaacgaacgaacgcgaaaaacgaaccctactctaacgaaccgcgtaacgaacataacgaactcccgactcccgcgacaactcttcctccaaaacgtaacgaccgtcttcatatttactttcgcttccctctacacgcaaatcccaaataaaaacacccaaaataaaacac

SEQ ID NO: 29125 - DNA, 544 bp, Artificial Sequence
  chemically treated genomic DNA (Homo sapiens) CpG-island No: 29125
tttacgcgcgggcggggcgtagcgacgaaggggttaaggcgttttatttcgttttagttcgggtattggttgttttggggggcgtggtcggagggcgggttcgcgtttgtcgtagtcgttggtgggcggggttcgggcggggagtaggaggggcgcggagcggagtcgggttcgcgtagcgcgtttcgtcgggcgtgtttcgggttgcgttagtaagcggggtcggtggcgttcgtgtcggagatttcgcgtcggattttgaggtagcgagtaagtgaggtaggtttatcgtggtatttttttcggtttcgatttgtcgtcgtgtttgttgtattgcgcggtatgtttgatttgattcggattgggtagggggcgcgtttcgttgttagggttttaagggggaggggagcggagaggaggcggatgatgttatggatgtttcgttcggtttggggggaggtggcggttagagggggtgcggttcggattatgttattttttttttttgcgtttcgtttttcggggttatacgcgttggtgggga

SEQ ID NO: 29126 - DNA, 544 bp, Artificial Sequence
  chemically treated genomic DNA (Homo sapiens) CpG-island No: 29126
tccccaccaacgcgtataaccccgaaaaacgaaacgcaaaaaaaaaaaataacataatccgaaccgcaccccctctaaccgccacctccccccaaaccgaacgaaacatccataacatcatccgcctcctctccgctcccctcccccttaaaaccctaacaacgaaacgcgccccctacccaatccgaatcaaatcaaacataccgcgcaatacaacaaacacgacgacaaatcgaaaccgaaaaaaataccacgataaacctacctcacttactcgctacctcaaaatccgacgcgaaatctccgacacgaacgccaccgaccccgcttactaacgcaacccgaaacacgcccgacgaaacgcgctacgcgaacccgactccgctccgcgcccctcctactccccgcccgaaccccgcccaccaacgactacgacaaacgcgaacccgccctccgaccacgccccccaaaacaaccaatacccgaactaaaacgaaataaaacgccttaaccccttcgtcgctacgccccgcccgcgcgtaaa

SEQ ID NO: 29127 - DNA, 544 bp, Artificial Sequence
  chemically treated genomic DNA (Homo sapiens) CpG-island No: 29127
tttttattaacgcgtgtggtttcggggggcggggcgtagagggaagaggtgatataattcgagtcgtattttttttggtcgttatttttttttaggtcgggcgaagtatttatgatattattcgtttttttttcgttttttttttttttgggattttagtagcgggacgcgttttttatttagttcgggttaggttagatatgtcgcgtagtgtagtaggtacggcggtaggtcggagtcgggagggatgttacgatgggtttgttttatttattcgttgttttagggttcggcgcggggttttcgatacgggcgttatcggtttcgtttgttggcgtagttcgaagtacgttcggcggggcgcgttgcgcgggttcggtttcgtttcgcgttttttttgtttttcgttcgagtttcgtttattagcggttgcggtaaacgcgagttcgtttttcggttacgttttttagggtagttaatgttcgggttggggcggggtgaggcgttttaattttttcgtcgttgcgtttcgttcgcgcgtggg

SEQ ID NO: 29128 - DNA, 544 bp, Artificial Sequence
  chemically treated genomic DNA (Homo sapiens) CpG-island No: 29128
cccacgcgcgaacgaaacgcaacgacgaaaaaattaaaacgcctcaccccgccccaacccgaacattaactaccctaaaaaacgtaaccgaaaaacgaactcgcgtttaccgcaaccgctaataaacgaaactcgaacgaaaaacaaaaaaaacgcgaaacgaaaccgaacccgcgcaacgcgccccgccgaacgtacttcgaactacgccaacaaacgaaaccgataacgcccgtatcgaaaaccccgcgccgaaccctaaaacaacgaataaataaaacaaacccatcgtaacatccctcccgactccgacctaccgccgtacctactacactacgcgacatatctaacctaacccgaactaaataaaaaacgcgtcccgctactaaaatcccaaaaaaaaaaaaaacgaaaaaaaaacgaataatatcataaatacttcgcccgacctaaaaaaaaataacgaccaaaaaaaatacgactcgaattatatcacctcttccctctacgccccgccccccgaaaccacacgcgttaataaaaa

SEQ ID NO: 29129 - DNA, 530 bp, Artificial Sequence
  chemically treated genomic DNA (Homo sapiens) CpG-island No: 29129
agcgcgggtttcggggattcgagggcgcggaagttcgggggtcggggtcgagtatagattgggaggcgtagcgttgggcgtacgttttcgtcggttcggcggtttttaatgaggcgcgttgtgcgtagattgttaagagtagtatgagtacggtttcggcggtttttagggtttcgcgggtcggcgttatttcggagcgcggtgttcggaattatttagcgttattagtcgggcggttgggagggggaagcggtcgattcgggcggttgggagggggaagcggtcgatttaggcggtagcggagggggttgtagcggaggcggtttcggtttgtacgttcgttttttcgtttgttcggtagggtttcgtttgagttttaggttttaggtttagcggcgtcgttcgtcggtgaaggaaattagcgtagagaggtcgcgttgttaggcgcgtggtggttcgggggtttacgtgtgagtttcgttttaggttgttaattgagagttttattttcgtttagagagattttattt

SEQ ID NO: 29130 - DNA, 530 bp, Artificial Sequence
  chemically treated genomic DNA (Homo sapiens) CpG-island No: 29130
aaataaaatctctctaaacgaaaataaaactctcaattaacaacctaaaacgaaactcacacgtaaacccccgaaccaccacgcgcctaacaacgcgacctctctacgctaatttccttcaccgacgaacgacgccgctaaacctaaaacctaaaactcaaacgaaaccctaccgaacaaacgaaaaaacgaacgtacaaaccgaaaccgcctccgctacaaccccctccgctaccgcctaaatcgaccgcttccccctcccaaccgcccgaatcgaccgcttccccctcccaaccgcccgactaataacgctaaataattccgaacaccgcgctccgaaataacgccgacccgcgaaaccctaaaaaccgccgaaaccgtactcatactactcttaacaatctacgcacaacgcgcctcattaaaaaccgccgaaccgacgaaaacgtacgcccaacgctacgcctcccaatctatactcgaccccgacccccgaacttccgcgccctcgaatccccgaaacccgcgct

SEQ ID NO: 29131 - DNA, 530 bp, Artificial Sequence
  chemically treated genomic DNA (Homo sapiens) CpG-island No: 29131
aggtggggtttttttgggcggaggtggaatttttaattggtagtttagggcgaggtttatacgtggattttcggattattacgcgtttggtagcgcggtttttttgcgttggttttttttatcggcgagcggcgtcgttgggtttggggtttggggtttagacggggttttgtcgggtaggcggaagggcgagcgtgtaagtcggggtcgttttcgttgtagtttttttcgttgtcgtttggatcggtcgttttttttttttagtcgttcggatcggtcgttttttttttttagtcgttcggttgatggcgttaagtgatttcgggtatcgcgtttcggggtggcgtcgattcgcggggttttgggggtcgtcggagtcgtgtttatgttgtttttagtagtttgcgtatagcgcgttttattaggggtcgtcgggtcgacggggacgtgcgtttagcgttgcgttttttaatttgtgttcgatttcggttttcgagttttcgcgttttcgggttttcgaggttcgcgtt

SEQ ID NO: 29132 - DNA, 530 bp, Artificial Sequence
  chemically treated genomic DNA (Homo sapiens) CpG-island No: 29132
aacgcgaacctcgaaaacccgaaaacgcgaaaactcgaaaaccgaaatcgaacacaaattaaaaaacgcaacgctaaacgcacgtccccgtcgacccgacgacccctaataaaacgcgctatacgcaaactactaaaaacaacataaacacgactccgacgacccccaaaaccccgcgaatcgacgccaccccgaaacgcgatacccgaaatcacttaacgccatcaaccgaacgactaaaaaaaaaaaacgaccgatccgaacgactaaaaaaaaaaaacgaccgatccaaacgacaacgaaaaaaactacaacgaaaacgaccccgacttacacgctcgcccttccgcctacccgacaaaaccccgtctaaaccccaaaccccaaacccaacgacgccgctcgccgataaaaaaaaccaacgcaaaaaaaccgcgctaccaaacgcgtaataatccgaaaatccacgtataaacctcgccctaaactaccaattaaaaattccacctccgcccaaaaaaaccccacct

SEQ ID NO: 29133 - DNA, 805 bp, Artificial Sequence
  chemically treated genomic DNA (Homo sapiens) CpG-island No: 29133
gagggacgaggcgtttcggaaaagggagtgtaggtcgcggtggggtggggcggcgaaggtcggaagggataaaatcgtagtcgtcggtttcgcggggtttacggtttcgtttcggtatcgtagcgggttttttttatttagttttagtttttcgtttgcgttttatttttcgcgtttcgcgttttagtcgattatggtcgggtttttgcgcgtttcgttgtttttgttggttattttggtcgtggttttggtcgtgagtttcgcggtcggttttagtttcggtaagtcgtcgcgtttagtgggaggttttatggacgttagcgtggaggaggagggtgtgcggcgtgtattggattttgtcgtcggcgagtataataaagttagtaacgatatgtattatagtcgcgcgttgtaggtggtgcgcgttcgtaagtaggtgcgtgtcgtttttcgtagggttcgaagtttcggtttcgtcgttttagttttttttcgcgttgttttcggatttcgtgttgttttttttcggcgtttgggttttttattcggattttgttttcggttttcgttgttattttcgagtttttggcgggcgtgttcgggaatgttttgagtttggtttggtttggaatcgtacggatacgttaggttcgcgttcggcgtttaagattagtttttaggagttagttcgagttgcgtcgtagcgcgggggtaggtataggacgttttatatagttttgtttcgattttttgggacgttgggtttcgggtgcgttgttgaatacgtaggagaaggaaaaataga

SEQ ID NO: 29134 - DNA, 805 bp, Artificial Sequence
  chemically treated genomic DNA (Homo sapiens) CpG-island No: 29134
tctatttttccttctcctacgtattcaacaacgcacccgaaacccaacgtcccaaaaaatcgaaacaaaactatataaaacgtcctatacctacccccgcgctacgacgcaactcgaactaactcctaaaaactaatcttaaacgccgaacgcgaacctaacgtatccgtacgattccaaaccaaaccaaactcaaaacattcccgaacacgcccgccaaaaactcgaaaataacaacgaaaaccgaaaacaaaatccgaataaaaaacccaaacgccgaaaaaaaacaacacgaaatccgaaaacaacgcgaaaaaaaactaaaacgacgaaaccgaaacttcgaaccctacgaaaaacgacacgcacctacttacgaacgcgcaccacctacaacgcgcgactataatacatatcgttactaactttattatactcgccgacgacaaaatccaatacacgccgcacaccctcctcctccacgctaacgtccataaaacctcccactaaacgcgacgacttaccgaaactaaaaccgaccgcgaaactcacgaccaaaaccacgaccaaaataaccaacaaaaacaacgaaacgcgcaaaaacccgaccataatcgactaaaacgcgaaacgcgaaaaataaaacgcaaacgaaaaactaaaactaaataaaaaaaacccgctacgataccgaaacgaaaccgtaaaccccgcgaaaccgacgactacgattttatcccttccgaccttcgccgccccaccccaccgcgacctacactcccttttccgaaacgcctcgtccctc

SEQ ID NO: 29135 - DNA, 805 bp, Artificial Sequence
  chemically treated genomic DNA (Homo sapiens) CpG-island No: 29135
tttgttttttttttttttgcgtatttagtagcgtattcggagtttagcgttttaggaggtcgggatagagttgtgtgggacgttttgtgtttgttttcgcgttgcggcgtagttcgagttggtttttggaagttgattttaggcgtcgggcgcggatttgacgtgttcgtgcggttttaggttaggttagatttagggtattttcggatacgttcgttaagggttcgggggtgatagcgaagatcgggaatagggttcgggtgagaagtttaggcgtcggagaggagtagtacggggttcgggagtagcgcggggggaggttgggacggcggggtcggggtttcggattttgcggggggcggtacgtatttgtttgcgggcgcgtattatttgtagcgcgcggttgtggtatatgtcgttgttggttttgttgtattcgtcgacggtaaagtttagtgtacgtcgtatattttttttttttacgttggcgtttatggggttttttattaggcgcggcggtttgtcgggattggagtcggtcgcggggtttacggttagggttacggttaggatggttagtaggagtagcggggcgcgtaggggttcggttatggtcggttaggacgcgggacgcggggagtggggcgtaggcgagaggttggagttagatagagaggattcgttgcgatatcgaggcgaggtcgtgagtttcgcgaggtcggcgattgcggttttatttttttcggttttcgtcgttttattttatcgcggtttgtattttttttttcggaacgtttcgtttttt

SEQ ID NO: 29136 - DNA, 805 bp, Artificial Sequence
  chemically treated genomic DNA (Homo sapiens) CpG-island No: 29136
aaaaaacgaaacgttccgaaaaaaaaaatacaaaccgcgataaaataaaacgacgaaaaccgaaaaaaataaaaccgcaatcgccgacctcgcgaaactcacgacctcgcctcgatatcgcaacgaatcctctctatctaactccaacctctcgcctacgccccactccccgcgtcccgcgtcctaaccgaccataaccgaacccctacgcgccccgctactcctactaaccatcctaaccgtaaccctaaccgtaaaccccgcgaccgactccaatcccgacaaaccgccgcgcctaataaaaaaccccataaacgccaacgtaaaaaaaaaaaatatacgacgtacactaaactttaccgtcgacgaatacaacaaaaccaacaacgacatataccacaaccgcgcgctacaaataatacgcgcccgcaaacaaatacgtaccgccccccgcaaaatccgaaaccccgaccccgccgtcccaacctccccccgcgctactcccgaaccccgtactactcctctccgacgcctaaacttctcacccgaaccctattcccgatcttcgctatcacccccgaacccttaacgaacgtatccgaaaataccctaaatctaacctaacctaaaaccgcacgaacacgtcaaatccgcgcccgacgcctaaaatcaacttccaaaaaccaactcgaactacgccgcaacgcgaaaacaaacacaaaacgtcccacacaactctatcccgacctcctaaaacgctaaactccgaatacgctactaaatacgcaaaaaaaaaaaaaacaaa

SEQ ID NO: 29137 - DNA, 703 bp, Artificial Sequence
  chemically treated genomic DNA (Homo sapiens) CpG-island No: 29137
atgtttcgaggtttcgttatttcgtacgtaggataaaggtgttgagaatgaggcgcgttggttttgtattttttgtcgagagtcggaagttaggggcgcgtcggggtcggtcgggtacgtgtagggggtttttcggtcgtcgcgttgtttcgaagtcggttttggggattcgcggttgcgcggatcgagttcgcgaaggggattaggttcgcggaggggtcgtagcggttttaaggatggcgtatgaagattttttacgtaagatagtcggtcgcgggggttaggggcggtttttttcgggttcggtttcgttcgattgatttgtgacgttggttcgggtgacgcgttgtattacggtttttatggcggcggttggggcgagtggggcggcgtcgcgttgcgttcggtttcgcgattttgagggcggattcgtagtcgtcgttttttggaggtgatattcggaagcgcgtttaattggtcggttcgattcggtcggttgttatttattttacgtcggttacgtttattttcggtttggcgataggtttatttatttatagattgatttcgtttatgtttgttacgtttatttgttgtttaatcgtaatttcgttcgttattgaaaagtttagtttttacgttcggttttgttttatttatatttgggtttcgttagagttttttgatttttttatttcgggtt

SEQ ID NO: 29138 - DNA, 703 bp, Artificial Sequence
  chemically treated genomic DNA (Homo sapiens) CpG-island No: 29138
aacccgaaataaaaaaatcaaaaaactctaacgaaacccaaatataaataaaacaaaaccgaacgtaaaaactaaacttttcaataacgaacgaaattacgattaaacaacaaataaacgtaacaaacataaacgaaatcaatctataaataaataaacctatcgccaaaccgaaaataaacgtaaccgacgtaaaataaataacaaccgaccgaatcgaaccgaccaattaaacgcgcttccgaatatcacctccaaaaaacgacgactacgaatccgccctcaaaatcgcgaaaccgaacgcaacgcgacgccgccccactcgccccaaccgccgccataaaaaccgtaatacaacgcgtcacccgaaccaacgtcacaaatcaatcgaacgaaaccgaacccgaaaaaaaccgcccctaacccccgcgaccgactatcttacgtaaaaaatcttcatacgccatccttaaaaccgctacgacccctccgcgaacctaatccccttcgcgaactcgatccgcgcaaccgcgaatccccaaaaccgacttcgaaacaacgcgacgaccgaaaaaccccctacacgtacccgaccgaccccgacgcgcccctaacttccgactctcgacaaaaaatacaaaaccaacgcgcctcattctcaacacctttatcctacgtacgaaataacgaaacctcgaaacat

SEQ ID NO: 29139 - DNA, 703 bp, Artificial Sequence
  chemically treated genomic DNA (Homo sapiens) CpG-island No: 29139
ggttcgggatggggggattaaagggttttggcgggatttagatgtggatggggtagggtcgagcgtggggattgggttttttaatgacgggcggggttacggttgggtagtaggtgggcgtggtaggtataggcggagttaatttatgagtgggtgggtttatcgttaggtcgagagtgggcgtggtcgacgtggggtgggtagtagtcgatcgagtcggatcggttagttgggcgcgttttcgggtgttatttttagagggcgacggttgcggattcgtttttagagtcgcgaggtcggacgtagcgcggcgtcgttttattcgttttagtcgtcgttatgaaggtcgtggtgtagcgcgttattcgggttagcgttataggttagtcgggcggggtcgggttcgggaggagtcgtttttgattttcgcgatcggttgttttgcgtggggggtttttatgcgttatttttggggtcgttgcggttttttcgcgagtttggtttttttcgcgagttcggttcgcgtagtcgcgagtttttagggtcggtttcggggtagcgcggcggtcggagagttttttgtacgtgttcgatcggtttcggcgcgtttttggttttcggttttcggtagagggtgtaggattagcgcgttttatttttagtatttttgttttgcgtgcgggatggcggagtttcggagtat

SEQ ID NO: 29140 - DNA, 703 bp, Artificial Sequence
  chemically treated genomic DNA (Homo sapiens) CpG-island No: 29140
atactccgaaactccgccatcccgcacgcaaaacaaaaatactaaaaataaaacgcgctaatcctacaccctctaccgaaaaccgaaaaccaaaaacgcgccgaaaccgatcgaacacgtacaaaaaactctccgaccgccgcgctaccccgaaaccgaccctaaaaactcgcgactacgcgaaccgaactcgcgaaaaaaaccaaactcgcgaaaaaaccgcaacgaccccaaaaataacgcataaaaaccccccacgcaaaacaaccgatcgcgaaaatcaaaaacgactcctcccgaacccgaccccgcccgactaacctataacgctaacccgaataacgcgctacaccacgaccttcataacgacgactaaaacgaataaaacgacgccgcgctacgtccgacctcgcgactctaaaaacgaatccgcaaccgtcgccctctaaaaataacacccgaaaacgcgcccaactaaccgatccgactcgatcgactactacccaccccacgtcgaccacgcccactctcgacctaacgataaacccacccactcataaattaactccgcctatacctaccacgcccacctactacccaaccgtaaccccgcccgtcattaaaaaacccaatccccacgctcgaccctaccccatccacatctaaatcccgccaaaaccctttaatccccccatcccgaacc

SEQ ID NO: 29141 - DNA, 722 bp, Artificial Sequence
  chemically treated genomic DNA (Homo sapiens) CpG-island No: 29141
gggatcgtttttcgcggtttaagcgtgtttttgttttgagtcggttttcgtttcgtttttcgggttcgtcgcgtttttttcgcgtcgttttcgtttcggtttttttttttcgtcgtttttttgttttgtttttcgtttcgttttcgttcgcggcgcgtttttttttcgtttttcgcgttcgtttttgtagttcgcgtttttcgtatcgtttcgcgttttcgtggcgttcgttcgcgcgcgttcgcgtttcgttttttttcgcgcggtttcgtattggcgtgttgtagggcgcggtgtattgcgtcgttatcgttaataggtggattttttttcggagataaaatcgtcggcgtcggcgtcgttagtttttttggttgagatttcggtttcgggtaaggacgttcggttttcgggttttcgttttcgttttcgtttttcgaagagggattttcggggtcggttttggggggtagagggtggtcgggtttcgtattcgttttcgcgcgcgttcggagttcggttttcgggggttttcgcgtcggtcgggttgggttcggggtggggggcggcgcggggcggcggggtcgggttttgggcggcgatcgtttcgtagtcgtgattttggggtcgcggggattttgcgggtcgggggttgatgggggtcgggtttcggggcgttgggttagaggacgttgagggaggtggtgagatttgggggtttt

SEQ ID NO: 29142 - DNA, 722 bp, Artificial Sequence
  chemically treated genomic DNA (Homo sapiens) CpG-island No: 29142
aaaacccccaaatctcaccacctccctcaacgtcctctaacccaacgccccgaaacccgacccccatcaacccccgacccgcaaaatccccgcgaccccaaaatcacgactacgaaacgatcgccgcccaaaacccgaccccgccgccccgcgccgccccccaccccgaacccaacccgaccgacgcgaaaacccccgaaaaccgaactccgaacgcgcgcgaaaacgaatacgaaacccgaccaccctctaccccccaaaaccgaccccgaaaatccctcttcgaaaaacgaaaacgaaaacgaaaacccgaaaaccgaacgtccttacccgaaaccgaaatctcaaccaaaaaaactaacgacgccgacgccgacgattttatctccgaaaaaaaatccacctattaacgataacgacgcaatacaccgcgccctacaacacgccaatacgaaaccgcgcgaaaaaaaacgaaacgcgaacgcgcgcgaacgaacgccacgaaaacgcgaaacgatacgaaaaacgcgaactacaaaaacgaacgcgaaaaacgaaaaaaaaacgcgccgcgaacgaaaacgaaacgaaaaacaaaacaaaaaaacgacgaaaaaaaaaaaccgaaacgaaaacgacgcgaaaaaaacgcgacgaacccgaaaaacgaaacgaaaaccgactcaaaacaaaaacacgcttaaaccgcgaaaaacgatccc

SEQ ID NO: 29143 - DNA, 722 bp, Artificial Sequence
  chemically treated genomic DNA (Homo sapiens) CpG-island No: 29143
agggtttttagattttattattttttttagcgttttttggtttagcgtttcgaagttcgatttttattagttttcggttcgtagggttttcgcggttttaaggttacggttacggggcgatcgtcgtttaggattcggtttcgtcgtttcgcgtcgttttttatttcgggtttagttcggtcgacgcggggattttcggaagtcggatttcgggcgcgcgcgggggcgggtgcggggttcggttattttttgttttttaggatcggtttcgggggttttttttcggaagacgggggcgggggcggaggttcgggggtcgagcgtttttattcggagtcgaggttttagttagagggattggcggcgtcggcgtcggcggttttattttcgggagggggtttatttattgacggtggcggcgtagtgtatcgcgttttgtagtacgttaatgcggaatcgcgcgggagggggcggggcgcggacgcgcgcgggcgggcgttacggggacgcgaggcgatgcgggaggcgcgggttgtaaagacggacgcgggaggcgggggagaaacgcgtcgcgggcgggggcggggcggggggtagggtagggaggcggcgggagggagggatcgggacggagacggcgcggggagagcgcggcgggttcgggagacggggcgagagtcggtttagggtaggaatacgtttgagtcgcgaaaagcggtttt

SEQ ID NO: 29144 - DNA, 722 bp, Artificial Sequence
  chemically treated genomic DNA (Homo sapiens) CpG-island No: 29144
aaaaccgcttttcgcgactcaaacgtattcctaccctaaaccgactctcgccccgtctcccgaacccgccgcgctctccccgcgccgtctccgtcccgatccctccctcccgccgcctccctaccctaccccccgccccgcccccgcccgcgacgcgtttctcccccgcctcccgcgtccgtctttacaacccgcgcctcccgcatcgcctcgcgtccccgtaacgcccgcccgcgcgcgtccgcgccccgccccctcccgcgcgattccgcattaacgtactacaaaacgcgatacactacgccgccaccgtcaataaataaaccccctcccgaaaataaaaccgccgacgccgacgccgccaatccctctaactaaaacctcgactccgaataaaaacgctcgacccccgaacctccgcccccgcccccgtcttccgaaaaaaaacccccgaaaccgatcctaaaaaacaaaaaataaccgaaccccgcacccgcccccgcgcgcgcccgaaatccgacttccgaaaatccccgcgtcgaccgaactaaacccgaaataaaaaacgacgcgaaacgacgaaaccgaatcctaaacgacgatcgccccgtaaccgtaaccttaaaaccgcgaaaaccctacgaaccgaaaactaataaaaatcgaacttcgaaacgctaaaccaaaaaacgctaaaaaaaataataaaatctaaaaaccct

SEQ ID NO: 29145 - DNA, 939 bp, Artificial Sequence
  chemically treated genomic DNA (Homo sapiens) CpG-island No: 29145
agtcgtcgcgttgggttatttatcgaggcggggttttttagttttcggtatcgttttcgtcgcgcggggcgcgggcggttttaattagtttaaatcggtcgagcgggtggaataaaggcgttttgtgcgcggggtttcggtttagacgtcgggaatttggtgggcgtcgttttaattcgttcgattcgagaggagttcgtcggggatttcgagtttagcgttcgttaggcggagaggagaggagttttcggtttagtttcgtttttcgtttttcgtttttcgggtttgttcgttttattcgcgcgcggcgttttttatttgggcggcgatttttcgcgggtttcggcgtacgattacgggtggcggggacgggggcgttaggttacggagtttatttgtagagaagatcgcgggaagtcgcgttacgatagagaggcgcgcgcggggtgcgtacgcgcggacgcgtttatttatatgcgcgggggtcgcggcgcgttacggagggcggggcgtataggttttttttcgggttttattcggtttcgttttttttttggtttcggcgaggtcgcgtttttagtttttatttcggtgcgattttcgtcgtttggtttgggttgagtttagttttgcggcgttcgttttggggcggttcggtcggttttgggtttgtaggggttaaaaggtttcgcgttcgggttcgggagtttagttttcgtttttttttcgggtttaggttttcgtttcggacgcgtttcggagtttcgtttggtttagttcgttcgttttttttagtttttgtggaggcgacgggggcgtcgggcgggttaaaaagtgttacgtgcgcggagtttttcggttcggtttttagggatttcgtagttagaggaatttggatttttttcgagttttttttatagttttggtagtttcggaatt

SEQ ID NO: 29146 - DNA, 939 bp, Artificial Sequence
  chemically treated genomic DNA (Homo sapiens) CpG-island No: 29146
aattccgaaactaccaaaactataaaaaaaactcgaaaaaaatccaaattcctctaactacgaaatccctaaaaaccgaaccgaaaaactccgcgcacgtaacactttttaacccgcccgacgcccccgtcgcctccacaaaaactaaaaaaaacgaacgaactaaaccaaacgaaactccgaaacgcgtccgaaacgaaaacctaaacccgaaaaaaaaacgaaaactaaactcccgaacccgaacgcgaaaccttttaacccctacaaacccaaaaccgaccgaaccgccccaaaacgaacgccgcaaaactaaactcaacccaaaccaaacgacgaaaatcgcaccgaaataaaaactaaaaacgcgacctcgccgaaaccaaaaaaaaaacgaaaccgaataaaacccgaaaaaaaacctatacgccccgccctccgtaacgcgccgcgacccccgcgcatataaataaacgcgtccgcgcgtacgcaccccgcgcgcgcctctctatcgtaacgcgacttcccgcgatcttctctacaaataaactccgtaacctaacgcccccgtccccgccacccgtaatcgtacgccgaaacccgcgaaaaatcgccgcccaaataaaaaacgccgcgcgcgaataaaacgaacaaacccgaaaaacgaaaaacgaaaaacgaaactaaaccgaaaactcctctcctctccgcctaacgaacgctaaactcgaaatccccgacgaactcctctcgaatcgaacgaattaaaacgacgcccaccaaattcccgacgtctaaaccgaaaccccgcgcacaaaacgcctttattccacccgctcgaccgatttaaactaattaaaaccgcccgcgccccgcgcgacgaaaacgataccgaaaactaaaaaaccccgcctcgataaataacccaacgcgacgact

SEQ ID NO: 29147 - DNA, 939 bp, Artificial Sequence
  chemically treated genomic DNA (Homo sapiens) CpG-island No: 29147
ggtttcggagttgttagagttgtgagggggattcgggagagatttaggtttttttggttgcgaagtttttggaggtcgggtcggagggtttcgcgtacgtagtattttttggttcgttcggcgttttcgtcgtttttataagggttgaagaggacgggcgggttggattaggcggggtttcgagacgcgttcgagacgggggtttgggttcgggagaggggcgggggttgggttttcggattcgggcgcggggttttttaatttttgtagatttaggatcggtcgggtcgttttaagacgaacgtcgtagggttgggtttagtttaagttagacggcgagagtcgtatcgaggtggaagttgggggcgcggtttcgtcggggttaggaaaggggcggggtcgggtggggttcggggaggagtttgtgcgtttcgtttttcgtgacgcgtcgcggttttcgcgtatataagtgggcgcgttcgcgcgtgcgtatttcgcgcgcgtttttttgtcgtggcgcggtttttcgcggttttttttgtaaatgggtttcgtggtttagcgttttcgttttcgttattcgtgatcgtgcgtcgaggttcgcgaggggtcgtcgtttaggtgaggggcgtcgcgcgcgggtgggacgagtaggttcgaggggcggggggcgaggggcggggttgggtcgggggtttttttttttttcgtttggcgagcgttgggttcggggttttcggcgggtttttttcgggtcgggcgggttgggacggcgtttattaggttttcgacgtttgggtcggggtttcgcgtataaagcgtttttgttttattcgttcggtcggtttgggttggttggagtcgttcgcgtttcgcgcggcgaaggcggtgtcgggagttggggagtttcgtttcggtaaataatttagcgcggcggtt

SEQ ID NO: 29148 - DNA, 939 bp, Artificial Sequence
  chemically treated genomic DNA (Homo sapiens) CpG-island No: 29148
aaccgccgcgctaaattatttaccgaaacgaaactccccaactcccgacaccgccttcgccgcgcgaaacgcgaacgactccaaccaacccaaaccgaccgaacgaataaaacaaaaacgctttatacgcgaaaccccgacccaaacgtcgaaaacctaataaacgccgtcccaacccgcccgacccgaaaaaaacccgccgaaaaccccgaacccaacgctcgccaaacgaaaaaaaaaaaaacccccgacccaaccccgcccctcgccccccgcccctcgaacctactcgtcccacccgcgcgcgacgcccctcacctaaacgacgacccctcgcgaacctcgacgcacgatcacgaataacgaaaacgaaaacgctaaaccacgaaacccatttacaaaaaaaaccgcgaaaaaccgcgccacgacaaaaaaacgcgcgcgaaatacgcacgcgcgaacgcgcccacttatatacgcgaaaaccgcgacgcgtcacgaaaaacgaaacgcacaaactcctccccgaaccccacccgaccccgcccctttcctaaccccgacgaaaccgcgcccccaacttccacctcgatacgactctcgccgtctaacttaaactaaacccaaccctacgacgttcgtcttaaaacgacccgaccgatcctaaatctacaaaaattaaaaaaccccgcgcccgaatccgaaaacccaacccccgcccctctcccgaacccaaacccccgtctcgaacgcgtctcgaaaccccgcctaatccaacccgcccgtcctcttcaacccttataaaaacgacgaaaacgccgaacgaaccaaaaaatactacgtacgcgaaaccctccgacccgacctccaaaaacttcgcaaccaaaaaaacctaaatctctcccgaatccccctcacaactctaacaactccgaaacc

SEQ ID NO: 29149 - DNA, 574 bp, Artificial Sequence
  chemically treated genomic DNA (Homo sapiens) CpG-island No: 29149
ggggtttcgtaatttgagagcgtgtagacgttgggtgagggattggtcgaaggtggagtgtttgggtattatcgggtcgcgatcgtttttaggttcggtttcgggtttagtggtgggggcggttttaggttcggtttcgaagtcggtttcggattcgatttcggattcggtttcgttttcggtttcgtagtcgaattttttttcgtattttaggtattcggggagggatagtttaaggtttgttttttcgtgttcgtggttagatttcgattcgggggatttagggaatatttgggcgtcggagcggtggtgggcgttaaggaagtttcggcgttgttgggtagtcgcgcgttgttgggtacgggcgttggaggtggtaagggcgcggaggagcgcgatggagtaggagagttagaggagcgcggtggttgttcggcggtttatgggcgggtataggtcgttgtaattatggcgagttcggcgttattgttgagttcgggattttcgatttatttttttaggtatatatcgagaagtcggtttgttttttggttttgtagagagtggtttcgaa

SEQ ID NO: 29150 - DNA, 574 bp, Artificial Sequence
  chemically treated genomic DNA (Homo sapiens) CpG-island No: 29150
ttcgaaaccactctctacaaaaccaaaaaacaaaccgacttctcgatatatacctaaaaaaataaatcgaaaatcccgaactcaacaataacgccgaactcgccataattacaacgacctatacccgcccataaaccgccgaacaaccaccgcgctcctctaactctcctactccatcgcgctcctccgcgcccttaccacctccaacgcccgtacccaacaacgcgcgactacccaacaacgccgaaacttccttaacgcccaccaccgctccgacgcccaaatattccctaaatcccccgaatcgaaatctaaccacgaacacgaaaaaacaaaccttaaactatccctccccgaatacctaaaatacgaaaaaaaattcgactacgaaaccgaaaacgaaaccgaatccgaaatcgaatccgaaaccgacttcgaaaccgaacctaaaaccgcccccaccactaaacccgaaaccgaacctaaaaacgatcgcgacccgataatacccaaacactccaccttcgaccaatccctcacccaacgtctacacgctctcaaattacgaaacccc

SEQ ID NO: 29151 - DNA, 574 bp, Artificial Sequence
  chemically treated genomic DNA (Homo sapiens) CpG-island No: 29151
ttcggagttattttttgtagagttagagggtaggtcggtttttcggtgtgtgtttaagaggatggatcggaggtttcgggtttagtagtggcgtcgagttcgttataattataacgatttgtgttcgtttataggtcgtcgggtagttatcgcgtttttttggtttttttgttttatcgcgttttttcgcgtttttgttatttttaacgttcgtgtttagtagcgcgcggttgtttaatagcgtcggagtttttttaacgtttattatcgtttcggcgtttaggtattttttgagtttttcgaatcggaatttgattacgagtacgaggaggtagattttgagttgttttttttcgagtgtttagagtacgaggaagagttcgattacgagatcgagagcgagatcgagttcgaaatcgagttcgagatcgatttcgagatcgagtttgagatcgtttttattattgagttcgagatcgagtttgaagacgatcgcggttcggtggtgtttaagtattttattttcggttagttttttatttagcgtttgtacgtttttaagttgcgaagtttt

SEQ ID NO: 29152 - DNA, 574 bp, Artificial Sequence
  chemically treated genomic DNA (Homo sapiens) CpG-island No: 29152
aaaacttcgcaacttaaaaacgtacaaacgctaaataaaaaactaaccgaaaataaaatacttaaacaccaccgaaccgcgatcgtcttcaaactcgatctcgaactcaataataaaaacgatctcaaactcgatctcgaaatcgatctcgaactcgatttcgaactcgatctcgctctcgatctcgtaatcgaactcttcctcgtactctaaacactcgaaaaaaaacaactcaaaatctacctcctcgtactcgtaatcaaattccgattcgaaaaactcaaaaaatacctaaacgccgaaacgataataaacgttaaaaaaactccgacgctattaaacaaccgcgcgctactaaacacgaacgttaaaaataacaaaaacgcgaaaaaacgcgataaaacaaaaaaaccaaaaaaacgcgataactacccgacgacctataaacgaacacaaatcgttataattataacgaactcgacgccactactaaacccgaaacctccgatccatcctcttaaacacacaccgaaaaaccgacctaccctctaactctacaaaaaataactccgaa

SEQ ID NO: 29153 - DNA, 530 bp, Artificial Sequence
  chemically treated genomic DNA (Homo sapiens) CpG-island No: 29153
tgcgtatatatgtagtttattttttcgttttggagttgtttgtcgatgagtttattgcgttttttttttgcgcgtttttgggttcgtttttttagggtttttttgcgtatttgtttgcgttttttcgttaggggtatttttttgattttgagagagcgcgaggttttgggttggggatttttagatcgatcgaagtagttttcgaaggtttgtacgagaaagttgcggagtaagttgcgttggggttttcggcggcggcgatttcgtcgatgttgaaattagcggaggtattcggaggttttatcgtcggattcgttttcgttggagttatcgtcgttgttggttatttttttatcgtagtatacgcggcggtcgcggttgttttcggatttgtttcgttaggtagacgcgcgagtaggtcgcggagtaggcggatcggtagtttggatttcggggttggggggtttgagatggattttgcgtttggtttcggaggtaggggttgtagaggtcgttcggcggatttgggt

SEQ ID NO: 29154 - DNA, 530 bp, Artificial Sequence
  chemically treated genomic DNA (Homo sapiens) CpG-island No: 29154
acccaaatccgccgaacgacctctacaacccctacctccgaaaccaaacgcaaaatccatctcaaaccccccaaccccgaaatccaaactaccgatccgcctactccgcgacctactcgcgcgtctacctaacgaaacaaatccgaaaacaaccgcgaccgccgcgtatactacgataaaaaaataaccaacaacgacgataactccaacgaaaacgaatccgacgataaaacctccgaatacctccgctaatttcaacatcgacgaaatcgccgccgccgaaaaccccaacgcaacttactccgcaactttctcgtacaaaccttcgaaaactacttcgatcgatctaaaaatccccaacccaaaacctcgcgctctctcaaaatcaaaaaaatacccctaacgaaaaaacgcaaacaaatacgcaaaaaaaccctaaaaaaacgaacccaaaaacgcgcaaaaaaaaaacgcaataaactcatcgacaaacaactccaaaacgaaaaaataaactacatatatacgca

SEQ ID NO: 29155 - DNA, 530 bp, Artificial Sequence
  chemically treated genomic DNA (Homo sapiens) CpG-island No: 29155
gtttaagttcgtcgggcggtttttgtagtttttgttttcggggttagacgtaagatttattttagattttttagtttcgagatttaggttgtcgattcgtttatttcgcggtttattcgcgcgtttgtttggcggggtaagttcgagagtagtcgcggtcgtcgcgtgtattacgatgaaggggtggttagtagcgacgatgattttagcggagacgagttcgacgatgggattttcggatgttttcgttggttttagtatcggcgaaatcgtcgtcgtcgaaagttttagcgtaatttatttcgtaattttttcgtgtaagttttcgggggttgtttcggtcgatttgagagtttttagtttaaagtttcgcgtttttttaaggttaagaaggtatttttggcggagaagcgtagatagatgcgtaaagaagttttggagaagcgggtttagaagcgcgtagagaagaaacgtagtaagtttatcgataaataattttaggacgaaaagatgggttatatgtgtacgta

SEQ ID NO: 29156 - DNA, 530 bp, Artificial Sequence
  chemically treated genomic DNA (Homo sapiens) CpG-island No: 29156
tacgtacacatataacccatcttttcgtcctaaaattatttatcgataaacttactacgtttcttctctacgcgcttctaaacccgcttctccaaaacttctttacgcatctatctacgcttctccgccaaaaataccttcttaaccttaaaaaaacgcgaaactttaaactaaaaactctcaaatcgaccgaaacaacccccgaaaacttacacgaaaaaattacgaaataaattacgctaaaactttcgacgacgacgatttcgccgatactaaaaccaacgaaaacatccgaaaatcccatcgtcgaactcgtctccgctaaaatcatcgtcgctactaaccaccccttcatcgtaatacacgcgacgaccgcgactactctcgaacttaccccgccaaacaaacgcgcgaataaaccgcgaaataaacgaatcgacaacctaaatctcgaaactaaaaaatctaaaataaatcttacgtctaaccccgaaaacaaaaactacaaaaaccgcccgacgaacttaaac

SEQ ID NO: 29157 - DNA, 632 bp, Artificial Sequence
  chemically treated genomic DNA (Homo sapiens) CpG-island No: 29157
aggtcggtcggtcgtagcgtgtcggggtcgtacgtggtgacgtcgaacgatagcgcgtcgggtcgcgcgttattcgagcgcgtgattttgacgaagatggtttcggttacgcgtacgggtcggttggtgaagacgagcgcgcgttcgtcgcgttcgtgttttacgcgcgttatcgtttgttcgtcgaggatgcggacgtgcgcgtcggcgcgtagggcgtggaaacgtaggtcgtcgtcgagttgcgtcggtagcgcgcggttgtgttgcgagttgagtgagttttgcgggatggggtagtcggcggtcggcgcggtttcgtcgtcgttcgcgttcggtacgttgaggtcgtataggtttatcgagaggcgcgcgtcgttcgtttcgcgtcgtagcgacggtcgtcgtagggcggtgaaggagcgcggtcgtagatagttcgggagtattagttcgttatttgcgcgggagatacggggtagtgttacgtagggttttcgggaggcggtttcggcgcgtttcgttgttcggtttttacgcgcgtatcgttataatttcggatggttaatggcgtatacgatgtttgtgatataaattagcgaatatagttaagaaacgatttttgtaggata

SEQ ID NO: 29158 - DNA, 632 bp, Artificial Sequence
  chemically treated genomic DNA (Homo sapiens) CpG-island No: 29158
tatcctacaaaaatcgtttcttaactatattcgctaatttatatcacaaacatcgtatacgccattaaccatccgaaattataacgatacgcgcgtaaaaaccgaacaacgaaacgcgccgaaaccgcctcccgaaaaccctacgtaacactaccccgtatctcccgcgcaaataacgaactaatactcccgaactatctacgaccgcgctccttcaccgccctacgacgaccgtcgctacgacgcgaaacgaacgacgcgcgcctctcgataaacctatacgacctcaacgtaccgaacgcgaacgacgacgaaaccgcgccgaccgccgactaccccatcccgcaaaactcactcaactcgcaacacaaccgcgcgctaccgacgcaactcgacgacgacctacgtttccacgccctacgcgccgacgcgcacgtccgcatcctcgacgaacaaacgataacgcgcgtaaaacacgaacgcgacgaacgcgcgctcgtcttcaccaaccgacccgtacgcgtaaccgaaaccatcttcgtcaaaatcacgcgctcgaataacgcgcgacccgacgcgctatcgttcgacgtcaccacgtacgaccccgacacgctacgaccgaccgacct

SEQ ID NO: 29159 - DNA, 632 bp, Artificial Sequence
  chemically treated genomic DNA (Homo sapiens) CpG-island No: 29159
tgttttgtaagagtcgttttttgattgtgttcgttaatttatgttataagtatcgtgtgcgttattagttattcgggattgtaacggtgcgcgcgtagggatcggatagcggggcgcgtcggggtcgtttttcgagagttttgcgtgatattgtttcgtgtttttcgcgtagatagcgagttggtgttttcggattgtttgcggtcgcgtttttttatcgttttgcggcggtcgtcgttgcggcgcgaggcggacgacgcgcgtttttcggtgagtttatgcgattttaacgtgtcgggcgcggacggcgacgaggtcgcgtcggtcgtcggttgttttatttcgtagaatttatttaattcgtagtatagtcgcgcgttgtcggcgtagttcgacggcgatttgcgtttttacgttttgcgcgtcggcgcgtacgttcgtattttcgacgagtagacggtggcgcgcgtggagtacgggcgcgacgagcgcgcgttcgtttttattagtcggttcgtgcgcgtggtcgagattattttcgttaaggttacgcgttcgggtggcgcgcggttcggcgcgttgtcgttcggcgttattacgtgcgatttcggtacgttgcggtcggtcgattt

SEQ ID NO: 29160 - DNA, 632 bp, Artificial Sequence
  chemically treated genomic DNA (Homo sapiens) CpG-island No: 29160
aaatcgaccgaccgcaacgtaccgaaatcgcacgtaataacgccgaacgacaacgcgccgaaccgcgcgccacccgaacgcgtaaccttaacgaaaataatctcgaccacgcgcacgaaccgactaataaaaacgaacgcgcgctcgtcgcgcccgtactccacgcgcgccaccgtctactcgtcgaaaatacgaacgtacgcgccgacgcgcaaaacgtaaaaacgcaaatcgccgtcgaactacgccgacaacgcgcgactatactacgaattaaataaattctacgaaataaaacaaccgacgaccgacgcgacctcgtcgccgtccgcgcccgacacgttaaaatcgcataaactcaccgaaaaacgcgcgtcgtccgcctcgcgccgcaacgacgaccgccgcaaaacgataaaaaaacgcgaccgcaaacaatccgaaaacaccaactcgctatctacgcgaaaaacacgaaacaatatcacgcaaaactctcgaaaaacgaccccgacgcgccccgctatccgatccctacgcgcgcaccgttacaatcccgaataactaataacgcacacgatacttataacataaattaacgaacacaatcaaaaaacgactcttacaaaaca

SEQ ID NO: 29161 - DNA, 577 bp, Artificial Sequence
  chemically treated genomic DNA (Homo sapiens) CpG-island No: 29161
ttggcgtcgggattacgcggtcgaggcgatcgaaagagaaacgaggttaggtaaggaggaggaaatttattcgatgaaggcgagttgtcgtttaagagggaggagggttttttcggttgtcgttgttgttgtttcgggacgtcgtttggggagttagttcgttcgtaaggtgcgcgttaggtagtttcgtatttagggggcgttttttttggttttttttagagcggtcgggacggaaggagttgcgcggcgcggcgcggcgcggcgcggcgggtggcgagggcgggttgtatttcgagcgcggcgtttttgagttgtatcgcggcgtaggtttgcgagtcgatttgttagtcggttaagaaaaggaagtttcgttttttttcgtttattcggtttttttattttttgtattttaaattttgtagagggcgagcggcgcggttacggaggcgtcgaggaggagcgagtcgtcgtcgggtagcggcgtgttttcgggggagagggcgtcggagaggaggcggcggcgcggcggcgagggcgcggcgcgcgatggtagttgtttagttcggcgggcgcg

SEQ ID NO: 29162 - DNA, 577 bp, Artificial Sequence
  chemically treated genomic DNA (Homo sapiens) CpG-island No: 29162
cgcgcccgccgaactaaacaactaccatcgcgcgccgcgccctcgccgccgcgccgccgcctcctctccgacgccctctcccccgaaaacacgccgctacccgacgacgactcgctcctcctcgacgcctccgtaaccgcgccgctcgccctctacaaaatttaaaatacaaaaaataaaaaaaccgaataaacgaaaaaaaacgaaacttccttttcttaaccgactaacaaatcgactcgcaaacctacgccgcgatacaactcaaaaacgccgcgctcgaaatacaacccgccctcgccacccgccgcgccgcgccgcgccgcgccgcgcaactccttccgtcccgaccgctctaaaaaaaaccaaaaaaaacgccccctaaatacgaaactacctaacgcgcaccttacgaacgaactaactccccaaacgacgtcccgaaacaacaacaacgacaaccgaaaaaaccctcctccctcttaaacgacaactcgccttcatcgaataaatttcctcctccttacctaacctcgtttctctttcgatcgcctcgaccgcgtaatcccgacgccaa

SEQ ID NO: 29163 - DNA, 577 bp, Artificial Sequence
  chemically treated genomic DNA (Homo sapiens) CpG-island No: 29163
cgcgttcgtcgggttaagtagttgttatcgcgcgtcgcgttttcgtcgtcgcgtcgtcgtttttttttcggcgttttttttttcgagggtacgtcgttgttcggcggcggttcgttttttttcggcgttttcgtggtcgcgtcgttcgttttttgtagagtttagagtataaggggtggggaagtcgggtgagcgggaagggacggagttttttttttttggtcggttgataagtcggttcgtaaatttgcgtcgcggtgtagtttaagggcgtcgcgttcggggtgtagttcgttttcgttattcgtcgcgtcgcgtcgcgtcgcgtcgcgtagtttttttcgtttcggtcgttttgggaggggttaggaagggcgttttttgggtgcggagttatttggcgcgtattttacgagcgggttggttttttaggcggcgtttcggaatagtagtagcggtagtcgaaaggattttttttttttttaggcggtagttcgtttttatcgggtggatttttttttttttgtttggtttcgtttttttttcgatcgtttcggtcgcgtggtttcggcgttag

SEQ ID NO: 29164 - DNA, 577 bp, Artificial Sequence
  chemically treated genomic DNA (Homo sapiens) CpG-island No: 29164
ctaacgccgaaaccacgcgaccgaaacgatcgaaaaaaaaacgaaaccaaacaaaaaaaaaaaaatccacccgataaaaacgaactaccgcctaaaaaaaaaaaaaatcctttcgactaccgctactactattccgaaacgccgcctaaaaaaccaacccgctcgtaaaatacgcgccaaataactccgcacccaaaaaacgcccttcctaacccctcccaaaacgaccgaaacgaaaaaaactacgcgacgcgacgcgacgcgacgcgacgaataacgaaaacgaactacaccccgaacgcgacgcccttaaactacaccgcgacgcaaatttacgaaccgacttatcaaccgaccaaaaaaaaaaaactccgtcccttcccgctcacccgacttccccaccccttatactctaaactctacaaaaaacgaacgacgcgaccacgaaaacgccgaaaaaaaacgaaccgccgccgaacaacgacgtaccctcgaaaaaaaaaacgccgaaaaaaaaacgacgacgcgacgacgaaaacgcgacgcgcgataacaactacttaacccgacgaacgcg

SEQ ID NO: 29165 - DNA, 801 bp, Artificial Sequence
  chemically treated genomic DNA (Homo sapiens) CpG-island No: 29165
cgtaggtcgtagtttagtgttcgaatgtagattgggaattgtgggttaattcgcgagttttgggtcggttttggtttagatcgtttttttcgtattgttgtgtcgagcggatcgatttaagggatcgcgtaggttttttcggttttttttacggggacgtgtgtttgggcgtgtgatacgtggcggaggtagcgcggttttaaggaataaggatacgggttattaggttatacgtatatgtatttgtatataattggaagatcgatttttgttttagattaatttttcgtattcggtaaagaaaggagaagcgtcgattagcgttttttttgttttttggcgtggattcgcggaatcgtttacgtttagaggggttttttttcgagcgcgaggaattggagttcggttggttttcgttttcgttttcgtttttcggttttagttgcgcggcgtcgttttattcgcgatgtcgtagtgttgcgcggtggcgtaggttaggcggttcggtaggtacggggagaattcggcggcgtagtcgtggcgtttcggcgttcgtagtattcgcgtcgttttatcgtatatcgtatttatttcgttcgtcgttttcggttttcgttgtttcggtcgcggaagtcgtttcgagtcggaggtatattggcgcggttagagagattaggtagatcggacggaagtgtgggtttcgtgttttgtgtttgagattttgattggttcgtataggaaagggcgttgatttcgacggagattatttttgttttgggtgaatttaaattgaattgcgtt

SEQ ID NO: 29166 - DNA, 801 bp, Artificial Sequence
  chemically treated genomic DNA (Homo sapiens) CpG-island No: 29166
aacgcaattcaatttaaattcacccaaaacaaaaataatctccgtcgaaatcaacgccctttcctatacgaaccaatcaaaatctcaaacacaaaacacgaaacccacacttccgtccgatctacctaatctctctaaccgcgccaatatacctccgactcgaaacgacttccgcgaccgaaacaacgaaaaccgaaaacgacgaacgaaataaatacgatatacgataaaacgacgcgaatactacgaacgccgaaacgccacgactacgccgccgaattctccccgtacctaccgaaccgcctaacctacgccaccgcgcaacactacgacatcgcgaataaaacgacgccgcgcaactaaaaccgaaaaacgaaaacgaaaacgaaaaccaaccgaactccaattcctcgcgctcgaaaaaaaacccctctaaacgtaaacgattccgcgaatccacgccaaaaaacaaaaaaaacgctaatcgacgcttctcctttctttaccgaatacgaaaaattaatctaaaacaaaaatcgatcttccaattatatacaaatacatatacgtataacctaataacccgtatccttattccttaaaaccgcgctacctccgccacgtatcacacgcccaaacacacgtccccgtaaaaaaaaccgaaaaaacctacgcgatcccttaaatcgatccgctcgacacaacaatacgaaaaaaacgatctaaaccaaaaccgacccaaaactcgcgaattaacccacaattcccaatctacattcgaacactaaactacgacctacg

SEQ ID NO: 29167 - DNA, 801 bp, Artificial Sequence
  chemically treated genomic DNA (Homo sapiens) CpG-island No: 29167
ggcgtaatttagtttggatttatttaaaataaaaatggttttcgtcggagttaacgtttttttttgtgcggattaattagaattttaaatatagggtacggggtttatattttcgttcggtttgtttggtttttttaatcgcgttagtgtgttttcgattcggaacggttttcgcggtcggggtagcgagggtcgggggcggcgggcgggatgagtgcggtgtgcggtggagcggcgcggatgttgcggacgtcgggacgttacggttacgtcgtcgagtttttttcgtatttgtcgggtcgtttggtttgcgttatcgcgtagtattacggtatcgcgggtgaggcggcgtcgcgtagttggggtcggggggcggaggcggaggcgggggttagtcgggttttagtttttcgcgttcgagggaaagtttttttgagcgtagacggtttcgcgggtttacgttagggggtagaagaggcgttggtcggcgttttttttttttttgtcgagtgcgaggagttggtttgaagtaggagtcgattttttagttgtgtgtaagtgtatatacgtgtagtttagtagttcgtgtttttgttttttgagatcgcgttgttttcgttacgtgttatacgtttaggtatacgttttcgtagggagagtcgggggagtttgcgcggttttttggatcggttcgttcggtatagtagtacggggaagacggtttgagttagaatcgatttagggttcgcgagttggtttataatttttagtttgtattcgagtattgagttgcgatttgcg

SEQ ID NO: 29168 - DNA, 801 bp, Artificial Sequence
  chemically treated genomic DNA (Homo sapiens) CpG-island No: 29168
cgcaaatcgcaactcaatactcgaatacaaactaaaaattataaaccaactcgcgaaccctaaatcgattctaactcaaaccgtcttccccgtactactataccgaacgaaccgatccaaaaaaccgcgcaaactcccccgactctccctacgaaaacgtatacctaaacgtataacacgtaacgaaaacaacgcgatctcaaaaaacaaaaacacgaactactaaactacacgtatatacacttacacacaactaaaaaatcgactcctacttcaaaccaactcctcgcactcgacaaaaaaaaaaaaaacgccgaccaacgcctcttctaccccctaacgtaaacccgcgaaaccgtctacgctcaaaaaaactttccctcgaacgcgaaaaactaaaacccgactaacccccgcctccgcctccgccccccgaccccaactacgcgacgccgcctcacccgcgataccgtaatactacgcgataacgcaaaccaaacgacccgacaaatacgaaaaaaactcgacgacgtaaccgtaacgtcccgacgtccgcaacatccgcgccgctccaccgcacaccgcactcatcccgcccgccgcccccgaccctcgctaccccgaccgcgaaaaccgttccgaatcgaaaacacactaacgcgattaaaaaaaccaaacaaaccgaacgaaaatataaaccccgtaccctatatttaaaattctaattaatccgcacaaaaaaaaacgttaactccgacgaaaaccatttttattttaaataaatccaaactaaattacgcc

SEQ ID NO: 29169 - DNA, 653 bp, Artificial Sequence
  chemically treated genomic DNA (Homo sapiens) CpG-island No: 29169
  misc_feature (462)..(462): n is either a, c, g or t
  misc_feature (642)..(642): n is either a, c, g or t
ataggaaagtaacgcggattaaaggatcggagaatttaagggcgcgatatatattacggcgttaaaaatcgtacggggaaaaacgggaagaggaggcgtagatatttaagtaaaataaagtcgggggcgcggtacgaaaaagaggaaaaataggggcgcgcgaaaaacgcgcggagaaaaaaataaacgggaagatagaaacggcgtaaggaagaaggaacgggggaaaaaggaagggggaaaagcgataaggggggggggaggtaaaacgtaaaggacggggggtaaaacgaaaaggcgggagaataaatcgggcgggagtaagacgtaaacggtcgataggaaagaaaaaaaaagtatcgtttttttttcgttttttttacgttcgtttcgttttttttacgttttcgttttcgtttcgttttttttatttcgattcgttttttttcgttcgtagttatnatcgtcgtagtttttttcgcgtagtttgggagtgattcggcgtttattcgggagacgtcgttttgtggttcggataatcggttttatgtagcgtcgttcgaggtagttcgcggagaggcggtttattttttaatttaggaatgtttatattttgagaaaaagaataataagggggtgggngggggtgggga

SEQ ID NO: 29170 - DNA, 653 bp, Artificial Sequence
  chemically treated genomic DNA (Homo sapiens) CpG-island No: 29170
  misc_feature (12)..(12): n is either a, c, g or t
  misc_feature (192)..(192): n is either a, c, g or t
tccccacccccncccacccccttattattctttttctcaaaatataaacattcctaaattaaaaaataaaccgcctctccgcgaactacctcgaacgacgctacataaaaccgattatccgaaccacaaaacgacgtctcccgaataaacgccgaatcactcccaaactacgcgaaaaaaactacgacgatnataactacgaacgaaaaaaaacgaatcgaaataaaaaaaacgaaacgaaaacgaaaacgtaaaaaaaacgaaacgaacgtaaaaaaaacgaaaaaaaaacgatactttttttttctttcctatcgaccgtttacgtcttactcccgcccgatttattctcccgccttttcgttttaccccccgtcctttacgttttacctccccccccccttatcgcttttcccccttcctttttcccccgttccttcttccttacgccgtttctatcttcccgtttatttttttctccgcgcgtttttcgcgcgcccctatttttcctctttttcgtaccgcgcccccgactttattttacttaaatatctacgcctcctcttcccgtttttccccgtacgatttttaacgccgtaatatatatcgcgcccttaaattctccgatcctttaatccgcgttactttcctat

SEQ ID NO: 29171 - DNA, 653 bp, Artificial Sequence
  chemically treated genomic DNA (Homo sapiens) CpG-island No: 29171
  misc_feature (12)..(12): n is either a, c, g or t
  misc_feature (192)..(192): n is either a, c, g or t
tttttatttttntttatttttttgttgtttttttttttaagatatgggtatttttgggttaaaaggtaagtcgttttttcgcgaattgtttcggacggcgttgtataggatcggttgttcgggttatagagcggcgtttttcgagtgaacgtcgagttatttttaggttgcgcggggagggttgcggcggtngtggttgcgggcgagggagggcgggtcggggtagggggagcgggacgggggcgggggcgtgggaggggcggggcgggcgtgggaggggcggggagggggcggtgtttttttttttttttttgtcggtcgtttgcgttttgttttcgttcggtttgttttttcgttttttcgttttgtttttcgttttttgcgttttgtttttttttttttttgtcgtttttttttttttttttttttttcgtttttttttttttgcgtcgtttttgttttttcgtttgttttttttttcgcgcgtttttcgcgcgtttttgttttttttttttttcgtgtcgcgttttcggttttgttttgtttgggtgtttgcgtttttttttttcgttttttttcgtgcggtttttggcgtcgtggtgtgtgtcgcgtttttgggtttttcggttttttggttcgcgttgtttttttgt

SEQ ID NO: 29172 - DNA, 653 bp, Artificial Sequence
  chemically treated genomic DNA (Homo sapiens) CpG-island No: 29172
  misc_feature (462)..(462): n is either a, c, g or t
  misc_feature (642)..(642): n is either a, c, g or t
acaaaaaaacaacgcgaaccaaaaaaccgaaaaacccaaaaacgcgacacacaccacgacgccaaaaaccgcacgaaaaaaaacgaaaaaaaaaaacgcaaacacccaaacaaaacaaaaccgaaaacgcgacacgaaaaaaaaaaaaaacaaaaacgcgcgaaaaacgcgcgaaaaaaaaaacaaacgaaaaaacaaaaacgacgcaaaaaaaaaaaaacgaaaaaaaaaaaaaaaaaaaaaaacgacaaaaaaaaaaaaaaacaaaacgcaaaaaacgaaaaacaaaacgaaaaaacgaaaaaacaaaccgaacgaaaacaaaacgcaaacgaccgacaaaaaaaaaaaaaaaaacaccgccccctccccgcccctcccacgcccgccccgcccctcccacgcccccgcccccgtcccgctccccctaccccgacccgccctccctcgcccgcaaccacnaccgccgcaaccctccccgcgcaacctaaaaataactcgacgttcactcgaaaaacgccgctctataacccgaacaaccgatcctatacaacgccgtccgaaacaattcgcgaaaaaacgacttaccttttaacccaaaaatacccatatcttaaaaaaaaaaacaacaaaaaaataaanaaaaataaaaa

SEQ ID NO: 29173 - DNA, 795 bp, Artificial Sequence
  chemically treated genomic DNA (Homo sapiens) CpG-island No: 29173
aggagcgcggagcggagcgtttcgattcgtcgtgcgtattttttggagggaaggggcgggggaatcggtttttgagggaagcgttcggtggcgagggggttagttaagtttcggttgcggcgttattttttcggttttacgagaggaaagttttttttttttagacgttttcgtcggttcgcgtttttcgggtttagtttttcgagttttcggagcgggcgtcgttttagtttagtttcggggaaacgcgagtcgcgatgtttggggggtgttttcggggtttcgtcgtcggggacgggcgtttgcggttggcgcgattagcgttggtatttttgggttgggttttttcgtttttttttattttttcggtattttttttttttttttcggcgtcgtttttggttttcgtcgtgttcgtttagttttcgttgtcggattagtgtttcgcgttgtgcgagtgtttcgaggtagcgcgtatagttaagtgcgttaatcgtaatttgatcgaggtgtttacggatttgttcgtttacgtgcgtaattttttttttatcggtaattagttggtcgtgttttttgtcggcgttttcgttcgtcggtcgtcgttggcggagttggtcgcgtttaattttagcggtagtcgtttggacgaggtgcgcgcgggcgttttcgagtatttgtttagtttgcgttagttcgattttagttataatttattggtcgattttagttttttcgttttttcgggtagtaatgttagcgtttcggtttttagtttttttgtggaattgattt

SEQ ID NO: 29174 - DNA, 795 bp, Artificial Sequence
  chemically treated genomic DNA (Homo sapiens) CpG-island No: 29174
aaatcaattccacaaaaaaactaaaaaccgaaacgctaacattactacccgaaaaaacgaaaaaactaaaatcgaccaataaattataactaaaatcgaactaacgcaaactaaacaaatactcgaaaacgcccgcgcgcacctcgtccaaacgactaccgctaaaattaaacgcgaccaactccgccaacgacgaccgacgaacgaaaacgccgacaaaaaacacgaccaactaattaccgataaaaaaaaaattacgcacgtaaacgaacaaatccgtaaacacctcgatcaaattacgattaacgcacttaactatacgcgctacctcgaaacactcgcacaacgcgaaacactaatccgacaacgaaaactaaacgaacacgacgaaaaccaaaaacgacgccgaaaaaaaaaaaaaaaataccgaaaaaataaaaaaaaacgaaaaaacccaacccaaaaataccaacgctaatcgcgccaaccgcaaacgcccgtccccgacgacgaaaccccgaaaacaccccccaaacatcgcgactcgcgtttccccgaaactaaactaaaacgacgcccgctccgaaaactcgaaaaactaaacccgaaaaacgcgaaccgacgaaaacgtctaaaaaaaaaaaactttcctctcgtaaaaccgaaaaaataacgccgcaaccgaaacttaactaaccccctcgccaccgaacgcttccctcaaaaaccgattcccccgccccttccctccaaaaaatacgcacgacgaatcgaaacgctccgctccgcgctcct

SEQ ID NO: 29175 - DNA, 795 bp, Artificial Sequence
  chemically treated genomic DNA (Homo sapiens) CpG-island No: 29175
ggattagttttataaggggattgggggtcgagacgttggtattgttgttcgagaaagcgaagggattgaggtcggttagtgggttgtggttgaggtcgagttggcgtaggttgggtagatgttcgaaggcgttcgcgcgtatttcgtttaggcggttgtcgttgaggttgagcgcggttagtttcgttagcggcggtcggcgggcgaaggcgtcggtagggagtacggttagttggttgtcggtaaggaagaggttgcgtacgtaggcgggtaggttcgtgggtatttcggttagattgcggttaacgtatttgattgtgcgcgttgtttcggagtattcgtatagcgcggggtattggttcggtagcgggggttgggcggatacggcggaagttaggaacggcgtcgaggaggagaaggaggatgtcgaggaggtgggagaagacgaggagatttagtttaggagtattagcgttagtcgcgttagtcgtagacgttcgttttcggcggcggggtttcgggagtattttttaggtatcgcggttcgcgttttttcggagttgggttgggacggcgttcgtttcgaaggttcgggaggttgggttcggagggcgcgagtcggcggaagcgtttggaaaaaaaaaatttttttttcgtggaatcgagggagtggcgtcgtagtcggaatttggttaattttttcgttatcgggcgttttttttaggggtcgattttttcgttttttttttttagaaagtacgtacggcgggtcgggacgtttcgtttcgcgttttt

SEQ ID NO: 29176 - DNA, 795 bp, Artificial Sequence
  chemically treated genomic DNA (Homo sapiens) CpG-island No: 29176
aaaaacgcgaaacgaaacgtcccgacccgccgtacgtactttctaaaaaaaaaaaacgaaaaaatcgacccctaaaaaaaacgcccgataacgaaaaaattaaccaaattccgactacgacgccactccctcgattccacgaaaaaaaaattttttttttccaaacgcttccgccgactcgcgccctccgaacccaacctcccgaaccttcgaaacgaacgccgtcccaacccaactccgaaaaaacgcgaaccgcgatacctaaaaaatactcccgaaaccccgccgccgaaaacgaacgtctacgactaacgcgactaacgctaatactcctaaactaaatctcctcgtcttctcccacctcctcgacatcctccttctcctcctcgacgccgttcctaacttccgccgtatccgcccaacccccgctaccgaaccaataccccgcgctatacgaatactccgaaacaacgcgcacaatcaaatacgttaaccgcaatctaaccgaaatacccacgaacctacccgcctacgtacgcaacctcttccttaccgacaaccaactaaccgtactccctaccgacgccttcgcccgccgaccgccgctaacgaaactaaccgcgctcaacctcaacgacaaccgcctaaacgaaatacgcgcgaacgccttcgaacatctacccaacctacgccaactcgacctcaaccacaacccactaaccgacctcaatcccttcgctttctcgaacaacaataccaacgtctcgacccccaatccccttataaaactaatcc

SEQ ID NO: 29177 - DNA, 1116 bp, Artificial Sequence
  chemically treated genomic DNA (Homo sapiens) CpG-island No: 29177
ttcgggtcgcggattcgttttacgtcgtatttagtacgttgttttttcgttttatttttgtgtcggttatcgtgtggtcgcgtttgcgcgtttcgttcggtttgtcggcgtgagaaagagttcgtgtcgtttttaagtttagattagaggggacggcgaagcgcgaaaaagttttttgcgtttagtacgtaggcgtagtcgtgtttttgggtttttcgggtttcgttttagttggcgcgttcggcgttttttcgttagcgggtagttgggggcgttgtagggagggtattcgagcgggttgggggcgttcggaagggtggtttgtaaggttcgggtagttgtagttttcggagtggggcggagaggcgcggtatcgcgcggacgaggatggggcgggggcgggcgtagttcgagggtgtaggtacgataaggcgggtgatagttagcggggaggggcgggcgttatcgcgtttacgttttttgttcggggtcgggtcgggagggttttcgggttttgcgcgcgtttggtcggcgggttgaggcgtacgggtcgtacgtagcgttatgcgaggtttttttgtttggtcgttgcggttgttcgagttatcgagttttgtcgagttaggtcggtttttgtcggtagtttgcgtgtgggtcgcggttagtcgcgttttcgggtttttatcgtcgtttattggtttgaggtcggcgcggttatggggcgcggggttcgcgttgttttggggcgttggagtcgcgcgtcgttggaggagcggttgtcggggcgggggttcgggcgtttcgcggggcgttttgggtttcgcgcggtttttggggttgtgggttcgcggtttcggtagttgtaggtgcggggtttttgtcgggttaggcgtttttcggttttcgcgcgttcggttttcgggcggtttcgtagtcgttgtttggataggggacgaggtttgtcggcgcgggtcggcggcgtttttcggggataaggggcggttgcgtttcgtagcggtcggattttcggaggttcggaagtttttggggttggcgtattttgagcgtcggaggttggtaggtagggtttttttcggttattttttttcgtcgggt

SEQ ID NO: 29178 - DNA, 1116 bp, Artificial Sequence
  chemically treated genomic DNA (Homo sapiens) CpG-island No: 29178
acccgacgaaaaaaaataaccgaaaaaaaccctacctaccaacctccgacgctcaaaatacgccaaccccaaaaacttccgaacctccgaaaatccgaccgctacgaaacgcaaccgccccttatccccgaaaaacgccgccgacccgcgccgacaaacctcgtcccctatccaaacaacgactacgaaaccgcccgaaaaccgaacgcgcgaaaaccgaaaaacgcctaacccgacaaaaaccccgcacctacaactaccgaaaccgcgaacccacaaccccaaaaaccgcgcgaaacccaaaacgccccgcgaaacgcccgaacccccgccccgacaaccgctcctccaacgacgcgcgactccaacgccccaaaacaacgcgaaccccgcgccccataaccgcgccgacctcaaaccaataaacgacgataaaaacccgaaaacgcgactaaccgcgacccacacgcaaactaccgacaaaaaccgacctaactcgacaaaactcgataactcgaacaaccgcaacgaccaaacaaaaaaacctcgcataacgctacgtacgacccgtacgcctcaacccgccgaccaaacgcgcgcaaaacccgaaaaccctcccgacccgaccccgaacaaaaaacgtaaacgcgataacgcccgcccctccccgctaactatcacccgccttatcgtacctacaccctcgaactacgcccgcccccgccccatcctcgtccgcgcgataccgcgcctctccgccccactccgaaaactacaactacccgaaccttacaaaccacccttccgaacgcccccaacccgctcgaataccctccctacaacgcccccaactacccgctaacgaaaaaacgccgaacgcgccaactaaaacgaaacccgaaaaacccaaaaacacgactacgcctacgtactaaacgcaaaaaactttttcgcgcttcgccgtcccctctaatctaaacttaaaaacgacacgaactctttctcacgccgacaaaccgaacgaaacgcgcaaacgcgaccacacgataaccgacacaaaaataaaacgaaaaaacaacgtactaaatacgacgtaaaacgaatccgcgacccgaa

SEQ ID NO: 29179 - DNA, 1116 bp, Artificial Sequence
  chemically treated genomic DNA (Homo sapiens) CpG-island No: 29179
gttcggcggagggaagtggtcggggaggattttatttgttagttttcggcgtttagggtacgttagttttaggagttttcgggttttcgggagttcggtcgttgcggggcgtaatcgttttttgttttcgggaggcgtcgtcggttcgcgtcgataggtttcgttttttgtttaggtagcggttgcgggatcgttcgggaatcgggcgcgcgggagtcgaggagcgtttggttcggtaaaagtttcgtatttgtagttgtcggggtcgcgagtttatagttttaggagtcgcgcgaggtttaggacgtttcgcgaggcgttcggattttcgtttcggtagtcgtttttttagcggcgcgcggttttaacgttttagagtagcgcgggtttcgcgttttatagtcgcgtcggttttaggttagtgaacggcgatagggattcgggaacgcggttggtcgcggtttatacgtaggttatcggtaggagtcgatttggttcggtagggttcggtggttcgagtagtcgtagcggttaggtaggggggtttcgtatggcgttgcgtgcgattcgtacgttttagttcgtcggttaggcgcgcgtaaagttcgaggattttttcggttcggtttcgagtaaagggcgtggacgcggtggcgttcgttttttttcgttggttgttattcgttttatcgtgtttgtattttcgggttgcgttcgttttcgttttattttcgttcgcgcggtgtcgcgttttttcgttttatttcggggattgtagttattcggattttgtaagttattttttcgagcgtttttaattcgttcgggtgttttttttgtagcgtttttaattgttcgttggcggaggagcgtcgggcgcgttagttgggacgaggttcgggaagtttaggagtacggttgcgtttgcgtattgggcgtagggaattttttcgcgtttcgtcgttttttttggtttgaatttgggaacgatacgagtttttttttacgtcggtagatcgggcggagcgcgtagacgcgattatacgatggtcggtataaagatggggcgggaggatagcgtgttggatacggcgtggggcgggttcgcggttcggg

SEQ ID NO: 29180 - DNA, 1116 bp, Artificial Sequence
  chemically treated genomic DNA (Homo sapiens) CpG-island No: 29180
cccgaaccgcgaacccgccccacgccgtatccaacacgctatcctcccgccccatctttataccgaccatcgtataatcgcgtctacgcgctccgcccgatctaccgacgtaaaaaaaaactcgtatcgttcccaaattcaaaccaaaaaaaacgacgaaacgcgaaaaaattccctacgcccaatacgcaaacgcaaccgtactcctaaacttcccgaacctcgtcccaactaacgcgcccgacgctcctccgccaacgaacaattaaaaacgctacaaaaaaaacacccgaacgaattaaaaacgctcgaaaaaataacttacaaaatccgaataactacaatccccgaaataaaacgaaaaaacgcgacaccgcgcgaacgaaaataaaacgaaaacgaacgcaacccgaaaatacaaacacgataaaacgaataacaaccaacgaaaaaaaacgaacgccaccgcgtccacgccctttactcgaaaccgaaccgaaaaaatcctcgaactttacgcgcgcctaaccgacgaactaaaacgtacgaatcgcacgcaacgccatacgaaacccccctacctaaccgctacgactactcgaaccaccgaaccctaccgaaccaaatcgactcctaccgataacctacgtataaaccgcgaccaaccgcgttcccgaatccctatcgccgttcactaacctaaaaccgacgcgactataaaacgcgaaacccgcgctactctaaaacgttaaaaccgcgcgccgctaaaaaaacgactaccgaaacgaaaatccgaacgcctcgcgaaacgtcctaaacctcgcgcgactcctaaaactataaactcgcgaccccgacaactacaaatacgaaacttttaccgaaccaaacgctcctcgactcccgcgcgcccgattcccgaacgatcccgcaaccgctacctaaacaaaaaacgaaacctatcgacgcgaaccgacgacgcctcccgaaaacaaaaaacgattacgccccgcaacgaccgaactcccgaaaacccgaaaactcctaaaactaacgtaccctaaacgccgaaaactaacaaataaaatcctccccgaccacttccctccgccgaac

SEQ ID NO: 29181 - DNA, 569 bp, Artificial Sequence
  chemically treated genomic DNA (Homo sapiens) CpG-island No: 29181
cggcggttgaaagtgtcgttgcgagtatttttaggtcgcgtttattttattacgtttcggtagttatttggagtcggaagcgttgcgtcgttttgtttatgttttttaggttcgttcgttgtttttgtcgcgttcggattatcgcgtttcgcgtcgttcggcgttcggattagcgtagggttacggtcgtcgttacgaagtagtaggttagggcgatttcggaggcgttaggtagcgcggtttatagttcgtattgtattatgatttttttagtttgttgttgtttatcgcgatagttgaagtcgtcgtacgcgtagttcgttcgtttcgtcgtaaaattcggattggattagtcgggattttacgttcgtttgcgcgggaggggcggggaagcgcgttagagtttagaggttattagaggcggttcgtttggtatcgtttttagcgatatttcgtttttcgttaagtcgagtaggcgggtggggaagggcgattgtttttcgtgggcgattttttaagtttgagtttagtatcggttgggtattatagtttcggtcgttttttgtttt

SEQ ID NO: 29182 - DNA, 569 bp, Artificial Sequence
  chemically treated genomic DNA (Homo sapiens) CpG-island No: 29182
aaaacaaaaaacgaccgaaactataatacccaaccgatactaaactcaaacttaaaaaatcgcccacgaaaaacaatcgcccttccccacccgcctactcgacttaacgaaaaacgaaatatcgctaaaaacgataccaaacgaaccgcctctaataacctctaaactctaacgcgcttccccgcccctcccgcgcaaacgaacgtaaaatcccgactaatccaatccgaattttacgacgaaacgaacgaactacgcgtacgacgacttcaactatcgcgataaacaacaacaaactaaaaaaatcataatacaatacgaactataaaccgcgctacctaacgcctccgaaatcgccctaacctactacttcgtaacgacgaccgtaaccctacgctaatccgaacgccgaacgacgcgaaacgcgataatccgaacgcgacaaaaacaacgaacgaacctaaaaaacataaacaaaacgacgcaacgcttccgactccaaataactaccgaaacgtaataaaataaacgcgacctaaaaatactcgcaacgacactttcaaccgccg

SEQ ID NO: 29183 - DNA, 569 bp, Artificial Sequence
  chemically treated genomic DNA (Homo sapiens) CpG-island No: 29183
ggggtagaggacggtcggggttgtggtgtttaatcggtgttaaatttaagtttgggaggtcgtttacgagaaatagtcgtttttttttattcgtttgttcggtttggcggggagcgggatgtcgttgggggcgatgttagacgggtcgtttttgatagtttttaggttttggcgcgttttttcgtttttttcgcgtaggcgggcgtgggatttcggttgatttagttcgggttttgcggcggagcgggcgggttgcgcgtgcggcggttttaattgtcgcggtaggtagtagtaggttgaagggattatggtgtagtacgagttgtgggtcgcgttgtttggcgttttcggggtcgttttggtttgttgtttcgtggcggcggtcgtggttttgcgttggttcgggcgtcggacggcgcggggcgcggtggttcgggcgcgatagaggtagcgagcgggtttggagaatatggatagggcggcgtagcgttttcggttttaggtgattgtcggagcgtagtgggatgggcgcggtttgagggtattcgtagcggtatttttagtcgtcg

SEQ ID NO: 29184 - DNA, 569 bp, Artificial Sequence
  chemically treated genomic DNA (Homo sapiens) CpG-island No: 29184
cgacgactaaaaataccgctacgaataccctcaaaccgcgcccatcccactacgctccgacaatcacctaaaaccgaaaacgctacgccgccctatccatattctccaaacccgctcgctacctctatcgcgcccgaaccaccgcgccccgcgccgtccgacgcccgaaccaacgcaaaaccacgaccgccgccacgaaacaacaaaccaaaacgaccccgaaaacgccaaacaacgcgacccacaactcgtactacaccataatcccttcaacctactactacctaccgcgacaattaaaaccgccgcacgcgcaacccgcccgctccgccgcaaaacccgaactaaatcaaccgaaatcccacgcccgcctacgcgaaaaaaacgaaaaaacgcgccaaaacctaaaaactatcaaaaacgacccgtctaacatcgcccccaacgacatcccgctccccgccaaaccgaacaaacgaataaaaaaaaacgactatttctcgtaaacgacctcccaaacttaaatttaacaccgattaaacaccacaaccccgaccgtcctctacccc

SEQ ID NO: 29185 - DNA, 869 bp, Artificial Sequence
  chemically treated genomic DNA (Homo sapiens) CpG-island No: 29185
atgaatatgggtgtcgagttgtgtttgttttggaggtgcgggcgcgggcggtggggtaagtttaaaatggagaggatttcgcgttgtatttttcgtcgtttttggttgcggaggcgtcggtggatgaagttcgagtgtatttcgttgtttaggttgaagtcggttagggcggagcgtagtaggaataggggtgtttagagcgttacgaagttgtgcggcgtcgtagttcgtagtgagcgtacgtgtatcgcgtcggttttacgcgttattcgggtttcgggtttcgggttcgtatcgttttaggtggtagagggggtaggcggtcgttcgcgtcgttcggttatttgttgtagacgggtttcgttgcgttcgcgttagatatggttttttttcggtcggtcgcgttttgttcggattttcgttttttgttcggtgttggtttcgggtttttcgtttcgtattcgttcgggcgtatcgtagggtttggaaagtagtttcggcgaacgaaaaggcgagtgaggaggcgggcgcgggtgggaggagtagttagtaagtttaggagtttagagagttaacgtcggggaggtagcgaggaggtaggcgggcgggcgagcgtttttttttttcgtttttttggcgttttcgttttcgggcggcggtaatttatttttttttaattttcggcgcggatagtaggggtttcggggcgtttttttagttttgtgcgttttggatcgtataagaggtcgtttcgggagcgttagagtggtacgcgttggggtttgggcggaggaggaggaggaggaggacgggtttcgaggggtttttttcgcgtcggcggttttttatttgttttcggtttcgttttt

SEQ ID NO: 29186 - DNA, 869 bp, Artificial Sequence
  chemically treated genomic DNA (Homo sapiens) CpG-island No: 29186
aaaaacgaaaccgaaaacaaataaaaaaccgccgacgcgaaaaaaacccctcgaaacccgtcctcctcctcctcctcctccgcccaaaccccaacgcgtaccactctaacgctcccgaaacgacctcttatacgatccaaaacgcacaaaactaaaaaaacgccccgaaacccctactatccgcgccgaaaattaaaaaaaaataaattaccgccgcccgaaaacgaaaacgccaaaaaaacgaaaaaaaaaaacgctcgcccgcccgcctacctcctcgctacctccccgacgttaactctctaaactcctaaacttactaactactcctcccacccgcgcccgcctcctcactcgccttttcgttcgccgaaactactttccaaaccctacgatacgcccgaacgaatacgaaacgaaaaacccgaaaccaacaccgaacaaaaaacgaaaatccgaacaaaacgcgaccgaccgaaaaaaaaccatatctaacgcgaacgcaacgaaacccgtctacaacaaataaccgaacgacgcgaacgaccgcctaccccctctaccacctaaaacgatacgaacccgaaacccgaaacccgaataacgcgtaaaaccgacgcgatacacgtacgctcactacgaactacgacgccgcacaacttcgtaacgctctaaacacccctattcctactacgctccgccctaaccgacttcaacctaaacaacgaaatacactcgaacttcatccaccgacgcctccgcaaccaaaaacgacgaaaaatacaacgcgaaatcctctccattttaaacttaccccaccgcccgcgcccgcacctccaaaacaaacacaactcgacacccatattcat

SEQ ID NO: 29187 - DNA, 869 bp, Artificial Sequence
  chemically treated genomic DNA (Homo sapiens) CpG-island No: 29187
gagggcggggtcgagggtaggtgggaggtcgtcggcgcgggaggggtttttcgaagttcgttttttttttttttttttttcgtttaggttttagcgcgtattattttggcgttttcgaggcggttttttgtgcgatttagggcgtataaggttgggagagcgtttcggggtttttgttattcgcgtcggaggttggaagagggtgggttgtcgtcgttcgagggcgagagcgttagaggagcgggaagaaggagcgttcgttcgttcgtttgttttttcgttgttttttcggcgttggttttttggatttttaggtttgttggttgttttttttattcgcgttcgtttttttattcgttttttcgttcgtcggggttgttttttaagttttgcggtgcgttcgggcgagtgcggggcgaggggttcggggttagtatcgagtagggggcgggggttcgggtagagcgcggtcggtcggggaggggttatgtttggcgcgggcgtagcggggttcgtttgtagtaagtgatcgagcggcgcggacggtcgtttgttttttttgttatttggggcggtgcgggttcggagttcggagttcgggtagcgcgtagagtcggcgcgatgtacgtgcgtttattgcgagttgcggcgtcgtatagtttcgtggcgttttgggtatttttgtttttgttgcgtttcgttttggtcgattttagtttggataacgaggtgtattcgagttttatttatcggcgttttcgtagttaggagcggcgggagatgtagcgcgagattttttttattttgggtttgttttatcgttcgcgttcgtatttttagggtaagtataattcggtatttatgtttat

SEQ ID NO: 29188 - DNA, 869 bp, Artificial Sequence
  chemically treated genomic DNA (Homo sapiens) CpG-island No: 29188
ataaacataaataccgaattatacttaccctaaaaatacgaacgcgaacgataaaacaaacccaaaataaaaaaaatctcgcgctacatctcccgccgctcctaactacgaaaacgccgataaataaaactcgaatacacctcgttatccaaactaaaatcgaccaaaacgaaacgcaacaaaaacaaaaatacccaaaacgccacgaaactatacgacgccgcaactcgcaataaacgcacgtacatcgcgccgactctacgcgctacccgaactccgaactccgaacccgcaccgccccaaataacaaaaaaaacaaacgaccgtccgcgccgctcgatcacttactacaaacgaaccccgctacgcccgcgccaaacataacccctccccgaccgaccgcgctctacccgaacccccgccccctactcgatactaaccccgaacccctcgccccgcactcgcccgaacgcaccgcaaaacttaaaaaacaaccccgacgaacgaaaaaacgaataaaaaaacgaacgcgaataaaaaaaacaaccaacaaacctaaaaatccaaaaaaccaacgccgaaaaaacaacgaaaaaacaaacgaacgaacgaacgctccttcttcccgctcctctaacgctctcgccctcgaacgacgacaacccaccctcttccaacctccgacgcgaataacaaaaaccccgaaacgctctcccaaccttatacgccctaaatcgcacaaaaaaccgcctcgaaaacgccaaaataatacgcgctaaaacctaaacgaaaaaaaaaaaaaaaaaaaacgaacttcgaaaaacccctcccgcgccgacgacctcccacctaccctcgaccccgccctc

SEQ ID NO: 29189 - DNA, 501 bp, Artificial Sequence
  chemically treated genomic DNA (Homo sapiens) CpG-island No: 29189
tataagacgtcgttttgtttagttttttttaattttcgcgtattttcggacgttttttttattttaggttcggattttggaattatttgggtttcgcgttttacgtttcgtcgtcgggtttatttgcgcgtttagttggtttagatgttgtatgtcgtcgtttacggttttcggtatcgggtttttagtgtagtgtaggcgggtttatggcgcgcgttttagtttcgtaggttttatcgtcgtcgtcgttttgtttagttttttttttcgttgtcgttgttatcgttgtcggttttttcgcgtatttataatcgtattttcgttacggtcgtcgtagcgcgtttttttttcggtcgttttgggttgttcggagtcggggagttttcgtagggtcgcggatacgcgcggtcgtcgggtttcggggaggggtaggggcggcgtcggtatcggtagacgcgaggttttttgttagttttttcgttgagtgatttttgggtacgg

SEQ ID NO: 29190 - DNA, 501 bp, Artificial Sequence
  chemically treated genomic DNA (Homo sapiens) CpG-island No: 29190
ccgtacccaaaaatcactcaacgaaaaaactaacaaaaaacctcgcgtctaccgataccgacgccgcccctacccctccccgaaacccgacgaccgcgcgtatccgcgaccctacgaaaactccccgactccgaacaacccaaaacgaccgaaaaaaaaacgcgctacgacgaccgtaacgaaaatacgattataaatacgcgaaaaaaccgacaacgataacaacgacaacgaaaaaaaaaactaaacaaaacgacgacgacgataaaacctacgaaactaaaacgcgcgccataaacccgcctacactacactaaaaacccgataccgaaaaccgtaaacgacgacatacaacatctaaaccaactaaacgcgcaaataaacccgacgacgaaacgtaaaacgcgaaacccaaataattccaaaatccgaacctaaaataaaaaaaacgtccgaaaatacgcgaaaattaaaaaaaactaaacaaaacgacgtcttata

SEQ ID NO: 29191 - DNA, 501 bp, Artificial Sequence
  chemically treated genomic DNA (Homo sapiens) CpG-island No: 29191
tcgtatttaaaggttatttagcgggagagttggtaggaaatttcgcgtttgtcggtgtcggcgtcgtttttgttttttttcggagttcggcggtcgcgcgtgttcgcggttttgcgagggtttttcggtttcggatagtttagggcggtcgggggaggagcgcgttgcgacggtcgtggcgaaagtgcggttgtggatgcgcggagaggtcggtagcggtggtagcggtagcggaggaggaagttgagtagggcggcggcggcggtggaatttgcggggttggggcgcgcgttatgggttcgtttgtattgtattgaggattcggtgtcggaggtcgtgggcggcgatatgtagtatttgaattagttgggcgcgtaggtgggttcggcggcggggcgtggggcgcggggtttaggtgattttaggattcgggtttggggtgggggggacgttcgggggtgcgcgggagttgggagagattagatagagcggcgttttgtg

SEQ ID NO: 29192 - DNA, 501 bp, Artificial Sequence
  chemically treated genomic DNA (Homo sapiens) CpG-island No: 29192
cacaaaacgccgctctatctaatctctcccaactcccgcgcacccccgaacgtcccccccaccccaaacccgaatcctaaaatcacctaaaccccgcgccccacgccccgccgccgaacccacctacgcgcccaactaattcaaatactacatatcgccgcccacgacctccgacaccgaatcctcaatacaatacaaacgaacccataacgcgcgccccaaccccgcaaattccaccgccgccgccgccctactcaacttcctcctccgctaccgctaccaccgctaccgacctctccgcgcatccacaaccgcactttcgccacgaccgtcgcaacgcgctcctcccccgaccgccctaaactatccgaaaccgaaaaaccctcgcaaaaccgcgaacacgcgcgaccgccgaactccgaaaaaaaacaaaaacgacgccgacaccgacaaacgcgaaatttcctaccaactctcccgctaaataacctttaaatacga

SEQ ID NO: 29193 - DNA, 943 bp, Artificial Sequence
  chemically treated genomic DNA (Homo sapiens) CpG-island No: 29193
gcgggggagtttcgcgtgtttagcgcgcggatcgtttttttttttttttttttatttggttcgttcgttcggagtttgtatatagcgtagttggaaaatgttatttcgttggaaaggttttcgttggtattgttaggatattaagtcgtcgcgttaggttttttcggttttttttttttggttagtttcgtaatttttcggagcgtagggcgttcgtttgggtaggggttcggtttcgggcgtcgttttttttgtgtagcggtttcggggtgttcggggtttcgacgtttttcgcgggtgcgggtaggtgggaacggcgacgcgcgcgggtttattttttttttttttcgttcgtcgttcgttcgcgtttatttgtgcggtttcgggcgtagtcgcgggcgttatttcgtcgtgtagagattgtagcgggaggtatcgggcggcgtaggtcgcgttaggagcggggtgtttttggtttgcgttttcgagagtagcgtcgcgacggcgtatagttagacgagtaggcggcggcggtttatagcggttttcgcgtttttgttcggtttcgcgcggtgtttttcgtcgggtgttcgtttgtagcgtcgcgtcgttttcgtcgttggtcggttcgggtttcgtttcgagggtttcggggtttttttcggttttcgagttcgttggttcggtcgtttggcgtttcgcggcggttgcgtttcgcggagtggtcgtcgttgttagcggttggggtcgcggaggggaggcgtgaggttggttttttgcggattattataaatttggggtcgcgtcgttcgtcgtcgttagtttttcgttttagtttcgagcggacggtcgaggagtcgtttgcgaataggaggttttaaagggagtagttttaggtggtaggggcgtaggtcgtcgcgttttgggaggtttttcgagtata

SEQ ID NO: 29194 - DNA, 943 bp, Artificial Sequence
  chemically treated genomic DNA (Homo sapiens) CpG-island No: 29194
tatactcgaaaaacctcccaaaacgcgacgacctacgcccctaccacctaaaactactccctttaaaacctcctattcgcaaacgactcctcgaccgtccgctcgaaactaaaacgaaaaactaacgacgacgaacgacgcgaccccaaatttataataatccgcaaaaaaccaacctcacgcctcccctccgcgaccccaaccgctaacaacgacgaccactccgcgaaacgcaaccgccgcgaaacgccaaacgaccgaaccaacgaactcgaaaaccgaaaaaaaccccgaaaccctcgaaacgaaacccgaaccgaccaacgacgaaaacgacgcgacgctacaaacgaacacccgacgaaaaacaccgcgcgaaaccgaacaaaaacgcgaaaaccgctataaaccgccgccgcctactcgtctaactatacgccgtcgcgacgctactctcgaaaacgcaaaccaaaaacaccccgctcctaacgcgacctacgccgcccgatacctcccgctacaatctctacacgacgaaataacgcccgcgactacgcccgaaaccgcacaaataaacgcgaacgaacgacgaacgaaaaaaaaaaaaaataaacccgcgcgcgtcgccgttcccacctacccgcacccgcgaaaaacgtcgaaaccccgaacaccccgaaaccgctacacaaaaaaaacgacgcccgaaaccgaacccctacccaaacgaacgccctacgctccgaaaaattacgaaactaaccaaaaaaaaaaaaccgaaaaaacctaacgcgacgacttaatatcctaacaataccaacgaaaacctttccaacgaaataacattttccaactacgctatatacaaactccgaacgaacgaaccaaataaaaaaaaaaaaaaaaaaacgatccgcgcgctaaacacgcgaaactcccccgc

SEQ ID NO: 29195 - DNA, 943 bp, Artificial Sequence
  chemically treated genomic DNA (Homo sapiens) CpG-island No: 29195
tgtgttcggggggttttttagggcgcggcggtttgcgtttttgttatttggggttgttttttttggaattttttgttcgtagacggtttttcggtcgttcgttcggagttggggcgaggggttggcggcggcgagcggcgcggttttaagtttatgataattcgtaaagagttagttttacgtttttttttcgcggttttagtcgttagtagcgacgattatttcgcgggacgtagtcgtcgcgaagcgttagacggtcgggttagcgagttcgggggtcgaaggggatttcgggattttcggggcgggattcgggtcgattagcggcgggggcggcgcggcgttgtaggcgaatattcggcggggggtatcgcgcggggtcgggtagaggcgcgggggtcgttatgggtcgtcgtcgtttgttcgtttggttgtgcgtcgtcgcggcgttgttttcgggggcgtaggttaggggtatttcgtttttggcgcggtttgcgtcgttcggtgtttttcgttatagtttttatacgacgggatggcgttcgcggttgcgttcggggtcgtataagtaagcgcgggcgggcggcgggcgggaagagggagggatgggttcgcgcgcgtcgtcgtttttatttgttcgtattcgcggggggcgtcgaggtttcgggtatttcgaggtcgttgtatagagggggcggcgttcggggtcgagtttttgtttaggcgagcgttttacgtttcgggaggttgcggggttggttaagaaaaaagaatcgagggggtttggcgcggcggtttggtattttggtagtgttagcggaaatttttttagcgaagtaatattttttagttgcgttgtgtgtagatttcgggcgagcggattaggtggagggagaggaggaaaggcggttcgcgcgttgagtacgcggggttttttcgt

SEQ ID NO: 29196 - DNA, 943 bp, Artificial Sequence
  chemically treated genomic DNA (Homo sapiens) CpG-island No: 29196
acgaaaaaaccccgcgtactcaacgcgcgaaccgcctttcctcctctccctccacctaatccgctcgcccgaaatctacacacaacgcaactaaaaaatattacttcgctaaaaaaatttccgctaacactaccaaaataccaaaccgccgcgccaaaccccctcgattcttttttcttaaccaaccccgcaacctcccgaaacgtaaaacgctcgcctaaacaaaaactcgaccccgaacgccgccccctctatacaacgacctcgaaatacccgaaacctcgacgccccccgcgaatacgaacaaataaaaacgacgacgcgcgcgaacccatccctccctcttcccgcccgccgcccgcccgcgcttacttatacgaccccgaacgcaaccgcgaacgccatcccgtcgtataaaaactataacgaaaaacaccgaacgacgcaaaccgcgccaaaaacgaaatacccctaacctacgcccccgaaaacaacgccgcgacgacgcacaaccaaacgaacaaacgacgacgacccataacgacccccgcgcctctacccgaccccgcgcgataccccccgccgaatattcgcctacaacgccgcgccgcccccgccgctaatcgacccgaatcccgccccgaaaatcccgaaatccccttcgacccccgaactcgctaacccgaccgtctaacgcttcgcgacgactacgtcccgcgaaataatcgtcgctactaacgactaaaaccgcgaaaaaaaaacgtaaaactaactctttacgaattatcataaacttaaaaccgcgccgctcgccgccgccaacccctcgccccaactccgaacgaacgaccgaaaaaccgtctacgaacaaaaaattccaaaaaaaacaaccccaaataacaaaaacgcaaaccgccgcgccctaaaaaaccccccgaacaca

SEQ ID NO: 29197 - DNA, 792 bp, Artificial Sequence
  chemically treated genomic DNA (Homo sapiens) CpG-island No: 29197
tgaggtcgagttggcgtaggttgggtagatgttcgaaggcgttcgcgcgtatttcgtttaggcggttgtcgttgaggttgagcgcggttagtttcgttagcggcggtcggcgggcgaaggcgtcggtagggagtacggttagttggttgtcggtaaggaagaggttgcgtacgtaggcgggtaggttcgtgggtatttcggttagattgcggttaacgtatttgattgtgcgcgttgtttcggagtattcgtatagcgcggggtattggttcggtagcgggggttgggcggatacggcggaagttaggaacggcgtcgaggaggagaaggaggatgtcgaggaggtgggagaagacgaggagatttagtttaggagtattagcgttagtcgcgttagtcgtagacgttcgttttcggcggcggggtttcgggagtattttttaggtatcgcggttcgcgttttttcggagttgggttgggacggcgttcgtttcgaaggttcgggaggttgggttcggagggcgcgagtcggcggaagcgtttggaaaaaaaaaatttttttttcgtggaatcgagggagtggcgtcgtagtcggaatttggttaattttttcgttatcgggcgttttttttaggggtcgattttttcgttttttttttttagaaagtacgtacggcgggtcgggacgtttcgtttcgcgtttttgttttcgtttttttttttgtcgtcgttttggtgttattttttcgttttttgttggtatttttcgttggattttttgagggatttggg

SEQ ID NO: 29198 - DNA, 792 bp, Artificial Sequence
  chemically treated genomic DNA (Homo sapiens) CpG-island No: 29198
cccaaatccctcaaaaaatccaacgaaaaataccaacaaaaaacgaaaaaataacaccaaaacgacgacaaaaaaaaaaacgaaaacaaaaacgcgaaacgaaacgtcccgacccgccgtacgtactttctaaaaaaaaaaaacgaaaaaatcgacccctaaaaaaaacgcccgataacgaaaaaattaaccaaattccgactacgacgccactccctcgattccacgaaaaaaaaattttttttttccaaacgcttccgccgactcgcgccctccgaacccaacctcccgaaccttcgaaacgaacgccgtcccaacccaactccgaaaaaacgcgaaccgcgatacctaaaaaatactcccgaaaccccgccgccgaaaacgaacgtctacgactaacgcgactaacgctaatactcctaaactaaatctcctcgtcttctcccacctcctcgacatcctccttctcctcctcgacgccgttcctaacttccgccgtatccgcccaacccccgctaccgaaccaataccccgcgctatacgaatactccgaaacaacgcgcacaatcaaatacgttaaccgcaatctaaccgaaatacccacgaacctacccgcctacgtacgcaacctcttccttaccgacaaccaactaaccgtactccctaccgacgccttcgcccgccgaccgccgctaacgaaactaaccgcgctcaacctcaacgacaaccgcctaaacgaaatacgcgcgaacgccttcgaacatctacccaacctacgccaactcgacctca

SEQ ID NO: 29199 - DNA, 792 bp, Artificial Sequence
  chemically treated genomic DNA (Homo sapiens) CpG-island No: 29199
tttaggttttttagaggatttagcgaggggtgttaataagaggcgaagaggtggtattagggcggcggtaggaagaggagcgggagtaggagcgcggagcggagcgtttcgattcgtcgtgcgtattttttggagggaaggggcgggggaatcggtttttgagggaagcgttcggtggcgagggggttagttaagtttcggttgcggcgttattttttcggttttacgagaggaaagttttttttttttagacgttttcgtcggttcgcgtttttcgggtttagtttttcgagttttcggagcgggcgtcgttttagtttagtttcggggaaacgcgagtcgcgatgtttggggggtgttttcggggtttcgtcgtcggggacgggcgtttgcggttggcgcgattagcgttggtatttttgggttgggttttttcgtttttttttattttttcggtattttttttttttttttcggcgtcgtttttggttttcgtcgtgttcgtttagttttcgttgtcggattagtgtttcgcgttgtgcgagtgtttcgaggtagcgcgtatagttaagtgcgttaatcgtaatttgatcgaggtgtttacggatttgttcgtttacgtgcgtaattttttttttatcggtaattagttggtcgtgttttttgtcggcgttttcgttcgtcggtcgtcgttggcggagttggtcgcgtttaattttagcggtagtcgtttggacgaggtgcgcgcgggcgttttcgagtatttgtttagtttgcgttagttcgatttta

SEQ ID NO: 29200 - DNA, 792 bp, Artificial Sequence
  chemically treated genomic DNA (Homo sapiens) CpG-island No: 29200
taaaatcgaactaacgcaaactaaacaaatactcgaaaacgcccgcgcgcacctcgtccaaacgactaccgctaaaattaaacgcgaccaactccgccaacgacgaccgacgaacgaaaacgccgacaaaaaacacgaccaactaattaccgataaaaaaaaaattacgcacgtaaacgaacaaatccgtaaacacctcgatcaaattacgattaacgcacttaactatacgcgctacctcgaaacactcgcacaacgcgaaacactaatccgacaacgaaaactaaacgaacacgacgaaaaccaaaaacgacgccgaaaaaaaaaaaaaaaataccgaaaaaataaaaaaaaacgaaaaaacccaacccaaaaataccaacgctaatcgcgccaaccgcaaacgcccgtccccgacgacgaaaccccgaaaacaccccccaaacatcgcgactcgcgtttccccgaaactaaactaaaacgacgcccgctccgaaaactcgaaaaactaaacccgaaaaacgcgaaccgacgaaaacgtctaaaaaaaaaaaactttcctctcgtaaaaccgaaaaaataacgccgcaaccgaaacttaactaaccccctcgccaccgaacgcttccctcaaaaaccgattcccccgccccttccctccaaaaaatacgcacgacgaatcgaaacgctccgctccgcgctcctactcccgctcctcttcctaccgccgccctaataccacctcttcgcctcttattaacacccctcgctaaatcctctaaaaaacctaaa

SEQ ID NO: 29201 - DNA, 643 bp, Artificial Sequence
  chemically treated genomic DNA (Homo sapiens) CpG-island No: 29201
gcgcgttttcggtttttgtttagaagttgtttattttgattttgttcgtagtaggtgaatttggtgtggtgcgcgtattgcgggttttgattggttgtgtacgttacggtgaaaaatttgagcgtttatttcgagttttgtaagtttttagtgttttttttgggtggacgtttaggcgtacggtcgttattttttttttatttgtggattcgttagtttttcgttcgttttaggaggcgatttcgcgttttgggtgcggtgaggtcgttgggatagcggaggtgtttttcgacgcgaagtagcgagttgaggcggcggttagcggggaagatgagcggtagtagcgttaggtttagttatttgttttagttcgtcgtgaagagcgtgtttgtgtatcgtaacggggattttttttacgcggggcgtcgcgtcgttatttatgagaagaaggtgtttagtttcgaagtttttttgaaggaggtgatcggcggcgtttaggtattttttggggtcgttaggaatatttatatttcgcggattggttatcgaattcggaagttagattagatttagagcgggggtaattacgtggttggaggttaggaagtttttaagaaatttaagtgagtcggttttttttatt

SEQ ID NO: 29202 - DNA, 643 bp, Artificial Sequence
  chemically treated genomic DNA (Homo sapiens) CpG-island No: 29202
aataaaaaaaaccgactcacttaaatttcttaaaaacttcctaacctccaaccacgtaattacccccgctctaaatctaatctaacttccgaattcgataaccaatccgcgaaatataaatattcctaacgaccccaaaaaatacctaaacgccgccgatcacctccttcaaaaaaacttcgaaactaaacaccttcttctcataaataacgacgcgacgccccgcgtaaaaaaaatccccgttacgatacacaaacacgctcttcacgacgaactaaaacaaataactaaacctaacgctactaccgctcatcttccccgctaaccgccgcctcaactcgctacttcgcgtcgaaaaacacctccgctatcccaacgacctcaccgcacccaaaacgcgaaatcgcctcctaaaacgaacgaaaaactaacgaatccacaaataaaaaaaaaataacgaccgtacgcctaaacgtccacccaaaaaaaacactaaaaacttacaaaactcgaaataaacgctcaaatttttcaccgtaacgtacacaaccaatcaaaacccgcaatacgcgcaccacaccaaattcacctactacgaacaaaatcaaaataaacaacttctaaacaaaaaccgaaaacgcgc

SEQ ID NO: 29203 - DNA, 643 bp, Artificial Sequence
  chemically treated genomic DNA (Homo sapiens) CpG-island No: 29203
ggtgggggagatcgatttatttgagttttttgaaggttttttggtttttagttacgtaattgttttcgttttggatttggtttagttttcggattcggtggttagttcgcggggtgtagatgtttttgacggttttaaagggtgtttgaacgtcgtcggttattttttttaggaagatttcgaagttggatattttttttttatggatgacgacgcggcgtttcgcgtagaaggggttttcgttgcggtatataagtacgttttttacgacgggttgagataggtggttggatttggcgttgttgtcgtttatttttttcgttggtcgtcgttttagttcgttgtttcgcgtcgggaggtattttcgttgttttagcggttttatcgtatttagggcgcgggatcgttttttgaaacgaacgagaaattgacgaatttataggtgaaagagaagtaacggtcgtgcgtttaggcgtttatttagaggagatattaggagtttgtaggattcggagtagacgtttaagttttttatcgtggcgtgtatagttaattaggattcgtagtgcgcgtattatattaggtttatttgttacgggtagaattaaggtggatagtttttgagtaggagtcggaaacgcgt

SEQ ID NO: 29204 - DNA, 643 bp, Artificial Sequence
  chemically treated genomic DNA (Homo sapiens) CpG-island No: 29204
acgcgtttccgactcctactcaaaaactatccaccttaattctacccgtaacaaataaacctaatataatacgcgcactacgaatcctaattaactatacacgccacgataaaaaacttaaacgtctactccgaatcctacaaactcctaatatctcctctaaataaacgcctaaacgcacgaccgttacttctctttcacctataaattcgtcaatttctcgttcgtttcaaaaaacgatcccgcgccctaaatacgataaaaccgctaaaacaacgaaaatacctcccgacgcgaaacaacgaactaaaacgacgaccaacgaaaaaaataaacgacaacaacgccaaatccaaccacctatctcaacccgtcgtaaaaaacgtacttatataccgcaacgaaaaccccttctacgcgaaacgccgcgtcgtcatccataaaaaaaaaatatccaacttcgaaatcttcctaaaaaaaataaccgacgacgttcaaacaccctttaaaaccgtcaaaaacatctacaccccgcgaactaaccaccgaatccgaaaactaaaccaaatccaaaacgaaaacaattacgtaactaaaaaccaaaaaaccttcaaaaaactcaaataaatcgatctcccccacc

SEQ ID NO: 29205 - DNA, 701 bp, Artificial Sequence
  chemically treated genomic DNA (Homo sapiens) CpG-island No: 29205
gcggttgtcgtcgtcgtcgtcgttgtagtttttatggataaaagggtattgttagttagtttcggtttcgtcgtcgtcgtcgtcgttgtcgtcgtttcgggcgcgtatatttagatttttattacgaatatttttattattttttgttttttttttttttaaagcggcgtcgtagtcgtcggtttttttttttttagtgttttcggcgcggagtagatcgtcggtagttttttttatattacgtcgtacggattttttagtagagtcgggttgttgtagtagttattagcgttgggacgcggcggtagcggcggcggcggcggtttttcggtaatattttttttttttatcgtttttagtttcggcgggaggtgggttcgtatcgcgcggggtcgtgggcgcgttgcgggtcgttcggggagagtattgggtcgagtatcgtgggtttcgggggttgtttttttaacgagggtttattgttagatttgagtgtttttttcggcgttaggagggtcggggggttcggttaggcgcgcggggcggcggggattgttttggcgcgaattatattaaatattttaaaatttttcgcggtttttttttttttttttgtatttttttttatttttattttttttttttttttaattcgaagttttttttttttcgggcgtaggaaggggttacgtttcggatggaga

SEQ ID NO: 29206 - DNA, 701 bp, Artificial Sequence
  chemically treated genomic DNA (Homo sapiens) CpG-island No: 29206
tctccatccgaaacgtaaccccttcctacgcccgaaaaaaaaaaaacttcgaattaaaaaaaaaaaaaaaataaaaataaaaaaaaatacaaaaaaaaaaaaaaaaaccgcgaaaaattttaaaatatttaatataattcgcgccaaaacaatccccgccgccccgcgcgcctaaccgaaccccccgaccctcctaacgccgaaaaaaacactcaaatctaacaataaaccctcgttaaaaaaacaacccccgaaacccacgatactcgacccaatactctccccgaacgacccgcaacgcgcccacgaccccgcgcgatacgaacccacctcccgccgaaactaaaaacgataaaaaaaaaaaatattaccgaaaaaccgccgccgccgccgctaccgccgcgtcccaacgctaataactactacaacaacccgactctactaaaaaatccgtacgacgtaatataaaaaaaactaccgacgatctactccgcgccgaaaacactaaaaaaaaaaaaaccgacgactacgacgccgctttaaaaaaaaaaaaaacaaaaaataataaaaatattcgtaataaaaatctaaatatacgcgcccgaaacgacgacaacgacgacgacgacgacgaaaccgaaactaactaacaatacccttttatccataaaaactacaacgacgacgacgacgacaaccgc

SEQ ID NO: 29207 - DNA, 701 bp, Artificial Sequence
  chemically treated genomic DNA (Homo sapiens) CpG-island No: 29207
tttttattcggggcgtgatttttttttacgttcgagaaagaggaagtttcgagttggaggggaagggagagtgggggtagggaaaagtgtaggaaaagaagggggggtcgcgaaaagttttggagtgtttgatgtggttcgcgttaaggtaattttcgtcgtttcgcgcgtttggtcgagtttttcgatttttttggcgtcgggaagagtatttaggtttaataatgaattttcgttggaggggtagttttcgaggtttacgatgttcggtttagtgtttttttcgagcggttcgtagcgcgtttacgatttcgcgcggtgcgagtttatttttcgtcggggttggggacggtggggagggagggtattatcggagggtcgtcgtcgtcgtcgttgtcgtcgcgttttagcgttggtggttgttgtagtagttcggttttgttggagggttcgtgcggcgtggtgtagaggaggttgtcggcggtttgtttcgcgtcgggggtattggggaggagggggtcggcggttacggcgtcgttttggagggaggaggaataggaggtggtggaagtgttcgtggtgaggatttggatgtacgcgttcggggcggcggtagcggcggcggcggcggcgaagtcggggttggttagtagtgtttttttgtttatggaggttgtagcggcggcggcgacgatagtcgt

SEQ ID NO: 29208 - DNA, 701 bp, Artificial Sequence
  chemically treated genomic DNA (Homo sapiens) CpG-island No: 29208
acgactatcgtcgccgccgccgctacaacctccataaacaaaaaaacactactaaccaaccccgacttcgccgccgccgccgccgctaccgccgccccgaacgcgtacatccaaatcctcaccacgaacacttccaccacctcctattcctcctccctccaaaacgacgccgtaaccgccgaccccctcctccccaatacccccgacgcgaaacaaaccgccgacaacctcctctacaccacgccgcacgaaccctccaacaaaaccgaactactacaacaaccaccaacgctaaaacgcgacgacaacgacgacgacgacgaccctccgataataccctccctccccaccgtccccaaccccgacgaaaaataaactcgcaccgcgcgaaatcgtaaacgcgctacgaaccgctcgaaaaaaacactaaaccgaacatcgtaaacctcgaaaactacccctccaacgaaaattcattattaaacctaaatactcttcccgacgccaaaaaaatcgaaaaactcgaccaaacgcgcgaaacgacgaaaattaccttaacgcgaaccacatcaaacactccaaaacttttcgcgacccccccttcttttcctacacttttccctacccccactctcccttcccctccaactcgaaacttcctctttctcgaacgtaaaaaaaaatcacgccccgaataaaaa

SEQ ID NO: 29209 - DNA, 557 bp, Artificial Sequence
  chemically treated genomic DNA (Homo sapiens) CpG-island No: 29209
gttaggcgttcgtaggtgtcggggttgaagaggggcgcggggtttagtgttttcgtcggcgtcggttttttagcgttcgcggtttcgtcgtcgttttagtagtcgtggtcgtcgttgcggtttttcgagtatatggttcggcgtcggcgcgtttggcgggcggaggcgtttagtttgcggcggggttcgcggcgcgtttcgtattgggtggggttggggtttcgtcgtttgttttagttattgtgtattgaggggttcgcgttatcgcgcgtcgggttcgtttttttttcgtttttttcgttcggcgtatttttcgtggtttcgttttttttcgcggtttgttttcgtcgtttcgttgttttcggcgcgtttttttagtttcgttttttcgcgggcgcgttttcgcggttagttcgtttcgtttttattggttgggtatttttcgttggtcggcgtggacgcgcgtcgcgggatagtttgggggttagggtcgtagggtagtttcgatggttttttatatttttatttttttgtatttattttgaaagtttcgtgtt

SEQ ID NO: 29210 - DNA, 557 bp, Artificial Sequence
  chemically treated genomic DNA (Homo sapiens) CpG-island No: 29210
aacacgaaactttcaaaataaatacaaaaaaataaaaatataaaaaaccatcgaaactaccctacgaccctaacccccaaactatcccgcgacgcgcgtccacgccgaccaacgaaaaatacccaaccaataaaaacgaaacgaactaaccgcgaaaacgcgcccgcgaaaaaacgaaactaaaaaaacgcgccgaaaacaacgaaacgacgaaaacaaaccgcgaaaaaaaacgaaaccacgaaaaatacgccgaacgaaaaaaacgaaaaaaaaacgaacccgacgcgcgataacgcgaacccctcaatacacaataactaaaacaaacgacgaaaccccaaccccacccaatacgaaacgcgccgcgaaccccgccgcaaactaaacgcctccgcccgccaaacgcgccgacgccgaaccatatactcgaaaaaccgcaacgacgaccacgactactaaaacgacgacgaaaccgcgaacgctaaaaaaccgacgccgacgaaaacactaaaccccgcgcccctcttcaaccccgacacctacgaacgcctaac

SEQ ID NO: 29211 - DNA, 557 bp, Artificial Sequence
  chemically treated genomic DNA (Homo sapiens) CpG-island No: 29211
gatacgaagtttttaaggtgggtgtagggaggtgggggtgtgaagagttatcgaggttattttgcggttttggtttttaggttatttcgcgacgcgcgtttacgtcgattagcggaaggtgtttagttagtgggggcggggcgagttagtcgcgaggacgcgttcgcgggggggcggggttaagaggacgcgtcgggagtagcggagcgacgaggataggtcgcggggaggggcggggttacggggggtgcgtcgggcggaaggggcgggaagagggcgggttcggcgcgcggtagcgcgggttttttagtgtataatggttagagtaggcggcggagttttaattttatttagtgcggagcgcgtcgcgagtttcgtcgtaagttgagcgttttcgttcgttaggcgcgtcggcgtcgggttatgtattcggggaatcgtagcggcggttacggttattgggacggcggcggggtcgcgggcgttgaggggtcggcgtcggcggggatattgagtttcgcgtttttttttagtttcggtatttacgagcgtttggt

SEQ ID NO: 29212 - DNA, 557 bp, Artificial Sequence
  chemically treated genomic DNA (Homo sapiens) CpG-island No: 29212
accaaacgctcgtaaataccgaaactaaaaaaaaacgcgaaactcaatatccccgccgacgccgacccctcaacgcccgcgaccccgccgccgtcccaataaccgtaaccgccgctacgattccccgaatacataacccgacgccgacgcgcctaacgaacgaaaacgctcaacttacgacgaaactcgcgacgcgctccgcactaaataaaattaaaactccgccgcctactctaaccattatacactaaaaaacccgcgctaccgcgcgccgaacccgccctcttcccgccccttccgcccgacgcaccccccgtaaccccgcccctccccgcgacctatcctcgtcgctccgctactcccgacgcgtcctcttaaccccgcccccccgcgaacgcgtcctcgcgactaactcgccccgcccccactaactaaacaccttccgctaatcgacgtaaacgcgcgtcgcgaaataacctaaaaaccaaaaccgcaaaataacctcgataactcttcacacccccacctccctacacccaccttaaaaacttcgtatc

SEQ ID NO: 29213 - DNA, 967 bp, Artificial Sequence
  chemically treated genomic DNA (Homo sapiens) CpG-island No: 29213
cgttggtaagagtcggcggggatcgtagcggttttgagcgagcgggtgttcgtagttatatgagtgatgttttgtagttttaggattcgttttttttcggcggttcggggcgtcgttagacgtttttttttcgttagttggacgttttgatttttttttttcggttgttcgcgttcgttagcggttagaaattttcgtttcgttttatgtaatcgggatttcgcgttttcgtgtcgtttcgttttcggtttagaggacgggtttggggggagggggcgtgtggcgacgttgttatttattagggtttagtcgtcgttttttcgagttgggtcggtgtttcgcgcggttttgtagttttgtagcgttcggggcggtgtaggagtttcggggtgtcgcggcgttcgttcggttgtatcgttggtttttcggttcgggttttaggttcggcgttttttatttttaggtcgcgcggtttcgttttttcgacgatttttagtttcgggttttcgttatttacgagttttcgttttcggtgagttgttgtttttagggtttcgagtcgcgcggtattttttgcggttcgaggcggattttttgtagttttttgattatttgttcgtatttttcgttttttatggagtttaggtcgttgtcgtggcggtcgtttagtagtcgttttttttttagttcgtcgcgggggttttttatggtttatttttgggggcgttcggtcgtttggaatatggcgcggacgagttgcgggcgttgttgcgggtgcgttgggtcgcgggttgcgcgttgttttttcgttggggcgttggcgggcgggacggcggtacggattgttgtgggttttgtagcgtcgtcgcggcgttttataaacgttggttggggatttttttggggcggggttaggttcggggaatttttaagttagttagattagaaaaagagaattggtttcgtt

SEQ ID NO: 29214 - DNA, 967 bp, Artificial Sequence
  chemically treated genomic DNA (Homo sapiens) CpG-island No: 29214
aacgaaaccaattctctttttctaatctaactaacttaaaaattccccgaacctaaccccgccccaaaaaaatccccaaccaacgtttataaaacgccgcgacgacgctacaaaacccacaacaatccgtaccgccgtcccgcccgccaacgccccaacgaaaaaacaacgcgcaacccgcgacccaacgcacccgcaacaacgcccgcaactcgtccgcgccatattccaaacgaccgaacgcccccaaaaataaaccataaaaaacccccgcgacgaactaaaaaaaaaacgactactaaacgaccgccacgacaacgacctaaactccataaaaaacgaaaaatacgaacaaataatcaaaaaactacaaaaaatccgcctcgaaccgcaaaaaataccgcgcgactcgaaaccctaaaaacaacaactcaccgaaaacgaaaactcgtaaataacgaaaacccgaaactaaaaatcgtcgaaaaaacgaaaccgcgcgacctaaaaataaaaaacgccgaacctaaaacccgaaccgaaaaaccaacgatacaaccgaacgaacgccgcgacaccccgaaactcctacaccgccccgaacgctacaaaactacaaaaccgcgcgaaacaccgacccaactcgaaaaaacgacgactaaaccctaataaataacaacgtcgccacacgccccctccccccaaacccgtcctctaaaccgaaaacgaaacgacacgaaaacgcgaaatcccgattacataaaacgaaacgaaaatttctaaccgctaacgaacgcgaacaaccgaaaaaaaaaaatcaaaacgtccaactaacgaaaaaaaaacgtctaacgacgccccgaaccgccgaaaaaaaacgaatcctaaaactacaaaacatcactcatataactacgaacacccgctcgctcaaaaccgctacgatccccgccgactcttaccaacg

SEQ ID NO: 29215 - DNA, 967 bp, Artificial Sequence
  chemically treated genomic DNA (Homo sapiens) CpG-island No: 29215
gacgaagttagttttttttttttggtttgattggtttggaaatttttcgagtttgatttcgttttagagaaatttttagttagcgtttatagggcgtcgcggcggcgttgtagagtttatagtagttcgtgtcgtcgtttcgttcgttagcgttttagcgaggaagtagcgcgtagttcgcggtttagcgtattcgtagtagcgttcgtagttcgttcgcgttatgttttaggcggtcgagcgtttttaggagtgggttatggagggttttcgcgacgggttgaagaaggagcggttattggacgatcgttacgatagcggtttggattttatgaaagacgaggagtacgagtagatggttaaggagttgtaggagattcgtttcgagtcgtaggaggtgtcgcgcggttcggagttttggaagtagtagtttatcgaggacggggattcgtaagtggcggaggttcggggttgggggtcgtcgggagggcgggatcgcgcggtttgggggtgggaggcgtcgggtttggagttcgagtcgggggattagcgatgtagtcgggcgggcgtcgcggtatttcggggtttttgtatcgtttcgaacgttgtagggttgtagggtcgcgcggggtatcggtttaattcggaggggcggcggttgggttttggtggatggtagcgtcgttatacgttttttttttttagattcgttttttaggtcgggggcggggcggtacggggacgcgaagtttcggttgtataaggcggggcgggagtttttggtcgttggcgggcgcgagtagtcgggaggggaaggttagggcgtttagttggcggagggggggcgtttggcggcgtttcgggtcgtcgggagggggcgaattttggggttgtagaatattatttatatagttgcgaatattcgttcgtttaaaatcgttgcgattttcgtcggtttttgttagcg

SEQ ID NO: 29216 - DNA, 967 bp, Artificial Sequence
  chemically treated genomic DNA (Homo sapiens) CpG-island No: 29216
cgctaacaaaaaccgacgaaaatcgcaacgattttaaacgaacgaatattcgcaactatataaataatattctacaaccccaaaattcgccccctcccgacgacccgaaacgccgccaaacgccccccctccgccaactaaacgccctaaccttcccctcccgactactcgcgcccgccaacgaccaaaaactcccgccccgccttatacaaccgaaacttcgcgtccccgtaccgccccgcccccgacctaaaaaacgaatctaaaaaaaaaaaacgtataacgacgctaccatccaccaaaacccaaccgccgcccctccgaattaaaccgataccccgcgcgaccctacaaccctacaacgttcgaaacgatacaaaaaccccgaaataccgcgacgcccgcccgactacatcgctaatcccccgactcgaactccaaacccgacgcctcccacccccaaaccgcgcgatcccgccctcccgacgacccccaaccccgaacctccgccacttacgaatccccgtcctcgataaactactacttccaaaactccgaaccgcgcgacacctcctacgactcgaaacgaatctcctacaactccttaaccatctactcgtactcctcgtctttcataaaatccaaaccgctatcgtaacgatcgtccaataaccgctccttcttcaacccgtcgcgaaaaccctccataacccactcctaaaaacgctcgaccgcctaaaacataacgcgaacgaactacgaacgctactacgaatacgctaaaccgcgaactacgcgctacttcctcgctaaaacgctaacgaacgaaacgacgacacgaactactataaactctacaacgccgccgcgacgccctataaacgctaactaaaaatttctctaaaacgaaatcaaactcgaaaaatttccaaaccaatcaaaccaaaaaaaaaaaactaacttcgtc

SEQ ID NO: 29217 - DNA, 520 bp, Artificial Sequence
  chemically treated genomic DNA (Homo sapiens) CpG-island No: 29217
gggacgacgcgaggtagtcgtagttttacgcgttcgtagttttcgttcgggtaggtttcgtcgtcgtatatttagttcgcgcggttagtagttatcgtcgtagagaatggatatgcgagcgcgattaataaggagcggttttttcgagcggagaggcggcggcgtagttaattagcgtcgtgatggagaggaaagggcgggtaattcgtaggttcgcgttaggtcgcgttttagttgtttttagtttttataggttttggggtcgtcgtatttgggttagagatttaggatgtcgcgaggcgcggtaagcgttttttagggaagtcgaagattttgtttgagcgtattattcgaatttcgggtttatatttcgttttcgtttagaggcgcggtttttattttttagcgttcgttagtatcgggagcgttttattttttttttagttgggttttaagagttattttggtaggtcgtgtacgtttcgcgttttatttcgtggggatatagaaacggaggagg

SEQ ID NO: 29218 - DNA, 520 bp, Artificial Sequence
  chemically treated genomic DNA (Homo sapiens) CpG-island No: 29218
cctcctccgtttctatatccccacgaaataaaacgcgaaacgtacacgacctaccaaaataactcttaaaacccaactaaaaaaaaaataaaacgctcccgatactaacgaacgctaaaaaataaaaaccgcgcctctaaacgaaaacgaaatataaacccgaaattcgaataatacgctcaaacaaaatcttcgacttccctaaaaaacgcttaccgcgcctcgcgacatcctaaatctctaacccaaatacgacgaccccaaaacctataaaaactaaaaacaactaaaacgcgacctaacgcgaacctacgaattacccgccctttcctctccatcacgacgctaattaactacgccgccgcctctccgctcgaaaaaaccgctccttattaatcgcgctcgcatatccattctctacgacgataactactaaccgcgcgaactaaatatacgacgacgaaacctacccgaacgaaaactacgaacgcgtaaaactacgactacctcgcgtcgtccc

SEQ ID NO: 29219 - DNA, 520 bp, Artificial Sequence
  chemically treated genomic DNA (Homo sapiens) CpG-island No: 29219
tttttttcgtttttgtatttttacgaggtgaggcgcggggcgtgtacggtttattagagtggtttttggggtttagttgaggaagggatgaggcgttttcggtattaacgagcgttagggagtgagaatcgcgtttttgggcgagagcggaatgtgggttcggggttcgggtggtgcgtttaggtaaggttttcggtttttttagggagcgtttgtcgcgtttcgcggtattttaggtttttggtttaggtgcggcgattttagggtttgtgagggttgagggtaattgaggcgcggtttaacgcgagtttgcggattgttcgtttttttttttttattacggcgttgattggttgcgtcgtcgttttttcgttcgggaaggtcgttttttattggtcgcgttcgtatgtttattttttgcgacggtggttgttagtcgcgcgagttgggtgtgcggcggcgaggtttgttcgggcggggattgcgggcgcgtggagttgcggttgtttcgcgtcgtttt

SEQ ID NO: 29220 - DNA, 520 bp, Artificial Sequence
  chemically treated genomic DNA (Homo sapiens) CpG-island No: 29220
aaaacgacgcgaaacaaccgcaactccacgcgcccgcaatccccgcccgaacaaacctcgccgccgcacacccaactcgcgcgactaacaaccaccgtcgcaaaaaataaacatacgaacgcgaccaataaaaaacgaccttcccgaacgaaaaaacgacgacgcaaccaatcaacgccgtaataaaaaaaaaaaaacgaacaatccgcaaactcgcgttaaaccgcgcctcaattaccctcaaccctcacaaaccctaaaatcgccgcacctaaaccaaaaacctaaaataccgcgaaacgcgacaaacgctccctaaaaaaaccgaaaaccttacctaaacgcaccacccgaaccccgaacccacattccgctctcgcccaaaaacgcgattctcactccctaacgctcgttaataccgaaaacgcctcatcccttcctcaactaaaccccaaaaaccactctaataaaccgtacacgccccgcgcctcacctcgtaaaaatacaaaaacgaaaaaaa

SEQ ID NO: 29221 - DNA, 529 bp, Artificial Sequence
  chemically treated genomic DNA (Homo sapiens) CpG-island No: 29221
tttaataacggggttaatttatataggtatatgttcgatttatcgagttttattttatcgtatttcgtagatatcgtattatttataaatcgaagggtcgcggtaatatttcgttgagttagtttattagtattatttttttagtagtacgcgtttatgttgcgttttcgcgttatattttagtaatttttataacggtttatagttcgttattattattatattcgttacggcgattcgcgattatattttagataagcgatcgcgattagtaattttcgatgttattatcggaatcgtttcgggatattatatttcggggtataaatcgtatttatattaagatagttaatttaatcgataaacgtttcgcgcgtttcgatcgttttattaatcggttattttttaattttcgttttttttttcgggttttcgtattttttaagatataaaaacgtcgaaattaggtcgggtaataattttaaaacggtttttaagcgtttaagcgaaaggaagagttatatatttt

SEQ ID NO: 29222 - DNA, 529 bp, Artificial Sequence
  chemically treated genomic DNA (Homo sapiens) CpG-island No: 29222
aaaatatataactcttcctttcgcttaaacgcttaaaaaccgttttaaaattattacccgacctaatttcgacgtttttatatcttaaaaaatacgaaaacccgaaaaaaaaaacgaaaattaaaaaataaccgattaataaaacgatcgaaacgcgcgaaacgtttatcgattaaattaactatcttaatataaatacgatttataccccgaaatataatatcccgaaacgattccgataataacatcgaaaattactaatcgcgatcgcttatctaaaatataatcgcgaatcgccgtaacgaatataataataataacgaactataaaccgttataaaaattactaaaatataacgcgaaaacgcaacataaacgcgtactactaaaaaaataatactaataaactaactcaacgaaatattaccgcgacccttcgatttataaataatacgatatctacgaaatacgataaaataaaactcgataaatcgaacatatacctatataaattaaccccgttattaaa

SEQ ID NO: 29223 - DNA, 529 bp, Artificial Sequence
  chemically treated genomic DNA (Homo sapiens) CpG-island No: 29223
agagtgtatggttttttttttcgtttaggcgtttgagagtcgttttgaagttgttgttcgatttggtttcggcgtttttatattttggagggtgcgagaattcggaggagaaagcgagggttagaaggtaatcgattaatgggacgatcgaggcgcgcggggcgtttgtcggttggattgattattttggtgtgagtacgatttatatttcggggtgtaatatttcggggcggtttcggtgatggtatcgagagttgttagtcgcggtcgtttgtttagagtgtggtcgcgagtcgtcgtgacgagtgtggtggtggtagcggattgtaggtcgttatagaggttgttggggtatagcgcgagagcgtagtatagacgcgtattattaagggggtaatgttggtgagttaatttagcgagatattatcgcgatttttcggtttatgggtggtacggtgtttacgggatgcggtgggatgggattcggtgggtcggatatatatttatgtaggttggtttcgttgttagg

SEQ ID NO: 29224 - DNA, 529 bp, Artificial Sequence
  chemically treated genomic DNA (Homo sapiens) CpG-island No: 29224
cctaacaacgaaaccaacctacataaatatatatccgacccaccgaatcccatcccaccgcatcccgtaaacaccgtaccacccataaaccgaaaaatcgcgataatatctcgctaaattaactcaccaacattacccccttaataatacgcgtctatactacgctctcgcgctataccccaacaacctctataacgacctacaatccgctaccaccaccacactcgtcacgacgactcgcgaccacactctaaacaaacgaccgcgactaacaactctcgataccatcaccgaaaccgccccgaaatattacaccccgaaatataaatcgtactcacaccaaaataatcaatccaaccgacaaacgccccgcgcgcctcgatcgtcccattaatcgattaccttctaaccctcgctttctcctccgaattctcgcaccctccaaaatataaaaacgccgaaaccaaatcgaacaacaacttcaaaacgactctcaaacgcctaaacgaaaaaaaaaaccatacactct

SEQ ID NO: 29225 - DNA, 565 bp, Artificial Sequence
  chemically treated genomic DNA (Homo sapiens) CpG-island No: 29225
ttttttttattcgtttatgttggtgggacggaggttttttcgggtttcgggatcgttcgcgaagtcgtttttcgtttttacgcgtttgtttgcggtcgtgaagtttcgcgttagagtataggttagttggtcggtttcgatgaagtttacgtttatggttcgcggtttacgttttttgggagtcgtacgaatttttttagcgagggatcggaagtaacgttaggggaagggcggatagcgtaggggcgaacgggcggcgtgtcgaggatcggcgagttaatagtagtttttgggatggtgtaattttattttttttcggcggatatttttcgggcggttgatggcgttttaggttacgtggtttcgtttcgttcgggcgattaattagtggttaggatttcggggtaggttaattcgcggtcgagttaggtcgcgtgttcgtttttttcgttcgcgattggagggcggaatttcgggttggagtttcggaagtttttgtggtagtttggcgtgagttttaggcgttcgtcggtttaggacgttcggtcgtttttatttttttttt

SEQ ID NO: 29226 - DNA, 565 bp, Artificial Sequence
  chemically treated genomic DNA (Homo sapiens) CpG-island No: 29226
aaaaaaaaaataaaaacgaccgaacgtcctaaaccgacgaacgcctaaaactcacgccaaactaccacaaaaacttccgaaactccaacccgaaattccgccctccaatcgcgaacgaaaaaaacgaacacgcgacctaactcgaccgcgaattaacctaccccgaaatcctaaccactaattaatcgcccgaacgaaacgaaaccacgtaacctaaaacgccatcaaccgcccgaaaaatatccgccgaaaaaaaataaaattacaccatcccaaaaactactattaactcgccgatcctcgacacgccgcccgttcgcccctacgctatccgcccttcccctaacgttacttccgatccctcgctaaaaaaattcgtacgactcccaaaaaacgtaaaccgcgaaccataaacgtaaacttcatcgaaaccgaccaactaacctatactctaacgcgaaacttcacgaccgcaaacaaacgcgtaaaaacgaaaaacgacttcgcgaacgatcccgaaacccgaaaaaacctccgtcccaccaacataaacgaataaaaaaaa

SEQ ID NO: 29227 - DNA, 565 bp, Artificial Sequence
  chemically treated genomic DNA (Homo sapiens) CpG-island No: 29227
ggggggggggtgggggcggtcgggcgttttgggtcggcgggcgtttggagtttacgttaagttgttataggggttttcgggattttagttcggagtttcgttttttagtcgcgagcggaggaggcgggtacgcggtttggttcggtcgcggattggtttgtttcgagattttggttattgattggtcgttcggacggggcggggttacgtggtttaaggcgttattagtcgttcgggagatattcgtcgggggagaatagggttgtattattttagaagttgttgttagttcgtcggttttcggtacgtcgttcgttcgtttttgcgttgttcgttttttttttagcgttattttcggtttttcgttgagggggttcgtgcggtttttaggaggcgtgaatcgcggattatgagcgtgggttttatcggggtcggttagttggtttatgttttggcgcggggttttacggtcgtaggtaagcgcgtggaggcgggaggcggtttcgcgggcggtttcgaggttcgagggggttttcgttttattagtatgagcgaatgaaagggg

SEQ ID NO: 29228 - DNA, 565 bp, Artificial Sequence
  chemically treated genomic DNA (Homo sapiens) CpG-island No: 29228
cccctttcattcgctcatactaataaaacgaaaaccccctcgaacctcgaaaccgcccgcgaaaccgcctcccgcctccacgcgcttacctacgaccgtaaaaccccgcgccaaaacataaaccaactaaccgaccccgataaaacccacgctcataatccgcgattcacgcctcctaaaaaccgcacgaaccccctcaacgaaaaaccgaaaataacgctaaaaaaaaaacgaacaacgcaaaaacgaacgaacgacgtaccgaaaaccgacgaactaacaacaacttctaaaataatacaaccctattctcccccgacgaatatctcccgaacgactaataacgccttaaaccacgtaaccccgccccgtccgaacgaccaatcaataaccaaaatctcgaaacaaaccaatccgcgaccgaaccaaaccgcgtacccgcctcctccgctcgcgactaaaaaacgaaactccgaactaaaatcccgaaaacccctataacaacttaacgtaaactccaaacgcccgccgacccaaaacgcccgaccgcccccacccccccccc

SEQ ID NO: 29229 - DNA, 579 bp, Artificial Sequence
  chemically treated genomic DNA (Homo sapiens) CpG-island No: 29229
agcgttttggcgcgattttttgtagcgggagtcggggcgagtcggtcggcgggtcggggttgttgtattgtagaggggagtagttgcgggtattcgtggcggcgggagcggcggtagggagttgcgattcgcggttcgagtcgggggtcggggggcgagcgtcgcgtatgtgtgcgcgcgagtgtggtcggcgcgcgttcgagtgtggtcggcgtgcgcggttttgttcggggcgtgcgggtatgagcgtgagcgtcggtgtggttcgaaaggttttttttttaaatttttcggtagtcggtttttgtgtgtgatacgatgatgttattatcgtcgagtagttttaacgtttgtatttttataaagttttatcgcgggtttcggaaacggggttgggggtggggaggcgaagattttttttttgtttcggtttttttcgtttcgtcgggatcgttcgtattgtgtagttttgaaatgtaaacgagtcgcggttcgggagttggggttttagaaaggaggggcgtggtggtcgggcgggttgattatcgagagagtagggggtttagttttgttggttta

SEQ ID NO: 29230 - DNA, 579 bp, Artificial Sequence
  chemically treated genomic DNA (Homo sapiens) CpG-island No: 29230
taaaccaacaaaactaaaccccctactctctcgataatcaacccgcccgaccaccacgcccctcctttctaaaaccccaactcccgaaccgcgactcgtttacatttcaaaactacacaatacgaacgatcccgacgaaacgaaaaaaaccgaaacaaaaaaaaaatcttcgcctccccacccccaaccccgtttccgaaacccgcgataaaactttataaaaatacaaacgttaaaactactcgacgataataacatcatcgtatcacacacaaaaaccgactaccgaaaaatttaaaaaaaaaacctttcgaaccacaccgacgctcacgctcatacccgcacgccccgaacaaaaccgcgcacgccgaccacactcgaacgcgcgccgaccacactcgcgcgcacacatacgcgacgctcgccccccgacccccgactcgaaccgcgaatcgcaactccctaccgccgctcccgccgccacgaatacccgcaactactcccctctacaatacaacaaccccgacccgccgaccgactcgccccgactcccgctacaaaaaatcgcgccaaaacgct

SEQ ID NO: 29231 - DNA, 579 bp, Artificial Sequence
  chemically treated genomic DNA (Homo sapiens) CpG-island No: 29231
tgagttaatagggttgagttttttattttttcggtggttagttcgttcgattattacgttttttttttttagggttttagttttcgggtcgcggttcgtttgtattttaaagttatataatgcgggcggtttcggcgaggcgggaggggtcggggtagagggagggttttcgtttttttatttttagtttcgttttcggagttcgcgatggagttttgtgaagatgtaggcgttggggttgttcggcgatgatgatattatcgtgttatatataggagtcggttgtcggggggtttaagagaagagtttttcggattatatcggcgtttacgtttatattcgtacgtttcgggtagagtcgcgtacgtcggttatattcgggcgcgcgtcggttatattcgcgcgtatatatacgcggcgttcgtttttcggttttcggttcgggtcgcgagtcgtagttttttgtcgtcgttttcgtcgttacggatgttcgtagttgtttttttttgtagtgtagtaatttcggttcgtcggtcggttcgtttcggttttcgttgtaaggaatcgcgttaggacgtt

SEQ ID NO: 29232 - DNA, 579 bp, Artificial Sequence
  chemically treated genomic DNA (Homo sapiens) CpG-island No: 29232
aacgtcctaacgcgattccttacaacgaaaaccgaaacgaaccgaccgacgaaccgaaattactacactacaaaaaaaaacaactacgaacatccgtaacgacgaaaacgacgacaaaaaactacgactcgcgacccgaaccgaaaaccgaaaaacgaacgccgcgtatatatacgcgcgaatataaccgacgcgcgcccgaatataaccgacgtacgcgactctacccgaaacgtacgaatataaacgtaaacgccgatataatccgaaaaactcttctcttaaaccccccgacaaccgactcctatatataacacgataatatcatcatcgccgaacaaccccaacgcctacatcttcacaaaactccatcgcgaactccgaaaacgaaactaaaaataaaaaaacgaaaaccctccctctaccccgacccctcccgcctcgccgaaaccgcccgcattatataactttaaaatacaaacgaaccgcgacccgaaaactaaaaccctaaaaaaaaaaaacgtaataatcgaacgaactaaccaccgaaaaaataaaaaactcaaccctattaactca

SEQ ID NO: 29233 - DNA, 536 bp, Artificial Sequence
  chemically treated genomic DNA (Homo sapiens) CpG-island No: 29233
ggatagcggtgacgtttttggtttagttttatcgtcgattcgttgtttaggttacgtttcgttattttattatttaaataattttttttttgattttatacgatcgttttagtttttaatttttcggttttcgtatattttcgttttcgttcgtacgttattttttcgatcgttatttgtttttatcggttttatgttttttggtattcgtcgagattttgttttttatttcgtatatcgtttattgtcgtttttattattcggttttcgtatgacggtatgtttagattcgtgttgagcgtttttatttttcgtttcgtcgtttagtagcgtatagcgttagtcgtttttagattaatttttaagatataggattttattattttttcgtagagcgttcgatgtagggataggtagtgacgttagggatgggagcgggggttttttggcggtgtatcggtttattaatttaatatttacgtcgttatgttttcgtttaatttttacggttttaggtattagtgggtggtgtcgtt

SEQ ID NO: 29234 - DNA, 536 bp, Artificial Sequence
  chemically treated genomic DNA (Homo sapiens) CpG-island No: 29234
aacgacaccacccactaatacctaaaaccgtaaaaattaaacgaaaacataacgacgtaaatattaaattaataaaccgatacaccgccaaaaaacccccgctcccatccctaacgtcactacctatccctacatcgaacgctctacgaaaaaataataaaatcctatatcttaaaaattaatctaaaaacgactaacgctatacgctactaaacgacgaaacgaaaaataaaaacgctcaacacgaatctaaacataccgtcatacgaaaaccgaataataaaaacgacaataaacgatatacgaaataaaaaacaaaatctcgacgaataccaaaaaacataaaaccgataaaaacaaataacgatcgaaaaaataacgtacgaacgaaaacgaaaatatacgaaaaccgaaaaattaaaaactaaaacgatcgtataaaatcaaaaaaaaaattatttaaataataaaataacgaaacgtaacctaaacaacgaatcgacgataaaactaaaccaaaaacgtcaccgctatcc

SEQ ID NO: 29235 - DNA, 536 bp, Artificial Sequence
  chemically treated genomic DNA (Homo sapiens) CpG-island No: 29235
agcggtattatttattgatgtttggggtcgtggggattgggcgaaggtataacgacgtggatattagattgataggtcggtgtatcgttagggggttttcgtttttatttttggcgttattgtttatttttatatcggacgttttgcgaaggggtgatggaattttgtattttaaaaattggtttgggggcggttgacgttatgcgttgttgggcggcggggcgggaaataggagcgtttaatacggatttaggtatgtcgttatgcggggatcggatggtagggacggtagtgggcgatatacgggatggggggtaaaatttcggcgggtattaaaaggtatgggatcggtggggataaataacggtcggggaagtgacgtgcgggcgggggcgagaatatgcgggggtcggggggttaggggttagagcgatcgtgtggaattaaggggggggttgtttgggtgataggatggcggggcgtggtttggatagcgaatcggcggtgagattgagttaggaacgttatcgttattt

SEQ ID NO: 29236 - DNA, 536 bp, Artificial Sequence
  chemically treated genomic DNA (Homo sapiens) CpG-island No: 29236
aaataacgataacgttcctaactcaatctcaccgccgattcgctatccaaaccacgccccgccatcctatcacccaaacaaccccccccttaattccacacgatcgctctaacccctaaccccccgacccccgcatattctcgcccccgcccgcacgtcacttccccgaccgttatttatccccaccgatcccataccttttaatacccgccgaaattttaccccccatcccgtatatcgcccactaccgtccctaccatccgatccccgcataacgacatacctaaatccgtattaaacgctcctatttcccgccccgccgcccaacaacgcataacgtcaaccgcccccaaaccaatttttaaaatacaaaattccatcaccccttcgcaaaacgtccgatataaaaataaacaataacgccaaaaataaaaacgaaaaccccctaacgatacaccgacctatcaatctaatatccacgtcgttataccttcgcccaatccccacgaccccaaacatcaataaataataccgct

SEQ ID NO: 29237 - DNA, 881 bp, Artificial Sequence
  chemically treated genomic DNA (Homo sapiens) CpG-island No: 29237
gggggcgcgcggggtttatttttttcgtttttttttttttcgaagttattttgagtttttgtgtttagcgaattagttcggtgttgcgttaggtcgttggttgcgcgttgggttcgggtgggggttcgtcggttcgtttttgttattggggtcgggttgtagtttttttttcgtcgtttcgagtttttttttcggttcggagttttttttcgcgcgtttttttttttttttttttttttttttttttttttgtttgttaggttttgttttcgttttttgcgtttatagttttcgttagcgtcgattttttcggagttcgagtcggagagcggcgaaggggagtcgtcggtttttttttaggacgttgatagtaggtttcggggttttcgtttcgttttttcgtcgacgggatatattttcgttttttttttgtttcgttagttttcgtcggatttatcgggcggcggagagagcgagcgggcgagcgtagcgcggcggtcgcgcgggagtgaaggggcgcgcggtaggtcggcggggagtttttcggggcgtacggagttcgcgcgtttttcgggattttttttcgtttttgggtcggatttgtgggcgtcgggagttcgggtagcgttcggcgcgtcgggtcggggtggcgggcggtttcgggatttcggtagttggagaaggagtcggagttcggtcgggatgagaaggtgacgtcgtcgggggcgttattcgttttgtgggggaagatgttcgtttattgcgtgtaggatgttatcgtggtggacgtggagaagcggaggaatttttttaagtattacgtgagtatagttttcgtcgattttgttgggggtggttcgaggtttcgggagggtttcgga

SEQ ID NO: 29238 - DNA, 881 bp, Artificial Sequence
  chemically treated genomic DNA (Homo sapiens) CpG-island No: 29238
tccgaaaccctcccgaaacctcgaaccacccccaacaaaatcgacgaaaactatactcacgtaatacttaaaaaaattcctccgcttctccacgtccaccacgataacatcctacacgcaataaacgaacatcttcccccacaaaacgaataacgcccccgacgacgtcaccttctcatcccgaccgaactccgactccttctccaactaccgaaatcccgaaaccgcccgccaccccgacccgacgcgccgaacgctacccgaactcccgacgcccacaaatccgacccaaaaacgaaaaaaaatcccgaaaaacgcgcgaactccgtacgccccgaaaaactccccgccgacctaccgcgcgccccttcactcccgcgcgaccgccgcgctacgctcgcccgctcgctctctccgccgcccgataaatccgacgaaaactaacgaaacaaaaaaaaaacgaaaatatatcccgtcgacgaaaaaacgaaacgaaaaccccgaaacctactatcaacgtcctaaaaaaaaaccgacgactccccttcgccgctctccgactcgaactccgaaaaaatcgacgctaacgaaaactataaacgcaaaaaacgaaaacaaaacctaacaaacaaaaaaaaaaaaaaaaaaaaaaaaaaaaaaaaaaacgcgcgaaaaaaaactccgaaccgaaaaaaaaactcgaaacgacgaaaaaaaaactacaacccgaccccaataacaaaaacgaaccgacgaacccccacccgaacccaacgcgcaaccaacgacctaacgcaacaccgaactaattcgctaaacacaaaaactcaaaataacttcgaaaaaaaaaaaaacgaaaaaaataaaccccgcgcgccccc

SEQ ID NO: 29239 - DNA, 881 bp, Artificial Sequence
  chemically treated genomic DNA (Homo sapiens) CpG-island No: 29239
ttcggggttttttcgggatttcgggttatttttagtagggtcggcgggggttgtatttacgtagtgtttggaggggttttttcgtttttttacgtttattacggtggtattttgtacgtagtaggcgagtatttttttttataaagcgagtggcgttttcggcggcgttatttttttatttcggtcgggtttcggttttttttttagttgtcggggtttcggggtcgttcgttatttcggttcggcgcgtcgaacgttgttcggattttcggcgtttataggttcggtttagggacgggggagggtttcggagggcgcgcgggtttcgtgcgtttcgggggatttttcgtcggtttgtcgcgcgtttttttattttcgcgcggtcgtcgcgttgcgttcgttcgttcgtttttttcgtcgttcggtgggttcggcgggaattggcggagtagaggaggggcgggggtgtgtttcgtcggcgaggggacggggcgggggtttcggagtttgttgttagcgttttggggaggggtcggcggttttttttcgtcgtttttcggttcgggtttcggggggatcggcgttggcggaggttgtgggcgtaggaggcggaggtagggtttggtaggtagggaagggaagggagggaggggagagaggggaagcgcgcggggaggggtttcgggtcgggggaggggttcggggcgacggggagggggttgtagttcggttttagtggtaggggcgggtcgacgagtttttattcgagtttagcgcgtagttagcggtttggcgtagtatcgggttagttcgttaggtataaaaatttagggtggtttcggggggagagggagcggggaaagtgagtttcgcgcgttttt

SEQ ID NO: 29240 - DNA, 881 bp, Artificial Sequence
  chemically treated genomic DNA (Homo sapiens) CpG-island No: 29240
aaaaacgcgcgaaactcactttccccgctccctctccccccgaaaccaccctaaatttttatacctaacgaactaacccgatactacgccaaaccgctaactacgcgctaaactcgaataaaaactcgtcgacccgcccctaccactaaaaccgaactacaaccccctccccgtcgccccgaacccctcccccgacccgaaacccctccccgcgcgcttcccctctctcccctccctcccttcccttccctacctaccaaaccctacctccgcctcctacgcccacaacctccgccaacgccgatccccccgaaacccgaaccgaaaaacgacgaaaaaaaaccgccgacccctccccaaaacgctaacaacaaactccgaaacccccgccccgtcccctcgccgacgaaacacacccccgcccctcctctactccgccaattcccgccgaacccaccgaacgacgaaaaaaacgaacgaacgaacgcaacgcgacgaccgcgcgaaaataaaaaaacgcgcgacaaaccgacgaaaaatcccccgaaacgcacgaaacccgcgcgccctccgaaaccctcccccgtccctaaaccgaacctataaacgccgaaaatccgaacaacgttcgacgcgccgaaccgaaataacgaacgaccccgaaaccccgacaactaaaaaaaaaaccgaaacccgaccgaaataaaaaaataacgccgccgaaaacgccactcgctttataaaaaaaaatactcgcctactacgtacaaaataccaccgtaataaacgtaaaaaaacgaaaaaacccctccaaacactacgtaaatacaacccccgccgaccctactaaaaataacccgaaatcccgaaaaaaccccgaa

SEQ ID NO: 29241 - DNA, 1366 bp, Artificial Sequence
  chemically treated genomic DNA (Homo sapiens) CpG-island No: 29241
ttggcgagggcggggcgggatggtgtagttggtggggaagggtggggcgaatttaggaaggcggttttatagggcgggcgtagattgggcgttcgggacgggttaaggagggcggaatgaatttggagagggcggggcggttgggggaggggcgggaaggttttggggattggtttaggggcgggttcggtggggtgggggggcggtgtcgaatgaatttgaaggggcggggtcggtttggcgcggttagggtggggtggggcgttttaggttttggttaaggagcgcgcggcgggcgggtcggtcgtagggtttgggtacgattatggtgggacgtcgttcgcggtttcggggatcgttgcggtagtagaggcggttggttaggaacgcgggtcgaggttggattttttgggtagttagttcgtgatttttgtcgttatcgatcgcgatttttattttttcgttttttttcggcgtcgacggttatatcgtcggacgatgcgcgttcgcggtcgttcgggaggttgagtttagtttttcgtttcgtttttttcgcgtagttgtttttatggttttgcggggcgtcgcgggagcgatcgatatttcggtgttttcggtcgggggagttttcggcggtttagcgttttcgtcgtttattttttcgggcggttcggtttcggcgggcgcggggttgtgggtcgcgttttatgattacgaggttcgcggcgaggacgagttgagtttgcggcgcggttagttggtggaggtgttgtcgtaggacgtcgtcgtgtcgggcgacgagggttggtgggtaggttaggtgtagcggcgtttcggtatttttttcgttaattacgtggttttttgtcgttcggtcgttagtttcgcgtcgtcgttttcgcggtttagtttttcggtatacgtcgttttcgagcggttggagttgaaggagtttatcggcgttgggggtttcgggtaggtgtatcgcgttatttggtagggttaggaggtggtcgtgaaggcggcgcgttaggattcggagtaggacgcggcggcggttgtcgagagcgtgcggcgcgaggttcggtttttcgttatgttgcggtattttaatattatcgagttgcgcggcgtgtgtttgtagtagtcgtatttttgtttggtgttggagttcgttcgcggcggagcgtttaatcgagcgttggtcgttgttaacgtcgtttcggattcgcgcgcgttcggttttcgtcgcgcgcgtcgtattttttcgtacgtgttggttaattgggtcgtgtagatagcgcggggtatgttttatttgtatgaggaggttttcgtgtttattttgtatcgggattttaagttt

SEQ ID NO: 29242 - DNA, 1366 bp, Artificial Sequence
  chemically treated genomic DNA (Homo sapiens) CpG-island No: 29242
aaacttaaaatcccgatacaaaataaacacgaaaacctcctcatacaaataaaacataccccgcgctatctacacgacccaattaaccaacacgtacgaaaaaatacgacgcgcgcgacgaaaaccgaacgcgcgcgaatccgaaacgacgttaacaacgaccaacgctcgattaaacgctccgccgcgaacgaactccaacaccaaacaaaaatacgactactacaaacacacgccgcgcaactcgataatattaaaataccgcaacataacgaaaaaccgaacctcgcgccgcacgctctcgacaaccgccgccgcgtcctactccgaatcctaacgcgccgccttcacgaccacctcctaaccctaccaaataacgcgatacacctacccgaaacccccaacgccgataaactccttcaactccaaccgctcgaaaacgacgtataccgaaaaactaaaccgcgaaaacgacgacgcgaaactaacgaccgaacgacaaaaaaccacgtaattaacgaaaaaaataccgaaacgccgctacacctaacctacccaccaaccctcgtcgcccgacacgacgacgtcctacgacaacacctccaccaactaaccgcgccgcaaactcaactcgtcctcgccgcgaacctcgtaatcataaaacgcgacccacaaccccgcgcccgccgaaaccgaaccgcccgaaaaaataaacgacgaaaacgctaaaccgccgaaaactcccccgaccgaaaacaccgaaatatcgatcgctcccgcgacgccccgcaaaaccataaaaacaactacgcgaaaaaaacgaaacgaaaaactaaactcaacctcccgaacgaccgcgaacgcgcatcgtccgacgatataaccgtcgacgccgaaaaaaaacgaaaaaataaaaatcgcgatcgataacgacaaaaatcacgaactaactacccaaaaaatccaacctcgacccgcgttcctaaccaaccgcctctactaccgcaacgatccccgaaaccgcgaacgacgtcccaccataatcgtacccaaaccctacgaccgacccgcccgccgcgcgctccttaaccaaaacctaaaacgccccaccccaccctaaccgcgccaaaccgaccccgccccttcaaattcattcgacaccgcccccccaccccaccgaacccgcccctaaaccaatccccaaaaccttcccgcccctcccccaaccgccccgccctctccaaattcattccgccctccttaacccgtcccgaacgcccaatctacgcccgccctataaaaccgccttcctaaattcgccccacccttccccaccaactacaccatcccgccccgccctcgccaa

SEQ ID NO: 29243 - DNA, 1366 bp, Artificial Sequence
  chemically treated genomic DNA (Homo sapiens) CpG-island No: 29243
ggatttgaggtttcggtgtaggatgggtacgaaggtttttttatgtaggtagagtatgtttcgcgttatttgtacggtttagttgattagtacgtgcggagggatgcggcgcgcgcggcgggggtcgggcgcgcgcgggttcggggcggcgttggtagcggttagcgttcggttgagcgtttcgtcgcgggcgaattttagtattaggtagaggtgcggttgttgtaggtatacgtcgcgtagttcgatgatgttggggtgtcgtagtatggcgaagagtcgagtttcgcgtcgtacgttttcggtagtcgtcgtcgcgttttgtttcgggttttggcgcgtcgtttttacggttattttttggttttgttaggtggcgcggtatatttgttcgaagtttttagcgtcgatgagtttttttagttttagtcgttcgaaggcgacgtgtatcggggagttgggtcgcgagggcggcggcgcggggttggcggtcgggcggtagggagttacgtagttggcggggaagatgtcgaggcgtcgttgtatttggtttgtttattagttttcgtcgttcgatacggcggcgttttgcgatagtatttttattagttggtcgcgtcgtaggtttagttcgttttcgtcgcgagtttcgtagttatagagcgcggtttatagtttcgcgttcgtcgaggtcgagtcgttcgaggaggtggacgacgaggacgttgagtcgtcgggggttttttcggtcgaggatatcggggtgtcggtcgttttcgcggcgtttcgtaaagttatgggggtagttgcgcggggaaggcggagcgggaagttgggtttagtttttcgggcggtcgcgggcgcgtatcgttcggcggtgtggtcgtcggcgtcgggggaaggcgagggggtaggaatcgcgatcggtgacggtagagattacgggttagttgtttaaagggtttagtttcggttcgcgtttttggttagtcgtttttgttgtcgtagcggttttcgaagtcgcgggcgacgttttattatggtcgtgtttaggttttgcggtcggttcgttcgtcgcgcgttttttagttagagtttgggacgttttattttattttagtcgcgttaggtcggtttcgtttttttaggtttattcggtatcgtttttttattttatcgggttcgtttttaggttagtttttagggttttttcgttttttttttagtcgtttcgttttttttaggtttatttcgttttttttgattcgtttcgggcgtttagtttgcgttcgttttatgggatcgtttttttaggttcgttttatttttttttattaattgtattatttcgtttcgttttcgttag

SEQ ID NO: 29244 - DNA, 1366 bp, Artificial Sequence
  chemically treated genomic DNA (Homo sapiens) CpG-island No: 29244
ctaacgaaaacgaaacgaaataatacaattaataaaaaaaaataaaacgaacctaaaaaaacgatcccataaaacgaacgcaaactaaacgcccgaaacgaatcaaaaaaaacgaaataaacctaaaaaaaacgaaacgactaaaaaaaaaacgaaaaaaccctaaaaactaacctaaaaacgaacccgataaaataaaaaaacgataccgaataaacctaaaaaaacgaaaccgacctaacgcgactaaaataaaataaaacgtcccaaactctaactaaaaaacgcgcgacgaacgaaccgaccgcaaaacctaaacacgaccataataaaacgtcgcccgcgacttcgaaaaccgctacgacaacaaaaacgactaaccaaaaacgcgaaccgaaactaaaccctttaaacaactaacccgtaatctctaccgtcaccgatcgcgattcctaccccctcgccttcccccgacgccgacgaccacaccgccgaacgatacgcgcccgcgaccgcccgaaaaactaaacccaacttcccgctccgccttccccgcgcaactacccccataactttacgaaacgccgcgaaaacgaccgacaccccgatatcctcgaccgaaaaaacccccgacgactcaacgtcctcgtcgtccacctcctcgaacgactcgacctcgacgaacgcgaaactataaaccgcgctctataactacgaaactcgcgacgaaaacgaactaaacctacgacgcgaccaactaataaaaatactatcgcaaaacgccgccgtatcgaacgacgaaaactaataaacaaaccaaatacaacgacgcctcgacatcttccccgccaactacgtaactccctaccgcccgaccgccaaccccgcgccgccgccctcgcgacccaactccccgatacacgtcgccttcgaacgactaaaactaaaaaaactcatcgacgctaaaaacttcgaacaaatataccgcgccacctaacaaaaccaaaaaataaccgtaaaaacgacgcgccaaaacccgaaacaaaacgcgacgacgactaccgaaaacgtacgacgcgaaactcgactcttcgccatactacgacaccccaacatcatcgaactacgcgacgtatacctacaacaaccgcacctctacctaatactaaaattcgcccgcgacgaaacgctcaaccgaacgctaaccgctaccaacgccgccccgaacccgcgcgcgcccgacccccgccgcgcgcgccgcatccctccgcacgtactaatcaactaaaccgtacaaataacgcgaaacatactctacctacataaaaaaaccttcgtacccatcctacaccgaaacctcaaatcc

SEQ ID NO: 29245 - DNA, 1080 bp, Artificial Sequence
  chemically treated genomic DNA (Homo sapiens) CpG-island No: 29245
gttttcgggcgttcggttatcgtcgtaggtgcgggtcgtatgaatggagcgtcgggcgtaaggtaaagtttggtatcgtttgcgcggtcgttatttgttttcggagcgtgagtgcggggtgtggggcgtgcgcgtgcgcgtttagagggggtttaaggcgagcgcgtcgggtagttgcgggcgcgtggttgttgaggttggcggcggtgtcgcgcgttcgacgggtcggtggttgcggggtttttcgtttcgattcgggttgggggtagtcgtggcggtcgtcggggatcgtaaggggcggaggaaaggagggggtcggtttcggtacgtagaggagtagtcgattatgtttcgagataatatggtttttttgatttaacggatcgttcgttaggtttgttttatttttcggggtagcgggggcggtcgcggcgttttcgatcgcgacgcggtttttggttcggaggcgtcgatgtagtcgggttttttcgagaatttgagtaagttgaagagttttttgatttagtttcgcgtcgaggatttgaatatcgtttcgcgtaaggttatattgtagtcgttgtcgtttaatttgtcgttagttatttatatgtatatttacgagacggacggttttagtttgggcgtgtttttgtttaagagcggtacgtttatttcgttgtacgattattcgggtatgtacggtatgtttaaggtgttgtacggtatcgtgcgtattagttgtatggataagttagacgcgggcggcgggtaacggtcgcgggttttgtcgttcgagtagtagttcgagtcgtcgttgtagtttcgggagcgagaagtcgtgcggtcgggcgtgttgcgttcgcgggtcgagtatatcgaggttagcggtttttgtatttttatatcgtatcgggataatttgtattagatcgacgtcgtggaagggtttgtcgtttttttggatattttggtttcgttttacgattcggacgatggtcgggattgttattattatcgggtgttggagtcggttaggtttaaggaggtttttagttcggtttgtgatttgtttcgagaggt

SEQ ID NO: 29246 - DNA, 1080 bp, Artificial Sequence
  chemically treated genomic DNA (Homo sapiens) CpG-island No: 29246
acctctcgaaacaaatcacaaaccgaactaaaaacctccttaaacctaaccgactccaacacccgataataataacaatcccgaccatcgtccgaatcgtaaaacgaaaccaaaatatccaaaaaaacgacaaacccttccacgacgtcgatctaatacaaattatcccgatacgatataaaaatacaaaaaccgctaacctcgatatactcgacccgcgaacgcaacacgcccgaccgcacgacttctcgctcccgaaactacaacgacgactcgaactactactcgaacgacaaaacccgcgaccgttacccgccgcccgcgtctaacttatccatacaactaatacgcacgataccgtacaacaccttaaacataccgtacatacccgaataatcgtacaacgaaataaacgtaccgctcttaaacaaaaacacgcccaaactaaaaccgtccgtctcgtaaatatacatataaataactaacgacaaattaaacgacaacgactacaatataaccttacgcgaaacgatattcaaatcctcgacgcgaaactaaatcaaaaaactcttcaacttactcaaattctcgaaaaaacccgactacatcgacgcctccgaaccaaaaaccgcgtcgcgatcgaaaacgccgcgaccgcccccgctaccccgaaaaataaaacaaacctaacgaacgatccgttaaatcaaaaaaaccatattatctcgaaacataatcgactactcctctacgtaccgaaaccgaccccctcctttcctccgccccttacgatccccgacgaccgccacgactacccccaacccgaatcgaaacgaaaaaccccgcaaccaccgacccgtcgaacgcgcgacaccgccgccaacctcaacaaccacgcgcccgcaactacccgacgcgctcgccttaaaccccctctaaacgcgcacgcgcacgccccacaccccgcactcacgctccgaaaacaaataacgaccgcgcaaacgataccaaactttaccttacgcccgacgctccattcatacgacccgcacctacgacgataaccgaacgcccgaaaac

SEQ ID NO: 29247 - DNA, 1080 bp, Artificial Sequence
  chemically treated genomic DNA (Homo sapiens) CpG-island No: 29247
atttttcgaggtaggttataggtcgagttggaggtttttttgggtttgatcggttttagtattcggtaatagtggtagtttcggttatcgttcgggtcgtagggcggggttaggatgtttaggaaggcggtaggtttttttacggcgtcgatttggtgtaggttgtttcggtgcggtgtgaggatgtaggggtcgttggtttcggtgtattcggttcgcgaacgtagtacgttcggtcgtacggtttttcgttttcggggttgtagcggcggttcgaattgttgttcgggcggtaaggttcgcggtcgttgttcgtcgttcgcgtttagtttgtttatgtagttgatgcgtacggtgtcgtatagtattttgagtatgtcgtgtatgttcgggtggtcgtgtagcgggatggacgtgtcgtttttgagtaggaatacgtttaggttgaagtcgttcgtttcgtagatgtgtatgtaggtgattggcggtaggttgggcggtagcggttgtagtgtggttttgcgcggggcgatgtttaagttttcggcgcggagttgggttaggaggttttttagtttgtttaggttttcggggaagttcggttgtatcggcgttttcgggttagaagtcgcgtcgcgatcggaagcgtcgcggtcgttttcgttgtttcggaaggtgaggtaagtttggcgggcgattcgttggattaaggaggttatgttgtttcggggtatggtcggttgtttttttgcgtgtcgggatcggtttttttttttttttcgttttttgcggttttcggcggtcgttacggttgtttttagttcgggtcgaggcgggaggtttcgtaattatcggttcgtcgggcgcgcggtatcgtcgttaattttagtagttacgcgttcgtaattgttcggcgcgttcgttttgagttttttttgagcgcgtacgcgtacgttttatatttcgtatttacgtttcgggagtagatagcggtcgcgtagacggtgttaggttttgttttacgttcggcgttttatttatgcggttcgtatttacgacggtggtcgggcgttcggggat

SEQ ID NO: 29248 - DNA, 1080 bp, Artificial Sequence
  chemically treated genomic DNA (Homo sapiens) CpG-island No: 29248
atccccgaacgcccgaccaccgtcgtaaatacgaaccgcataaataaaacgccgaacgtaaaacaaaacctaacaccgtctacgcgaccgctatctactcccgaaacgtaaatacgaaatataaaacgtacgcgtacgcgctcaaaaaaaactcaaaacgaacgcgccgaacaattacgaacgcgtaactactaaaattaacgacgataccgcgcgcccgacgaaccgataattacgaaacctcccgcctcgacccgaactaaaaacaaccgtaacgaccgccgaaaaccgcaaaaaacgaaaaaaaaaaaaaaaccgatcccgacacgcaaaaaaacaaccgaccataccccgaaacaacataacctccttaatccaacgaatcgcccgccaaacttacctcaccttccgaaacaacgaaaacgaccgcgacgcttccgatcgcgacgcgacttctaacccgaaaacgccgatacaaccgaacttccccgaaaacctaaacaaactaaaaaacctcctaacccaactccgcgccgaaaacttaaacatcgccccgcgcaaaaccacactacaaccgctaccgcccaacctaccgccaatcacctacatacacatctacgaaacgaacgacttcaacctaaacgtattcctactcaaaaacgacacgtccatcccgctacacgaccacccgaacatacacgacatactcaaaatactatacgacaccgtacgcatcaactacataaacaaactaaacgcgaacgacgaacaacgaccgcgaaccttaccgcccgaacaacaattcgaaccgccgctacaaccccgaaaacgaaaaaccgtacgaccgaacgtactacgttcgcgaaccgaatacaccgaaaccaacgacccctacatcctcacaccgcaccgaaacaacctacaccaaatcgacgccgtaaaaaaacctaccgccttcctaaacatcctaaccccgccctacgacccgaacgataaccgaaactaccactattaccgaatactaaaaccgatcaaacccaaaaaaacctccaactcgacctataacctacctcgaaaaat

SEQ ID NO: 29249 - DNA, 548 bp, Artificial Sequence
  chemically treated genomic DNA (Homo sapiens) CpG-island No: 29249
ggagttcgtaggttttcgtgtttttttaatttttttcgtttttttcgatagtcgcgcgttttcgttttagtttaaggttagtggttcggtttcgaggaaggcgcgggggtcgcgagagacgattttttatagtatcgttaaggaaatcggcgtcgtcggtgttttcgcgggtttttttcggtagttcgggggttgtttttcgtcgttgcgcgtttttttttattatttattcgttgttttcgtcggtcggagttttcgttttattaatttttttaatttcgcgggcggcgggtaggtgggggcgcgtttttaggtcgtaagaagggagcgtttcgagattttttcggggtcggttttgtttaggagggagttatcgacgtttttttttggcgttttttcgtcgttcggttttttaggcgcgtagtttttttcgagagtttcgaattttatcgttattttgtttttgtttcgggagaggggaggtcgaagtgttgtcggttagagggtttacgtaagtttcgaaattcggggggacgttttttttattt

SEQ ID NO: 29250 - DNA, 548 bp, Artificial Sequence
  chemically treated genomic DNA (Homo sapiens) CpG-island No: 29250
aaataaaaaaaacgtccccccgaatttcgaaacttacgtaaaccctctaaccgacaacacttcgacctcccctctcccgaaacaaaaacaaaataacgataaaattcgaaactctcgaaaaaaactacgcgcctaaaaaaccgaacgacgaaaaaacgccaaaaaaaaacgtcgataactccctcctaaacaaaaccgaccccgaaaaaatctcgaaacgctcccttcttacgacctaaaaacgcgcccccacctacccgccgcccgcgaaattaaaaaaattaataaaacgaaaactccgaccgacgaaaacaacgaataaataataaaaaaaaacgcgcaacgacgaaaaacaacccccgaactaccgaaaaaaacccgcgaaaacaccgacgacgccgatttccttaacgatactataaaaaatcgtctctcgcgacccccgcgccttcctcgaaaccgaaccactaaccttaaactaaaacgaaaacgcgcgactatcgaaaaaaacgaaaaaaattaaaaaaacacgaaaacctacgaactcc

SEQ ID NO: 29251 - DNA, 548 bp, Artificial Sequence
  chemically treated genomic DNA (Homo sapiens) CpG-island No: 29251
gggtggaagaggcgttttttcgggtttcgaggtttgcgtaggttttttggtcggtagtatttcgattttttttttttcggggtaggggtaaagtgacggtaaagttcggggttttcggggagagttgcgcgtttggagagtcgagcggcggagaagcgttaggggaaagcgtcggtagtttttttttgggtagagtcgatttcgggaaaatttcggagcgttttttttttgcggtttggaggcgcgtttttatttgttcgtcgttcgcgaagttgagggggttagtaaggcgggggtttcggtcggcggaggtagcgagtgggtggtggaggagggcgcgtaacggcgggaagtagttttcggattgtcgagggaggttcgcgggggtatcggcgacgtcggtttttttggcgatgttgtggaaagtcgtttttcgcggttttcgcgtttttttcgaggtcgggttattggttttgggttgaggcggggacgcgcggttgtcgggaaaggcggagaagattgggagggtacggaaatttacggatttt

SEQ ID NO: 29252 - DNA, 548 bp, Artificial Sequence
  chemically treated genomic DNA (Homo sapiens) CpG-island No: 29252
aaaatccgtaaatttccgtaccctcccaatcttctccgcctttcccgacaaccgcgcgtccccgcctcaacccaaaaccaataacccgacctcgaaaaaaacgcgaaaaccgcgaaaaacgactttccacaacatcgccaaaaaaaccgacgtcgccgatacccccgcgaacctccctcgacaatccgaaaactacttcccgccgttacgcgccctcctccaccacccactcgctacctccgccgaccgaaacccccgccttactaaccccctcaacttcgcgaacgacgaacaaataaaaacgcgcctccaaaccgcaaaaaaaaaacgctccgaaattttcccgaaatcgactctacccaaaaaaaaactaccgacgctttcccctaacgcttctccgccgctcgactctccaaacgcgcaactctccccgaaaaccccgaactttaccgtcactttacccctaccccgaaaaaaaaaaaatcgaaatactaccgaccaaaaaacctacgcaaacctcgaaacccgaaaaaacgcctcttccaccc

SEQ ID NO: 29253 - DNA, 501 bp, Artificial Sequence
  chemically treated genomic DNA (Homo sapiens) CpG-island No: 29253
ggtttcgcggttttcgcgttgattatgggtaagacgacgtttcggaagggagttcgattcgtatttcgggttttgagttcgaaagaacgggggaaagtcgaattatgtaaatgcggatttttgcgatggggttcgggttacggttttcgtcggttttttaggtgaggtatttatcggtagtaagcgcgggcgaggcgattgttcgcgtttcgtttttttttgcgtacgtgggcggatcggtaggcgggcgagttgttcgggtcgtttcgcgattggcgttgttgttaaattcgtcggcggtcgtcgcgcgttatttcgagggggagtttttggacgttcgagtgttcggttagtagggcgcggagggtaggatcggggttgggggcggggcggggtgtttgagcgagggaaaatcgcgaggttttcggttgttatttttttcggaggaggatgttagtagaaggcgggtggaggagggggttttattaaggagttttgaaa

SEQ ID NO: 29254 - DNA, 501 bp, Artificial Sequence
  chemically treated genomic DNA (Homo sapiens) CpG-island No: 29254
tttcaaaactccttaataaaaccccctcctccacccgccttctactaacatcctcctccgaaaaaaataacaaccgaaaacctcgcgattttccctcgctcaaacaccccgccccgcccccaaccccgatcctaccctccgcgccctactaaccgaacactcgaacgtccaaaaactccccctcgaaataacgcgcgacgaccgccgacgaatttaacaacaacgccaatcgcgaaacgacccgaacaactcgcccgcctaccgatccgcccacgtacgcaaaaaaaaacgaaacgcgaacaatcgcctcgcccgcgcttactaccgataaatacctcacctaaaaaaccgacgaaaaccgtaacccgaaccccatcgcaaaaatccgcatttacataattcgactttcccccgttctttcgaactcaaaacccgaaatacgaatcgaactcccttccgaaacgtcgtcttacccataatcaacgcgaaaaccgcgaaacc

SEQ ID NO: 29255 - DNA, 501 bp, Artificial Sequence
  chemically treated genomic DNA (Homo sapiens) CpG-island No: 29255
ttttaagattttttgatggggtttttttttttattcgttttttattggtattttttttcgggaaaggtggtagtcgaagatttcgcggttttttttcgtttaggtatttcgtttcgtttttagtttcggttttgtttttcgcgttttgttggtcgggtattcgggcgtttaggagttttttttcggggtggcgcgcggcgatcgtcggcgggtttggtagtagcgttagtcgcggggcggttcgggtaattcgttcgtttgtcggttcgtttacgtgcgtagagaggagcgaagcgcgagtagtcgtttcgttcgcgtttgttgtcggtgggtgttttatttaaggggtcggcgggggtcgtaattcgagttttatcgtagggattcgtatttgtataattcggttttttttcgttttttcggatttagggttcgagatgcgagtcggattttttttcgaggcgtcgttttgtttatggttagcgcgggggtcgcgggatt

SEQ ID NO: 29256 - DNA, 501 bp, Artificial Sequence
  chemically treated genomic DNA (Homo sapiens) CpG-island No: 29256
aatcccgcgacccccgcgctaaccataaacaaaacgacgcctcgaaaaaaaatccgactcgcatctcgaaccctaaatccgaaaaaacgaaaaaaaaccgaattatacaaatacgaatccctacgataaaactcgaattacgacccccgccgaccccttaaataaaacacccaccgacaacaaacgcgaacgaaacgactactcgcgcttcgctcctctctacgcacgtaaacgaaccgacaaacgaacgaattacccgaaccgccccgcgactaacgctactaccaaacccgccgacgatcgccgcgcgccaccccgaaaaaaaactcctaaacgcccgaatacccgaccaacaaaacgcgaaaaacaaaaccgaaactaaaaacgaaacgaaatacctaaacgaaaaaaaaccgcgaaatcttcgactaccacctttcccgaaaaaaaataccaataaaaaacgaataaaaaaaaaaaccccatcaaaaaatcttaaaa

SEQ ID NO: 29257 - DNA, 1025 bp, Artificial Sequence
  chemically treated genomic DNA (Homo sapiens) CpG-island No: 29257
ttttagaacgttattttcgggtgataatttgtagggtttttcgtttttcgcgatttttcgggagtttttttttcggcgttttttcggggttgtaggggttgtaggttcggtttcggggtttttttatcgtagttcgttcggttttaggttagtgggttttaattacgtcgataatatgatttcggcgattttgtgcggcgatgggatgcggtcgtgggcggtggagtttaggcggagttcgttttttatacgcgagggcgttttttttttatcgttcgtcggttttaaagttcgcgttttaggcgacggtagttaacgggttgtcggttggaggtttcgtcgacgtttcgttttttgcgtgtttattcgcgtttcgtagtttcgtttttagcgtcgattttaagtttcggcgtttagtggttcggcgttttttaaggttcggtgtttagcgttaatttcgaggtttttatgtttcgtttttcgacgttagggggtagggttagcgcgttgcgcgtcggggcggggttttggttgcgtcggtcgcgtagttcgcgcgcggagcgtattttgttgcggtcgttggtcgttagcgcggtttcggcggttgttttggagaagtaagatggcggcgacggcggtcgtagtggtggtcgaggaggatacggagttgcgggatttgttggtgtagacgttggagaatagcggggttttgaatcgtattaaggtgaggtcggaggttggggtcgggtttggcggattcgtagggtttgcgtggatagcgggcgttataacggtcgcggcgaggaggtcgtttttttggcgagggatcggggtcggcgggtattgggggcgcgttcggtatggttttcgttttgttcgttttatagagggggtcggttcgttcgttcgtgtggtttcggagggtatcgcggattgggggtgtttggttcgttttttgttttatttcgtgggggcgggatcgcggggtttgggggttatacgggcggttcgtagttgggttttgg

SEQ ID NO: 29258 - DNA, 1025 bp, Artificial Sequence
  chemically treated genomic DNA (Homo sapiens) CpG-island No: 29258
ccaaaacccaactacgaaccgcccgtataacccccaaaccccgcgatcccgcccccacgaaataaaacaaaaaacgaaccaaacacccccaatccgcgataccctccgaaaccacacgaacgaacgaaccgaccccctctataaaacgaacaaaacgaaaaccataccgaacgcgcccccaatacccgccgaccccgatccctcgccaaaaaaacgacctcctcgccgcgaccgttataacgcccgctatccacgcaaaccctacgaatccgccaaacccgaccccaacctccgacctcaccttaatacgattcaaaaccccgctattctccaacgtctacaccaacaaatcccgcaactccgtatcctcctcgaccaccactacgaccgccgtcgccgccatcttacttctccaaaacaaccgccgaaaccgcgctaacgaccaacgaccgcaacaaaatacgctccgcgcgcgaactacgcgaccgacgcaaccaaaaccccgccccgacgcgcaacgcgctaaccctaccccctaacgtcgaaaaacgaaacataaaaacctcgaaattaacgctaaacaccgaaccttaaaaaacgccgaaccactaaacgccgaaacttaaaatcgacgctaaaaacgaaactacgaaacgcgaataaacacgcaaaaaacgaaacgtcgacgaaacctccaaccgacaacccgttaactaccgtcgcctaaaacgcgaactttaaaaccgacgaacgataaaaaaaaaacgccctcgcgtataaaaaacgaactccgcctaaactccaccgcccacgaccgcatcccatcgccgcacaaaatcgccgaaatcatattatcgacgtaattaaaacccactaacctaaaaccgaacgaactacgataaaaaaaccccgaaaccgaacctacaacccctacaaccccgaaaaaacgccgaaaaaaaaactcccgaaaaatcgcgaaaaacgaaaaaccctacaaattatcacccgaaaataacgttctaaaa

SEQ ID NO: 29259 - DNA, 1025 bp, Artificial Sequence
  chemically treated genomic DNA (Homo sapiens) CpG-island No: 29259
ttagggtttagttgcgggtcgttcgtgtggtttttaagtttcgcggtttcgtttttacggaatgaggtaggggacgggttaggtatttttagttcgcggtgtttttcgggattatacgaacgaacgagtcgattttttttgtggggcgggtaggacggaggttatgtcgggcgcgtttttagtgttcgtcggtttcggtttttcgttagggaggcggttttttcgtcgcgatcgttgtgacgttcgttgtttacgtaagttttgcggattcgttaggttcggttttagttttcggttttattttgatgcggtttaggatttcgttgttttttagcgtttgtattagtaggtttcgtagtttcgtgtttttttcggttattattgcggtcgtcgtcgtcgttattttgtttttttaagataatcgtcgaagtcgcgttaacggttaacggtcgtagtagggtacgtttcgcgcgcgggttacgcggtcgacgtagttaaagtttcgtttcgacgcgtagcgcgttggttttgttttttggcgtcgggaggcggggtatagagatttcggggttgacgttggatatcgagttttggggagcgtcggattattgagcgtcgaaatttagggtcggcgttgggggcggggttgcggggcgcgggtgggtacgtaaggggcggggcgtcggcggggtttttagtcggtaattcgttggttgtcgtcgtttgaggcgcgagttttgaagtcggcgagcggtgaggaggaggcgttttcgcgtgtggagagcggatttcgtttggattttatcgtttacggtcgtattttatcgtcgtataagatcgtcggagttatattatcgacgtagttaaagtttattagtttaaagtcgggcggattgcggtaaggaggtttcgagatcgaatttgtagtttttgtagtttcgggggggcgtcggggaagggattttcgagaggtcgcgaggggcggaaggttttgtaggttgttattcggaaataacgttttgagg

SEQ ID NO: 29260 - DNA, 1025 bp, Artificial Sequence
  chemically treated genomic DNA (Homo sapiens) CpG-island No: 29260
cctcaaaacgttatttccgaataacaacctacaaaaccttccgcccctcgcgacctctcgaaaatcccttccccgacgcccccccgaaactacaaaaactacaaattcgatctcgaaacctccttaccgcaatccgcccgactttaaactaataaactttaactacgtcgataatataactccgacgatcttatacgacgataaaatacgaccgtaaacgataaaatccaaacgaaatccgctctccacacgcgaaaacgcctcctcctcaccgctcgccgacttcaaaactcgcgcctcaaacgacgacaaccaacgaattaccgactaaaaaccccgccgacgccccgccccttacgtacccacccgcgccccgcaaccccgcccccaacgccgaccctaaatttcgacgctcaataatccgacgctccccaaaactcgatatccaacgtcaaccccgaaatctctataccccgcctcccgacgccaaaaaacaaaaccaacgcgctacgcgtcgaaacgaaactttaactacgtcgaccgcgtaacccgcgcgcgaaacgtaccctactacgaccgttaaccgttaacgcgacttcgacgattatcttaaaaaaacaaaataacgacgacgacgaccgcaataataaccgaaaaaaacacgaaactacgaaacctactaatacaaacgctaaaaaacaacgaaatcctaaaccgcatcaaaataaaaccgaaaactaaaaccgaacctaacgaatccgcaaaacttacgtaaacaacgaacgtcacaacgatcgcgacgaaaaaaccgcctccctaacgaaaaaccgaaaccgacgaacactaaaaacgcgcccgacataacctccgtcctacccgccccacaaaaaaaatcgactcgttcgttcgtataatcccgaaaaacaccgcgaactaaaaatacctaacccgtcccctacctcattccgtaaaaacgaaaccgcgaaacttaaaaaccacacgaacgacccgcaactaaaccctaa

SEQ ID NO: 29261 - DNA, 742 bp, Artificial Sequence
  chemically treated genomic DNA (Homo sapiens) CpG-island No: 29261
cgttcgttatcgtaggaaattttcgattttatcgatagcgggaaagaggttttgagattggagaggaaattacggatttgtagggttcgtttcgttttttcgttaagttaagtggtgtttttaatttgtttcgatttgttttcgtgcgtttaggtcgtttgttcggtttagtagtggtaatggagtggttaggtacgcggtagttattgttttttaggtatgcgatggtttaggggttagacgttcggtgtagtattttcgttcggttcgttagcgtttttttttagtcgtaggtattgtttttgacgaaggcgaaggcgttagcgaattttcgcgggagtggttattttggcgtttttttttcgtcgggtcggggtttgtgttttcgttggtaggcgtaggatgcgtaggatggagcgcgtatgcgtattggtcgttagtcgaggacggaagtgggcgttcggaagttagacgtgttttttgggcgtgatttggtattgtcgcgtcgtagttgtcgtattcgtcgtattcgttgtaggcgcgaggttgggtgtaggtagttgtttgagtttcgaggtatcgacggacggatagacggacggattgattgacgatgtcgcgtttttataggttttcgtttatcgcgtagcgggttgttattgtcgtagtagtcgagtttaagtttgagggcgttgtggttatgatttttaagattttttttttttttgtagggtttatggtt

SEQ ID NO: 29262 - DNA, 742 bp, Artificial Sequence
  chemically treated genomic DNA (Homo sapiens) CpG-island No: 29262
aaccataaaccctacaaaaaaaaaaaaaatcttaaaaatcataaccacaacgccctcaaacttaaactcgactactacgacaataacaacccgctacgcgataaacgaaaacctataaaaacgcgacatcgtcaatcaatccgtccgtctatccgtccgtcgatacctcgaaactcaaacaactacctacacccaacctcgcgcctacaacgaatacgacgaatacgacaactacgacgcgacaataccaaatcacgcccaaaaaacacgtctaacttccgaacgcccacttccgtcctcgactaacgaccaatacgcatacgcgctccatcctacgcatcctacgcctaccaacgaaaacacaaaccccgacccgacgaaaaaaaaacgccaaaataaccactcccgcgaaaattcgctaacgccttcgccttcgtcaaaaacaatacctacgactaaaaaaaaacgctaacgaaccgaacgaaaatactacaccgaacgtctaacccctaaaccatcgcatacctaaaaaacaataactaccgcgtacctaaccactccattaccactactaaaccgaacaaacgacctaaacgcacgaaaacaaatcgaaacaaattaaaaacaccacttaacttaacgaaaaaacgaaacgaaccctacaaatccgtaatttcctctccaatctcaaaacctctttcccgctatcgataaaatcgaaaatttcctacgataacgaacg

SEQ ID NO: 29263 - DNA, 742 bp, Artificial Sequence
  chemically treated genomic DNA (Homo sapiens) CpG-island No: 29263
aattataagttttgtaaaaaggagaaaaattttgaaagttatagttataacgtttttagatttgggttcggttgttgcggtagtggtagttcgttgcgcggtaggcggaggtttgtgagagcgcggtatcgttagttagttcgttcgtttgttcgttcgtcgatgtttcgaggtttaaatagttgtttgtatttaatttcgcgtttgtagcgaatgcggcgaatgcggtaattgcgacgcggtagtgttaagttacgtttaggggatacgtttagttttcggacgtttattttcgttttcggttggcggttagtgcgtatgcgcgttttattttgcgtattttacgtttattaacgagggtatagatttcggttcggcgggggaggggcgttagggtggttattttcgcgagagttcgttggcgttttcgttttcgttagggatagtgtttgcggttggaggggggcgttggcgggtcgggcgagggtattgtatcgagcgtttggtttttaggttatcgtatgtttaagagatagtggttgtcgcgtgtttggttattttattattattgttggatcgggtaggcgatttgagcgtacggaagtaagtcgaagtaagttgggaatattatttggtttagcggagaggcgaggcgggttttgtaggttcgtggttttttttttagttttagagtttttttttcgttgtcgatagagtcgggggttttttgcgataacgggcg

SEQ ID NO: 29264 - DNA, 742 bp, Artificial Sequence
  chemically treated genomic DNA (Homo sapiens) CpG-island No: 29264
cgcccgttatcgcaaaaaacccccgactctatcgacaacgaaaaaaaaactctaaaactaaaaaaaaaaccacgaacctacaaaacccgcctcgcctctccgctaaaccaaataatattcccaacttacttcgacttacttccgtacgctcaaatcgcctacccgatccaacaataataataaaataaccaaacacgcgacaaccactatctcttaaacatacgataacctaaaaaccaaacgctcgatacaataccctcgcccgacccgccaacgcccccctccaaccgcaaacactatccctaacgaaaacgaaaacgccaacgaactctcgcgaaaataaccaccctaacgcccctcccccgccgaaccgaaatctataccctcgttaataaacgtaaaatacgcaaaataaaacgcgcatacgcactaaccgccaaccgaaaacgaaaataaacgtccgaaaactaaacgtatcccctaaacgtaacttaacactaccgcgtcgcaattaccgcattcgccgcattcgctacaaacgcgaaattaaatacaaacaactatttaaacctcgaaacatcgacgaacgaacaaacgaacgaactaactaacgataccgcgctctcacaaacctccgcctaccgcgcaacgaactaccactaccgcaacaaccgaacccaaatctaaaaacgttataactataactttcaaaatttttctcctttttacaaaacttataatt

SEQ ID NO: 29265 - DNA, 743 bp, Artificial Sequence
  chemically treated genomic DNA (Homo sapiens) CpG-island No: 29265
gcgagttttcgagatggtatcgcgtgggggtcgcgcggcggggttttgtttcggggttcggtaaattcggttgttcgttcggttcgtttttcggcgtcgttatttatcgaagaatttttgtacgatttttagcgggtggttgagttaattttttttatacggtatttcgttaggggtcggggtcggcgaagatcgggcggaggcgattcgcgggtcgagcgcggtcgggcggtcggcgtttagtttttttttagcggttcggtcgtttttcgttcgcgttcgttcgcgtttttttacgtatagcgagtcgcggggcgcgggtttttcgcgttttagggagcggcggttgcggtggggtcgtcgaggagttgttggcgatagttaggcgggcgcgtacgggtttttagtttttatttcgtataatggcgggaaatagtcgtcgtcgatcgcgttgtttgcgatttgggtggagttcgcgtggggaggggcggcgggagcgcgcggcgtagcgcggttttgcgcggcgaggaggaggggcggcggcggcgtcgttattttggagacgggtaaaaggaagggtacgtagcgtcgttggaggttgcgtagcgcggggttcggcgacgcgttttaagggcggcgcgttgtcgtttgtatttttgggtcggcgtgtagcgggaatttttatagtgggtttataagagggtaaagcgagtttgtataatagttgaaaagtattaagttta

SEQ ID NO: 29266 - DNA, 743 bp, Artificial Sequence
  chemically treated genomic DNA (Homo sapiens) CpG-island No: 29266
taaacttaatacttttcaactattatacaaactcgctttaccctcttataaacccactataaaaattcccgctacacgccgacccaaaaatacaaacgacaacgcgccgcccttaaaacgcgtcgccgaaccccgcgctacgcaacctccaacgacgctacgtacccttccttttacccgtctccaaaataacgacgccgccgccgcccctcctcctcgccgcgcaaaaccgcgctacgccgcgcgctcccgccgcccctccccacgcgaactccacccaaatcgcaaacaacgcgatcgacgacgactatttcccgccattatacgaaataaaaactaaaaacccgtacgcgcccgcctaactatcgccaacaactcctcgacgaccccaccgcaaccgccgctccctaaaacgcgaaaaacccgcgccccgcgactcgctatacgtaaaaaaacgcgaacgaacgcgaacgaaaaacgaccgaaccgctaaaaaaaaactaaacgccgaccgcccgaccgcgctcgacccgcgaatcgcctccgcccgatcttcgccgaccccgacccctaacgaaataccgtataaaaaaaattaactcaaccacccgctaaaaatcgtacaaaaattcttcgataaataacgacgccgaaaaacgaaccgaacgaacaaccgaatttaccgaaccccgaaacaaaaccccgccgcgcgacccccacgcgataccatctcgaaaactcgc

SEQ ID NO: 29267 - DNA, 743 bp, Artificial Sequence
  chemically treated genomic DNA (Homo sapiens) CpG-island No: 29267
tgagtttaatgttttttagttgttgtgtagattcgttttgtttttttataagtttattatgggagttttcgttatacgtcggtttaggggtataaacgataacgcgtcgtttttggagcgcgtcgtcgggtttcgcgttgcgtagtttttagcggcgttgcgtgtttttttttttgttcgtttttaaaatggcggcgtcgtcgtcgtttttttttttcgtcgcgtagagtcgcgttgcgtcgcgcgttttcgtcgtttttttttacgcgagttttatttaggtcgtaggtagcgcggtcggcggcggttatttttcgttattgtgcgaagtgaaggttaggggttcgtacgcgttcgtttgattgtcgttagtagtttttcggcggttttatcgtagtcgtcgttttttgaggcgcgggaggttcgcgtttcgcggttcgttgtgcgtgggagggcgcgagcgaacgcgggcgaggagcggtcgagtcgttgaagaggagttgggcgtcggtcgttcggtcgcgttcggttcgcggatcgttttcgttcggttttcgtcggtttcggtttttggcgagatgtcgtgtggggaggattggtttagttattcgttgggaatcgtgtagggatttttcggtgagtggcggcgtcggggggcgggtcgggcgggtagtcgagtttgtcgggtttcggggtagggtttcgtcgcgcggtttttacgcggtattatttcgagggttcgt

SEQ ID NO: 29268 - DNA, 743 bp, Artificial Sequence
  chemically treated genomic DNA (Homo sapiens) CpG-island No: 29268
acgaaccctcgaaataataccgcgtaaaaaccgcgcgacgaaaccctaccccgaaacccgacaaactcgactacccgcccgacccgccccccgacgccgccactcaccgaaaaatccctacacgattcccaacgaataactaaaccaatcctccccacacgacatctcgccaaaaaccgaaaccgacgaaaaccgaacgaaaacgatccgcgaaccgaacgcgaccgaacgaccgacgcccaactcctcttcaacgactcgaccgctcctcgcccgcgttcgctcgcgccctcccacgcacaacgaaccgcgaaacgcgaacctcccgcgcctcaaaaaacgacgactacgataaaaccgccgaaaaactactaacgacaatcaaacgaacgcgtacgaacccctaaccttcacttcgcacaataacgaaaaataaccgccgccgaccgcgctacctacgacctaaataaaactcgcgtaaaaaaaaacgacgaaaacgcgcgacgcaacgcgactctacgcgacgaaaaaaaaaaacgacgacgacgccgccattttaaaaacgaacaaaaaaaaaaacacgcaacgccgctaaaaactacgcaacgcgaaacccgacgacgcgctccaaaaacgacgcgttatcgtttatacccctaaaccgacgtataacgaaaactcccataataaacttataaaaaaacaaaacgaatctacacaacaactaaaaaacattaaactca

SEQ ID NO: 29269 - DNA, 837 bp, Artificial Sequence
  chemically treated genomic DNA (Homo sapiens) CpG-island No: 29269
tagcgggtcgagtcgtggttcgttaatttcgttgttttcgcgtattcggcgtttgtaggtcgttttcggggttatcgggtcgttgagcgacgggcgtcgggaggtttttgcgttttttttgcgatttttttcggtcgttcgcgtcggttttgtggttcgaggtttcggttgggtttttgtcgtcgcggggatcggtttcggtcgtcgtcgtcgtttcgtcgcgttttttgcgttgtagttgttgttggcgtcggcgttcggtttcgcgtaggatgtcgaacgggttcgattcgtcgtttagtagttgatggaagcggttggttattacgtagtcgaaatttttttgtatcgcggcgttagcggtagttacgggattttttagagcgttttttatgtcgtcgcgattattgcgggttcgggagggtagtttacgcgagcgcgttttagcgaagtcggcggttaggatttatgtcgttcgtttcgtcgttatcgtttttcgggttttattttgttcggtttttatcggcgttcgttttcgcggcgtcgtcgtcgttcgtttcgttgcgttagatagttagttagcgcgcgcgggtgcgtttttttttcgatacggcgcgtttggagatttaattatcgatcggttgttgttacgttacgcgatttttgggtttcgtttcgttcgtttagtagggaggggcggggtttaggggcggagttattggttggtttaggcggcgtcgacgaagcggtggggtttcggttgtgtgtgttttttttcgggattgcgatcgtatttgttatgggttattttgttttgaagtttatgtatatatttag

SEQ ID NO: 29270 - DNA, 837 bp, Artificial Sequence
  chemically treated genomic DNA (Homo sapiens) CpG-island No: 29270
ctaaatatatacataaacttcaaaacaaaataacccataacaaatacgatcgcaatcccgaaaaaaaacacacacaaccgaaaccccaccgcttcgtcgacgccgcctaaaccaaccaataactccgcccctaaaccccgcccctccctactaaacgaacgaaacgaaacccaaaaatcgcgtaacgtaacaacaaccgatcgataattaaatctccaaacgcgccgtatcgaaaaaaaaacgcacccgcgcgcgctaactaactatctaacgcaacgaaacgaacgacgacgacgccgcgaaaacgaacgccgataaaaaccgaacaaaataaaacccgaaaaacgataacgacgaaacgaacgacataaatcctaaccgccgacttcgctaaaacgcgctcgcgtaaactaccctcccgaacccgcaataatcgcgacgacataaaaaacgctctaaaaaatcccgtaactaccgctaacgccgcgatacaaaaaaatttcgactacgtaataaccaaccgcttccatcaactactaaacgacgaatcgaacccgttcgacatcctacgcgaaaccgaacgccgacgccaacaacaactacaacgcaaaaaacgcgacgaaacgacgacgacgaccgaaaccgatccccgcgacgacaaaaacccaaccgaaacctcgaaccacaaaaccgacgcgaacgaccgaaaaaaatcgcaaaaaaaacgcaaaaacctcccgacgcccgtcgctcaacgacccgataaccccgaaaacgacctacaaacgccgaatacgcgaaaacaacgaaattaacgaaccacgactcgacccgcta

SEQ ID NO: 29271 - DNA, 837 bp, Artificial Sequence
  chemically treated genomic DNA (Homo sapiens) CpG-island No: 29271
ttaaatgtatatataagttttaaagtagagtggtttatagtaaatacggtcgtagtttcgggagaaagtatatatagtcgagattttatcgtttcgtcggcgtcgtttggattagttagtagtttcgtttttgggtttcgtttttttttgttgagcgaacggggcggggtttagaggtcgcgtgacgtgatagtagtcggtcggtgattgggtttttaggcgcgtcgtgtcggaaagggggcgtattcgcgcgcgttgattggttgtttggcgtagcggggcggacggcggcggcgtcgcgggggcgggcgtcggtaggggtcggatagggtagggttcggagggcggtggcggcggagcgggcggtatgggttttggtcgtcggtttcgttgagacgcgttcgcgtgggttgttttttcgggttcgtagtggtcgcggcggtatgaagggcgttttggggagtttcgtggttgtcgttggcgtcgcgatgtaggagagtttcggttgcgtggtggttaatcgtttttattagttgttggacgacgagtcggattcgttcgatattttgcgcgaggtcgagcgtcggcgttagtagtagttgtagcgtaagaggcgcgacgaggcggcggcggcggtcggggtcggttttcgcggcggtaggagtttagtcggggtttcgggttatagagtcggcgcgggcggtcggagggagtcgtagaaggagcgtaagagtttttcggcgttcgtcgtttagcggttcgatagtttcgggggcggtttgtaggcgtcgggtacgcggggatagcggggttagcggattacggttcggttcgttg

SEQ ID NO: 29272 - DNA, 837 bp, Artificial Sequence
  chemically treated genomic DNA (Homo sapiens) CpG-island No: 29272
caacgaaccgaaccgtaatccgctaaccccgctatccccgcgtacccgacgcctacaaaccgcccccgaaactatcgaaccgctaaacgacgaacgccgaaaaactcttacgctccttctacgactccctccgaccgcccgcgccgactctataacccgaaaccccgactaaactcctaccgccgcgaaaaccgaccccgaccgccgccgccgcctcgtcgcgcctcttacgctacaactactactaacgccgacgctcgacctcgcgcaaaatatcgaacgaatccgactcgtcgtccaacaactaataaaaacgattaaccaccacgcaaccgaaactctcctacatcgcgacgccaacgacaaccacgaaactccccaaaacgcccttcataccgccgcgaccactacgaacccgaaaaaacaacccacgcgaacgcgtctcaacgaaaccgacgaccaaaacccataccgcccgctccgccgccaccgccctccgaaccctaccctatccgacccctaccgacgcccgcccccgcgacgccgccgccgtccgccccgctacgccaaacaaccaatcaacgcgcgcgaatacgccccctttccgacacgacgcgcctaaaaacccaatcaccgaccgactactatcacgtcacgcgacctctaaaccccgccccgttcgctcaacaaaaaaaaacgaaacccaaaaacgaaactactaactaatccaaacgacgccgacgaaacgataaaatctcgactatatatactttctcccgaaactacgaccgtatttactataaaccactctactttaaaacttatatatacatttaa

SEQ ID NO: 29273 - DNA, 1795 bp, Artificial Sequence
  chemically treated genomic DNA (Homo sapiens) CpG-island No: 29273
cggaattcgattaagaaattaggtacgtcgggtgtttattaggatttcgggtagtagagattttagtcgtcgggcgggtggtgggatcgagggcggggcgggcggcggggttttagttttttaaattttttgcgcgcgggaatcgcggtttaataattaacggcgggcggggtcgagcggggcgcgcgtttttatcgtttaacgattattatttttttcgatttcgtttcgtcgttgtttaattagtcgtttttttgtcgtttttttcgtcgtttttgtttttttggttcggattaattacgcggagggacggcggggcggggcggtaggcgggtgtgttcgggcgagtggagacgtcgcgcgttttattggagtttcgaacgttgttggttttttagatagaaaaaaatataagagcggcggttaatggcgaggtgggaaggattcgcgcgtagattcggtttcgtttcggtcggttggaaagaaggttaggtttggttattggttcgcgtcgtttgttattcgtcggtgcggttagcgggtagcggtttcgcggtgattggtttcgtttaggcgcgaaatgtaacgcgggaaaagtcggggtaggtatcgcggcggtaggttgttatttttgggggtttagcgtcgcgcgttttgtttttttgttatcgtaagggtcgggtcgttcgttgttttttatttttgtagtttgcgttgcggagtataaagagcggagggcgcgtttgatttggggttggggtttagttttgttcgtcggtgtcgtttgtttaattagttaggtggttgttgcgtaggatttcgggaaacgttagtttgttatgagtcggtaggattgagtttgcgattcggagtagagcgagtgaggggtagagcggtgtttaggagtgcggttcggggtcgtcggagttgggggtcgggtcgggcgatgattcggggtttcgaggcgtttatggcggagaattcgtcgtcgtcgtcgtcgttcgttattttttgttacgatttttcgaagcgggtgttggtgtcggttattaggacgatttcgattaagttaacgtgcggcggtggaggggagtcggagtcgtcgtcgtcgtttatttttattagtttcggttttagcgattttatggtgtattcgtggcgttggggcgagaacgtatataacgtgacgtttagttttggggtcgcgggggtcgtcgtttcggtcgttttgtttgtagtcgtagtcgtcgagtattcggggtttcgtggtcggggcgcgttttcgttcgtcgtttcggttttcgtcgtcgtttcgggaggtgaggacgaggaggaagcgagtagtttagatagcggttattttaaggtgagcggcgcgggcgggcgggcgggcgggacgtggggtagtcggggttcgttaacggtgcggcgggcggggcggagttgaaaacgcgaggtcgattcggttacggcgggggttgcggttgataggatgttgacgttattgtcgcgcgttaaaaatcggttttagtcggggggggtttgttacgtgataggcgggagcggcgcgggagatcgtttttgcggtaggtgtagtgggcgggagcgcggttcggggtcgttggggaggtcgggttaacggttattgatattttttcggcgggttgtcgagtttttagtttcgagaggaaacgagagggatgagggttttgagttgttttatcgattgcgagagggtagggagcgtatagtgtttgttttattattgtagatcgttttcgttttgttaaaagat

SEQ ID NO: 29274 - DNA, 1795 bp, Artificial Sequence
  chemically treated genomic DNA (Homo sapiens) CpG-island No: 29274
atcttttaacaaaacgaaaacgatctacaataataaaacaaacactatacgctccctaccctctcgcaatcgataaaacaactcaaaaccctcatccctctcgtttcctctcgaaactaaaaactcgacaacccgccgaaaaaatatcaataaccgttaacccgacctccccaacgaccccgaaccgcgctcccgcccactacacctaccgcaaaaacgatctcccgcgccgctcccgcctatcacgtaacaaaccccccccgactaaaaccgatttttaacgcgcgacaataacgtcaacatcctatcaaccgcaacccccgccgtaaccgaatcgacctcgcgttttcaactccgccccgcccgccgcaccgttaacgaaccccgactaccccacgtcccgcccgcccgcccgcccgcgccgctcaccttaaaataaccgctatctaaactactcgcttcctcctcgtcctcacctcccgaaacgacgacgaaaaccgaaacgacgaacgaaaacgcgccccgaccacgaaaccccgaatactcgacgactacgactacaaacaaaacgaccgaaacgacgacccccgcgaccccaaaactaaacgtcacgttatatacgttctcgccccaacgccacgaatacaccataaaatcgctaaaaccgaaactaataaaaataaacgacgacgacgactccgactcccctccaccgccgcacgttaacttaatcgaaatcgtcctaataaccgacaccaacacccgcttcgaaaaatcgtaacaaaaaataacgaacgacgacgacgacgacgaattctccgccataaacgcctcgaaaccccgaatcatcgcccgacccgacccccaactccgacgaccccgaaccgcactcctaaacaccgctctacccctcactcgctctactccgaatcgcaaactcaatcctaccgactcataacaaactaacgtttcccgaaatcctacgcaacaaccacctaactaattaaacaaacgacaccgacgaacaaaactaaaccccaaccccaaatcaaacgcgccctccgctctttatactccgcaacgcaaactacaaaaataaaaaacaacgaacgacccgacccttacgataacaaaaaaacaaaacgcgcgacgctaaacccccaaaaataacaacctaccgccgcgatacctaccccgacttttcccgcgttacatttcgcgcctaaacgaaaccaatcaccgcgaaaccgctacccgctaaccgcaccgacgaataacaaacgacgcgaaccaataaccaaacctaaccttctttccaaccgaccgaaacgaaaccgaatctacgcgcgaatccttcccacctcgccattaaccgccgctcttatatttttttctatctaaaaaaccaacaacgttcgaaactccaataaaacgcgcgacgtctccactcgcccgaacacacccgcctaccgccccgccccgccgtccctccgcgtaattaatccgaaccaaaaaaacaaaaacgacgaaaaaaacgacaaaaaaacgactaattaaacaacgacgaaacgaaatcgaaaaaaataataatcgttaaacgataaaaacgcgcgccccgctcgaccccgcccgccgttaattattaaaccgcgattcccgcgcgcaaaaaatttaaaaaactaaaaccccgccgcccgccccgccctcgatcccaccacccgcccgacgactaaaatctctactacccgaaatcctaataaacacccgacgtacctaatttcttaatcgaattccg

SEQ ID NO: 29275 - DNA, 1795 bp, Artificial Sequence
  chemically treated genomic DNA (Homo sapiens) CpG-island No: 29275
attttttaatagggcgagggcgatttgtagtaatggagtaaatattgtgcgttttttgttttttcgtagtcggtggaataatttaaggtttttatttttttcgttttttttcggaattgaggattcggtagttcgtcgggaggatgttagtggtcgttgattcggtttttttagcgatttcgggtcgcgttttcgtttattgtatttgtcgtaaggacggtttttcgcgtcgttttcgtttgttacgtgataggtttttttcgattggggtcggtttttggcgcgcggtagtgacgttagtattttgttagtcgtagttttcgtcgtagtcggatcgatttcgcgtttttaatttcgtttcgttcgtcgtatcgttaacgggtttcggttgttttacgtttcgttcgttcgttcgttcgcgtcgtttattttgaggtggtcgttgtttgggttgttcgtttttttttcgtttttatttttcgaggcggcggcggaggtcgaggcggcgggcgggggcgcgtttcggttacgaagtttcgagtgttcggcggttgcggttgtaggtagggcggtcgaggcggcggttttcgcggttttagggttgagcgttacgttgtgtgcgttttcgttttagcgttacgggtatattatgaagtcgttgaagtcggggttggtggggatgagcggcggcggcggtttcggtttttttttatcgtcgtacgttggtttgatcggggtcgttttgatgatcgatattagtattcgtttcggggagtcgtggtagaagatgacgggcggcggcggcggcggcgggtttttcgttatgggcgtttcgaagtttcggattatcgttcggttcgatttttagtttcggcggtttcgggtcgtatttttgagtatcgttttgttttttattcgttttgtttcgagtcgtaggtttagttttgtcggtttatggtagattgacgtttttcggaattttgcgtagtagttatttaattagttgagtagacggtatcggcgggtagggttggattttagttttaggttaagcgcgtttttcgttttttgtatttcgtagcgtaggttgtaggggtgggaagtagcgggcggttcggtttttgcggtgataggaaagtaggacgcgcggcgttgagtttttaaaaataataatttgtcgtcgcggtgtttgtttcggtttttttcgcgttatatttcgcgtttgggcggaattagttatcgcgaggtcgttgttcgttggtcgtatcggcgagtgataggcggcgcgagttaatggttaggtttggttttttttttagtcggtcggggcggggtcgggtttgcgcgcgggttttttttatttcgttattggtcgtcgtttttatatttttttttgtttggagggttaatagcgttcgaaattttagtggagcgcgcggcgtttttattcgttcggatatattcgtttgtcgtttcgtttcgtcgttttttcgcgtggttagttcgggttagggagataagggcggcggggagggcggtaagagggcggttgattggatagcggcggggcggggtcggggggggtggtgatcgttgggcggtggaggcgcgcgtttcgttcggtttcgttcgtcgttggttgttgggtcgcggttttcgcgcgtagggagtttaaagggttggggtttcgtcgttcgtttcgttttcggttttattattcgttcggcggttggagtttttgttgttcgaggttttgatgggtattcggcgtgtttggttttttaatcgagtttcg

SEQ ID NO: 29276 - DNA, 1795 bp, Artificial Sequence
  chemically treated genomic DNA (Homo sapiens) CpG-island No: 29276
cgaaactcgattaaaaaaccaaacacgccgaatacccatcaaaacctcgaacaacaaaaactccaaccgccgaacgaataataaaaccgaaaacgaaacgaacgacgaaaccccaaccctttaaactccctacgcgcgaaaaccgcgacccaacaaccaacgacgaacgaaaccgaacgaaacgcgcgcctccaccgcccaacgatcaccaccccccccgaccccgccccgccgctatccaatcaaccgccctcttaccgccctccccgccgcccttatctccctaacccgaactaaccacgcgaaaaaacgacgaaacgaaacgacaaacgaatatatccgaacgaataaaaacgccgcgcgctccactaaaatttcgaacgctattaaccctccaaacaaaaaaaaatataaaaacgacgaccaataacgaaataaaaaaaacccgcgcgcaaacccgaccccgccccgaccgactaaaaaaaaaaccaaacctaaccattaactcgcgccgcctatcactcgccgatacgaccaacgaacaacgacctcgcgataactaattccgcccaaacgcgaaatataacgcgaaaaaaaccgaaacaaacaccgcgacgacaaattattatttttaaaaactcaacgccgcgcgtcctactttcctatcaccgcaaaaaccgaaccgcccgctacttcccacccctacaacctacgctacgaaatacaaaaaacgaaaaacgcgcttaacctaaaactaaaatccaaccctacccgccgataccgtctactcaactaattaaataactactacgcaaaattccgaaaaacgtcaatctaccataaaccgacaaaactaaacctacgactcgaaacaaaacgaataaaaaacaaaacgatactcaaaaatacgacccgaaaccgccgaaactaaaaatcgaaccgaacgataatccgaaacttcgaaacgcccataacgaaaaacccgccgccgccgccgccgcccgtcatcttctaccacgactccccgaaacgaatactaatatcgatcatcaaaacgaccccgatcaaaccaacgtacgacgataaaaaaaaaccgaaaccgccgccgccgctcatccccaccaaccccgacttcaacgacttcataatatacccgtaacgctaaaacgaaaacgcacacaacgtaacgctcaaccctaaaaccgcgaaaaccgccgcctcgaccgccctacctacaaccgcaaccgccgaacactcgaaacttcgtaaccgaaacgcgcccccgcccgccgcctcgacctccgccgccgcctcgaaaaataaaaacgaaaaaaaaacgaacaacccaaacaacgaccacctcaaaataaacgacgcgaacgaacgaacgaacgaaacgtaaaacaaccgaaacccgttaacgatacgacgaacgaaacgaaattaaaaacgcgaaatcgatccgactacgacgaaaactacgactaacaaaatactaacgtcactaccgcgcgccaaaaaccgaccccaatcgaaaaaaacctatcacgtaacaaacgaaaacgacgcgaaaaaccgtccttacgacaaatacaataaacgaaaacgcgacccgaaatcgctaaaaaaaccgaatcaacgaccactaacatcctcccgacgaactaccgaatcctcaattccgaaaaaaaacgaaaaaaataaaaaccttaaattattccaccgactacgaaaaaacaaaaaacgcacaatatttactccattactacaaatcgccctcgccctattaaaaaat

SEQ ID NO: 29277 - DNA, 595 bp, Artificial Sequence
  chemically treated genomic DNA (Homo sapiens) CpG-island No: 29277
ggcgtcgcgtttcgttcggttcgcgtcgttttttttgcggttcgggtttttagcggtaggcgggcgagcgcgtttatcggatcgatcggacgtcgggttcgataggcggcgacgatttttagcgcgcgcgttcgattagtcgatttgaggagagacgatcggaattattttgaggcgttgtcgtagatatcgttttaaagataggaagaggttatgtttgcgtcgcgtagagtgtttatttatagagttggagtttttatatggaggttacggcgttaagtcggatttcgcgagatttacgtcgggtttcgttttaaagaggaagcggttcgggagagggttatagattcgagggaacgaaaatgggtaggcgcggagagggcgggtcggaggggcggggttattaaaagtcgttatttgttttatcgtttgtatttggttattgggtacgttttttagtttttgggtttcggaagattgcgcggttattatatcggttgtcgttttgaggtttcgttttagagttgagggggcgggtgtttttttaggtttagcggatatggttttttggttttaaaaatatattaaaaataag

SEQ ID NO: 29278 - DNA, 595 bp, Artificial Sequence
  chemically treated genomic DNA (Homo sapiens) CpG-island No: 29278
cttatttttaatatatttttaaaaccaaaaaaccatatccgctaaacctaaaaaaacacccgccccctcaactctaaaacgaaacctcaaaacgacaaccgatataataaccgcgcaatcttccgaaacccaaaaactaaaaaacgtacccaataaccaaatacaaacgataaaacaaataacgacttttaataaccccgcccctccgacccgccctctccgcgcctacccattttcgttccctcgaatctataaccctctcccgaaccgcttcctctttaaaacgaaacccgacgtaaatctcgcgaaatccgacttaacgccgtaacctccatataaaaactccaactctataaataaacactctacgcgacgcaaacataacctcttcctatctttaaaacgatatctacgacaacgcctcaaaataattccgatcgtctctcctcaaatcgactaatcgaacgcgcgcgctaaaaatcgtcgccgcctatcgaacccgacgtccgatcgatccgataaacgcgctcgcccgcctaccgctaaaaacccgaaccgcaaaaaaaacgacgcgaaccgaacgaaacgcgacgcc

SEQ ID NO: 29279 - DNA, 595 bp, Artificial Sequence
  chemically treated genomic DNA (Homo sapiens) CpG-island No: 29279
tttatttttggtgtgtttttgagattaaagaattatattcgttaagtttgaggaggtattcgtttttttagttttgaaacgaggttttaaaacggtaatcgatgtggtagtcgcgtaatttttcgaaatttaaaggttagagggcgtgtttagtggttaggtgtaggcggtggggtaagtaacggtttttggtagtttcgttttttcgattcgtttttttcgcgtttgtttattttcgttttttcgggtttgtaattttttttcgggtcgttttttttttaaggcggagttcggcgtggatttcgcgagattcggtttggcgtcgtgatttttatgtgggagttttagttttataagtaaatattttgcgcggcgtagatatggtttttttttatttttgaggcggtgtttgcggtagcgttttagagtggtttcggtcgtttttttttaagtcggttagtcgggcgcgcgcgttgagagtcgtcgtcgtttgtcgggttcggcgttcggtcggttcggtgggcgcgttcgttcgtttgtcgttgagggttcgagtcgtagggaaagcggcgcgggtcgggcggggcgcggcgtt

SEQ ID NO: 29280 - DNA, 595 bp, Artificial Sequence
  chemically treated genomic DNA (Homo sapiens) CpG-island No: 29280
aacgccgcgccccgcccgacccgcgccgctttccctacgactcgaaccctcaacgacaaacgaacgaacgcgcccaccgaaccgaccgaacgccgaacccgacaaacgacgacgactctcaacgcgcgcgcccgactaaccgacttaaaaaaaaacgaccgaaaccactctaaaacgctaccgcaaacaccgcctcaaaaataaaaaaaaaccatatctacgccgcgcaaaatatttacttataaaactaaaactcccacataaaaatcacgacgccaaaccgaatctcgcgaaatccacgccgaactccgccttaaaaaaaaaacgacccgaaaaaaaattacaaacccgaaaaaacgaaaataaacaaacgcgaaaaaaacgaatcgaaaaaacgaaactaccaaaaaccgttacttaccccaccgcctacacctaaccactaaacacgccctctaacctttaaatttcgaaaaattacgcgactaccacatcgattaccgttttaaaacctcgtttcaaaactaaaaaaacgaatacctcctcaaacttaacgaatataattctttaatctcaaaaacacaccaaaaataaa

SEQ ID NO: 29281 - DNA, 593 bp, Artificial Sequence
  chemically treated genomic DNA (Homo sapiens) CpG-island No: 29281
atcgtggattttattttcggagtcgtcgttggaggggttagtcgcgaggtagatagcggatcgtcgggcggggcgggacgtagtgggcggggcggaggggcggggttaaaagttttttgtttaattttcgttgtttttttttatcgtttgcgcgcgtcggggtcgtagtcggggggaggcggcggtagcggtagcggttgcgggtagcgcgcggggcgtagggcgcggggcgattatcgtcggggttcgggaggcgggtagtgggtataggtttttcggtgttcgttttttcgttgcggaggggggtcgcgagcgggcggtcggggaggggtcggtatcgtcgttataaaatgagtttgttgtcggttatcgatacgagcgtcgtttcggtgtattagttcgtttagttgtttaattgggtttatttgtcgttgtaggatacgtattaggttagcgttttcgatgtttttcggttcgagtcgatcgtcggcgtcgtattttcggagttggttttcggtaagggtcgtttcgagtagttgggttcgtttttgtattttagttattttaatagttttttttagttgtagcgcgga

SEQ ID NO: 29282 - DNA, 593 bp, Artificial Sequence
  chemically treated genomic DNA (Homo sapiens) CpG-island No: 29282
tccgcgctacaactaaaaaaaactattaaaataactaaaatacaaaaacgaacccaactactcgaaacgacccttaccgaaaaccaactccgaaaatacgacgccgacgatcgactcgaaccgaaaaacatcgaaaacgctaacctaatacgtatcctacaacgacaaataaacccaattaaacaactaaacgaactaatacaccgaaacgacgctcgtatcgataaccgacaacaaactcattttataacgacgataccgacccctccccgaccgcccgctcgcgacccccctccgcaacgaaaaaacgaacaccgaaaaacctatacccactacccgcctcccgaaccccgacgataatcgccccgcgccctacgccccgcgcgctacccgcaaccgctaccgctaccgccgcctccccccgactacgaccccgacgcgcgcaaacgataaaaaaaaacaacgaaaattaaacaaaaaacttttaaccccgcccctccgccccgcccactacgtcccgccccgcccgacgatccgctatctacctcgcgactaacccctccaacgacgactccgaaaataaaatccacgat

SEQ ID NO: 29283 - DNA, 593 bp, Artificial Sequence
  chemically treated genomic DNA (Homo sapiens) CpG-island No: 29283
ttcgcgttgtagttggaagaagttgttgagatagttggagtgtaggggcgagtttagttgttcggggcggtttttgtcgaaggttagtttcgggggtgcggcgtcggcggtcggttcgggtcggaaggtatcgaaggcgttagtttggtgcgtgttttgtagcgataggtagatttagttgagtagttgggcgggttggtatatcgaggcggcgttcgtgtcgatggtcgatagtaggtttattttgtggcggcggtgtcggttttttttcggtcgttcgttcgcggttttttttcgtagcggaggggcgggtatcggggagtttgtgtttattgttcgtttttcgagtttcgacggtgatcgtttcgcgttttgcgtttcgcgcgttgttcgtagtcgttgtcgttgtcgtcgttttttttcgattgcggtttcggcgcgcgtaggcggtggaaggaggtagcgaaagttgggtaggaaatttttggtttcgttttttcgtttcgtttattgcgtttcgtttcgttcggcgattcgttatttgtttcgcggttgatttttttagcggcggtttcgggggtggggtttacgat

SEQ ID NO: 29284 - DNA, 593 bp, Artificial Sequence
  chemically treated genomic DNA (Homo sapiens) CpG-island No: 29284
atcgtaaaccccacccccgaaaccgccgctaaaaaaatcaaccgcgaaacaaataacgaatcgccgaacgaaacgaaacgcaataaacgaaacgaaaaaacgaaaccaaaaatttcctacccaactttcgctacctccttccaccgcctacgcgcgccgaaaccgcaatcgaaaaaaaacgacgacaacgacaacgactacgaacaacgcgcgaaacgcaaaacgcgaaacgatcaccgtcgaaactcgaaaaacgaacaataaacacaaactccccgatacccgcccctccgctacgaaaaaaaaccgcgaacgaacgaccgaaaaaaaaccgacaccgccgccacaaaataaacctactatcgaccatcgacacgaacgccgcctcgatataccaacccgcccaactactcaactaaatctacctatcgctacaaaacacgcaccaaactaacgccttcgataccttccgacccgaaccgaccgccgacgccgcacccccgaaactaaccttcgacaaaaaccgccccgaacaactaaactcgcccctacactccaactatctcaacaacttcttccaactacaacgcgaa

SEQ ID NO: 29285 - DNA, 1327 bp, Artificial Sequence
  chemically treated genomic DNA (Homo sapiens) CpG-island No: 29285
ttttaaagcgtagatttaggtcggtttttagcgtggaattcgatttatgtatttcgtttttttacgtggtattagatgttttgtcggttgttatcgtgaattttagttttcgcggagtcgatattgatttggttattttagagttcggagggaaatagcgttttcgtattttcgttttatttgggttgtttttcggatcgtcgttcgttttagattttaggaggcgttattaggtttcgttgatttcgttttatattttcgggagtttttagttggtcggtcgcggcgatcggaagtttcggattgaggtattggtttcgttcgtcgtttttttagtcgagattcggtagcggcggtcggagcggttgttacgtcgtatttgttcgcgagggggcgcgttaggtttaggtcgtagtcgattgtcgcgttttttgttttcgtttttcgttattttcggattgcgtttatttgtttgggtcgttggtttgggaggcgggggtcggcgggagttaagtcgaggaaagggcggagcggtttttcgggcgcgttatcggagtattatggcggagttaggagttggcggcgacggttataggggcggcgacggcgtagtgcgaagcgaaataggtgatcgtatagcggggatagtgggggtttcgtcgggtaggggacggcgagcggggtcggcgggttggtatcgaaattattcggcgtcggtagtttttttttcgttcgcgcggtcgcggttcggaataatcggttttgcgcgtcgcgtattttgtttcgagagcgttttttttcgtttttcgtcgtcgcggttcggttagttcggttcggtttcggtcggggttgcggtcgttttcgggcgttttatcgcgattttttcgtaataggtggaggcgagtcgggggaggaaacggagagatttcggtcgttgtttttttcgtcgcggtttcgggtttaatttagttgaatgggaaatcgtattttttagattaaattagtggttagagagtcgtcggttaggtgcgattggtaggacgagtagtttttgggtattttttttcgttttttttggtcgtttcgggtgtcgggggttttttagcggggtcggtgtggggtaggatcgcggggtgagcggttcgttttttaatttggtgttcgtagtggcgacgatcgtcgttcgaggggatcgagttcgggagggtcggggtttagtgtagtacggtgggggtttgcgagtgcgggtttgacgggattagattttcgttgatttgtcggagtttttagagttttttgtttttagtttgtgtaggagtttaaagga

SEQ ID NO: 29286 - DNA, 1327 bp, Artificial Sequence
  chemically treated genomic DNA (Homo sapiens) CpG-island No: 29286
tcctttaaactcctacacaaactaaaaacaaaaaactctaaaaactccgacaaatcaacgaaaatctaatcccgtcaaacccgcactcgcaaacccccaccgtactacactaaaccccgaccctcccgaactcgatcccctcgaacgacgatcgtcgccactacgaacaccaaattaaaaaacgaaccgctcaccccgcgatcctaccccacaccgaccccgctaaaaaacccccgacacccgaaacgaccaaaaaaaacgaaaaaaaatacccaaaaactactcgtcctaccaatcgcacctaaccgacgactctctaaccactaatttaatctaaaaaatacgatttcccattcaactaaattaaacccgaaaccgcgacgaaaaaaacaacgaccgaaatctctccgtttcctcccccgactcgcctccacctattacgaaaaaatcgcgataaaacgcccgaaaacgaccgcaaccccgaccgaaaccgaaccgaactaaccgaaccgcgacgacgaaaaacgaaaaaaaacgctctcgaaacaaaatacgcgacgcgcaaaaccgattattccgaaccgcgaccgcgcgaacgaaaaaaaaactaccgacgccgaataatttcgataccaacccgccgaccccgctcgccgtcccctacccgacgaaacccccactatccccgctatacgatcacctatttcgcttcgcactacgccgtcgccgcccctataaccgtcgccgccaactcctaactccgccataatactccgataacgcgcccgaaaaaccgctccgccctttcctcgacttaactcccgccgacccccgcctcccaaaccaacgacccaaacaaataaacgcaatccgaaaataacgaaaaacgaaaacaaaaaacgcgacaatcgactacgacctaaacctaacgcgccccctcgcgaacaaatacgacgtaacaaccgctccgaccgccgctaccgaatctcgactaaaaaaacgacgaacgaaaccaatacctcaatccgaaacttccgatcgccgcgaccgaccaactaaaaactcccgaaaatataaaacgaaatcaacgaaacctaataacgcctcctaaaatctaaaacgaacgacgatccgaaaaacaacccaaataaaacgaaaatacgaaaacgctatttccctccgaactctaaaataaccaaatcaatatcgactccgcgaaaactaaaattcacgataacaaccgacaaaacatctaataccacgtaaaaaaacgaaatacataaatcgaattccacgctaaaaaccgacctaaatctacgctttaaaa

SEQ ID NO: 29287 - DNA, 1327 bp, Artificial Sequence
  chemically treated genomic DNA (Homo sapiens) CpG-island No: 29287
ttttttgggtttttgtatagattaaaaataaaaaattttgagaatttcgataagttaacgaaagtttgatttcgttaagttcgtattcgtaaatttttatcgtgttgtattgggtttcggttttttcgagttcggttttttcggacgacggtcgtcgttattgcgggtattagattggggggcgggtcgtttatttcgcggttttgttttatatcgatttcgttgaggagttttcggtattcggggcgattagggaaggcgggaggaggtgtttagaaattgttcgttttgttagtcgtatttggtcgacgattttttggttattggtttggtttgggggatacgattttttatttaattgaattagattcgaggtcgcggcggggagggtagcggtcggggttttttcgttttttttttcggttcgtttttatttgttgcgggaaagtcgcggtggagcgttcgagggcggtcgtaatttcggtcggggtcgagtcgggttggtcgagtcgcggcggcgaagggcgggggaaggcgttttcggagtagggtgcgcggcgcgtagggtcggttgtttcgggtcgcggtcgcgcgggcggggagggggttgtcggcgtcgggtgatttcggtgttagttcgtcggtttcgttcgtcgttttttgttcgacgggatttttattattttcgttgtgcggttatttgtttcgtttcgtattgcgtcgtcgtcgtttttgtggtcgtcgtcgttagtttttagtttcgttatggtgtttcgatgacgcgttcggagagtcgtttcgtttttttttcggtttggttttcgtcggttttcgttttttaggttagcggtttagataggtgagcgtagttcggggatggcggagggcggggatagagagcgcggtagtcggttgcggtttgggtttggcgcgttttttcgcgggtaggtgcggcgtggtagtcgtttcgatcgtcgttgtcgagtttcggttggaagagcggcgggcggaattagtattttagttcggagttttcggtcgtcgcggtcgattagttgagggttttcggagatatggagcggggttagcgaggtttggtggcgttttttggagtttgggacgagcggcggttcgaggagtagtttaggtggggcgagggtacggagacgttattttttttcgaattttgaagtagttaggttagtgtcggtttcgcgagggttggagtttacggtgatagtcggtagagtatttgatgttacgtggagaggcgaagtatatgggtcggattttacgttgggagtcggtttggatttgcgttttagga

SEQ ID NO: 29288 - DNA, 1327 bp, Artificial Sequence
  chemically treated genomic DNA (Homo sapiens) CpG-island No: 29288
tcctaaaacgcaaatccaaaccgactcccaacgtaaaatccgacccatatacttcgcctctccacgtaacatcaaatactctaccgactatcaccgtaaactccaaccctcgcgaaaccgacactaacctaactacttcaaaattcgaaaaaaaataacgtctccgtaccctcgccccacctaaactactcctcgaaccgccgctcgtcccaaactccaaaaaacgccaccaaacctcgctaaccccgctccatatctccgaaaaccctcaactaatcgaccgcgacgaccgaaaactccgaactaaaatactaattccgcccgccgctcttccaaccgaaactcgacaacgacgatcgaaacgactaccacgccgcacctacccgcgaaaaaacgcgccaaacccaaaccgcaaccgactaccgcgctctctatccccgccctccgccatccccgaactacgctcacctatctaaaccgctaacctaaaaaacgaaaaccgacgaaaaccaaaccgaaaaaaaaacgaaacgactctccgaacgcgtcatcgaaacaccataacgaaactaaaaactaacgacgacgaccacaaaaacgacgacgacgcaatacgaaacgaaacaaataaccgcacaacgaaaataataaaaatcccgtcgaacaaaaaacgacgaacgaaaccgacgaactaacaccgaaatcacccgacgccgacaaccccctccccgcccgcgcgaccgcgacccgaaacaaccgaccctacgcgccgcgcaccctactccgaaaacgccttcccccgcccttcgccgccgcgactcgaccaacccgactcgaccccgaccgaaattacgaccgccctcgaacgctccaccgcgactttcccgcaacaaataaaaacgaaccgaaaaaaaaaacgaaaaaaccccgaccgctaccctccccgccgcgacctcgaatctaattcaattaaataaaaaatcgtatcccccaaaccaaaccaataaccaaaaaatcgtcgaccaaatacgactaacaaaacgaacaatttctaaacacctcctcccgccttccctaatcgccccgaataccgaaaactcctcaacgaaatcgatataaaacaaaaccgcgaaataaacgacccgccccccaatctaatacccgcaataacgacgaccgtcgtccgaaaaaaccgaactcgaaaaaaccgaaacccaatacaacacgataaaaatttacgaatacgaacttaacgaaatcaaactttcgttaacttatcgaaattctcaaaattttttatttttaatctatacaaaaacccaaaaaa

SEQ ID NO: 29289 - DNA, 1377 bp, Artificial Sequence
  chemically treated genomic DNA (Homo sapiens) CpG-island No: 29289
cgtcgtcgcgggtgtggtgatttcgggttcgtcgtttatttggagcgtttcggcggcgtttggtttagaattatcggggcggatagttttttggagttgtacgcggattgcggaaggggatagtgagcgggatcggttcgtatttcgttcgcgggttcggatcgttggaagtattcgggtttttttttttttttgtttttcggtttcgttttttttttttcgcgttgcgcgtggcggtttcgggttgcgcgtttttgtaggaggagatcggtattgtcgtcggcggttttttttttaatcgttagtttcggtcgcgcgtttcgtttcgtttcgcggaggagggtgggggcgtttttcgcgtcgggttcgtttagttttttcgcggttgttcgggtcgggttttttattggtcggcgggcgggaggtgaggggcggtagggttcgtttttggcggttcgcgttcgggaaggtcggtagtcgagcgtcggaggtcgtggagagggcgggtagggaggcggcgggcgtcgaggagacgtagcggcggcggtggtggcggtggtggcggcggtggcggcggcggcgtttggtttcggtcgtagtttttgcgtttcgttcgttttgggtcgtttttgttagtttcgcgcgcggttcgtttttcgtcgcggttcgtagtttgcggcgttcgagtttcgagggcgttttttcgggcgttgggttcgaggcggttaagacggcgggtcggtcgggtacggggcggcgggcgttgtgttgcgggttgcgttggtggggggcggcgggtcgcggcgcgggtttagggttcggcgtgtgcggttgggaggtattgtgggggcgggcgcgcgggcggcggtcggggttatggtcgagggcggcgggggcgcgcggaggagggcgtcggcgttgttcgaggttgttcgcgcgcgttacgagagtttgtatatttcggacgacgtgttcggcgagttcggttcggatagcggcgggaattttttttatagtatttcggtcgtttcgcgttttttttcggtcgttttttcggacgacgagcgcgagttttcgggatttttaggggtcgtttcgttatcgtttcgcgtttcggacgtataggagtcggaggaggacgaggtcggcgcgggttggagcgtagcgttgcgggatcgttcgttttcgcgtttcgaggatatcggcggtaaggggttgttcgcgggtggatgtcgggggcggcgttggaatcgggcgcgggggaggcgtgggtgttggggcgggcgagtttagatttttcgtgggttggtttgtgggtgttttttcggaaataaatgaggttgtaggagcggtgatcggtttgattgtttttggggg

SEQ ID NO: 29290 - DNA, 1377 bp, Artificial Sequence
  chemically treated genomic DNA (Homo sapiens) CpG-island No: 29290
cccccaaaaacaatcaaaccgatcaccgctcctacaacctcatttatttccgaaaaaacacccacaaaccaacccacgaaaaatctaaactcgcccgccccaacacccacgcctcccccgcgcccgattccaacgccgcccccgacatccacccgcgaacaaccccttaccgccgatatcctcgaaacgcgaaaacgaacgatcccgcaacgctacgctccaacccgcgccgacctcgtcctcctccgactcctatacgtccgaaacgcgaaacgataacgaaacgacccctaaaaatcccgaaaactcgcgctcgtcgtccgaaaaaacgaccgaaaaaaaacgcgaaacgaccgaaatactataaaaaaaattcccgccgctatccgaaccgaactcgccgaacacgtcgtccgaaatatacaaactctcgtaacgcgcgcgaacaacctcgaacaacgccgacgccctcctccgcgcgcccccgccgccctcgaccataaccccgaccgccgcccgcgcgcccgcccccacaatacctcccaaccgcacacgccgaaccctaaacccgcgccgcgacccgccgccccccaccaacgcaacccgcaacacaacgcccgccgccccgtacccgaccgacccgccgtcttaaccgcctcgaacccaacgcccgaaaaaacgccctcgaaactcgaacgccgcaaactacgaaccgcgacgaaaaacgaaccgcgcgcgaaactaacaaaaacgacccaaaacgaacgaaacgcaaaaactacgaccgaaaccaaacgccgccgccgccaccgccgccaccaccgccaccaccgccgccgctacgtctcctcgacgcccgccgcctccctacccgccctctccacgacctccgacgctcgactaccgaccttcccgaacgcgaaccgccaaaaacgaaccctaccgcccctcacctcccgcccgccgaccaataaaaaacccgacccgaacaaccgcgaaaaaactaaacgaacccgacgcgaaaaacgcccccaccctcctccgcgaaacgaaacgaaacgcgcgaccgaaactaacgattaaaaaaaaaaccgccgacgacaataccgatctcctcctacaaaaacgcgcaacccgaaaccgccacgcgcaacgcgaaaaaaaaaaaacgaaaccgaaaaacaaaaaaaaaaaaaaacccgaatacttccaacgatccgaacccgcgaacgaaatacgaaccgatcccgctcactatccccttccgcaatccgcgtacaactccaaaaaactatccgccccgataattctaaaccaaacgccgccgaaacgctccaaataaacgacgaacccgaaatcaccacacccgcgacgacg

SEQ ID NO: 29291 - DNA, 1377 bp, Artificial Sequence
  chemically treated genomic DNA (Homo sapiens) CpG-island No: 29291
tttttaggagtagttagatcgattatcgtttttgtagttttatttgttttcggagagatatttataagttagtttacggagagtttggattcgttcgttttagtatttacgtttttttcgcgttcggttttagcgtcgttttcgatatttattcgcgggtagttttttatcgtcggtattttcgaagcgcgggggcgggcggtttcgtagcgttgcgttttagttcgcgtcggtttcgttttttttcggtttttgtgcgttcggggcgcggggcggtggcggggcggtttttgggggtttcgggggttcgcgttcgtcgttcgaggaggcggtcgaggaggagcgcgaggcggtcgaggtgttgtagaaggggttttcgtcgttgttcgggtcggattcgtcgaatacgtcgttcgagatgtgtaggttttcgtagcgcgcgcgggtagtttcgagtagcgtcggcgttttttttcgcgcgttttcgtcgttttcggttatggtttcggtcgtcgttcgcgcgttcgtttttatagtgttttttagtcgtatacgtcgggttttgggttcgcgtcgcggttcgtcgttttttattagcgtagttcgtagtatagcgttcgtcgtttcgtgttcggtcggttcgtcgttttggtcgtttcgggtttagcgttcggggaagcgttttcggagttcgggcgtcgtaggttgcgggtcgcggcgggaggcgagtcgcgcgcggggttggtaggggcgatttagagcgggcgggacgtagaggttgcggtcgagattaggcgtcgtcgtcgttatcgtcgttattatcgttattatcgtcgtcgttgcgttttttcggcgttcgtcgtttttttgttcgttttttttacggttttcggcgttcggttgtcgattttttcgggcgcgagtcgttagaggcgggttttgtcgttttttatttttcgttcgtcggttaatggggagttcggttcggatagtcgcgggggagttgggcgggttcggcgcggggaacgtttttattttttttcgcggggcggggcggggcgcgcggtcggggttggcggttagggggagggtcgtcggcggtagtgtcggtttttttttatagggacgcgtagttcgggatcgttacgcgtagcgcgggagggggagggcgggatcggggaataggaggggagggggattcgggtgtttttagcggttcgggttcgcggacggagtgcgggtcgatttcgtttattgttttttttcgtagttcgcgtgtagttttagggagttgttcgtttcggtggttttgaattaggcgtcgtcgaaacgttttaggtaggcggcgggttcgaggttattatattcgcggcggcg

SEQ ID NO: 29292 - DNA, 1377 bp, Artificial Sequence
  chemically treated genomic DNA (Homo sapiens) CpG-island No: 29292
cgccgccgcgaatataataacctcgaacccgccgcctacctaaaacgtttcgacgacgcctaattcaaaaccaccgaaacgaacaactccctaaaactacacgcgaactacgaaaaaaaacaataaacgaaatcgacccgcactccgtccgcgaacccgaaccgctaaaaacacccgaatccccctcccctcctattccccgatcccgccctccccctcccgcgctacgcgtaacgatcccgaactacgcgtccctataaaaaaaaaccgacactaccgccgacgaccctccccctaaccgccaaccccgaccgcgcgccccgccccgccccgcgaaaaaaaataaaaacgttccccgcgccgaacccgcccaactcccccgcgactatccgaaccgaactccccattaaccgacgaacgaaaaataaaaaacgacaaaacccgcctctaacgactcgcgcccgaaaaaatcgacaaccgaacgccgaaaaccgtaaaaaaaacgaacaaaaaaacgacgaacgccgaaaaaacgcaacgacgacgataataacgataataacgacgataacgacgacgacgcctaatctcgaccgcaacctctacgtcccgcccgctctaaatcgcccctaccaaccccgcgcgcgactcgcctcccgccgcgacccgcaacctacgacgcccgaactccgaaaacgcttccccgaacgctaaacccgaaacgaccaaaacgacgaaccgaccgaacacgaaacgacgaacgctatactacgaactacgctaataaaaaacgacgaaccgcgacgcgaacccaaaacccgacgtatacgactaaaaaacactataaaaacgaacgcgcgaacgacgaccgaaaccataaccgaaaacgacgaaaacgcgcgaaaaaaaacgccgacgctactcgaaactacccgcgcgcgctacgaaaacctacacatctcgaacgacgtattcgacgaatccgacccgaacaacgacgaaaaccccttctacaacacctcgaccgcctcgcgctcctcctcgaccgcctcctcgaacgacgaacgcgaacccccgaaacccccaaaaaccgccccgccaccgccccgcgccccgaacgcacaaaaaccgaaaaaaaacgaaaccgacgcgaactaaaacgcaacgctacgaaaccgcccgcccccgcgcttcgaaaataccgacgataaaaaactacccgcgaataaatatcgaaaacgacgctaaaaccgaacgcgaaaaaaacgtaaatactaaaacgaacgaatccaaactctccgtaaactaacttataaatatctctccgaaaacaaataaaactacaaaaacgataatcgatctaactactcctaaaaa

SEQ ID NO: 29293 - DNA, 689 bp, Artificial Sequence
  chemically treated genomic DNA (Homo sapiens) CpG-island No: 29293
tcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttttaatatcgtaagcgataggtcgattatcgtcgcgttttagcgaaagcggttttcgtcgaaaatgatttatagcgttgtcggtatttgttttacgagttgtatgataaaaaagttagttataagtgcggcggcgatagttatgtttcgcgttcgtcgtaaggagttgattgggttgaaggtttttaagggtatcggttcgattttgaatttttaaggatttatatggttttaaaaaaaattgcgggtcgt

SEQ ID NO: 29294 - DNA, 689 bp, Artificial Sequence
  chemically treated genomic DNA (Homo sapiens) CpG-island No: 29294
acgacccgcaattttttttaaaaccatataaatccttaaaaattcaaaatcgaaccgatacccttaaaaaccttcaacccaatcaactccttacgacgaacgcgaaacataactatcgccgccgcacttataactaacttttttatcatacaactcgtaaaacaaataccgacaacgctataaatcattttcgacgaaaaccgctttcgctaaaacgcgacgataatcgacctatcgcttacgatattaaaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacga

SEQ ID NO: 29295 - DNA, 689 bp, Artificial Sequence
  chemically treated genomic DNA (Homo sapiens) CpG-island No: 29295
gcggttcgtaattttttttagagttatataggtttttaaaagtttaaggtcggatcgatgtttttgagagtttttaatttagttagttttttacggcgggcgcggggtatgattatcgtcgtcgtatttatgattgatttttttattatgtaattcgtaggataggtgtcggtagcgttgtgggttattttcggcgaggatcgttttcgttggagcgcgacgatgatcggtttgtcgtttgcggtattaggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcgg

SEQ ID NO: 29296 - DNA, 689 bp, Artificial Sequence
  chemically treated genomic DNA (Homo sapiens) CpG-island No: 29296
ccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattcctaataccgcaaacgacaaaccgatcatcgtcgcgctccaacgaaaacgatcctcgccgaaaataacccacaacgctaccgacacctatcctacgaattacataataaaaaaatcaatcataaatacgacgacgataatcataccccgcgcccgccgtaaaaaactaactaaattaaaaactctcaaaaacatcgatccgaccttaaacttttaaaaacctatataactctaaaaaaaattacgaaccgc

SEQ ID NO: 29297 - DNA, 699 bp, Artificial Sequence
  chemically treated genomic DNA (Homo sapiens) CpG-island No: 29297
ggggtattcgcgtattttcgggttttttatcgtttcgagtggaggagattgttttcgttcgcgtggtcggggaggcgggagttttttaagttttttgaagttcgcgttcgtttgcggtttgagggttttcgggtaggcgtcgtacggtttttttttttggaagaaggcggtggaggcgcggggacggggtcgcggttttcgtttagagcgcgggacgtatcggtcgttatgggaacggcggcgtaggtaggcgttgacgttagtaggcggcgcgttgttcgtattgcggtatagagtcgcggtttgtttttaggatacgggtcgttggcgggttaggtggttgcgtggtcgttttatttcgcgtacgcgtcgttaggttgggggagttgatttgtattgtttcgggtgtcggtttcggcgggacgggcggttttgcgtattttttttcgtgagtatattatgggtgcgttggtggcgggagcgcgggtcggggtgttcggtttgttcggtttttttttgggcggcgtgtcggggttgttggagttcgagagcgcggaggttgatagcgtagtgatcgacgagcgtgggtcgggtgtttcgggggaatgcgatttttgagagtttttatcgtatttttgcgttttttttattggttttcgtgttttcggagagttgagtatggtgttttgatagagaatt

SEQ ID NO: 29298 - DNA, 699 bp, Artificial Sequence
  chemically treated genomic DNA (Homo sapiens) CpG-island No: 29298
aattctctatcaaaacaccatactcaactctccgaaaacacgaaaaccaataaaaaaaacgcaaaaatacgataaaaactctcaaaaatcgcattcccccgaaacacccgacccacgctcgtcgatcactacgctatcaacctccgcgctctcgaactccaacaaccccgacacgccgcccaaaaaaaaaccgaacaaaccgaacaccccgacccgcgctcccgccaccaacgcacccataatatactcacgaaaaaaaatacgcaaaaccgcccgtcccgccgaaaccgacacccgaaacaatacaaatcaactcccccaacctaacgacgcgtacgcgaaataaaacgaccacgcaaccacctaacccgccaacgacccgtatcctaaaaacaaaccgcgactctataccgcaatacgaacaacgcgccgcctactaacgtcaacgcctacctacgccgccgttcccataacgaccgatacgtcccgcgctctaaacgaaaaccgcgaccccgtccccgcgcctccaccgccttcttccaaaaaaaaaaaccgtacgacgcctacccgaaaaccctcaaaccgcaaacgaacgcgaacttcaaaaaacttaaaaaactcccgcctccccgaccacgcgaacgaaaacaatctcctccactcgaaacgataaaaaacccgaaaatacgcgaatacccc

SEQ ID NO: 29299 - DNA, 699 bp, Artificial Sequence
  chemically treated genomic DNA (Homo sapiens) CpG-island No: 29299
aattttttattagagtattatgtttaatttttcggggatacggagattagtgaaagaagcgtaaaagtacggtgaggatttttagaaatcgtattttttcgggatattcggtttacgttcgtcggttattacgttattagttttcgcgttttcggattttagtagtttcgatacgtcgtttaggagagggtcgggtaggtcgagtatttcggttcgcgttttcgttattagcgtatttatgatgtatttacggagaggggtacgtagaatcgttcgtttcgtcggagtcgatattcggagtagtgtaaattaatttttttagtttagcggcgcgtgcgcgaagtgaggcggttacgtagttatttaattcgttagcgattcgtgttttgaaagtaagtcgcggttttgtgtcgtagtgcggatagcgcgtcgtttgttgacgttagcgtttgtttacgtcgtcgtttttatggcgatcgatgcgtttcgcgttttaggcgaagatcgcggtttcgttttcgcgtttttatcgtttttttttaggaggaggggtcgtgcggcgtttgttcgggggtttttaggtcgtaggcgggcgcgagttttagggaatttagggggttttcgttttttcggttacgcgagcgggaatagttttttttattcggagcggtaagggattcggaaatgcgcgggtgtttt

SEQ ID NO: 29300 - DNA, 699 bp, Artificial Sequence
  chemically treated genomic DNA (Homo sapiens) CpG-island No: 29300
aaaacacccgcgcatttccgaatcccttaccgctccgaataaaaaaaactattcccgctcgcgtaaccgaaaaaacgaaaaccccctaaattccctaaaactcgcgcccgcctacgacctaaaaacccccgaacaaacgccgcacgacccctcctcctaaaaaaaaacgataaaaacgcgaaaacgaaaccgcgatcttcgcctaaaacgcgaaacgcatcgatcgccataaaaacgacgacgtaaacaaacgctaacgtcaacaaacgacgcgctatccgcactacgacacaaaaccgcgacttactttcaaaacacgaatcgctaacgaattaaataactacgtaaccgcctcacttcgcgcacgcgccgctaaactaaaaaaattaatttacactactccgaatatcgactccgacgaaacgaacgattctacgtacccctctccgtaaatacatcataaatacgctaataacgaaaacgcgaaccgaaatactcgacctacccgaccctctcctaaacgacgtatcgaaactactaaaatccgaaaacgcgaaaactaataacgtaataaccgacgaacgtaaaccgaatatcccgaaaaaatacgatttctaaaaatcctcaccgtacttttacgcttctttcactaatctccgtatccccgaaaaattaaacataatactctaataaaaaatt

SEQ ID NO: 29301 - DNA, 530 bp, Artificial Sequence
  chemically treated genomic DNA (Homo sapiens) CpG-island No: 29301
ttcgtcgaaaagtttatcgtttgttcgttatttggtatttcgggtattttagttttttttgtttggtttataatcgtgcgttttttaggatcggcgtttatttttggttgcgggaagagcggacgtaggtagagcggtttcgtcgagtgtttcgtttcgtttcgcggtcgtcggagtagtttagagcgcgcgtcgggtcgacgaggaagtggatttcgtttagtcgagcgttaattggttttcgggttggtagtttcgtcgtagtaggagcgcgggcggcgcgtacggcggcggaattagtcggagtcgagcgagggcgaagcgggcgtgcgttagtgtagtgtcgcgggtcgcgcgcgttttcgatagggaagggtcggagttgcgtaggggcgcgcggaagaggttaagttagtcggagtttcgtttcgtttcgtttcgttttaacgggggttggaattcggcgtcgagagtagagaaaaggggtttttggtgatcgtttttatttggtatttttttaatttaggagg

SEQ ID NO: 29302 - DNA, 530 bp, Artificial Sequence
  chemically treated genomic DNA (Homo sapiens) CpG-island No: 29302
cctcctaaattaaaaaaataccaaataaaaacgatcaccaaaaaccccttttctctactctcgacgccgaattccaacccccgttaaaacgaaacgaaacgaaacgaaactccgactaacttaacctcttccgcgcgcccctacgcaactccgacccttccctatcgaaaacgcgcgcgacccgcgacactacactaacgcacgcccgcttcgccctcgctcgactccgactaattccgccgccgtacgcgccgcccgcgctcctactacgacgaaactaccaacccgaaaaccaattaacgctcgactaaacgaaatccacttcctcgtcgacccgacgcgcgctctaaactactccgacgaccgcgaaacgaaacgaaacactcgacgaaaccgctctacctacgtccgctcttcccgcaaccaaaaataaacgccgatcctaaaaaacgcacgattataaaccaaacaaaaaaaactaaaatacccgaaataccaaataacgaacaaacgataaacttttcgacgaa

SEQ ID NO: 29303 - DNA, 530 bp, Artificial Sequence
  chemically treated genomic DNA (Homo sapiens) CpG-island No: 29303
ttttttgggttagagggatgttaggtaggggcggttattagaggttttttttttttattttcggcgtcgggttttagttttcgttggggcggggcggggcggggcggggtttcggttagtttggtttttttcgcgcgtttttgcgtagtttcggtttttttttatcgggagcgcgcgcggttcgcggtattgtattggcgtacgttcgtttcgttttcgttcggtttcggttggtttcgtcgtcgtgcgcgtcgttcgcgtttttgttgcggcgaagttgttagttcgggagttaattagcgttcggttaggcggggtttattttttcgtcggttcggcgcgcgttttggattgtttcggcggtcgcggggcggggcggagtattcggcggagtcgttttgtttgcgttcgtttttttcgtagttaagggtgggcgtcggttttaggaggcgtacggttgtaagttagataaaaagaattggggtgttcggagtgttaggtggcgggtaagcggtgggtttttcggcggg

SEQ ID NO: 29304 - DNA, 530 bp, Artificial Sequence
  chemically treated genomic DNA (Homo sapiens) CpG-island No: 29304
cccgccgaaaaacccaccgcttacccgccacctaacactccgaacaccccaattctttttatctaacttacaaccgtacgcctcctaaaaccgacgcccacccttaactacgaaaaaaacgaacgcaaacaaaacgactccgccgaatactccgccccgccccgcgaccgccgaaacaatccaaaacgcgcgccgaaccgacgaaaaaataaaccccgcctaaccgaacgctaattaactcccgaactaacaacttcgccgcaacaaaaacgcgaacgacgcgcacgacgacgaaaccaaccgaaaccgaacgaaaacgaaacgaacgtacgccaatacaataccgcgaaccgcgcgcgctcccgataaaaaaaaaccgaaactacgcaaaaacgcgcgaaaaaaaccaaactaaccgaaaccccgccccgccccgccccgccccaacgaaaactaaaacccgacgccgaaaataaaaaaaaaaaacctctaataaccgcccctacctaacatccctctaacccaaaaaa

SEQ ID NO: 29305 - DNA, 538 bp, Artificial Sequence
  chemically treated genomic DNA (Homo sapiens) CpG-island No: 29305
tttcggacgtagcgattgtagggattgttttggagttcgagcgagggaggcgtgaagtataggagtaacggggtattttcggttcggtttgcggggaagggaagtaggggtagggtcgagggggaagaggttttcgcgagttcgatttcgcgtttatacgttatttgcgaggttagttgttgtcgcgtcgtttcgcgggatcgtagggattttcgaagttttaatgggcgtagaagtgcgagcgagcggcggtgtttatcggtagcgaagaggaggagcgttagggcgtcgggttcgtcgggttacgtggtttcggtcgttttacgtgattcggtgtagcgcgcgttcgggacgttatttagtcgagtatttcgtatcgtttcggtttcggtttcggtttcggtcgaaattttgtttttcgggttttataattcgatttttttagaagtcgattggtcgttttaggttcgtttcgaggttttgttattggagtgtttttatgaaattcggtggttgttgtcgggatttagaggttttt

SEQ ID NO: 29306 - DNA, 538 bp, Artificial Sequence
  chemically treated genomic DNA (Homo sapiens) CpG-island No: 29306
aaaaacctctaaatcccgacaacaaccaccgaatttcataaaaacactccaataacaaaacctcgaaacgaacctaaaacgaccaatcgacttctaaaaaaatcgaattataaaacccgaaaaacaaaatttcgaccgaaaccgaaaccgaaaccgaaacgatacgaaatactcgactaaataacgtcccgaacgcgcgctacaccgaatcacgtaaaacgaccgaaaccacgtaacccgacgaacccgacgccctaacgctcctcctcttcgctaccgataaacaccgccgctcgctcgcacttctacgcccattaaaacttcgaaaatccctacgatcccgcgaaacgacgcgacaacaactaacctcgcaaataacgtataaacgcgaaatcgaactcgcgaaaacctcttccccctcgaccctacccctacttcccttccccgcaaaccgaaccgaaaataccccgttactcctatacttcacgcctccctcgctcgaactccaaaacaatccctacaatcgctacgtccgaaa

SEQ ID NO: 29307 - DNA, 538 bp, Artificial Sequence
  chemically treated genomic DNA (Homo sapiens) CpG-island No: 29307
aaaagtttttaagtttcggtagtagttatcggattttatggggatattttagtggtagggtttcggggcgggtttgagacggttaatcggtttttaaagaagtcgggttgtagggttcgaagagtagggtttcggtcggggtcggggtcggggtcggggcggtgcgggatgttcggttgggtagcgtttcgggcgcgcgttgtatcgggttacgtgaggcggtcggggttacgtgattcggcgggttcggcgttttggcgtttttttttttcgttgtcggtgggtatcgtcgttcgttcgtatttttgcgtttattggagtttcggagatttttgcggtttcgcgggacggcgcggtagtagttgatttcgtaggtagcgtgtgggcgcggggtcgagttcgcggaggttttttttttttcggttttgtttttgtttttttttttcgtaggtcgggtcgggagtgtttcgttatttttgtattttacgtttttttcgttcgggttttagggtagtttttgtagtcgttgcgttcgggg

SEQ ID NO: 29308 - DNA, 538 bp, Artificial Sequence
  chemically treated genomic DNA (Homo sapiens) CpG-island No: 29308
ccccgaacgcaacgactacaaaaactaccctaaaacccgaacgaaaaaaacgtaaaatacaaaaataacgaaacactcccgacccgacctacgaaaaaaaaaaacaaaaacaaaaccgaaaaaaaaaaaacctccgcgaactcgaccccgcgcccacacgctacctacgaaatcaactactaccgcgccgtcccgcgaaaccgcaaaaatctccgaaactccaataaacgcaaaaatacgaacgaacgacgatacccaccgacaacgaaaaaaaaaaacgccaaaacgccgaacccgccgaatcacgtaaccccgaccgcctcacgtaacccgatacaacgcgcgcccgaaacgctacccaaccgaacatcccgcaccgccccgaccccgaccccgaccccgaccgaaaccctactcttcgaaccctacaacccgacttctttaaaaaccgattaaccgtctcaaacccgccccgaaaccctaccactaaaatatccccataaaatccgataactactaccgaaacttaaaaactttt

SEQ ID NO: 29309 - DNA, 538 bp, Artificial Sequence
  chemically treated genomic DNA (Homo sapiens) CpG-island No: 29309
tagcgcgaagtgtattagcgcgtcgtagtagagttagatgagcgtttcgcggttcgtcgttttttgttcgcggtttaggcgtaggtttagggcgtagttcgtcgttagtagcgcggcgtatagtagtagcgaatcgttagtttcggtttttagtttttatttagcgtttatgttttaggttttcgacgttaacggtttaggattatgcggtagaggaaagtagggagagaaacgacggggcggggttggtcgggaaggggcggagtcggatggttaaggaggagcggagttgattggttaaggcggttcggggagggacggggtttttcggtcgggtcggggttagagcgaggatttcgtgttcgtttcgtattttggttagtttgttgagttcggtggttttgttaggtgtcgtttatggaggtttcgtagaaggaacgtgtttattaatttgcgtaatcgtttcgattaaatttgtttttaaatcgagtttaaaggattggtaatagggttatattttttgatgttgtttcgtttt

SEQ ID NO: 29310 - DNA, 538 bp, Artificial Sequence
  chemically treated genomic DNA (Homo sapiens) CpG-island No: 29310
aaaacgaaacaacatcaaaaaatataaccctattaccaatcctttaaactcgatttaaaaacaaatttaatcgaaacgattacgcaaattaataaacacgttccttctacgaaacctccataaacgacacctaacaaaaccaccgaactcaacaaactaaccaaaatacgaaacgaacacgaaatcctcgctctaaccccgacccgaccgaaaaaccccgtccctccccgaaccgccttaaccaatcaactccgctcctccttaaccatccgactccgccccttcccgaccaaccccgccccgtcgtttctctccctactttcctctaccgcataatcctaaaccgttaacgtcgaaaacctaaaacataaacgctaaataaaaactaaaaaccgaaactaacgattcgctactactatacgccgcgctactaacgacgaactacgccctaaacctacgcctaaaccgcgaacaaaaaacgacgaaccgcgaaacgctcatctaactctactacgacgcgctaatacacttcgcgcta

SEQ ID NO: 29311 - DNA, 538 bp, Artificial Sequence
  chemically treated genomic DNA (Homo sapiens) CpG-island No: 29311
aaagcgaaataatattaaaaggtgtggttttattattaattttttgggttcggtttgggaataggtttggtcgaggcggttgcgtaagttggtgagtacgttttttttacggaatttttatgggcggtatttggtaaaattatcggatttagtaggttggttagggtgcgaggcgggtacggaattttcgttttggtttcgattcggtcggggagtttcgttttttttcggatcgttttggttaattagtttcgtttttttttggttattcggtttcgttttttttcggttagtttcgtttcgtcgtttttttttttgtttttttttgtcgtatggttttgggtcgttggcgtcggaagtttgaagtatgggcgttgagtgggagttgggggtcgaggttggcggttcgttgttgttgtgcgtcgcgttgttggcggcgggttgcgttttgggtttgcgtttgggtcgcgggtagggggcggcggatcgcggggcgtttatttggttttgttacgacgcgttggtgtatttcgcgttg

SEQ ID NO: 29312 - DNA, 538 bp, Artificial Sequence
  chemically treated genomic DNA (Homo sapiens) CpG-island No: 29312
caacgcgaaatacaccaacgcgtcgtaacaaaaccaaataaacgccccgcgatccgccgccccctacccgcgacccaaacgcaaacccaaaacgcaacccgccgccaacaacgcgacgcacaacaacaacgaaccgccaacctcgacccccaactcccactcaacgcccatacttcaaacttccgacgccaacgacccaaaaccatacgacaaaaaaaaacaaaaaaaaaaacgacgaaacgaaactaaccgaaaaaaaacgaaaccgaataaccaaaaaaaaacgaaactaattaaccaaaacgatccgaaaaaaaacgaaactccccgaccgaatcgaaaccaaaacgaaaattccgtacccgcctcgcaccctaaccaacctactaaatccgataattttaccaaataccgcccataaaaattccgtaaaaaaaacgtactcaccaacttacgcaaccgcctcgaccaaacctattcccaaaccgaacccaaaaaattaataataaaaccacaccttttaatattatttcgcttt

SEQ ID NO: 29313 - DNA, 938 bp, Artificial Sequence
  chemically treated genomic DNA (Homo sapiens) CpG-island No: 29313
ggttgattttttcggggagtttggtttttaaagcgcggatttcgcgacgcgcggtttgtaggattgcggggttcggcggtcgagacgcggtatttataggggttttttcgcgcggtcgcggcggtggtggcgggaatttgggattggtcggcgaggggtttcgtatggtaatcgttttcgatcgtaagttataggttgtgggtatcgcgtagagcgtattttttatcgaattttttttattttattttaattttcgagatcgaaagtgcggagcgcggagttttgtaaatttgatttcgagttaaggtgcgcgaggcgacggcgagtgtttttcgggttttttgtagtttcggggttggaagtttcggttttcgcgtatttcgttttttgttcgttcgaaagcgaaatttggtcggcgggtaggaggggagagttcggtttcgagttttgtttggcggggtttcggtttggaggtattttcgattcgtatttggcggcgcgatttatttatttgttcgtttttaaggcgtcgttaggagtaatagtagtagcggcggtagcggtagcggtcgtagggtcgggcggtcgggagttcgtatgggcggcggggttgggttatatgtcggggggtagtagattgtttagttttacgttcgttggggttaagcgcggtcgcgcggttttagtttcgcgtttggggttttgcgtgttacgttttaggcgatttgagttttagggcgttttcgttatagtcgcgttttttaggtttttttagaaattaagggcgagcgattcgcggagtttttacgcgcgttttttcggttatttagttggatggtagcgcgagggtagttttcgcggatttatagtttttagttattcggttgttagttttgagagtttgagagtttttatttttcggggtttatgtttagatt

SEQ ID NO: 29314 - DNA, 938 bp, Artificial Sequence
  chemically treated genomic DNA (Homo sapiens) CpG-island No: 29314
aatctaaacataaaccccgaaaaataaaaactctcaaactctcaaaactaacaaccgaataactaaaaactataaatccgcgaaaactaccctcgcgctaccatccaactaaataaccgaaaaaacgcgcgtaaaaactccgcgaatcgctcgcccttaatttctaaaaaaacctaaaaaacgcgactataacgaaaacgccctaaaactcaaatcgcctaaaacgtaacacgcaaaaccccaaacgcgaaactaaaaccgcgcgaccgcgcttaaccccaacgaacgtaaaactaaacaatctactaccccccgacatataacccaaccccgccgcccatacgaactcccgaccgcccgaccctacgaccgctaccgctaccgccgctactactattactcctaacgacgccttaaaaacgaacaaataaataaatcgcgccgccaaatacgaatcgaaaatacctccaaaccgaaaccccgccaaacaaaactcgaaaccgaactctcccctcctacccgccgaccaaatttcgctttcgaacgaacaaaaaacgaaatacgcgaaaaccgaaacttccaaccccgaaactacaaaaaacccgaaaaacactcgccgtcgcctcgcgcaccttaactcgaaatcaaatttacaaaactccgcgctccgcactttcgatctcgaaaattaaaataaaataaaaaaaattcgataaaaaatacgctctacgcgatacccacaacctataacttacgatcgaaaacgattaccatacgaaacccctcgccgaccaatcccaaattcccgccaccaccgccgcgaccgcgcgaaaaaacccctataaataccgcgtctcgaccgccgaaccccgcaatcctacaaaccgcgcgtcgcgaaatccgcgctttaaaaaccaaactccccgaaaaaatcaacc

SEQ ID NO: 29315 - DNA, 938 bp, Artificial Sequence
  chemically treated genomic DNA (Homo sapiens) CpG-island No: 29315
ggtttgggtatgaatttcgagaggtggaaatttttagatttttaggattgatagtcgagtggttggggattataaattcgcgagaattgttttcgcgttgttatttagttgggtagtcgggggagcgcgcgtgggggtttcgcgagtcgttcgtttttggtttttggggaagtttgggggacgcggttgtggcggaggcgttttgggatttaggtcgtttggagcgtggtacgtagagttttaggcgcggagttgaggtcgcgcggtcgcgtttggttttagcgggcgtgggattgagtagtttgttgtttttcgatatgtgatttagtttcgtcgtttatgcgggttttcggtcgttcggttttgcggtcgttgtcgttgtcgtcgttgttgttgttgtttttggcggcgttttggggacgggtaggtaggtgggtcgcgtcgttaggtgcgggtcggggatgtttttaggtcggggtttcgttaggtagagttcgaggtcgagttttttttttttgttcgtcggttaggtttcgttttcgggcgggtagaggacgaggtgcgcggaggtcggagtttttagtttcggggttgtagggagttcgggggatattcgtcgtcgtttcgcgtattttggttcggggttaagtttgtaggatttcgcgtttcgtattttcggtttcgagaattgaggtggggtggggggagttcggtggggggtgcgttttgcgcggtgtttatagtttatgatttgcggtcggggacggttattatgcggggtttttcgtcggttagttttaggttttcgttattatcgtcgcggtcgcgcggaggggtttttgtggatgtcgcgtttcggtcgtcgggtttcgtagttttgtaagtcgcgcgtcgcgagattcgcgttttaaaagttaaatttttcgaaagggttagtt

SEQ ID NO: 29316 - DNA, 938 bp, Artificial Sequence
  chemically treated genomic DNA (Homo sapiens) CpG-island No: 29316
aactaaccctttcgaaaaatttaacttttaaaacgcgaatctcgcgacgcgcgacttacaaaactacgaaacccgacgaccgaaacgcgacatccacaaaaacccctccgcgcgaccgcgacgataataacgaaaacctaaaactaaccgacgaaaaaccccgcataataaccgtccccgaccgcaaatcataaactataaacaccgcgcaaaacgcaccccccaccgaactccccccaccccacctcaattctcgaaaccgaaaatacgaaacgcgaaatcctacaaacttaaccccgaaccaaaatacgcgaaacgacgacgaatatcccccgaactccctacaaccccgaaactaaaaactccgacctccgcgcacctcgtcctctacccgcccgaaaacgaaacctaaccgacgaacaaaaaaaaaaaactcgacctcgaactctacctaacgaaaccccgacctaaaaacatccccgacccgcacctaacgacgcgacccacctacctacccgtccccaaaacgccgccaaaaacaacaacaacaacgacgacaacgacaacgaccgcaaaaccgaacgaccgaaaacccgcataaacgacgaaactaaatcacatatcgaaaaacaacaaactactcaatcccacgcccgctaaaaccaaacgcgaccgcgcgacctcaactccgcgcctaaaactctacgtaccacgctccaaacgacctaaatcccaaaacgcctccgccacaaccgcgtcccccaaacttccccaaaaaccaaaaacgaacgactcgcgaaacccccacgcgcgctcccccgactacccaactaaataacaacgcgaaaacaattctcgcgaatttataatccccaaccactcgactatcaatcctaaaaatctaaaaatttccacctctcgaaattcatacccaaacc

SEQ ID NO: 29317 - DNA, 521 bp, Artificial Sequence
  chemically treated genomic DNA (Homo sapiens) CpG-island No: 29317
atttcgtttgttttaacgaacgcgggcgcggggtttttttcgtaggttatataaggtagtcgcgggtggaggtagtagaggcgagcgtacgttcgtcgagggggaaaggggcgtggggaggcggtcggggcggtcggtatttttcgggcgtgagtgcgtagcgcgcgggggagcgtagggcgcggcggagtcgggttttagagcgcgggtgattcggggcgcgggtcgggagtcgggattttgttcgtcgtcgtcgttgtcgagcgtcgtttttgttttttgtaggaagggcgagcgcggcggttagcgtttagcgatttttcgtttttcgttaagttttaacgttttgttcgattagtcgcgcgtttttcggggtttcgtagattcgcgagatggtattaaggtaagattcgtttttttgttttttcgcgtttcgggtttttttaatatttttgttcgttttattttttttttttcgggtatattttgtaggaggaataacgggtagtgttggtgtttgt

SEQ ID NO: 29318 - DNA, 521 bp, Artificial Sequence
  chemically treated genomic DNA (Homo sapiens) CpG-island No: 29318
acaaacaccaacactacccgttattcctcctacaaaatatacccgaaaaaaaaaaaataaaacgaacaaaaatattaaaaaaacccgaaacgcgaaaaaacaaaaaaacgaatcttaccttaataccatctcgcgaatctacgaaaccccgaaaaacgcgcgactaatcgaacaaaacgttaaaacttaacgaaaaacgaaaaatcgctaaacgctaaccgccgcgctcgcccttcctacaaaaaacaaaaacgacgctcgacaacgacgacgacgaacaaaatcccgactcccgacccgcgccccgaatcacccgcgctctaaaacccgactccgccgcgccctacgctcccccgcgcgctacgcactcacgcccgaaaaataccgaccgccccgaccgcctccccacgcccctttccccctcgacgaacgtacgctcgcctctactacctccacccgcgactaccttatataacctacgaaaaaaaccccgcgcccgcgttcgttaaaacaaacgaaat

SEQ ID NO: 29319 - DNA, 521 bp, Artificial Sequence
  chemically treated genomic DNA (Homo sapiens) CpG-island No: 29319
gtagatattagtattgttcgttgttttttttgtaagatgtgttcgagggagaaaaggtgaggcgggtaagagtattggaggggttcgggacgcgaggaagtagagaagcgggttttattttggtgttatttcgcgggtttgcggagtttcggaaggcgcgcggttagtcgagtagagcgttggagtttagcggaggacgaagggtcgttgagcgttggtcgtcgcgttcgttttttttgtagggaataaaggcggcgttcggtagcggcggcggcgggtagaatttcggttttcggttcgcgtttcgagttattcgcgttttgaaattcgatttcgtcgcgttttgcgttttttcgcgcgttgcgtatttacgttcgggggatatcggtcgtttcggtcgtttttttacgtttttttttttttcgacggacgtgcgttcgtttttgttgtttttattcgcggttgttttatgtaatttgcgaggaaagtttcgcgttcgcgttcgttggggtaagcgggat

SEQ ID NO: 29320 - DNA, 521 bp, Artificial Sequence
  chemically treated genomic DNA (Homo sapiens) CpG-island No: 29320
atcccgcttaccccaacgaacgcgaacgcgaaactttcctcgcaaattacataaaacaaccgcgaataaaaacaacaaaaacgaacgcacgtccgtcgaaaaaaaaaaaaacgtaaaaaaacgaccgaaacgaccgatatcccccgaacgtaaatacgcaacgcgcgaaaaaacgcaaaacgcgacgaaatcgaatttcaaaacgcgaataactcgaaacgcgaaccgaaaaccgaaattctacccgccgccgccgctaccgaacgccgcctttattccctacaaaaaaaacgaacgcgacgaccaacgctcaacgacccttcgtcctccgctaaactccaacgctctactcgactaaccgcgcgccttccgaaactccgcaaacccgcgaaataacaccaaaataaaacccgcttctctacttcctcgcgtcccgaacccctccaatactcttacccgcctcaccttttctccctcgaacacatcttacaaaaaaaacaacgaacaatactaatatctac

SEQ ID NO: 29321 - DNA, 536 bp, Artificial Sequence
  chemically treated genomic DNA (Homo sapiens) CpG-island No: 29321
gtgagatgcggtcgttgaggtagatgttaatttggtgtagtcgtacgttttttttttgtagtcgtagtttttcgttttgtagttgtagtcgtatcgtttcgtttcgcgcgtttagcgcgttcgtcggtatcggcggtcgcggtatgatcggttcgcgtcgttcggggcgcggggtgcgcgggggtttcggttcggtagtttcggtttcggttttacgttgagttcgtagtatcgagtttagttcggttaacgttagtagcgttaggagtattaatagcgtttttcggtcgcgtcgtagtttttcgcgggtagcgcgtcgcgcgtcgtgcgtttttatatgcgttcgttaattggtagttagcgatttgcgcgttttaaggcggcggtggaggttaggattcggatttcggaatcgtcgtgtcgttcggttttcggttcgttttatttgcgcgtcgtttttttttcgtttagtttcgcgttagtttaagcgtagttttcggggtggtttatttcggtagggtttttaagtgggttgg

SEQ ID NO: 29322 - DNA, 536 bp, Artificial Sequence
  chemically treated genomic DNA (Homo sapiens) CpG-island No: 29322
ccaacccacttaaaaaccctaccgaaataaaccaccccgaaaactacgcttaaactaacgcgaaactaaacgaaaaaaaaacgacgcgcaaataaaacgaaccgaaaaccgaacgacacgacgattccgaaatccgaatcctaacctccaccgccgccttaaaacgcgcaaatcgctaactaccaattaacgaacgcatataaaaacgcacgacgcgcgacgcgctacccgcgaaaaactacgacgcgaccgaaaaacgctattaatactcctaacgctactaacgttaaccgaactaaactcgatactacgaactcaacgtaaaaccgaaaccgaaactaccgaaccgaaacccccgcgcaccccgcgccccgaacgacgcgaaccgatcataccgcgaccgccgataccgacgaacgcgctaaacgcgcgaaacgaaacgatacgactacaactacaaaacgaaaaactacgactacaaaaaaaaaacgtacgactacaccaaattaacatctacctcaacgaccgcatctcac

SEQ ID NO: 29323 - DNA, 536 bp, Artificial Sequence
  chemically treated genomic DNA (Homo sapiens) CpG-island No: 29323
ttagtttatttgaagattttgtcgaaatgagttatttcgggggttgcgtttgggttggcgcggggttggacggaaagggggcggcgcgtaggtggggcgggtcgggggtcgggcggtacggcggtttcgggattcgggttttggtttttatcgtcgttttggggcgcgtagatcgttggttgttagttggcgggcgtatgtgggggcgtacggcgcgcggcgcgttgttcgcgggaaattacggcgcggtcgggaggcgttgttggtgtttttggcgttattggcgttggtcgggttgggttcggtgttgcgggtttagcgtggggtcggggtcggggttgtcgagtcgggattttcgcgtatttcgcgtttcgggcggcgcgagtcggttatgtcgcggtcgtcggtgtcggcgaacgcgttgggcgcgcggggcgaggcggtgcggttgtagttgtagggcgaggagttgcggttgtaggaggagagcgtgcggttgtattagattaatatttattttagcgatcgtattttat

SEQ ID NO: 29324 - DNA, 536 bp, Artificial Sequence
  chemically treated genomic DNA (Homo sapiens) CpG-island No: 29324
ataaaatacgatcgctaaaataaatattaatctaatacaaccgcacgctctcctcctacaaccgcaactcctcgccctacaactacaaccgcaccgcctcgccccgcgcgcccaacgcgttcgccgacaccgacgaccgcgacataaccgactcgcgccgcccgaaacgcgaaatacgcgaaaatcccgactcgacaaccccgaccccgaccccacgctaaacccgcaacaccgaacccaacccgaccaacgccaataacgccaaaaacaccaacaacgcctcccgaccgcgccgtaatttcccgcgaacaacgcgccgcgcgccgtacgcccccacatacgcccgccaactaacaaccaacgatctacgcgccccaaaacgacgataaaaaccaaaacccgaatcccgaaaccgccgtaccgcccgacccccgacccgccccacctacgcgccgccccctttccgtccaaccccgcgccaacccaaacgcaacccccgaaataactcatttcgacaaaatcttcaaataaactaa

SEQ ID NO: 29325 - DNA, 597 bp, Artificial Sequence
  chemically treated genomic DNA (Homo sapiens) CpG-island No: 29325
tttttttcgaggttttttaattttttggttttcgcgtaggaacgtttattttcgttgtgttcgcgtttgcgttttcgacgtttttttgaataggaaatatttgattagggtttgaataggttttttcgttttcggttcgtatatttcgcggttcgttattttatttcgtcgcgtttaggtcgacgtcgttcgtttttgattcggattagcgagtttagcgtcgggcggtttagatacgtgaagttttgtaatagtttttatttgtcgcgttggaagttgcggttggagttttgcgtcgcgcggttttttagcgtttagaatacgtcggtgtttagcgttaggtaagttaggtaggcgagtagtaggagtacggtgttgggtatcgcgtagtttcggattttgttttcgggagtcgttcgggttcgcggtcggtatatagcgggagaggcggggagtcggcgtcgggagcggtggattaggattcggtgggagggaagggttaggcgtttagttcgtattttttttcgtaaacgtttgttggtgttcggtttcgtcggggaggaggagtgttggggaatgggatagtttggttttatt

SEQ ID NO: 29326 - DNA, 597 bp, Artificial Sequence
  chemically treated genomic DNA (Homo sapiens) CpG-island No: 29326
aataaaaccaaactatcccattccccaacactcctcctccccgacgaaaccgaacaccaacaaacgtttacgaaaaaaaatacgaactaaacgcctaacccttccctcccaccgaatcctaatccaccgctcccgacgccgactccccgcctctcccgctatataccgaccgcgaacccgaacgactcccgaaaacaaaatccgaaactacgcgatacccaacaccgtactcctactactcgcctacctaacttacctaacgctaaacaccgacgtattctaaacgctaaaaaaccgcgcgacgcaaaactccaaccgcaacttccaacgcgacaaataaaaactattacaaaacttcacgtatctaaaccgcccgacgctaaactcgctaatccgaatcaaaaacgaacgacgtcgacctaaacgcgacgaaataaaataacgaaccgcgaaatatacgaaccgaaaacgaaaaaacctattcaaaccctaatcaaatatttcctattcaaaaaaacgtcgaaaacgcaaacgcgaacacaacgaaaataaacgttcctacgcgaaaaccaaaaaattaaaaaacctcgaaaaaaa

SEQ ID NO: 29327 - DNA, 597 bp, Artificial Sequence
  chemically treated genomic DNA (Homo sapiens) CpG-island No: 29327
ggtggggttaggttgttttattttttaatatttttttttttcggcgaaatcgggtattagtaggcgtttgcgagaggagatacgagttggacgtttggttttttttttttatcgggttttagtttatcgttttcggcgtcggtttttcgtttttttcgttatgtatcgatcgcgagttcgggcggttttcgagggtagggttcggggttgcgcggtgtttagtatcgtgtttttgttgttcgtttatttggtttatttggcgttgggtatcggcgtgttttggacgttggagggtcgcgcggcgtaggattttagtcgtagtttttagcgcgataagtgggagttgttgtagaattttacgtgtttggatcgttcggcgttggattcgttgattcgggttaggggcgagcggcgtcggtttgggcgcggcgggatggggtagcgggtcgcggggtgtacgggtcgagggcgagggggtttatttaggttttggttaggtgttttttgtttagggaaacgtcgggaacgtagacgcgggtataacgggggtgggcgtttttgcgcggggattagagggttgggggatttcggaggaaa

SEQ ID NO: 29328 - DNA, 597 bp, Artificial Sequence
  chemically treated genomic DNA (Homo sapiens) CpG-island No: 29328
tttcctccgaaatcccccaaccctctaatccccgcgcaaaaacgcccacccccgttatacccgcgtctacgttcccgacgtttccctaaacaaaaaacacctaaccaaaacctaaataaaccccctcgccctcgacccgtacaccccgcgacccgctaccccatcccgccgcgcccaaaccgacgccgctcgcccctaacccgaatcaacgaatccaacgccgaacgatccaaacacgtaaaattctacaacaactcccacttatcgcgctaaaaactacgactaaaatcctacgccgcgcgaccctccaacgtccaaaacacgccgatacccaacgccaaataaaccaaataaacgaacaacaaaaacacgatactaaacaccgcgcaaccccgaaccctaccctcgaaaaccgcccgaactcgcgatcgatacataacgaaaaaaacgaaaaaccgacgccgaaaacgataaactaaaacccgataaaaaaaaaaaaccaaacgtccaactcgtatctcctctcgcaaacgcctactaatacccgatttcgccgaaaaaaaaaaatattaaaaaataaaacaacctaaccccacc

SEQ ID NO: 29329 - DNA, 655 bp, Artificial Sequence
  chemically treated genomic DNA (Homo sapiens) CpG-island No: 29329
cgtgtttcgtaagggagttttcgtttttattattttcggttttaggcggagcgtagtttttcgcggtttcgttgtcgttgttttcggtttttttttcgttttcgttttcgtgggttaggtcggtattttggacggtagcggtgacgttggtttcgcgcgcggattggaggttcgttagaagtagttagtcgatagttattagtagttcggcggagtagttcgtgtttttggggtttatggttttcggtttcgacggtcgttcgaggcgtagtcgtcgtcgcggtttttgaggataggtacgtcgaagagagttgcgatatttcgttcgtagtcgttcggtttcgaatttcgtgacgaatcgtgacgttttaatggttgtcggggcgttgtttcggtgttgagcgtttggaattcgcgcggagttaggttgcgaggcgtgtaagacggaacgcgacgagaagtcgcgtgcgataagtttttaggagaggacgtcgttttttttcgtaatcggaagttttttgtttagggcgtttttttgagtttttcgggtgcggtaggcgttgttgtcggttgttttttttgttttagtttatggagcgattttttagttttttcgtttattttgtttgtttttttttaagatatttttttttcg

SEQ ID NO: 29330 - DNA, 655 bp, Artificial Sequence
  chemically treated genomic DNA (Homo sapiens) CpG-island No: 29330
cgaaaaaaaaatatcttaaaaaaaaacaaacaaaataaacgaaaaaactaaaaaatcgctccataaactaaaacaaaaaaaacaaccgacaacaacgcctaccgcacccgaaaaactcaaaaaaacgccctaaacaaaaaacttccgattacgaaaaaaaacgacgtcctctcctaaaaacttatcgcacgcgacttctcgtcgcgttccgtcttacacgcctcgcaacctaactccgcgcgaattccaaacgctcaacaccgaaacaacgccccgacaaccattaaaacgtcacgattcgtcacgaaattcgaaaccgaacgactacgaacgaaatatcgcaactctcttcgacgtacctatcctcaaaaaccgcgacgacgactacgcctcgaacgaccgtcgaaaccgaaaaccataaaccccaaaaacacgaactactccgccgaactactaataactatcgactaactacttctaacgaacctccaatccgcgcgcgaaaccaacgtcaccgctaccgtccaaaataccgacctaacccacgaaaacgaaaacgaaaaaaaaaccgaaaacaacgacaacgaaaccgcgaaaaactacgctccgcctaaaaccgaaaataataaaaacgaaaactcccttacgaaacacg

SEQ ID NO: 29331 - DNA, 655 bp, Artificial Sequence
  chemically treated genomic DNA (Homo sapiens) CpG-island No: 29331
cgaaaaagaaatgttttaaaagaaagtaggtagggtgagcgaggaggttgaagagtcgttttataaattgaggtagaaggagtagtcgatagtaacgtttatcgtattcggaaggtttaaggaggcgttttgggtagggaattttcggttgcggggaagggcggcgtttttttttagggatttgtcgtacgcggtttttcgtcgcgtttcgttttgtacgtttcgtagtttagtttcgcgcgagttttaggcgtttagtatcggagtagcgtttcggtaattattgaggcgttacggttcgttacgggattcggagtcgggcggttacgggcggggtgtcgtagtttttttcgacgtatttgtttttaggagtcgcggcggcgattgcgtttcggacggtcgtcggggtcgagaattatgagttttaggggtacgggttgtttcgtcgggttgttgatgattgtcggttggttgtttttggcgggtttttagttcgcgcgcgggattaacgttatcgttgtcgtttaggatgtcggtttggtttacgaaggcgagggcgaggaggagatcgaaaataacgatagcgagatcgcggagaattacgtttcgtttgaaatcgaggatggtgagggcgggagtttttttgcggggtacg

SEQ ID NO: 29332 - DNA, 655 bp, Artificial Sequence
  chemically treated genomic DNA (Homo sapiens) CpG-island No: 29332
cgtaccccgcaaaaaaactcccgccctcaccatcctcgatttcaaacgaaacgtaattctccgcgatctcgctatcgttattttcgatctcctcctcgccctcgccttcgtaaaccaaaccgacatcctaaacgacaacgataacgttaatcccgcgcgcgaactaaaaacccgccaaaaacaaccaaccgacaatcatcaacaacccgacgaaacaacccgtacccctaaaactcataattctcgaccccgacgaccgtccgaaacgcaatcgccgccgcgactcctaaaaacaaatacgtcgaaaaaaactacgacaccccgcccgtaaccgcccgactccgaatcccgtaacgaaccgtaacgcctcaataattaccgaaacgctactccgatactaaacgcctaaaactcgcgcgaaactaaactacgaaacgtacaaaacgaaacgcgacgaaaaaccgcgtacgacaaatccctaaaaaaaaacgccgcccttccccgcaaccgaaaattccctacccaaaacgcctccttaaaccttccgaatacgataaacgttactatcgactactccttctacctcaatttataaaacgactcttcaacctcctcgctcaccctacctactttcttttaaaacatttctttttcg

SEQ ID NO: 29333 - DNA, 720 bp, Artificial Sequence
  chemically treated genomic DNA (Homo sapiens) CpG-island No: 29333
gtttagcgggaggcggtttttatcggtttattcgagattttaattttaggcgttttgtagttttttttagatttttcgggatcgtgtttggtttttttattcgtacgttgcggttgcgtttttttttcgtaatattacgttggcgaatttggaaaggattaaatagttttattcgttaatttagcgcggcgggatcggtttaaaagggtttttgtagtttgcgtatgcggattcggcggtcgttatcgatttttcgtttgttttttttcgggcggtagtcgcggtttggagtttgttgatagttttgcgatcggcgggcgtagtttcgtttcgtgtttttacgttattttattagggacggggcggggcggcggttttcgtagtttattagcgcgaattacgatttcggcgagttcgggaggaaagtcgttagaaagaaggcgattggatggcggcggcgttttggggcgtagcgtcgttcgggtttcgtttatcgttgtttttttttgttgggttttagagttattgaggtttgagcgagagtcgacggcgggcgggcgtagttgttgtcggagcgtcggcgcgtgttggtgggttatatatttttttttttttttattcgcgagttttcggatatggtggttttcggtttcgtgattagtcggttgggttcggtatttttttttttgttagttttggtggatttgtagtacgaaggtg

SEQ ID NO: 29334 - DNA, 720 bp, Artificial Sequence
  chemically treated genomic DNA (Homo sapiens) CpG-island No: 29334
caccttcgtactacaaatccaccaaaactaacaaaaaaaaaaataccgaacccaaccgactaatcacgaaaccgaaaaccaccatatccgaaaactcgcgaataaaaaaaaaaaaaaatatataacccaccaacacgcgccgacgctccgacaacaactacgcccgcccgccgtcgactctcgctcaaacctcaataactctaaaacccaacaaaaaaaaacaacgataaacgaaacccgaacgacgctacgccccaaaacgccgccgccatccaatcgccttctttctaacgactttcctcccgaactcgccgaaatcgtaattcgcgctaataaactacgaaaaccgccgccccgccccgtccctaataaaataacgtaaaaacacgaaacgaaactacgcccgccgatcgcaaaactatcaacaaactccaaaccgcgactaccgcccgaaaaaaaacaaacgaaaaatcgataacgaccgccgaatccgcatacgcaaactacaaaaacccttttaaaccgatcccgccgcgctaaattaacgaataaaactatttaatcctttccaaattcgccaacgtaatattacgaaaaaaaaacgcaaccgcaacgtacgaataaaaaaaccaaacacgatcccgaaaaatctaaaaaaaactacaaaacgcctaaaattaaaatctcgaataaaccgataaaaaccgcctcccgctaaac

SEQ ID NO: 29335 - DNA, 720 bp, Artificial Sequence
  chemically treated genomic DNA (Homo sapiens) CpG-island No: 29335
tattttcgtattgtagatttattaggattagtaggaaggggaatatcgagtttagtcggttggttacggagtcgggggttattatgttcgagggttcgcgagtgaagaggaggaaaggtgtgtggtttattagtacgcgtcggcgtttcggtagtagttgcgttcgttcgtcgtcggttttcgtttaggttttagtggttttggagtttagtagaggaaggtagcggtgggcggggttcgggcgacgttacgttttagagcgtcgtcgttatttaatcgttttttttttggcggtttttttttcgggttcgtcggggtcgtggttcgcgttgataggttgcggaggtcgtcgtttcgtttcgtttttgataggataacgtggaagtacgagacgaggttgcgttcgtcggtcgtagagttgttagtaagttttaaatcgcggttgtcgttcggagggaagtagacggggagtcggtggcggtcgtcgagttcgtatgcgtaggttgtaaaggtttttttgggtcggtttcgtcgcgttaggttggcgagtgggattatttgattttttttaggttcgttagcgtggtgttacgagaggaaagcgtagtcgtagcgtacgaatgggaaggttaaatacggtttcggggagtttgagggaagttgtagggcgtttggaattggggtttcgagtgagtcggtaaaaatcgtttttcgttgagt

SEQ ID NO: 29336 - DNA, 720 bp, Artificial Sequence
  chemically treated genomic DNA (Homo sapiens) CpG-island No: 29336
actcaacgaaaaacgatttttaccgactcactcgaaaccccaattccaaacgccctacaacttccctcaaactccccgaaaccgtatttaaccttcccattcgtacgctacgactacgctttcctctcgtaacaccacgctaacgaacctaaaaaaaatcaaataatcccactcgccaacctaacgcgacgaaaccgacccaaaaaaacctttacaacctacgcatacgaactcgacgaccgccaccgactccccgtctacttccctccgaacgacaaccgcgatttaaaacttactaacaactctacgaccgacgaacgcaacctcgtctcgtacttccacgttatcctatcaaaaacgaaacgaaacgacgacctccgcaacctatcaacgcgaaccacgaccccgacgaacccgaaaaaaaaaccgccaaaaaaaaaacgattaaataacgacgacgctctaaaacgtaacgtcgcccgaaccccgcccaccgctaccttcctctactaaactccaaaaccactaaaacctaaacgaaaaccgacgacgaacgaacgcaactactaccgaaacgccgacgcgtactaataaaccacacacctttcctcctcttcactcgcgaaccctcgaacataataacccccgactccgtaaccaaccgactaaactcgatattccccttcctactaatcctaataaatctacaatacgaaaata

SEQ ID NO: 29337 - DNA, 728 bp, Artificial Sequence
  chemically treated genomic DNA (Homo sapiens) CpG-island No: 29337
agcgcgcgggcgtgcgagtagcgaaagggataggggtaaagtgagtgatttgtttttgggggtgatcgtcggagcgcggcgtgagtttttttttttgggatttcgtagttgattagtcgcgttgacggatagatagatagatatcgtttttagttttagttattatttttttttcggtcggcggcggatagtggacgcggcggcgagtcgcgggtaggggtcggagttcgcgttcggaggcggggtggagggggtcggggttcgcggcgtcgtattgaaatttttcgtttaatttttgggttgttttcgtttcggaggagtcgtggttcgcgcgggggaagtcgagtcgagcggagtcgcgagaagtgttagttcgggtcgggaggagtcgtagtcggaggagggggaggaggaagaagagaaggaagaggagagggggtcgtagtggcgattcggcgttcggaagtcgggtttatggacgggtgaggcggcggtgtgcgtagatagtgttttagtcgcgcgcgttttttaggttttggttcgggtttcgggtcggggaggaagagtagttcgtcgaggcgtcgaggagagcgggtcgttttatagttcgagtcggagagggagcgcgagtcgcgtcggtttcggtcgggttttcgaaattatgaattttttgttgttttgggtgtattggagttttgttttgttgttttatttttattatgttaagg

SEQ ID NO: 29338 - DNA, 728 bp, Artificial Sequence
  chemically treated genomic DNA (Homo sapiens) CpG-island No: 29338
ccttaacataataaaaataaaacaacaaaacaaaactccaatacacccaaaacaacaaaaaattcataatttcgaaaacccgaccgaaaccgacgcgactcgcgctccctctccgactcgaactataaaacgacccgctctcctcgacgcctcgacgaactactcttcctccccgacccgaaacccgaaccaaaacctaaaaaacgcgcgcgactaaaacactatctacgcacaccgccgcctcacccgtccataaacccgacttccgaacgccgaatcgccactacgaccccctctcctcttccttctcttcttcctcctccccctcctccgactacgactcctcccgacccgaactaacacttctcgcgactccgctcgactcgacttcccccgcgcgaaccacgactcctccgaaacgaaaacaacccaaaaattaaacgaaaaatttcaatacgacgccgcgaaccccgaccccctccaccccgcctccgaacgcgaactccgacccctacccgcgactcgccgccgcgtccactatccgccgccgaccgaaaaaaaaataataactaaaactaaaaacgatatctatctatctatccgtcaacgcgactaatcaactacgaaatcccaaaaaaaaaaactcacgccgcgctccgacgatcacccccaaaaacaaatcactcactttacccctatccctttcgctactcgcacgcccgcgcgct

SEQ ID NO: 29339 - DNA, 728 bp, Artificial Sequence
  chemically treated genomic DNA (Homo sapiens) CpG-island No: 29339
ttttggtatggtggaggtagagtagtaaggtaaggttttaatgtatttaagatagtagaaagtttatggtttcggaggttcgatcggggtcggcgcggttcgcgtttttttttcggttcgggttgtggggcggttcgtttttttcggcgtttcggcgagttatttttttttttcggttcgaggttcgggttagggtttggggagcgcgcgcggttggagtattgtttgcgtatatcgtcgttttattcgtttatgagttcggttttcgagcgtcgagtcgttattgcggttttttttttttttttttttttttttttttttttttttttttcggttgcggtttttttcggttcgagttagtatttttcgcggtttcgttcggttcggtttttttcgcgcggattacggttttttcgaagcgagaatagtttagaagttggacgaaaagttttagtgcgacgtcgcgagtttcgattttttttatttcgttttcgggcgcgggtttcggtttttgttcgcggttcgtcgtcgcgtttattgttcgtcgtcggtcggggaggaggtggtagttggggttgggggcggtgtttgtttgtttgttcgttagcgcgattggttagttgcgggattttaagggggagggtttacgtcgcgtttcggcggttatttttaaaagtaggttatttattttgtttttgtttttttcgttgttcgtacgttcgcgcgtt

SEQ ID NO: 29340 - DNA, 728 bp, Artificial Sequence
  chemically treated genomic DNA (Homo sapiens) CpG-island No: 29340
aacgcgcgaacgtacgaacaacgaaaaaaacaaaaacaaaataaataacctacttttaaaaataaccgccgaaacgcgacgtaaaccctcccccttaaaatcccgcaactaaccaatcgcgctaacgaacaaacaaacaaacaccgcccccaaccccaactaccacctcctccccgaccgacgacgaacaataaacgcgacgacgaaccgcgaacaaaaaccgaaacccgcgcccgaaaacgaaataaaaaaaatcgaaactcgcgacgtcgcactaaaacttttcgtccaacttctaaactattctcgcttcgaaaaaaccgtaatccgcgcgaaaaaaaccgaaccgaacgaaaccgcgaaaaatactaactcgaaccgaaaaaaaccgcaaccgaaaaaaaaaaaaaaaaaaaaaaaaaaaaaaaaaaaaaaaaaaccgcaataacgactcgacgctcgaaaaccgaactcataaacgaataaaacgacgatatacgcaaacaatactccaaccgcgcgcgctccccaaaccctaacccgaacctcgaaccgaaaaaaaaaaataactcgccgaaacgccgaaaaaaacgaaccgccccacaacccgaaccgaaaaaaaaacgcgaaccgcgccgaccccgatcgaacctccgaaaccataaactttctactatcttaaatacattaaaaccttaccttactactctacctccaccataccaaaa

SEQ ID NO: 29341 - DNA, 637 bp, Artificial Sequence
  chemically treated genomic DNA (Homo sapiens) CpG-island No: 29341
aaagacgtcgcgaggagagtttttgttttcgtttttttcgtttcgcgttttattcgtattagtttacgtcgttttcggaaattttataattaattttttttagagttcgtgcgcgcggcgagtgggttagaaggagaaatcgggataatcgtatttcgggattagagatgttttttttcgcgtttttttttggatagggagtattattttttgtatcgttcgttttagtttgcgagttgggcgattcgcggtgttagggcgagcggagtacgcgttttttttagttttttaagcgaatgatgtttttttagtttggacgcgtatagtattgggtagtggggtcggagataaagaagcggtcgtcggttacgcgtagggtcgcggttttggtcgtaaagtgaggtcgagagcgtaggaagagtacgggtgtgagtcgcgttcgtcgggtcgggtttttgcgcgtttcgtttcgttttcggattttagcgagtagtcgcgaggtaggatttagggatcgttcgggcggattttttggaacgtcggtttttttatttgcggggagtttcgatatttgcgtcgtttttttgcggagttttgggttttttgggtagttagtcgtttattggaagtttaggaa

SEQ ID NO: 29342 - DNA, 637 bp, Artificial Sequence
  chemically treated genomic DNA (Homo sapiens) CpG-island No: 29342
ttcctaaacttccaataaacgactaactacccaaaaaacccaaaactccgcaaaaaaacgacgcaaatatcgaaactccccgcaaataaaaaaaccgacgttccaaaaaatccgcccgaacgatccctaaatcctacctcgcgactactcgctaaaatccgaaaacgaaacgaaacgcgcaaaaacccgacccgacgaacgcgactcacacccgtactcttcctacgctctcgacctcactttacgaccaaaaccgcgaccctacgcgtaaccgacgaccgcttctttatctccgaccccactacccaatactatacgcgtccaaactaaaaaaacatcattcgcttaaaaaactaaaaaaaacgcgtactccgctcgccctaacaccgcgaatcgcccaactcgcaaactaaaacgaacgatacaaaaaataatactccctatccaaaaaaaaacgcgaaaaaaaacatctctaatcccgaaatacgattatcccgatttctccttctaacccactcgccgcgcgcacgaactctaaaaaaaattaattataaaatttccgaaaacgacgtaaactaatacgaataaaacgcgaaacgaaaaaaacgaaaacaaaaactctcctcgcgacgtcttt

SEQ ID NO: 29343 - DNA, 637 bp, Artificial Sequence
  chemically treated genomic DNA (Homo sapiens) CpG-island No: 29343
tttttgagtttttagtaggcgattgattgtttaagagatttagggtttcgtaaggagacggcgtaggtgtcggggtttttcgtaggtgaggaggtcgacgttttaggaggttcgttcgggcggtttttgagttttgtttcgcggttgttcgttgggattcgagggcggaacgggacgcgtaggaattcggttcgacgggcgcggtttatattcgtgttttttttgcgttttcggttttattttgcggttagagtcgcggttttgcgcgtggtcggcggtcgtttttttattttcgattttattgtttagtattgtacgcgtttagattaaagaaatattattcgtttaaggggttgggaaaagcgcgtgtttcgttcgttttggtatcgcgggtcgtttagttcgtagattgggacgggcggtgtaagaggtggtgttttttgtttaggaggggacgcggaagagggtatttttggtttcgggatgcgattgtttcggtttttttttttggtttattcgtcgcgcgtacgaattttaggggaagttggttgtaaagttttcgagagcggcgtgggttggtgcgagtgaagcgcggggcgggggaggcgaggatagaagtttttttcgcggcgttttt

SEQ ID NO: 29344 - DNA, 637 bp, Artificial Sequence
  chemically treated genomic DNA (Homo sapiens) CpG-island No: 29344
aaaaacgccgcgaaaaaaacttctatcctcgcctcccccgccccgcgcttcactcgcaccaacccacgccgctctcgaaaactttacaaccaacttcccctaaaattcgtacgcgcgacgaataaaccaaaaaaaaaaaccgaaacaatcgcatcccgaaaccaaaaataccctcttccgcgtcccctcctaaacaaaaaacaccacctcttacaccgcccgtcccaatctacgaactaaacgacccgcgataccaaaacgaacgaaacacgcgcttttcccaaccccttaaacgaataatatttctttaatctaaacgcgtacaatactaaacaataaaatcgaaaataaaaaaacgaccgccgaccacgcgcaaaaccgcgactctaaccgcaaaataaaaccgaaaacgcaaaaaaaacacgaatataaaccgcgcccgtcgaaccgaattcctacgcgtcccgttccgccctcgaatcccaacgaacaaccgcgaaacaaaactcaaaaaccgcccgaacgaacctcctaaaacgtcgacctcctcacctacgaaaaaccccgacacctacgccgtctccttacgaaaccctaaatctcttaaacaatcaatcgcctactaaaaactcaaaaa

SEQ ID NO: 29345 - DNA, 921 bp, Artificial Sequence
  chemically treated genomic DNA (Homo sapiens) CpG-island No: 29345
ttattcgcgttgttatttatattatttttttgtttataaagagttcgcgtttgggacgtttcgtaggttgaagggaggtttgggcgttcgcgattcgtttgtttttttttttttcgcgggttttttttttttttattttttttcgttattattttttttttttttttttcgcgaatttagtttatttttcgttttaggatttcggttcggttttagtttttcggattaggtcgggttacgtgggtttagggttacgtgtcgttgcgggttacgtgtcgttgcgggttacgtgtcggtttgtattacgcgtgagggggcgcgcggtgttggaagttgtcgtatttgcggggagtcgagtcgtcggcgttcgacgcgcgcgttttcgcgagattcgcgggattacgtgacgttcgggcgcggcgtagtttacgtgataagcgttgtcggtcgcggtgtttttttcgtgtcggcgtcgtagtggtcgggttttttgcgtttggtaacgtcgttgtttttaacgttagtttttggcgttcgcgtttcgttatcgtagcgttcggtagttcgcggtttaatcgtcgttcgcgttttcgtttttcgtatcgtattcggtcgtttcgcgttatggcggttttcggtagcgttcggcgatttttgttgttgttattgttgttgttgttgttcggtgagggggtcgaggcggggtttgggagcggcgggatcgggcggagtcgaggtttttgggttttgagggcgggggattgtcgggtcgttgtttcgcgggtcgtttcgtatttattgtttttggtttcggtcggttttgttcgcgggcgggtgtttttttcggggtcgtagggtcggagcggagtttaatggtaggtgtttgggggattaggaggttttattttaggatttggtttt

SEQ ID NO: 29346 - DNA, 921 bp, Artificial Sequence
  chemically treated genomic DNA (Homo sapiens) CpG-island No: 29346
aaaaccaaatcctaaaataaaacctcctaatcccccaaacacctaccattaaactccgctccgaccctacgaccccgaaaaaaacacccgcccgcgaacaaaaccgaccgaaaccaaaaacaataaatacgaaacgacccgcgaaacaacgacccgacaatcccccgccctcaaaacccaaaaacctcgactccgcccgatcccgccgctcccaaaccccgcctcgaccccctcaccgaacaacaacaacaacaataacaacaacaaaaatcgccgaacgctaccgaaaaccgccataacgcgaaacgaccgaatacgatacgaaaaacgaaaacgcgaacgacgattaaaccgcgaactaccgaacgctacgataacgaaacgcgaacgccaaaaactaacgttaaaaacaacgacgttaccaaacgcaaaaaacccgaccactacgacgccgacacgaaaaaaacaccgcgaccgacaacgcttatcacgtaaactacgccgcgcccgaacgtcacgtaatcccgcgaatctcgcgaaaacgcgcgcgtcgaacgccgacgactcgactccccgcaaatacgacaacttccaacaccgcgcgccccctcacgcgtaatacaaaccgacacgtaacccgcaacgacacgtaacccgcaacgacacgtaaccctaaacccacgtaacccgacctaatccgaaaaactaaaaccgaaccgaaatcctaaaacgaaaaataaactaaattcgcgaaaaaaaaaaaaaaaaaataataacgaaaaaaaataaaaaaaaaaaaaacccgcgaaaaaaaaaaaaacaaacgaatcgcgaacgcccaaacctcccttcaacctacgaaacgtcccaaacgcgaactctttataaacaaaaaaataatataaataacaacgcgaataa

SEQ ID NO: 29347 - DNA, 921 bp, Artificial Sequence
  chemically treated genomic DNA (Homo sapiens) CpG-island No: 29347
ggagttaggttttgggatgagattttttggttttttaagtatttgttattgagtttcgtttcgattttacgatttcgagagaaatattcgttcgcgggtagagtcggtcgggattaggagtagtgggtgcggggcgattcgcgggataacgattcggtagtttttcgtttttaagatttagggatttcggtttcgttcggtttcgtcgtttttaggtttcgtttcgatttttttatcgagtagtagtaatagtagtagtagtagtaggggtcgtcgggcgttgtcgggggtcgttatggcgcgaggcggtcgggtacggtgcggggagcgggggcgcgggcggcggttgggtcgcggattgtcgggcgttgcggtggcggggcgcgggcgttaagggttggcgttagagatagcggcgttattagacgtaagaggttcggttattgcgacgtcggtacgaagaagatatcgcggtcggtagcgtttgttacgtgagttgcgtcgcgttcgggcgttacgtgatttcgcgggtttcgcgagagcgcgcgcgtcgagcgtcggcggttcggtttttcgtaggtgcggtagtttttagtatcgcgcgtttttttacgcgtgatgtaggtcgatacgtgattcgtagcggtacgtgattcgtagcggtacgtgattttggatttacgtgattcggtttggttcgggggattggggtcgagtcgaggttttgaaacgggaagtgggttgggttcgcggaaaaggaagaggaagagtagtggcgggagaaagtgaggaaagaggaagttcgcgaggggagaaagggtagacggatcgcggacgtttaggtttttttttagtttgcgaggcgttttaaacgcgggttttttatggataggagggtggtgtgggtggtagcgcgggtga

SEQ ID NO: 29348 - DNA, 921 bp, Artificial Sequence
  chemically treated genomic DNA (Homo sapiens) CpG-island No: 29348
tcacccgcgctaccacccacaccaccctcctatccataaaaaacccgcgtttaaaacgcctcgcaaactaaaaaaaaacctaaacgtccgcgatccgtctaccctttctcccctcgcgaacttcctctttcctcactttctcccgccactactcttcctcttccttttccgcgaacccaacccacttcccgtttcaaaacctcgactcgaccccaatcccccgaaccaaaccgaatcacgtaaatccaaaatcacgtaccgctacgaatcacgtaccgctacgaatcacgtatcgacctacatcacgcgtaaaaaaacgcgcgatactaaaaactaccgcacctacgaaaaaccgaaccgccgacgctcgacgcgcgcgctctcgcgaaacccgcgaaatcacgtaacgcccgaacgcgacgcaactcacgtaacaaacgctaccgaccgcgatatcttcttcgtaccgacgtcgcaataaccgaacctcttacgtctaataacgccgctatctctaacgccaacccttaacgcccgcgccccgccaccgcaacgcccgacaatccgcgacccaaccgccgcccgcgcccccgctccccgcaccgtacccgaccgcctcgcgccataacgacccccgacaacgcccgacgacccctactactactactactattactactactcgataaaaaaatcgaaacgaaacctaaaaacgacgaaaccgaacgaaaccgaaatccctaaatcttaaaaacgaaaaactaccgaatcgttatcccgcgaatcgccccgcacccactactcctaatcccgaccgactctacccgcgaacgaatatttctctcgaaatcgtaaaatcgaaacgaaactcaataacaaatacttaaaaaaccaaaaaatctcatcccaaaacctaactcc

SEQ ID NO: 29349 - DNA, 1129 bp, Artificial Sequence
  chemically treated genomic DNA (Homo sapiens) CpG-island No: 29349
aagtcgttttttttgaagtgggagatggtcggggaggcgtagtttcgtcgtttttaagcggcggttttcgagcggcgattattttattattttttaatttagtttttttcggtttttcgtttttttttcgatttcgttttcgaaattattagtttaatttatttttttttattttagatattttgttaggcgatagttacgtcgattttggtgttcgcggggtttagtttaaagaagggagaagtcgtttgtttcgtgtagcgttcgttataacggtttttttaatcgtttttagcggtgataatcgtttagggagttgcgtagtatagttattggtttggggggatgggagggaacgagtaagaagtggggggcggagcgagaattgcgaaggcggtcggttttattttcgcgagacgggaaagtcggtttcgtatggcgttggcggtacgtagcgcgtttgcgcggtggtgggttgcgtagttgttgggggcgaggtagatcgagtagaggttgttttagttaaagagttgtagcgcgtatcgttttttttgtttacgttagaattatttagtttttagagcgtattattttgtcgtttcggggcgatggtaatggtagttttgttagtgtgtagaaggaatcgtgtcgtagcgttttggagaagtttttcggtgatttgtttttatcgtgaataaattttgtgagggtttcgttttggttaggtatcgacggcgcggaaagggttttacgtggttcgatcggtaaacgcggggcggattttttggtttattatgtttgtattgtgcggtgaaaaataggagtgtttttgggtcgcgaagatgaaagcgtttattggggtcgatttcggttttcgggttgggtgttcgttttttttttttggtttagagttgttggtcgttcgttagcgcgtttcgttttaatgtgtcgcgcgggattcgggttttttgggtgtatttatgtttattacgttatcgttttttttgtaaatttttttttttttttttttttggttttcgcgtttttatttttttcgtcgttagtgtttcggagattgattagtttgtggaggtcgacgttgggttttttttatagttttgcgttgttg

SEQ ID NO: 29350 - DNA, 1129 bp, Artificial Sequence
  chemically treated genomic DNA (Homo sapiens) CpG-island No: 29350
caacaacgcaaaactataaaaaaaacccaacgtcgacctccacaaactaatcaatctccgaaacactaacgacgaaaaaaataaaaacgcgaaaaccaaaaaaaaaaaaaaaaaaaaatttacaaaaaaaacgataacgtaataaacataaatacacccaaaaaacccgaatcccgcgcgacacattaaaacgaaacgcgctaacgaacgaccaacaactctaaaccaaaaaaaaaaaacgaacacccaacccgaaaaccgaaatcgaccccaataaacgctttcatcttcgcgacccaaaaacactcctatttttcaccgcacaatacaaacataataaaccaaaaaatccgccccgcgtttaccgatcgaaccacgtaaaaccctttccgcgccgtcgatacctaaccaaaacgaaaccctcacaaaatttattcacgataaaaacaaatcaccgaaaaacttctccaaaacgctacgacacgattccttctacacactaacaaaactaccattaccatcgccccgaaacgacaaaataatacgctctaaaaactaaataattctaacgtaaacaaaaaaaacgatacgcgctacaactctttaactaaaacaacctctactcgatctacctcgcccccaacaactacgcaacccaccaccgcgcaaacgcgctacgtaccgccaacgccatacgaaaccgactttcccgtctcgcgaaaataaaaccgaccgccttcgcaattctcgctccgccccccacttcttactcgttccctcccatccccccaaaccaataactatactacgcaactccctaaacgattatcaccgctaaaaacgattaaaaaaaccgttataacgaacgctacacgaaacaaacgacttctcccttctttaaactaaaccccgcgaacaccaaaatcgacgtaactatcgcctaacaaaatatctaaaataaaaaaaaataaattaaactaataatttcgaaaacgaaatcgaaaaaaaaacgaaaaaccgaaaaaaactaaattaaaaaataataaaataatcgccgctcgaaaaccgccgcttaaaaacgacgaaactacgcctccccgaccatctcccacttcaaaaaaaacgactt

SEQ ID NO: 29351 - DNA, 1129 bp, Artificial Sequence
  chemically treated genomic DNA (Homo sapiens) CpG-island No: 29351
taataacgtaaaattataaaaaaaatttaacgtcggtttttataggttaattagttttcgaggtattgacggcgggagagatgaaaacgcgaaggttagaggagaaaaagaggaaggatttgtagagagaacggtaacgtggtggatatgaatatatttaagaaattcggatttcgcgcggtatattgggacgaagcgcgttggcgggcggttagtaattttgggttaggggaaggaggcggatatttagttcgagagtcgaaatcggttttagtggacgtttttattttcgcggtttagaaatatttttattttttatcgtataatgtaaatatggtggattagaaaattcgtttcgcgtttgtcggtcgaattacgtggggtttttttcgcgtcgtcgatgtttagttagggcggggtttttatagaatttgtttacggtgggggtagattatcggagaatttttttagagcgttacggtacggttttttttatatattggtagaattgttattgttatcgtttcgaggcggtagaatggtacgttttgaaaattggatggttttaacgtaagtaagaaaaacggtgcgcgttgtagttttttaattggaatagtttttgttcggtttatttcgtttttaatagttgcgtaatttattatcgcgtaggcgcgttgcgtgtcgttagcgttatgcgaaatcgattttttcgtttcgcgagagtggggtcggtcgttttcgtagttttcgtttcgttttttattttttgttcgtttttttttatttttttaagttagtagttgtgttgcgtagttttttaagcggttgttatcgttggagacggttgggagaatcgttgtggcgagcgttatacgaggtaaacgattttttttttttttgaattggatttcgcgagtattagagtcggcgtaattatcgtttgatagggtatttgaagtaaaagggggtaggttgggttggtggtttcgagagcggagtcgggagaaggacgaaaggtcgggaggggttgggttggggggtagtggggtggtcgtcgttcggaggtcgtcgtttggaagcggcggggttgcgttttttcgattattttttattttagggagggcggttt

SEQ ID NO: 29352 - DNA, 1129 bp, Artificial Sequence
  chemically treated genomic DNA (Homo sapiens) CpG-island No: 29352
aaaccgccctccctaaaataaaaaataatcgaaaaaacgcaaccccgccgcttccaaacgacgacctccgaacgacgaccaccccactaccccccaacccaacccctcccgacctttcgtccttctcccgactccgctctcgaaaccaccaacccaacctacccccttttacttcaaataccctatcaaacgataattacgccgactctaatactcgcgaaatccaattcaaaaaaaaaaaaaatcgtttacctcgtataacgctcgccacaacgattctcccaaccgtctccaacgataacaaccgcttaaaaaactacgcaacacaactactaacttaaaaaaataaaaaaaaacgaacaaaaaataaaaaacgaaacgaaaactacgaaaacgaccgaccccactctcgcgaaacgaaaaaatcgatttcgcataacgctaacgacacgcaacgcgcctacgcgataataaattacgcaactattaaaaacgaaataaaccgaacaaaaactattccaattaaaaaactacaacgcgcaccgtttttcttacttacgttaaaaccatccaattttcaaaacgtaccattctaccgcctcgaaacgataacaataacaattctaccaatatataaaaaaaaccgtaccgtaacgctctaaaaaaattctccgataatctacccccaccgtaaacaaattctataaaaaccccgccctaactaaacatcgacgacgcgaaaaaaaccccacgtaattcgaccgacaaacgcgaaacgaattttctaatccaccatatttacattatacgataaaaaataaaaatatttctaaaccgcgaaaataaaaacgtccactaaaaccgatttcgactctcgaactaaatatccgcctccttcccctaacccaaaattactaaccgcccgccaacgcgcttcgtcccaatataccgcgcgaaatccgaatttcttaaatatattcatatccaccacgttaccgttctctctacaaatccttcctctttttctcctctaaccttcgcgttttcatctctcccgccgtcaatacctcgaaaactaattaacctataaaaaccgacgttaaattttttttataattttacgttatta

SEQ ID NO: 29353 - DNA, 628 bp, Artificial Sequence
  chemically treated genomic DNA (Homo sapiens) CpG-island No: 29353
gggtcgttatcgttcgtttgggttcggttcgtagaaggtaggagttcggatcggtagagtcgaggttttatgtgagtcgcgcgggaggcgtagagggggttgtatcggacggaaggttgtatcggtggcgggcgtaagtagcggtcgttttttcggttgtgcggtcggagggttcgggcggtagtattttcgtttattcgggcggttttggttcgcggatttcgttttagttttatatttttttttcgtcgatattaggtcgcgttcgcgtgacggggtcgaaaacgtcggtatttttcggtcgtcgcgtcggtagtttcggggggtgattgtagttcggtcggcgtttcgtcgttcgtttcgtttagttcggggtcgcggtgacgggaggcggcggttaatttcggtcgattataagtcgacgagaattagttcggcgtcggtttttcgttttttttcgcgtcgtcgggtcggcgcggttaggcgggtttagatcgcggaagtatatttatttttatatcgcggtttttgtttttgaagtttttgatgcggtggttttttaagttggggttttcggttatggttgcgcgcggtttcggcggcggttatttttgcggttgcggcggcg

SEQ ID NO: 29354 - DNA, 628 bp, Artificial Sequence
  chemically treated genomic DNA (Homo sapiens) CpG-island No: 29354
cgccgccgcaaccgcaaaaataaccgccgccgaaaccgcgcgcaaccataaccgaaaaccccaacttaaaaaaccaccgcatcaaaaacttcaaaaacaaaaaccgcgatataaaaataaatatacttccgcgatctaaacccgcctaaccgcgccgacccgacgacgcgaaaaaaaacgaaaaaccgacgccgaactaattctcgtcgacttataatcgaccgaaattaaccgccgcctcccgtcaccgcgaccccgaactaaacgaaacgaacgacgaaacgccgaccgaactacaatcaccccccgaaactaccgacgcgacgaccgaaaaataccgacgttttcgaccccgtcacgcgaacgcgacctaatatcgacgaaaaaaaaatataaaactaaaacgaaatccgcgaaccaaaaccgcccgaataaacgaaaatactaccgcccgaaccctccgaccgcacaaccgaaaaaacgaccgctacttacgcccgccaccgatacaaccttccgtccgatacaaccccctctacgcctcccgcgcgactcacataaaacctcgactctaccgatccgaactcctaccttctacgaaccgaacccaaacgaacgataacgaccc

SEQ ID NO: 29355 - DNA, 628 bp, Artificial Sequence
  chemically treated genomic DNA (Homo sapiens) CpG-island No: 29355
cgtcgtcgtagtcgtaggagtagtcgtcgtcggagtcgcgcgtagttatggtcgagaattttagtttggagaattatcgtattaagagttttaagaataagggtcgcgatgtggaagtgagtgtgttttcgcggtttgggttcgtttggtcgcgtcggttcggcgacgcggggaggggcggggggtcggcgtcgggttggttttcgtcggtttgtggtcggtcggagttggtcgtcgtttttcgttatcgcggtttcgggttgggcggagcgggcggcgagacgtcggtcgggttgtagttatttttcggagttgtcggcgcggcgatcgggaaatgtcggcgttttcggtttcgttacgcgggcgcggtttggtgtcggcgaggaggggatgtggagttgaggcggggttcgcgggttagggtcgttcggatgaacggggatgttgtcgttcgggtttttcgatcgtatagtcgagggggcggtcgttgtttgcgttcgttatcggtgtaatttttcgttcggtgtagttttttttgcgtttttcgcgcggtttatatggagtttcggttttgtcggttcgggtttttattttttgcgagtcgggtttaggcgggcggtggcggttt

SEQ ID NO: 29356 - DNA, 628 bp, Artificial Sequence
  chemically treated genomic DNA (Homo sapiens) CpG-island No: 29356
aaaccgccaccgcccgcctaaacccgactcgcaaaaaataaaaacccgaaccgacaaaaccgaaactccatataaaccgcgcgaaaaacgcaaaaaaaactacaccgaacgaaaaattacaccgataacgaacgcaaacaacgaccgccccctcgactatacgatcgaaaaacccgaacgacaacatccccgttcatccgaacgaccctaacccgcgaaccccgcctcaactccacatcccctcctcgccgacaccaaaccgcgcccgcgtaacgaaaccgaaaacgccgacatttcccgatcgccgcgccgacaactccgaaaaataactacaacccgaccgacgtctcgccgcccgctccgcccaacccgaaaccgcgataacgaaaaacgacgaccaactccgaccgaccacaaaccgacgaaaaccaacccgacgccgaccccccgcccctccccgcgtcgccgaaccgacgcgaccaaacgaacccaaaccgcgaaaacacactcacttccacatcgcgacccttattcttaaaactcttaatacgataattctccaaactaaaattctcgaccataactacgcgcgactccgacgacgactactcctacgactacgacgacg

SEQ ID NO: 29357 - DNA, 511 bp, Artificial Sequence
  chemically treated genomic DNA (Homo sapiens) CpG-island No: 29357
ttcgttgcgcgttaatcgacgttttagtttttaacgagataaatatagttaagttcggttttttcggcgggtagttgtgcgcgtacgtgtagtcgtagttaagtgtcggaggtatttcgggatttgtagtttatacgttttttgagggacgagagggttgaggagtgggtaggggcgtaggagagattttgcgtatgtgtaaatatgtgtcgagatcgaggaggttattgggtaatgtagttttttgttttttgggttgggaatgacggaggcggggtaaggggcggatttttcgttttcgttagcgttaattatggatatggggcggggttggaggattaggtatttttgtacgttttgtttcgtcggaagtggaggtcgcgggttttgagcgggtgaggcgcgcgggaatatcggcgtcgggattcggatgggggcgggtgggggacgttgtagttggggttatttgaggggagtttatggggtttgaaaggtatttgttaggcggtat

SEQ ID NO: 29358 - DNA, 511 bp, Artificial Sequence
  chemically treated genomic DNA (Homo sapiens) CpG-island No: 29358
ataccgcctaacaaatacctttcaaaccccataaactcccctcaaataaccccaactacaacgtcccccacccgcccccatccgaatcccgacgccgatattcccgcgcgcctcacccgctcaaaacccgcgacctccacttccgacgaaacaaaacgtacaaaaatacctaatcctccaaccccgccccatatccataattaacgctaacgaaaacgaaaaatccgccccttaccccgcctccgtcattcccaacccaaaaaacaaaaaactacattacccaataacctcctcgatctcgacacatatttacacatacgcaaaatctctcctacgcccctacccactcctcaaccctctcgtccctcaaaaaacgtataaactacaaatcccgaaatacctccgacacttaactacgactacacgtacgcgcacaactacccgccgaaaaaaccgaacttaactatatttatctcgttaaaaactaaaacgtcgattaacgcgcaacgaa

SEQ ID NO: 29359 - DNA, 511 bp, Artificial Sequence
  chemically treated genomic DNA (Homo sapiens) CpG-island No: 29359
gtatcgtttgatagatgttttttaggttttatgggttttttttaaatggttttagttgtagcgttttttattcgtttttattcgaatttcggcgtcggtgttttcgcgcgttttattcgtttagagttcgcggtttttattttcggcggggtaggacgtgtagaggtgtttagttttttagtttcgttttatatttatgattgacgttggcgaggacgaggagttcgttttttgtttcgttttcgttatttttagtttaaaaaataaaggattgtattatttagtggttttttcggtttcgatatatatttgtatatgcgtagaattttttttacgtttttgtttattttttagttttttcgttttttaggaaacgtatggattataagtttcgaaatgttttcggtatttagttacgattgtacgtgcgcgtatagttgttcgtcggaagaatcgagtttggttgtgtttatttcgttggggattaaggcgtcggttggcgcgtaacggg

SEQ ID NO: 29360 - DNA, 511 bp, Artificial Sequence
  chemically treated genomic DNA (Homo sapiens) CpG-island No: 29360
cccgttacgcgccaaccgacgccttaatccccaacgaaataaacacaaccaaactcgattcttccgacgaacaactatacgcgcacgtacaatcgtaactaaataccgaaaacatttcgaaacttataatccatacgtttcctaaaaaacgaaaaaactaaaaaataaacaaaaacgtaaaaaaaattctacgcatatacaaatatatatcgaaaccgaaaaaaccactaaataatacaatcctttattttttaaactaaaaataacgaaaacgaaacaaaaaacgaactcctcgtcctcgccaacgtcaatcataaatataaaacgaaactaaaaaactaaacacctctacacgtcctaccccgccgaaaataaaaaccgcgaactctaaacgaataaaacgcgcgaaaacaccgacgccgaaattcgaataaaaacgaataaaaaacgctacaactaaaaccatttaaaaaaaacccataaaacctaaaaaacatctatcaaacgatac

SEQ ID NO: 29361 - DNA, 501 bp, Artificial Sequence
  chemically treated genomic DNA (Homo sapiens) CpG-island No: 29361
cgttggcgttgaacgttgagcgtaggcggggaggttcggtatttttcgattttagtagcgtttttaaaatcgaagtttagtcggttagagaggatatttacgtgtatacggttttgatgttcgttttgtcgtttaggttttgcgggtagttggttatgttgtcgtttagtttgagtaaatagttcgaaaagtttttgaagatcgtatcgtatttgttcgttgtttttacggtttgtattagatacgttgcggggaggagggaatatcggttagtagcgttacgatttcgttttgtcgtttattgtttttttttgcgagattttggtttcgcgcggttttatcgtatcgggcggttttttttagcgtttagtttcggggttcgttagtgttaaaggtgaatgaaagacgtgatttaggaatgttcgatttgtagttaacgttgcgtttagtgtaaattgtcggtgtgtgagtaggtgtgggtgggtgggaggtaggtgagtt

SEQ ID NO: 29362 - DNA, 501 bp, Artificial Sequence
  chemically treated genomic DNA (Homo sapiens) CpG-island No: 29362
aactcacctacctcccacccacccacacctactcacacaccgacaatttacactaaacgcaacgttaactacaaatcgaacattcctaaatcacgtctttcattcacctttaacactaacgaaccccgaaactaaacgctaaaaaaaaccgcccgatacgataaaaccgcgcgaaaccaaaatctcgcaaaaaaaaacaataaacgacaaaacgaaatcgtaacgctactaaccgatattccctcctccccgcaacgtatctaatacaaaccgtaaaaacaacgaacaaatacgatacgatcttcaaaaacttttcgaactatttactcaaactaaacgacaacataaccaactacccgcaaaacctaaacgacaaaacgaacatcaaaaccgtatacacgtaaatatcctctctaaccgactaaacttcgattttaaaaacgctactaaaatcgaaaaataccgaacctccccgcctacgctcaacgttcaacgccaacg

SEQ ID NO: 29363 - DNA, 501 bp, Artificial Sequence
  chemically treated genomic DNA (Homo sapiens) CpG-island No: 29363
gatttatttattttttatttatttatatttgtttatatatcgataatttgtattagacgtagcgttagttgtaggtcgggtatttttgggttacgttttttatttatttttaatattggcgagtttcgaggttgggcgttgggagaggtcgttcgatgcgatgaggtcgcgcggagttagggtttcgtaggaaagggtagtgggcggtagggcggggtcgtggcgttgttgatcggtgttttttttttttcgtagcgtatttggtgtaggtcgtgagagtagcgggtaagtgcgatgcggtttttaagggtttttcggattgtttgtttaagttgggcgatagtatggttaattattcgtagggtttggacgataagacgaatattaagatcgtgtgtacgtaagtgttttttttggtcggttggatttcggttttgggggcgttattgaggtcggagagtgtcgagttttttcgtttgcgtttagcgtttagcgttagcg

SEQ ID NO: 29364 - DNA, 501 bp, Artificial Sequence
  chemically treated genomic DNA (Homo sapiens) CpG-island No: 29364
cgctaacgctaaacgctaaacgcaaacgaaaaaactcgacactctccgacctcaataacgcccccaaaaccgaaatccaaccgaccaaaaaaaacacttacgtacacacgatcttaatattcgtcttatcgtccaaaccctacgaataattaaccatactatcgcccaacttaaacaaacaatccgaaaaacccttaaaaaccgcatcgcacttacccgctactctcacgacctacaccaaatacgctacgaaaaaaaaaaaacaccgatcaacaacgccacgaccccgccctaccgcccactaccctttcctacgaaaccctaactccgcgcgacctcatcgcatcgaacgacctctcccaacgcccaacctcgaaactcgccaatattaaaaataaataaaaaacgtaacccaaaaatacccgacctacaactaacgctacgtctaatacaaattatcgatatataaacaaatataaataaataaaaaataaataaatc

SEQ ID NO: 29365 - DNA, 531 bp, Artificial Sequence
  chemically treated genomic DNA (Homo sapiens) CpG-island No: 29365
ttaggttgcgggcgcgcggttgtggttattttttttcgttttgaggtcgacgaattcggttggaagttgagtgtttagcggtttaaagtagttcgggcgtcgggagggcgttagagaagtatagcgttagggcggggaagaaagggtgaattttagaatcgaaattcgtattggcgtttacgattttgggcgtcggtttggttttcggtagttttttggcggttgcgtttgtgtgtgaatgtgtttcgggaggatcggatattttaatttttcggtttttaacgcgggcgtttgttcgcgagcgtcgggttagacgtcgaagaggaaggtgatcgaattcgtagtagttttcgagagcgtattcgtttgtaaattgttgtaggaagagcgaggcgggttttgcgttttttaattcggaacgggaagtattggggaagggatcgaggttaatttcgattttcgttggggtagatacgtaaatttttttaaattttcgagtttattttatagcgaatattaaatatttttgcg

SEQ ID NO: 29366 - DNA, 531 bp, Artificial Sequence
  chemically treated genomic DNA (Homo sapiens) CpG-island No: 29366
cgcaaaaatatttaatattcgctataaaataaactcgaaaatttaaaaaaatttacgtatctaccccaacgaaaatcgaaattaacctcgatcccttccccaatacttcccgttccgaattaaaaaacgcaaaacccgcctcgctcttcctacaacaatttacaaacgaatacgctctcgaaaactactacgaattcgatcaccttcctcttcgacgtctaacccgacgctcgcgaacaaacgcccgcgttaaaaaccgaaaaattaaaatatccgatcctcccgaaacacattcacacacaaacgcaaccgccaaaaaactaccgaaaaccaaaccgacgcccaaaatcgtaaacgccaatacgaatttcgattctaaaattcaccctttcttccccgccctaacgctatacttctctaacgccctcccgacgcccgaactactttaaaccgctaaacactcaacttccaaccgaattcgtcgacctcaaaacgaaaaaaaataaccacaaccgcgcgcccgcaacctaa

SEQ ID NO: 29367 - DNA, 531 bp, Artificial Sequence
  chemically treated genomic DNA (Homo sapiens) CpG-island No: 29367
cgtaagggtatttaatgttcgttgtaaggtgaattcggaggtttgagaaggtttacgtatttgttttagcggaggtcgaagttaatttcggttttttttttagtgtttttcgtttcggattaaaaagcgtaaggttcgtttcgttttttttgtagtaatttgtaaacgggtacgttttcggaagttgttacgggttcggttattttttttttcggcgtttggttcggcgttcgcggataggcgttcgcgttgggggtcgggggattgaggtgttcggttttttcgggatatatttatatataagcgtagtcgttagaaagttgtcgaggattaggtcggcgtttagggtcgtgggcgttagtgcggatttcgattttgagatttattttttttttttcgttttaacgttgtgtttttttggcgttttttcggcgttcgggttgttttgggtcgttaggtatttagtttttagtcgggttcgtcggttttagggcggaaagagatggttatagtcgcgcgttcgtagtttgg

SEQ ID NO: 29368 - DNA, 531 bp, Artificial Sequence
  chemically treated genomic DNA (Homo sapiens) CpG-island No: 29368
ccaaactacgaacgcgcgactataaccatctctttccgccctaaaaccgacgaacccgactaaaaactaaatacctaacgacccaaaacaacccgaacgccgaaaaaacgccaaaaaaacacaacgttaaaacgaaaaaaaaaaaataaatctcaaaatcgaaatccgcactaacgcccacgaccctaaacgccgacctaatcctcgacaactttctaacgactacgcttatatataaatatatcccgaaaaaaccgaacacctcaatcccccgacccccaacgcgaacgcctatccgcgaacgccgaaccaaacgccgaaaaaaaaaataaccgaacccgtaacaacttccgaaaacgtacccgtttacaaattactacaaaaaaaacgaaacgaaccttacgctttttaatccgaaacgaaaaacactaaaaaaaaaaccgaaattaacttcgacctccgctaaaacaaatacgtaaaccttctcaaacctccgaattcaccttacaacgaacattaaatacccttacg

SEQ ID NO: 29369 - DNA, 512 bp, Artificial Sequence
  chemically treated genomic DNA (Homo sapiens) CpG-island No: 29369
cggcgtgttttttcggtgcgtcgtttcgaggttcgagcgttttcgcgtgcgtggttgacggtttggagggcgttttttttgtcgcggtttttttgtagcggggggataaagagggcggcgggcggttggcggttttgagcgtagttcggtcggtagtgtagggtttgcgaagttcgcgggtcggcgtaggggtgggagtcgggttcggggtttagagagatttttcggggtcggggttgcggtttcgcgggtttttttatcggtcgggtttttcggtaattattagagagcgggggcgttcggggaggttcggcgttttataaggtttacgcgtattcgcgggtcgcggggtcgtcgtcggtcgtttaggcgcggagtttttcgggggttattcggtcgtcgggttcgcgggacgtacggggtcgttaggggaggataataagttttaggttttgtttttgcgtttcgttcggtttttttcgcggggttgcgtagtttattcggttattttg

SEQ ID NO: 29370 - DNA, 512 bp, Artificial Sequence
  chemically treated genomic DNA (Homo sapiens) CpG-island No: 29370
caaaataaccgaataaactacgcaaccccgcgaaaaaaaccgaacgaaacgcaaaaacaaaacctaaaacttattatcctcccctaacgaccccgtacgtcccgcgaacccgacgaccgaataacccccgaaaaactccgcgcctaaacgaccgacgacgaccccgcgacccgcgaatacgcgtaaaccttataaaacgccgaacctccccgaacgcccccgctctctaataattaccgaaaaacccgaccgataaaaaaacccgcgaaaccgcaaccccgaccccgaaaaatctctctaaaccccgaacccgactcccacccctacgccgacccgcgaacttcgcaaaccctacactaccgaccgaactacgctcaaaaccgccaaccgcccgccgccctctttatccccccgctacaaaaaaaccgcgacaaaaaaaacgccctccaaaccgtcaaccacgcacgcgaaaacgctcgaacctcgaaacgacgcaccgaaaaaacacgccg

SEQ ID NO: 29371 - DNA, 512 bp, Artificial Sequence
  chemically treated genomic DNA (Homo sapiens) CpG-island No: 29371
taggatggtcgagtgggttgcgtagtttcgcgggggaggtcgggcggggcgtagggatagggtttgaggtttgttgtttttttttggcggtttcgtgcgtttcgcgggttcggcggtcgggtgattttcgagaggtttcgcgtttgggcggtcggcggcgatttcgcggttcgcgaatacgcgtggattttgtggaacgtcgggttttttcgggcgttttcgttttttggtagttgtcgggagattcggtcggtggggaagttcgcggagtcgtagtttcggtttcggaaggtttttttgggtttcgggttcgatttttatttttgcgtcggttcgcgggtttcgtaggttttgtattgtcgatcgggttgcgtttaaggtcgttagtcgttcgtcgttttttttgttttttcgttgtaggaaggtcgcggtagagggggcgttttttaagtcgttagttacgtacgcggaggcgttcgggtttcggggcggcgtatcgggagagtacgtcg

SEQ ID NO: 29372 - DNA, 512 bp, Artificial Sequence
  chemically treated genomic DNA (Homo sapiens) CpG-island No: 29372
cgacgtactctcccgatacgccgccccgaaacccgaacgcctccgcgtacgtaactaacgacttaaaaaacgccccctctaccgcgaccttcctacaacgaaaaaacaaaaaaaacgacgaacgactaacgaccttaaacgcaacccgatcgacaatacaaaacctacgaaacccgcgaaccgacgcaaaaataaaaatcgaacccgaaacccaaaaaaaccttccgaaaccgaaactacgactccgcgaacttccccaccgaccgaatctcccgacaactaccaaaaaacgaaaacgcccgaaaaaacccgacgttccacaaaatccacgcgtattcgcgaaccgcgaaatcgccgccgaccgcccaaacgcgaaacctctcgaaaatcacccgaccgccgaacccgcgaaacgcacgaaaccgccaaaaaaaaacaacaaacctcaaaccctatccctacgccccgcccgacctcccccgcgaaactacgcaacccactcgaccatccta

SEQ ID NO: 29373 - DNA, 599 bp, Artificial Sequence
  chemically treated genomic DNA (Homo sapiens) CpG-island No: 29373
ttcgcgtggggggagttggttatttttaggttgtatgaagaggcggggtttcgcggggcggagttgggggtggtttgtgggttcgcgcgggtttcgggtagtttttgggttcggggagtagacgattcgttagttatattaggcgttcggtttttgcgttcgtttttttcgtgttttagagatttgcgttttttaggttcgagtttttgtcggtttattttcgagttcgtgtggttcgcgaatttttaattttagtcgttgtagtttttttttaggttcggcgttttcgagtttcgcgggcgtcgcgtttgtttttttttggttacgttgtagtcgcggtgtcggcgagttttttcgggttgttttcgcgggcgttagagggagggcgggcgttcgcgtggtgacggcgacgtttgtagtttaaggagcgttttattcgttgtcgtcggaggggtcggtgattttttggttatttcgcgtcggaggtttagatggtttaggcgaagattaacgttaaagttaacgaggggcgtttttgtcgttttttttttatggttgatcgttttagtcgtttgttggagagtttggattagttggag

SEQ ID NO: 29374 - DNA, 599 bp, Artificial Sequence
  chemically treated genomic DNA (Homo sapiens) CpG-island No: 29374
ctccaactaatccaaactctccaacaaacgactaaaacgatcaaccataaaaaaaaaacgacaaaaacgcccctcgttaactttaacgttaatcttcgcctaaaccatctaaacctccgacgcgaaataaccaaaaaatcaccgacccctccgacgacaacgaataaaacgctccttaaactacaaacgtcgccgtcaccacgcgaacgcccgccctccctctaacgcccgcgaaaacaacccgaaaaaactcgccgacaccgcgactacaacgtaaccaaaaaaaaacaaacgcgacgcccgcgaaactcgaaaacgccgaacctaaaaaaaaactacaacgactaaaattaaaaattcgcgaaccacacgaactcgaaaataaaccgacaaaaactcgaacctaaaaaacgcaaatctctaaaacacgaaaaaaacgaacgcaaaaaccgaacgcctaatataactaacgaatcgtctactccccgaacccaaaaactacccgaaacccgcgcgaacccacaaaccacccccaactccgccccgcgaaaccccgcctcttcatacaacctaaaaataaccaactccccccacgcgaa

SEQ ID NO: 29375 - DNA, 599 bp, Artificial Sequence
  chemically treated genomic DNA (Homo sapiens) CpG-island No: 29375
ttttagttggtttaggttttttagtaggcggttggagcggttagttatggaggaggagcggtagaagcgtttttcgttggttttagcgttgattttcgtttgagttatttaagttttcgacgcggggtagttaagaggttatcggttttttcggcggtagcgagtggagcgttttttgggttgtaggcgtcgtcgttattacgcgggcgttcgttttttttttgacgttcgcgggggtaattcgggaggattcgtcgatatcgcggttgtagcgtagttaaagaagggtaggcgcggcgttcgcggggttcggggacgtcgggtttgggagggggttgtagcggttggagttagaggttcgcgagttatacgggttcgaggatgggtcgataggggttcgggtttggggagcgtaagtttttgaggtacgggaggggcggacgtagagatcgagcgtttaatgtggttagcggatcgtttgtttttcggatttaggaattattcgaagttcgcgcggatttatagattatttttagtttcgtttcgcgaggtttcgtttttttatgtaatttaaaagtaattaattttttttacgcgaa

SEQ ID NO: 29376 - DNA, 599 bp, Artificial Sequence
  chemically treated genomic DNA (Homo sapiens) CpG-island No: 29376
ttcgcgtaaaaaaaattaattacttttaaattacataaaaaaacgaaacctcgcgaaacgaaactaaaaataatctataaatccgcgcgaacttcgaataattcctaaatccgaaaaacaaacgatccgctaaccacattaaacgctcgatctctacgtccgcccctcccgtacctcaaaaacttacgctccccaaacccgaacccctatcgacccatcctcgaacccgtataactcgcgaacctctaactccaaccgctacaaccccctcccaaacccgacgtccccgaaccccgcgaacgccgcgcctacccttctttaactacgctacaaccgcgatatcgacgaatcctcccgaattacccccgcgaacgtcaaaaaaaaaacgaacgcccgcgtaataacgacgacgcctacaacccaaaaaacgctccactcgctaccgccgaaaaaaccgataacctcttaactaccccgcgtcgaaaacttaaataactcaaacgaaaatcaacgctaaaaccaacgaaaaacgcttctaccgctcctcctccataactaaccgctccaaccgcctactaaaaaacctaaaccaactaaaa

SEQ ID NO: 29377 - DNA, 1416 bp, Artificial Sequence
  chemically treated genomic DNA (Homo sapiens) CpG-island No: 29377
  misc_feature (45)..(45): n is either a, c, g or t
  misc_feature (50)..(51): n is either a, c, g or t
  misc_feature (55)..(55): n is either a, c, g or t
  misc_feature (99)..(99): n is either a, c, g or t
  misc_feature (129)..(129): n is either a, c, g or t
  misc_feature (133)..(133): n is either a, c, g or t
  misc_feature (216)..(216): n is either a, c, g or t
  misc_feature (326)..(326): n is either a, c, g or t
  misc_feature (334)..(335): n is either a, c, g or t
  misc_feature (382)..(382): n is either a, c, g or t
  misc_feature (398)..(398): n is either a, c, g or t
  misc_feature (460)..(460): n is either a, c, g or t
  misc_feature (520)..(520): n is either a, c, g or t
  misc_feature (536)..(536): n is either a, c, g or t
  misc_feature (556)..(556): n is either a, c, g or t
  misc_feature (928)..(928): n is either a, c, g or t
  misc_feature (1012)..(1012): n is either a, c, g or t
  misc_feature (1129)..(1129): n is either a, c, g or t
  misc_feature (1235)..(1235): n is either a, c, g or t
  misc_feature (1291)..(1291): n is either a, c, g or t
  misc_feature (1320)..(1320): n is either a, c, g or t
  misc_feature (1398)..(1398): n is either a, c, g or t
  misc_feature (1410)..(1410): n is either a, c, g or t
gacgtttttttttcggaagtagcggggtacgaagagaataaatantaganntttntgtgtgagagaagaacgagagagaggaggaggaggaggcgtttngagagagaggagaaaacgttatcggcgcgnaatnttaacgttacgcgttagacgatagatagagaaagaaggaagaagagagagcgtacgagaagaacgatacgagtaaggcgcgtnatagaacgggcgtagcgagaggagaggaggaaatacgagagaagttatcggagttagagaaaacgagtagagtcgaggagcgagagatacgtaaagattcgcgtacgagncgagagtnnaaggcggagataataaggcgcgaattagtttagcgtaaaatcgagtncgacgtcgacgaaggnatagaggtaacgaggcgaggcgtagaaagtacgagaacgtagagggcgggagcgaggtaagnacggagtaagagaaggttaacgagttcgcgggcgacgaaaggagcgtttagtcggttagnagtcgatataggaaanggcgagaaagaaataaaaanacgaaaaacgaaatcgcgcgggatcgcggcgaaagaaagtttttcggtcgcgaacgagatttcgcggagacgcgttacgtatcgcgtcgagagaagaacgagcgtattacgtcgtcgttttcgtgttatatttagcgacgacgaatattttacgatcggcgcgcgtttttcgagatacgtttttttaagtaagtatagtcgcggtcgttcgcgagtcgacgacgaatcgcgagagcgagacgtcgttacgttattacgattgacgttttttagtcgttcgaggaagtagtttataagttagagagaaacggacggcgcgaggagcgtaaatcgaggtatacgcgatagagacgtagaatcgacggcgaggtntcggggagggatagatcggaaagggagagcgttcggtgaacggcgcggaatattagtatcgcggcggagagggaaaattgtttnacggcgtcgtaaaaaaaatgtaggtcgcggaacgcgttcgcgttcgtcgaaataggatagagaaagatatttttaagaataataaatcgtagttcgagattacgcggcggcgatagnagggattttacgcgtaatacgaaatcgcgcgcgtacgtcgcgtcgagaagagacggcgtagcgcgcggagttaggaagttttatacgtatagacgagtagaaggtncgacggagcgcgcgtatagataaaatacgacgataatataaagttagggtaaatanagtcgaacggacgcgcgcgtacgagaatnatgagacggcgaagtagcgtaagagagagagaagtagagaatagattaaagttaggagatagtgtagagaggaataantagagtttaagnacgagt

SEQ ID NO: 29378 - DNA, 1416 bp, Artificial Sequence
  chemically treated genomic DNA (Homo sapiens) CpG-island No: 29378
  misc_feature (7)..(7): n is either a, c, g or t
  misc_feature (19)..(19): n is either a, c, g or t
  misc_feature (97)..(97): n is either a, c, g or t
  misc_feature (126)..(126): n is either a, c, g or t
  misc_feature (182)..(182): n is either a, c, g or t
  misc_feature (288)..(288): n is either a, c, g or t
  misc_feature (405)..(405): n is either a, c, g or t
  misc_feature (489)..(489): n is either a, c, g or t
  misc_feature (861)..(861): n is either a, c, g or t
  misc_feature (881)..(881): n is either a, c, g or t
  misc_feature (897)..(897): n is either a, c, g or t
  misc_feature (957)..(957): n is either a, c, g or t
  misc_feature (1019)..(1019): n is either a, c, g or t
  misc_feature (1035)..(1035): n is either a, c, g or t
  misc_feature (1082)..(1083): n is either a, c, g or t
  misc_feature (1091)..(1091): n is either a, c, g or t
  misc_feature (1201)..(1201): n is either a, c, g or t
  misc_feature (1284)..(1284): n is either a, c, g or t
  misc_feature (1288)..(1288): n is either a, c, g or t
  misc_feature (1318)..(1318): n is either a, c, g or t
  misc_feature (1362)..(1362): n is either a, c, g or t
  misc_feature (1366)..(1367): n is either a, c, g or t
  misc_feature (1372)..(1372): n is either a, c, g or t
actcgtncttaaactctanttattcctctctacactatctcctaactttaatctattctctacttctctctctcttacgctacttcgccgtctcatnattctcgtacgcgcgcgtccgttcgactntatttaccctaactttatattatcgtcgtattttatctatacgcgcgctccgtcgnaccttctactcgtctatacgtataaaacttcctaactccgcgcgctacgccgtctcttctcgacgcgacgtacgcgcgcgatttcgtattacgcgtaaaatccctnctatcgccgccgcgtaatctcgaactacgatttattattcttaaaaatatctttctctatcctatttcgacgaacgcgaacgcgttccgcgacctacattttttttacgacgccgtnaaacaattttccctctccgccgcgatactaatattccgcgccgttcaccgaacgctctccctttccgatctatccctccccganacctcgccgtcgattctacgtctctatcgcgtatacctcgatttacgctcctcgcgccgtccgtttctctctaacttataaactacttcctcgaacgactaaaaaacgtcaatcgtaataacgtaacgacgtctcgctctcgcgattcgtcgtcgactcgcgaacgaccgcgactatacttacttaaaaaaacgtatctcgaaaaacgcgcgccgatcgtaaaatattcgtcgtcgctaaatataacacgaaaacgacgacgtaatacgctcgttcttctctcgacgcgatacgtaacgcgtctccgcgaaatctcgttcgcgaccgaaaaactttctttcgccgcgatcccgcgcgatttcgtttttcgtntttttatttctttctcgccntttcctatatcgactnctaaccgactaaacgctcctttcgtcgcccgcgaactcgttaaccttctcttactccgtncttacctcgctcccgccctctacgttctcgtactttctacgcctcgcctcgttacctctatnccttcgtcgacgtcgnactcgattttacgctaaactaattcgcgccttattatctccgccttnnactctcgnctcgtacgcgaatctttacgtatctctcgctcctcgactctactcgttttctctaactccgataacttctctcgtatttcctcctctcctctcgctacgcccgttctatnacgcgccttactcgtatcgttcttctcgtacgctctctcttcttccttctttctctatctatcgtctaacgcgtaacgttaanattncgcgccgataacgttttctcctctctctcnaaacgcctcctcctcctcctctctctcgttcttctctcacacanaaanntctantatttattctcttcgtaccccgctacttccgaaaaaaaaacgtc

SEQ ID NO: 29379 - DNA, 1416 bp, Artificial Sequence
  chemically treated genomic DNA (Homo sapiens) CpG-island No: 29379
  misc_feature (7)..(7): n is either a, c, g or t
  misc_feature (19)..(19): n is either a, c, g or t
  misc_feature (97)..(97): n is either a, c, g or t
  misc_feature (126)..(126): n is either a, c, g or t
  misc_feature (182)..(182): n is either a, c, g or t
  misc_feature (288)..(288): n is either a, c, g or t
  misc_feature (405)..(405): n is either a, c, g or t
  misc_feature (489)..(489): n is either a, c, g or t
  misc_feature (861)..(861): n is either a, c, g or t
  misc_feature (881)..(881): n is either a, c, g or t
  misc_feature (897)..(897): n is either a, c, g or t
  misc_feature (957)..(957): n is either a, c, g or t
  misc_feature (1019)..(1019): n is either a, c, g or t
  misc_feature (1035)..(1035): n is either a, c, g or t
  misc_feature (1082)..(1083): n is either a, c, g or t
  misc_feature (1091)..(1091): n is either a, c, g or t
  misc_feature (1201)..(1201): n is either a, c, g or t
  misc_feature (1284)..(1284): n is either a, c, g or t
  misc_feature (1288)..(1288): n is either a, c, g or t
  misc_feature (1318)..(1318): n is either a, c, g or t
  misc_feature (1362)..(1362): n is either a, c, g or t
  misc_feature (1366)..(1367): n is either a, c, g or t
  misc_feature (1372)..(1372): n is either a, c, g or t
gttcgtntttgggttttanttgtttttttttgtattgttttttggttttggtttgttttttgttttttttttttttgcgttgtttcgtcgttttatnattttcgtgcgcgcgcgttcgttcggttntgtttgttttggttttatattatcgtcgtgttttgtttatgcgcgcgtttcgtcgngttttttgttcgtttgtgcgtgtgaggttttttggtttcgcgcgttgcgtcgttttttttcggcgcggcgtgcgcgcgcggtttcgtgttgcgcgtggggtttttnttgtcgtcgtcgcgtggtttcgggttgcggtttgttatttttgggggtatttttttttattttatttcggcgggcgcgggcgcgtttcgcggtttgtattttttttgcggcgtcgtnaggtaatttttttttttcgtcgcggtattggtgtttcgcgtcgtttatcgggcgtttttttttttcgatttattttttttcggngtttcgtcgtcgattttgcgtttttatcgcgtatatttcggtttgcgtttttcgcgtcgttcgtttttttttggtttatgggttgttttttcgggcggttggggggcgttagtcgtggtggcgtggcggcgtttcgttttcgcgattcgtcgtcggttcgcgggcgatcgcggttatgtttatttgagagggcgtatttcgggaggcgcgcgtcggtcgtgggatattcgtcgtcgttgggtatagtacggaggcggcggcgtggtgcgttcgtttttttttcggcgcggtgcgtggcgcgttttcgcggggtttcgttcgcggtcggggggttttttttcgtcgcggtttcgcgcggtttcgtttttcgtntttttgtttttttttcgttnttttttgtgtcggttnttggtcggttgggcgtttttttcgtcgttcgcgggttcgttggtttttttttgtttcgtntttgtttcgttttcgttttttgcgttttcgtgttttttgcgtttcgtttcgttgtttttgtnttttcgtcggcgtcgngttcggttttgcgttgggttggttcgcgttttgttgttttcgttttnngttttcgnttcgtgcgcgggtttttgcgtgtttttcgtttttcggttttgttcgttttttttggtttcggtggtttttttcgtgttttttttttttttttcgttgcgttcgttttgtngcgcgttttgttcgtgtcgtttttttcgtgcgttttttttttttttttttttttttgtttgtcgtttggcgcgtggcgttggngttncgcgtcggtggcgttttttttttttttttngggcgtttttttttttttttttttttcgttttttttttatatanaagnntttgntgtttgtttttttcgtgtttcgttgttttcggagggagaacgtt

SEQ ID NO: 29380 - DNA, 1416 bp, Artificial Sequence
  chemically treated genomic DNA (Homo sapiens) CpG-island No: 29380
  misc_feature (45)..(45): n is either a, c, g or t
  misc_feature (50)..(51): n is either a, c, g or t
  misc_feature (55)..(55): n is either a, c, g or t
  misc_feature (99)..(99): n is either a, c, g or t
  misc_feature (129)..(129): n is either a, c, g or t
  misc_feature (133)..(133): n is either a, c, g or t
  misc_feature (216)..(216): n is either a, c, g or t
  misc_feature (326)..(326): n is either a, c, g or t
  misc_feature (334)..(335): n is either a, c, g or t
  misc_feature (382)..(382): n is either a, c, g or t
  misc_feature (398)..(398): n is either a, c, g or t
  misc_feature (460)..(460): n is either a, c, g or t
  misc_feature (520)..(520): n is either a, c, g or t
  misc_feature (536)..(536): n is either a, c, g or t
  misc_feature (556)..(556): n is either a, c, g or t
  misc_feature (928)..(928): n is either a, c, g or t
  misc_feature (1012)..(1012): n is either a, c, g or t
  misc_feature (1129)..(1129): n is either a, c, g or t
  misc_feature (1235)..(1235): n is either a, c, g or t
  misc_feature (1291)..(1291): n is either a, c, g or t
  misc_feature (1320)..(1320): n is either a, c, g or t
  misc_feature (1398)..(1398): n is either a, c, g or t
  misc_feature (1410)..(1410): n is either a, c, g or t
aacgttctccctccgaaaacaacgaaacacgaaaaaaacaaacancaaanncttntatataaaaaaaaaacgaaaaaaaaaaaaaaaaaaaaacgcccnaaaaaaaaaaaaaaaacgccaccgacgcgnaacnccaacgccacgcgccaaacgacaaacaaaaaaaaaaaaaaaaaaaaaaaacgcacgaaaaaaacgacacgaacaaaacgcgcnacaaaacgaacgcaacgaaaaaaaaaaaaaaaacacgaaaaaaaccaccgaaaccaaaaaaaacgaacaaaaccgaaaaacgaaaaacacgcaaaaacccgcgcacgaancgaaaacnnaaaacgaaaacaacaaaacgcgaaccaacccaacgcaaaaccgaacncgacgccgacgaaaanacaaaaacaacgaaacgaaacgcaaaaaacacgaaaacgcaaaaaacgaaaacgaaacaaanacgaaacaaaaaaaaaccaacgaacccgcgaacgacgaaaaaaacgcccaaccgaccaanaaccgacacaaaaaanaacgaaaaaaaaacaaaaanacgaaaaacgaaaccgcgcgaaaccgcgacgaaaaaaaaccccccgaccgcgaacgaaaccccgcgaaaacgcgccacgcaccgcgccgaaaaaaaaacgaacgcaccacgccgccgcctccgtactatacccaacgacgacgaatatcccacgaccgacgcgcgcctcccgaaatacgccctctcaaataaacataaccgcgatcgcccgcgaaccgacgacgaatcgcgaaaacgaaacgccgccacgccaccacgactaacgccccccaaccgcccgaaaaaacaacccataaaccaaaaaaaaacgaacgacgcgaaaaacgcaaaccgaaatatacgcgataaaaacgcaaaatcgacgacgaaacnccgaaaaaaaataaatcgaaaaaaaaaaacgcccgataaacgacgcgaaacaccaataccgcgacgaaaaaaaaaaattacctnacgacgccgcaaaaaaaatacaaaccgcgaaacgcgcccgcgcccgccgaaataaaataaaaaaaaatacccccaaaaataacaaaccgcaacccgaaaccacgcgacgacgacaanaaaaaccccacgcgcaacacgaaaccgcgcgcgcacgccgcgccgaaaaaaaacgacgcaacgcgcgaaaccaaaaaacctcacacgcacaaacgaacaaaaaacncgacgaaacgcgcgcataaacaaaacacgacgataatataaaaccaaaacaaacanaaccgaacgaacgcgcgcgcacgaaaatnataaaacgacgaaacaacgcaaaaaaaaaaaaaacaaaaaacaaaccaaaaccaaaaaacaatacaaaaaaaaacaantaaaacccaaanacgaac

SEQ ID NO: 29381 - DNA, 545 bp, Artificial Sequence
  chemically treated genomic DNA (Homo sapiens) CpG-island No: 29381
gttatataaggttcgcgtcggtttaatttcggatttggtgttatttatttgggaagcgttcggacggcggagtttggcggcggcggtggtggtggttgtcgtagattgtggttaaaaaaaagaaggcggcggcggcggcggcggcggaggcggaggtagttgcgaggtatgggagcgtcgaagcgtttaggcgtaggtcgaagttgtcgcgttttttgggtacggcgggagtgttgagtagaaaggggagcgtcgggggttcgtagtcggtttcggaggcgcgggtcgggtttttgtttggttacgttgagcgttagttagttttagcgaataattttagttacgataataatttattttttttttagataagcgagatttgggttgttgcgttcgttttattgtttagatatttgttaggggtttcggagtcggtagagttatcgagttttcgttttgagtcgtcgtttttttttttttcgatttcgttttttggagcgggaggttaggaaagtagcgggagaggggaaggggttagaaggaga

SEQ ID NO: 29382 - DNA, 545 bp, Artificial Sequence
  chemically treated genomic DNA (Homo sapiens) CpG-island No: 29382
tctccttctaaccccttcccctctcccgctactttcctaacctcccgctccaaaaaacgaaatcgaaaaaaaaaaaaacgacgactcaaaacgaaaactcgataactctaccgactccgaaacccctaacaaatatctaaacaataaaacgaacgcaacaacccaaatctcgcttatctaaaaaaaaaataaattattatcgtaactaaaattattcgctaaaactaactaacgctcaacgtaaccaaacaaaaacccgacccgcgcctccgaaaccgactacgaacccccgacgctcccctttctactcaacactcccgccgtacccaaaaaacgcgacaacttcgacctacgcctaaacgcttcgacgctcccatacctcgcaactacctccgcctccgccgccgccgccgccgccgccttcttttttttaaccacaatctacgacaaccaccaccaccgccgccgccaaactccgccgtccgaacgcttcccaaataaataacaccaaatccgaaattaaaccgacgcgaaccttatataac

SEQ ID NO: 29383 - DNA, 545 bp, Artificial Sequence
  chemically treated genomic DNA (Homo sapiens) CpG-island No: 29383
tttttttttagtttttttttttttttcgttgtttttttggtttttcgttttagggagcgaggtcggggagagggagggcgacgatttagagcggggattcggtggttttgtcgatttcggagtttttggtaagtgtttaaataataggacggacgtagtagtttaagtttcgtttgtttggaaggaaggtgggttgttgtcgtaattggagttgttcgttggggttgattggcgtttagcgtagttaaataaaaattcggttcgcgttttcggagtcggttgcgggttttcggcgtttttttttttgtttagtattttcgtcgtgtttagaaagcgcggtagtttcggtttgcgtttgggcgtttcggcgtttttatgtttcgtagttgttttcgttttcgtcgtcgtcgtcgtcgtcgtttttttttttttaattatagtttgcggtagttattattatcgtcgtcgttaagtttcgtcgttcgggcgttttttaaataaataatattaagttcgaagttgagtcggcgcgggttttatatagt

SEQ ID NO: 29384 - DNA, 545 bp, Artificial Sequence
  chemically treated genomic DNA (Homo sapiens) CpG-island No: 29384
actatataaaacccgcgccgactcaacttcgaacttaatattatttatttaaaaaacgcccgaacgacgaaacttaacgacgacgataataataactaccgcaaactataattaaaaaaaaaaaaacgacgacgacgacgacgacgaaaacgaaaacaactacgaaacataaaaacgccgaaacgcccaaacgcaaaccgaaactaccgcgctttctaaacacgacgaaaatactaaacaaaaaaaaaaacgccgaaaacccgcaaccgactccgaaaacgcgaaccgaatttttatttaactacgctaaacgccaatcaaccccaacgaacaactccaattacgacaacaacccaccttccttccaaacaaacgaaacttaaactactacgtccgtcctattatttaaacacttaccaaaaactccgaaatcgacaaaaccaccgaatccccgctctaaatcgtcgccctccctctccccgacctcgctccctaaaacgaaaaaccaaaaaaacaacgaaaaaaaaaaaaaaactaaaaaaaaa

SEQ ID NO: 29385 - DNA, 523 bp, Artificial Sequence
  chemically treated genomic DNA (Homo sapiens) CpG-island No: 29385
gcggcggttcgattgtttttttgttttttttgcgtgatttcggggtaggttttggtgtagagcgtcgttaaggacgtcgagcgggaggcgggattgtttagatattttttagcgaagtgtatgtgtgtttgtaaattatcgttggttgtcgggagatcgcgaggatcggtttaggttgcggcggagtcgagggcgagggagaggtcgcgtgagtgagtagagtttagagtcgtgcgtttttagaattgcgcgttcgtttcgtgtattttcgcgcgttatgtttagttgtttcgcgcgttttgttacgggttcgttgggttttcgcgttttttagttttcggagtttattttgatcggggttataatatttattgagatttttttttttgttttgtattttcgttattggtatcggatttgtagaagcgtgcgtgggattagaggatcgttttttttataataatcggtttttgtattttagtagtcgttggaagttttagtttttttatcgttaagtttattt

SEQ ID NO: 29386 - DNA, 523 bp, Artificial Sequence
  chemically treated genomic DNA (Homo sapiens) CpG-island No: 29386
aaataaacttaacgataaaaaaactaaaacttccaacgactactaaaatacaaaaaccgattattataaaaaaaacgatcctctaatcccacgcacgcttctacaaatccgataccaataacgaaaatacaaaacaaaaaaaaaaatctcaataaatattataaccccgatcaaaataaactccgaaaactaaaaaacgcgaaaacccaacgaacccgtaacaaaacgcgcgaaacaactaaacataacgcgcgaaaatacacgaaacgaacgcgcaattctaaaaacgcacgactctaaactctactcactcacgcgacctctccctcgccctcgactccgccgcaacctaaaccgatcctcgcgatctcccgacaaccaacgataatttacaaacacacatacacttcgctaaaaaatatctaaacaatcccgcctcccgctcgacgtccttaacgacgctctacaccaaaacctaccccgaaatcacgcaaaaaaaacaaaaaaacaatcgaaccgccgc

SEQ ID NO: 29387 - DNA, 523 bp, Artificial Sequence
  chemically treated genomic DNA (Homo sapiens) CpG-island No: 29387
ggatgaatttggcggtaaaagagttggggtttttaacggttgttaagatgtaggggtcggttgttgtggggagggcggttttttgattttacgtacgtttttgtaaattcgatgttagtggcgaaggtataagatagaagaggggattttaataggtattatggtttcgattaaagtgggtttcggaagttagaaggcgcggaagtttagcgggttcgtagtagagcgcgcggggtaattgggtatggcgcgcgggggtgtacggggcggacgcgtagttttgggggcgtacggttttggattttgtttatttacgcggtttttttttcgttttcgatttcgtcgtagtttggatcggttttcgcggtttttcgatagttaacgatggtttataaatatatatgtatttcgttgaaggatgtttgggtaatttcgtttttcgttcggcgtttttggcgacgttttgtattaggatttgtttcgaggttacgtagaaaagataaaagggtagtcgggtcgtcgt

SEQ ID NO: 29388 - DNA, 523 bp, Artificial Sequence
  chemically treated genomic DNA (Homo sapiens) CpG-island No: 29388
acgacgacccgactacccttttatcttttctacgtaacctcgaaacaaatcctaatacaaaacgtcgccaaaaacgccgaacgaaaaacgaaattacccaaacatccttcaacgaaatacatatatatttataaaccatcgttaactatcgaaaaaccgcgaaaaccgatccaaactacgacgaaatcgaaaacgaaaaaaaaaccgcgtaaataaacaaaatccaaaaccgtacgcccccaaaactacgcgtccgccccgtacacccccgcgcgccatacccaattaccccgcgcgctctactacgaacccgctaaacttccgcgccttctaacttccgaaacccactttaatcgaaaccataatacctattaaaatcccctcttctatcttataccttcgccactaacatcgaatttacaaaaacgtacgtaaaatcaaaaaaccgccctccccacaacaaccgacccctacatcttaacaaccgttaaaaaccccaactcttttaccgccaaattcatcc

SEQ ID NO: 29389 - DNA, 740 bp, Artificial Sequence
  chemically treated genomic DNA (Homo sapiens) CpG-island No: 29389
tttttatttcgatttttcgtttaattttcgttttagttagttttaggagttatatgcgtatgcgttttttcgcgtttttttttaattttttacgttttatttttttttttttttttttttagtttcggtttcgtcgttacgattggttagtcgattattcggtttcggttaataagcgtcgttttttcgttttcgtgttattgggtagaagaaaataaaaataaatagagcgagaagggttagagatttttcgaggcggcggtagagatagaagagcggggtcggggtcggttgattaggaatttgggcgagtagcggcgggggttcgaggggttagtattagtaggcgcggtttatacgttcgggaagattgcgtttttttttttattttttttcggaggtagtcgtaagatgggagggggcgggggcggaggcgtgggggtcgcggttttgttaggttcgggtttgcggtgcgggggttcggttgtttttttgtagtttcgtaggtttagtcgcgttttttttaacgtttcggattgcgggtattcggtttggttttttttttttgagtttagtttggagcgtgtcggcgcgggttcgttttttttcggagttatttttttattgagaggggcgcgcgaggcgttcgtttttgaaggttttttttagtttttttttttttttggcggaggttgaattcgggggtcgggattggaaggcgtgttttcggttggattgaa

SEQ ID NO: 29390 - DNA, 740 bp, Artificial Sequence
  chemically treated genomic DNA (Homo sapiens) CpG-island No: 29390
ttcaatccaaccgaaaacacgccttccaatcccgacccccgaattcaacctccgccaaaaaaaaaaaaaaactaaaaaaaaccttcaaaaacgaacgcctcgcgcgcccctctcaataaaaaaataactccgaaaaaaaacgaacccgcgccgacacgctccaaactaaactcaaaaaaaaaaaaccaaaccgaatacccgcaatccgaaacgttaaaaaaaacgcgactaaacctacgaaactacaaaaaaacaaccgaacccccgcaccgcaaacccgaacctaacaaaaccgcgacccccacgcctccgcccccgccccctcccatcttacgactacctccgaaaaaaaataaaaaaaaaaacgcaatcttcccgaacgtataaaccgcgcctactaatactaacccctcgaacccccgccgctactcgcccaaattcctaatcaaccgaccccgaccccgctcttctatctctaccgccgcctcgaaaaatctctaacccttctcgctctatttatttttattttcttctacccaataacacgaaaacgaaaaaacgacgcttattaaccgaaaccgaataatcgactaaccaatcgtaacgacgaaaccgaaactaaaaaaaaaaaaaaaaaaaaataaaacgtaaaaaattaaaaaaaaacgcgaaaaaacgcatacgcatataactcctaaaactaactaaaacgaaaattaaacgaaaaatcgaaataaaaa

SEQ ID NO: 29391 - DNA, 740 bp, Artificial Sequence
  chemically treated genomic DNA (Homo sapiens) CpG-island No: 29391
tttagtttagtcggaaatacgttttttaatttcggttttcgaatttaattttcgttagagggggaggagggttgagggggatttttaagggcgagcgtttcgcgcgttttttttagtggggagatggtttcgggagggggcgggttcgcgtcgatacgttttaggttgggtttagaaagagggaattaggtcggatgttcgtagttcggggcgttggggagggcgcggttggatttgcggggttataagaaggtagtcggattttcgtatcgtaggttcggatttgataggatcgcgatttttacgttttcgttttcgtttttttttattttgcggttgttttcgaggagggatgggggagagggcgtagttttttcgagcgtgtgagtcgcgtttattggtattgatttttcgggttttcgtcgttgttcgtttaggtttttggttagtcggtttcgatttcgtttttttgtttttgtcgtcgtttcggagagtttttggtttttttcgttttgtttgtttttgtttttttttatttagtaatacgggggcgagagggcggcgtttattggtcgaggtcgggtggtcggttggttaatcgtggcggcggagtcggagttgaggaggaaaagggagaggagtgaaacgtggaaagttggggaggggcgcgggagggcgtatgcgtatgtggtttttgggattggttggagcgggagttgagcgggaagtcggggtggggg

SEQ ID NO: 29392 - DNA, 740 bp, Artificial Sequence
  chemically treated genomic DNA (Homo sapiens) CpG-island No: 29392
cccccaccccgacttcccgctcaactcccgctccaaccaatcccaaaaaccacatacgcatacgccctcccgcgcccctccccaactttccacgtttcactcctctcccttttcctcctcaactccgactccgccgccacgattaaccaaccgaccacccgacctcgaccaataaacgccgccctctcgcccccgtattactaaataaaaaaaaacaaaaacaaacaaaacgaaaaaaaccaaaaactctccgaaacgacgacaaaaacaaaaaaacgaaatcgaaaccgactaaccaaaaacctaaacgaacaacgacgaaaacccgaaaaatcaataccaataaacgcgactcacacgctcgaaaaaactacgccctctcccccatccctcctcgaaaacaaccgcaaaataaaaaaaaacgaaaacgaaaacgtaaaaatcgcgatcctatcaaatccgaacctacgatacgaaaatccgactaccttcttataaccccgcaaatccaaccgcgccctccccaacgccccgaactacgaacatccgacctaattccctctttctaaacccaacctaaaacgtatcgacgcgaacccgccccctcccgaaaccatctccccactaaaaaaaacgcgcgaaacgctcgcccttaaaaatccccctcaaccctcctccccctctaacgaaaattaaattcgaaaaccgaaattaaaaaacgtatttccgactaaactaaa

SEQ ID NO: 29393 - DNA, 633 bp, Artificial Sequence
  chemically treated genomic DNA (Homo sapiens) CpG-island No: 29393
gtttcgtattttgtgatttgtacgtgcgttggtgggttttcgggggcggggcgtcgcgttggtttcgtttattaggtgcgttttttgtttcgttttttgtagacgcgcgtacgtttacgttggattttgatacgatgtacgcgcgtttgcgtttgttcgtcgatcgtttgacggtgcgttgcggtttgttgggtagtttggggttcgtgttcgtgttgcggttcgacgcgttttggtaagtgttggttcgtgattgtttcgttatcggtcgttattattgggaggttgacgtgtaggaggcgggcgtcggttggtgggtgggcgcggtttacgttttttttcggcgtcgcggggtttcggtcgtcgttcgtttgggttgtaatcgttagttttggtgttttaagcgttacgattttgagtattgggttttttacgacggttagcgtagtcgtttgcggtttcgcgacgatttcgatcggttcggcgtttttttggattacgaggtcggcgttttcgttttttacgacgtgacgggcggtatgagttatttgtatatttttcgcgttacgttttaggagtcgttttattcggttttgcggttttgggagggggttattagtatttttcggttgt

SEQ ID NO: 29394 - DNA, 633 bp, Artificial Sequence
  chemically treated genomic DNA (Homo sapiens) CpG-island No: 29394
acaaccgaaaaatactaataaccccctcccaaaaccgcaaaaccgaataaaacgactcctaaaacgtaacgcgaaaaatatacaaataactcataccgcccgtcacgtcgtaaaaaacgaaaacgccgacctcgtaatccaaaaaaacgccgaaccgatcgaaatcgtcgcgaaaccgcaaacgactacgctaaccgtcgtaaaaaacccaatactcaaaatcgtaacgcttaaaacaccaaaactaacgattacaacccaaacgaacgacgaccgaaaccccgcgacgccgaaaaaaaacgtaaaccgcgcccacccaccaaccgacgcccgcctcctacacgtcaacctcccaataataacgaccgataacgaaacaatcacgaaccaacacttaccaaaacgcgtcgaaccgcaacacgaacacgaaccccaaactacccaacaaaccgcaacgcaccgtcaaacgatcgacgaacaaacgcaaacgcgcgtacatcgtatcaaaatccaacgtaaacgtacgcgcgtctacaaaaaacgaaacaaaaaacgcacctaataaacgaaaccaacgcgacgccccgcccccgaaaacccaccaacgcacgtacaaatcacaaaatacgaaac

SEQ ID NO: 29395 - DNA, 633 bp, Artificial Sequence
  chemically treated genomic DNA (Homo sapiens) CpG-island No: 29395
gtagtcgggggatgttgatggtttttttttagagtcgtagggtcgggtagagcggtttttggaacgtggcgcggaaggtatgtaggtggtttatgtcgttcgttacgtcgtagaaggcgaggacgtcggtttcgtagtttaggaagacgtcgagtcggtcgaggtcgtcgcggggtcgtaggcggttgcgttggtcgtcgtggaaggtttagtatttaaggtcgtagcgtttgaggtattaggattggcggttgtagtttaggcgggcggcggtcgaggtttcgcggcgtcgaagggaggcgtaggtcgcgtttatttattagtcggcgttcgttttttgtacgttaattttttagtagtggcggtcggtggcgaagtagttacgagttagtatttgttagagcgcgtcgaatcgtagtacgggtacgggttttaggttgtttagtaggtcgtagcgtatcgttaggcgatcggcggataggcgtaggcgcgcgtgtatcgtgttaggatttagcgtgggcgtgcgcgcgtttgtagggggcgagataagggacgtatttggtgggcggggttagcgcggcgtttcgttttcgggaatttattaacgtacgtgtaaattataaaatgcgaagt

SEQ ID NO: 29396 - DNA, 633 bp, Artificial Sequence
  chemically treated genomic DNA (Homo sapiens) CpG-island No: 29396
acttcgcattttataatttacacgtacgttaataaattcccgaaaacgaaacgccgcgctaaccccgcccaccaaatacgtcccttatctcgccccctacaaacgcgcgcacgcccacgctaaatcctaacacgatacacgcgcgcctacgcctatccgccgatcgcctaacgatacgctacgacctactaaacaacctaaaacccgtacccgtactacgattcgacgcgctctaacaaatactaactcgtaactacttcgccaccgaccgccactactaaaaaattaacgtacaaaaaacgaacgccgactaataaataaacgcgacctacgcctcccttcgacgccgcgaaacctcgaccgccgcccgcctaaactacaaccgccaatcctaatacctcaaacgctacgaccttaaatactaaaccttccacgacgaccaacgcaaccgcctacgaccccgcgacgacctcgaccgactcgacgtcttcctaaactacgaaaccgacgtcctcgccttctacgacgtaacgaacgacataaaccacctacataccttccgcgccacgttccaaaaaccgctctacccgaccctacgactctaaaaaaaaaccatcaacatcccccgactac

SEQ ID NO: 29397 - DNA, 605 bp, Artificial Sequence
  chemically treated genomic DNA (Homo sapiens) CpG-island No: 29397
gtttcgtttttcgttcgtttcgtttcgtttcgtttcgtaggtttcgttcgtcgttgttcggggaatcgcggatttcgtagttgtaggaggcgttcggttcggcggagtagttttagtcgttatcgtcgttttcgtagttttcgtcgttattgttatcgtcgtcgtcgttattgcgttttggtttcggttttcgcgttttttcggtcggttatgtagtttcgtcgcgtttaggcgttcggtgcgtagttgttgttcgcgttggttttgttgttgttgttgttcggagcggggtttcgaggtagttttttggttaattcggtgttcgtcgcgtttttgtttgcgttcgggtcgtgcgtcgcgtagttttgtcggaatgggggtgtgtgtatttcgcgttttgagtcggattcgtagtattcggttttcgtcggcgagtttggttatagttgtatttgtttcgtcgggattttcggcgttaattgttaggtgagtggaagcggcgggcgcggtgcggggcgttggttcgggattagtagttttttttcgtcggttttgttgttgttgttcgataatgggtacgtttgatataggtttttttattttgg

SEQ ID NO: 29398 - DNA, 605 bp, Artificial Sequence
  chemically treated genomic DNA (Homo sapiens) CpG-island No: 29398
ccaaaataaaaaaacctatatcaaacgtacccattatcgaacaacaacaacaaaaccgacgaaaaaaaactactaatcccgaaccaacgccccgcaccgcgcccgccgcttccactcacctaacaattaacgccgaaaatcccgacgaaacaaatacaactataaccaaactcgccgacgaaaaccgaatactacgaatccgactcaaaacgcgaaatacacacacccccattccgacaaaactacgcgacgcacgacccgaacgcaaacaaaaacgcgacgaacaccgaattaaccaaaaaactacctcgaaaccccgctccgaacaacaacaacaacaaaaccaacgcgaacaacaactacgcaccgaacgcctaaacgcgacgaaactacataaccgaccgaaaaaacgcgaaaaccgaaaccaaaacgcaataacgacgacgacgataacaataacgacgaaaactacgaaaacgacgataacgactaaaactactccgccgaaccgaacgcctcctacaactacgaaatccgcgattccccgaacaacgacgaacgaaacctacgaaacgaaacgaaacgaaacgaacgaaaaacgaaac

SEQ ID NO: 29399 - DNA, 605 bp, Artificial Sequence
  chemically treated genomic DNA (Homo sapiens) CpG-island No: 29399
ttaaagtgggaaagtttgtgttaggcgtgtttattgtcgggtagtagtagtagggtcggcgggaagaggttgttggtttcggattagcgtttcgtatcgcgttcgtcgtttttatttatttggtagttggcgtcggagatttcggcggggtaggtgtagttgtagttaggttcgtcggcgggggtcgggtgttgcgggttcggtttagggcgcgaggtgtatatatttttatttcggtagggttgcgcggcgtacggttcgggcgtagataggggcgcggcgggtatcgggttggttagggagttgtttcggggtttcgtttcgagtagtagtagtagtagggttagcgcgggtagtagttgcgtatcgggcgtttgggcgcggcggggttgtatggtcggtcgggagggcgcgggagtcggagttaggacgtagtgacggcggcggcggtggtagtggcgacgagagttgcgagagcgacggtggcggttagggttgtttcgtcgggtcgggcgttttttgtagttgcgggattcgcggtttttcgggtaacggcgggcggggtttgcggggcggggcggggcggggcgagcggggggcggggt

SEQ ID NO: 29400 - DNA, 605 bp, Artificial Sequence
  chemically treated genomic DNA (Homo sapiens) CpG-island No: 29400
accccgccccccgctcgccccgccccgccccgccccgcaaaccccgcccgccgttacccgaaaaaccgcgaatcccgcaactacaaaaaacgcccgacccgacgaaacaaccctaaccgccaccgtcgctctcgcaactctcgtcgccactaccaccgccgccgccgtcactacgtcctaactccgactcccgcgccctcccgaccgaccatacaaccccgccgcgcccaaacgcccgatacgcaactactacccgcgctaaccctactactactactactcgaaacgaaaccccgaaacaactccctaaccaacccgatacccgccgcgcccctatctacgcccgaaccgtacgccgcgcaaccctaccgaaataaaaatatatacacctcgcgccctaaaccgaacccgcaacacccgacccccgccgacgaacctaactacaactacacctaccccgccgaaatctccgacgccaactaccaaataaataaaaacgacgaacgcgatacgaaacgctaatccgaaaccaacaacctcttcccgccgaccctactactactacccgacaataaacacgcctaacacaaactttcccactttaa

SEQ ID NO: 29401 - DNA, 794 bp, Artificial Sequence
  chemically treated genomic DNA (Homo sapiens) CpG-island No: 29401
tcgtcgtcgttttgttttttgtttgtttttttttagcgtttcgcgtgggattttcggcggtagtttatattttttttgattgtcggtgttcgttagggtattttgcgcgcgttcgtcggtttcgtttcggtttcgtttcgtttcgtcggtttcgtttttcgtttttttttcgtttttcggagtcgacgagtggcggcggcggttttaggtttcgggttttttagataagagggcgggtggaggaggaagcgttcgagtttagagttttgtttcggcgttttcgagtatcgttcgttttagtcgattagtttcgtcggttattgggtttcgtcgagacgagaggagggaaaggtttcggcggtcgcgaggaggcggcgggggcgcgggcggaggcggcgcgggcggtcgcggttgtcgttttgttgtgcggttcgggtcgaggaaggagaagtgggaggaggggggagttcggcgtttcgtttttttcgcggtttatggcgacgattttcggtatattcgggatttttcggtcgtggcggtcgaggcgtcggttgttcgggttttagtttcggtcgttgtggtgatttcgtcgcgtttcgtcgtcgttttcgtgtcgttcgtcgttttcgtcgttttcgtcgtcggggatatgtttaatttcggaggtcggaggaacgggttcgttaagttgcgtttgataggtgagggggggcggcgggtcgggttgggtagtcgcggggtgggcgagttggcggggggtgtttgtggtttgggaagggttagggtcgcgatta

SEQ ID NO: 29402 - DNA, 794 bp, Artificial Sequence
  chemically treated genomic DNA (Homo sapiens) CpG-island No: 29402
taatcgcgaccctaacccttcccaaaccacaaacaccccccgccaactcgcccaccccgcgactacccaacccgacccgccgccccccctcacctatcaaacgcaacttaacgaacccgttcctccgacctccgaaattaaacatatccccgacgacgaaaacgacgaaaacgacgaacgacacgaaaacgacgacgaaacgcgacgaaatcaccacaacgaccgaaactaaaacccgaacaaccgacgcctcgaccgccacgaccgaaaaatcccgaatataccgaaaatcgtcgccataaaccgcgaaaaaaacgaaacgccgaactcccccctcctcccacttctccttcctcgacccgaaccgcacaacaaaacgacaaccgcgaccgcccgcgccgcctccgcccgcgcccccgccgcctcctcgcgaccgccgaaacctttccctcctctcgtctcgacgaaacccaataaccgacgaaactaatcgactaaaacgaacgatactcgaaaacgccgaaacaaaactctaaactcgaacgcttcctcctccacccgccctcttatctaaaaaacccgaaacctaaaaccgccgccgccactcgtcgactccgaaaaacgaaaaaaaaacgaaaaacgaaaccgacgaaacgaaacgaaaccgaaacgaaaccgacgaacgcgcgcaaaataccctaacgaacaccgacaatcaaaaaaaatataaactaccgccgaaaatcccacgcgaaacgctaaaaaaaaacaaacaaaaaacaaaacgacgacga

SEQ ID NO: 29403 - DNA, 794 bp, Artificial Sequence
  chemically treated genomic DNA (Homo sapiens) CpG-island No: 29403
tgatcgcgattttggttttttttaagttataggtatttttcgttagttcgtttatttcgcggttgtttagttcggttcgtcgtttttttttatttgttaggcgtagtttgacgggttcgttttttcggttttcggggttagatatgttttcggcggcgggggcggcgggggcggcgggcggtacgggggcgacggcgaggcgcggcggagttattatagcggtcggggttggggttcgagtagtcggcgtttcggtcgttacggtcggagggtttcggatgtgtcgagagtcgtcgttatgagtcgcggagggagcgggacgtcgagtttttttttttttttattttttttttttcggttcgggtcgtataataaagcggtagtcgcggtcgttcgcgtcgttttcgttcgcgttttcgtcgttttttcgcggtcgtcgaggttttttttttttttcgtttcggcgaggtttagtagtcgacggggttggtcggttgaagcgggcggtgttcgggggcgtcggagtagaattttgggttcgggcgtttttttttttattcgtttttttgtttgagggattcgggatttggggtcgtcgtcgttattcgtcggtttcggggggcggggaggagacgggaggcggggtcggcggggcggggcggggtcggggcggggtcggcgggcgcgcgtagggtgttttggcgggtatcggtagttagggagggtgtgagttgtcgtcgagggttttacgcggaacgttgggagggagtaggtagggagtaaagcggcggcgg

SEQ ID NO: 29404 - DNA, 794 bp, Artificial Sequence
  chemically treated genomic DNA (Homo sapiens) CpG-island No: 29404
ccgccgccgctttactccctacctactccctcccaacgttccgcgtaaaaccctcgacgacaactcacaccctccctaactaccgatacccgccaaaacaccctacgcgcgcccgccgaccccgccccgaccccgccccgccccgccgaccccgcctcccgtctcctccccgccccccgaaaccgacgaataacgacgacgaccccaaatcccgaatccctcaaacaaaaaaacgaataaaaaaaaaaacgcccgaacccaaaattctactccgacgcccccgaacaccgcccgcttcaaccgaccaaccccgtcgactactaaacctcgccgaaacgaaaaaaaaaaaaaacctcgacgaccgcgaaaaaacgacgaaaacgcgaacgaaaacgacgcgaacgaccgcgactaccgctttattatacgacccgaaccgaaaaaaaaaaaataaaaaaaaaaaaaaactcgacgtcccgctccctccgcgactcataacgacgactctcgacacatccgaaaccctccgaccgtaacgaccgaaacgccgactactcgaaccccaaccccgaccgctataataactccgccgcgcctcgccgtcgcccccgtaccgcccgccgcccccgccgcccccgccgccgaaaacatatctaaccccgaaaaccgaaaaaacgaacccgtcaaactacgcctaacaaataaaaaaaaacgacgaaccgaactaaacaaccgcgaaataaacgaactaacgaaaaatacctataacttaaaaaaaaccaaaatcgcgatca

SEQ ID NO: 29405 - DNA, 751 bp, Artificial Sequence
  chemically treated genomic DNA (Homo sapiens) CpG-island No: 29405
gtcgcggtagtttttagattcggcgttatggttcgcgtttttttcgtgggggtttagtcgttgtagggttagttttcgtttatcgtcgtcggtttcgtcgttgggtttcgcgtcgttgtcgttttcgttcgggttttcgaagatgtcgagcgttttttcggcgtcgcggtgttgtcggtaggttatttagtagtagggttttacgtcggtttcgtcgatgttttagaaggtgagttttttttcgaagagcggttcgtatacgttcgcggggtagtgtagtttgtcggtgcggtagtagttgagtacgtaggcgaagacgttcgggtgtttgtcgaagaagaattcgtagttttcgtcgtcgttgttgtcgttgttatttatatcgtcgttatcggtttcgggtcggttttcgtcgtcggggtcggttagttaggcgaggcgggttttcggtagggtgcgtagggtgttgcggtaggttttatgtcgcgtgtcgtttacgttgatgatgatttttttcgacgtttcgtttttggttatttttttttttagatatgttttggacggaggtttgtttttcgatttgcgttcgcggtaggaggagatatatatcgagttgattataagaagcgttgcggggtttcggtttggggcggtcgttgttttttaaatatttttttcgaggaggtagcgttagacgggggagggggaggagacgaagaggaggtaggaggcggtggcggttttttttgcg

SEQ ID NO: 29406 - DNA, 751 bp, Artificial Sequence
  chemically treated genomic DNA (Homo sapiens) CpG-island No: 29406
cgcaaaaaaaaccgccaccgcctcctacctcctcttcgtctcctccccctcccccgtctaacgctacctcctcgaaaaaaatatttaaaaaacaacgaccgccccaaaccgaaaccccgcaacgcttcttataatcaactcgatatatatctcctcctaccgcgaacgcaaatcgaaaaacaaacctccgtccaaaacatatctaaaaaaaaaaataaccaaaaacgaaacgtcgaaaaaaatcatcatcaacgtaaacgacacgcgacataaaacctaccgcaacaccctacgcaccctaccgaaaacccgcctcgcctaactaaccgaccccgacgacgaaaaccgacccgaaaccgataacgacgatataaataacaacgacaacaacgacgacgaaaactacgaattcttcttcgacaaacacccgaacgtcttcgcctacgtactcaactactaccgcaccgacaaactacactaccccgcgaacgtatacgaaccgctcttcgaaaaaaaactcaccttctaaaacatcgacgaaaccgacgtaaaaccctactactaaataacctaccgacaacaccgcgacgccgaaaaaacgctcgacatcttcgaaaacccgaacgaaaacgacaacgacgcgaaacccaacgacgaaaccgacgacgataaacgaaaactaaccctacaacgactaaacccccacgaaaaaaacgcgaaccataacgccgaatctaaaaactaccgcgac

SEQ ID NO: 29407 - DNA, 751 bp, Artificial Sequence
  chemically treated genomic DNA (Homo sapiens) CpG-island No: 29407
cgtagagggggtcgttatcgttttttgtttttttttcgttttttttttttttttcgtttgacgttgttttttcgggaagggtgtttggagggtagcggtcgttttaagtcggagtttcgtagcgttttttatgattagttcggtgtgtgtttttttttatcgcgggcgtaagtcggggaataagttttcgtttaaaatatgtttgaaggaggagatggttaagggcgaggcgtcggagaagattattattaacgtgggcggtacgcgatatgagatttatcgtagtattttgcgtattttatcgggaattcgtttcgtttggttggtcgatttcgacggcgggggtcggttcgagatcgatggcggcggtgtgggtagtagcggtagtagcggcggcgggggttgcgagttttttttcgataggtattcgggcgttttcgtttacgtgtttaattattatcgtatcggtaagttgtattgtttcgcggacgtgtgcgggtcgtttttcgaagaggagtttattttttggggtatcgacgagatcgacgtggaattttgttgttggatgatttatcggtagtatcgcgacgtcgaggaggcgttcgatattttcgagagttcggacggaggcggtagcggcgcggggtttagcgacgaggtcggcgacgatgagcgggagttggttttgtagcgattgggtttttacgagggaggcgcgggttatggcgtcgggtttgggggttgtcgcggt

SEQ ID NO: 29408 - DNA, 751 bp, Artificial Sequence
  chemically treated genomic DNA (Homo sapiens) CpG-island No: 29408
accgcgacaacccccaaacccgacgccataacccgcgcctccctcgtaaaaacccaatcgctacaaaaccaactcccgctcatcgtcgccgacctcgtcgctaaaccccgcgccgctaccgcctccgtccgaactctcgaaaatatcgaacgcctcctcgacgtcgcgatactaccgataaatcatccaacaacaaaattccacgtcgatctcgtcgataccccaaaaaataaactcctcttcgaaaaacgacccgcacacgtccgcgaaacaatacaacttaccgatacgataataattaaacacgtaaacgaaaacgcccgaatacctatcgaaaaaaaactcgcaacccccgccgccgctactaccgctactacccacaccgccgccatcgatctcgaaccgacccccgccgtcgaaatcgaccaaccaaacgaaacgaattcccgataaaatacgcaaaatactacgataaatctcatatcgcgtaccgcccacgttaataataatcttctccgacgcctcgcccttaaccatctcctccttcaaacatattttaaacgaaaacttattccccgacttacgcccgcgataaaaaaaaacacacaccgaactaatcataaaaaacgctacgaaactccgacttaaaacgaccgctaccctccaaacacccttcccgaaaaaacaacgtcaaacgaaaaaaaaaaaaaaaacgaaaaaaaaacaaaaaacgataacgaccccctctacg

SEQ ID NO: 29409 - DNA, 1059 bp, Artificial Sequence
  chemically treated genomic DNA (Homo sapiens) CpG-island No: 29409
tatacgcggtttttcgttacgacgggatatataaacgttttgggtcggggatacgttttcgtttttatttcgattaaagacgaggaagcgtatagtttacgcgtatcgcgaaggttcggggcgttcgcgtttatacgggttatttttcggttttaagatcgtattaagtttcggaatagtcggttttttcgtagcggcggtagcgtagtagtaataagtttttcgagcggttgtcggggttaggtcgatatttttacggtagtcggagtttcgtgggttcgggttgtttgcggttaatacgaggcggcggcggcggtatgtggttttttttttttatttataaattttagcgtcgggcgaggaaggtaggcggggtagagtagagagcggcggtcgggcgggcgggggttgcgtagggcgaggcggtagttggaaaataagcgcgttcgtaggagcgagtttcgggttttgcgttcgcggttgggagttgcgtcggatcgggcgtagcgttgcgggggtcgcgttggggcgggggtgttttagacggggcgttttgcgcggcgtcgagtttggggggcggggtcgttttggggagtcgggttttgggtattggcgaaggtgtatcgggggcggcggtcgagcggttaaggatatttgtaggtttttcgggtcgcgcggagagggagttttagcgtaacgtttcggcgtttggtttttgcgatttggcggcgttgggagttacgttatttacgcgtttgtttattttcgggcggggcgtcggttttggttcgcgcgcggtagggggcgggcgcgaggtggtataggggagggggcgtttcggcgtcggtgggttggggttttaggggtttatggttttttttcggcgttggtagcggtcgttacgttttagtggcgttttttttttcggggtttcgtttcgtttagacgcgtttttcgcggggcggggtgggcggggcgcggcgtagcgcggagtcgattcgatttattgtaggttttggcgatcgagcgtagttttttttttcggagtcgagttttaat

SEQ ID NO: 29410 - DNA, 1059 bp, Artificial Sequence
  chemically treated genomic DNA (Homo sapiens) CpG-island No: 29410
attaaaactcgactccgaaaaaaaaaactacgctcgatcgccaaaacctacaataaatcgaatcgactccgcgctacgccgcgccccgcccaccccgccccgcgaaaaacgcgtctaaacgaaacgaaaccccgaaaaaaaaaacgccactaaaacgtaacgaccgctaccaacgccgaaaaaaaaccataaacccctaaaaccccaacccaccgacgccgaaacgccccctcccctataccacctcgcgcccgccccctaccgcgcgcgaaccaaaaccgacgccccgcccgaaaataaacaaacgcgtaaataacgtaactcccaacgccgccaaatcgcaaaaaccaaacgccgaaacgttacgctaaaactccctctccgcgcgacccgaaaaacctacaaatatccttaaccgctcgaccgccgcccccgatacaccttcgccaatacccaaaacccgactccccaaaacgaccccgccccccaaactcgacgccgcgcaaaacgccccgtctaaaacacccccgccccaacgcgacccccgcaacgctacgcccgatccgacgcaactcccaaccgcgaacgcaaaacccgaaactcgctcctacgaacgcgcttattttccaactaccgcctcgccctacgcaacccccgcccgcccgaccgccgctctctactctaccccgcctaccttcctcgcccgacgctaaaatttataaataaaaaaaaaaaaccacataccgccgccgccgcctcgtattaaccgcaaacaacccgaacccacgaaactccgactaccgtaaaaatatcgacctaaccccgacaaccgctcgaaaaacttattactactacgctaccgccgctacgaaaaaaccgactattccgaaacttaatacgatcttaaaaccgaaaaataacccgtataaacgcgaacgccccgaaccttcgcgatacgcgtaaactatacgcttcctcgtctttaatcgaaataaaaacgaaaacgtatccccgacccaaaacgtttatatatcccgtcgtaacgaaaaaccgcgtata

SEQ ID NO: 29411 - DNA, 1059 bp, Artificial Sequence
  chemically treated genomic DNA (Homo sapiens) CpG-island No: 29411
gttggggttcggtttcggggagaaagattgcgttcggtcgttagggtttgtagtgagtcggatcggtttcgcgttgcgtcgcgtttcgtttatttcgtttcgcgaagggcgcgtttgggcgaggcggggtttcggaggaaaaggcgttattggggcgtggcggtcgttgttagcgtcggagggagattatgagtttttagggttttagtttatcggcgtcgaggcgtttttttttttatgttatttcgcgttcgttttttgtcgcgcgcgagttaaggtcggcgtttcgttcggagatgggtagacgcgtagatggcgtggtttttagcgtcgttagatcgtaggaattaggcgtcggggcgttgcgttgaggtttttttttcgcgcggttcgggaagtttgtaggtgtttttggtcgttcggtcgtcgttttcggtatattttcgttagtgtttagagttcggttttttagagcggtttcgttttttaggttcggcgtcgcgtaggacgtttcgtttgaggtattttcgttttagcgcggttttcgtagcgttgcgttcggttcggcgtagtttttagtcgcggacgtaggattcgaggttcgtttttgcgggcgcgtttgttttttagttgtcgtttcgttttgcgtagttttcgttcgttcggtcgtcgttttttgttttgtttcgtttgtttttttcgttcggcgttgggatttatgaatggggggaagaggttatatgtcgtcgtcgtcgtttcgtgttgatcgtaagtagttcgggtttacggagtttcggttgtcgtgagagtgtcggtttggtttcggtagtcgttcggaggatttgttgttgttgcgttgtcgtcgttgcggggaagtcggttatttcggggtttggtgcggttttggagtcggagggtggttcgtgtgagcgcgagcgtttcggattttcgcggtgcgcgtggattgtgcgttttttcgtttttggtcggggtgaaggcgggggcgtgttttcggtttagagcgtttgtgtgtttcgtcgtagcgggggatcgcgtgtg

SEQ ID NO: 29412 - DNA, 1059 bp, Artificial Sequence
  chemically treated genomic DNA (Homo sapiens) CpG-island No: 29412
cacacgcgatcccccgctacgacgaaacacacaaacgctctaaaccgaaaacacgcccccgccttcaccccgaccaaaaacgaaaaaacgcacaatccacgcgcaccgcgaaaatccgaaacgctcgcgctcacacgaaccaccctccgactccaaaaccgcaccaaaccccgaaataaccgacttccccgcaacgacgacaacgcaacaacaacaaatcctccgaacgactaccgaaaccaaaccgacactctcacgacaaccgaaactccgtaaacccgaactacttacgatcaacacgaaacgacgacgacgacatataacctcttccccccattcataaatcccaacgccgaacgaaaaaaacaaacgaaacaaaacaaaaaacgacgaccgaacgaacgaaaactacgcaaaacgaaacgacaactaaaaaacaaacgcgcccgcaaaaacgaacctcgaatcctacgtccgcgactaaaaactacgccgaaccgaacgcaacgctacgaaaaccgcgctaaaacgaaaatacctcaaacgaaacgtcctacgcgacgccgaacctaaaaaacgaaaccgctctaaaaaaccgaactctaaacactaacgaaaatataccgaaaacgacgaccgaacgaccaaaaacacctacaaacttcccgaaccgcgcgaaaaaaaaacctcaacgcaacgccccgacgcctaattcctacgatctaacgacgctaaaaaccacgccatctacgcgtctacccatctccgaacgaaacgccgaccttaactcgcgcgcgacaaaaaacgaacgcgaaataacataaaaaaaaaaacgcctcgacgccgataaactaaaaccctaaaaactcataatctccctccgacgctaacaacgaccgccacgccccaataacgccttttcctccgaaaccccgcctcgcccaaacgcgcccttcgcgaaacgaaataaacgaaacgcgacgcaacgcgaaaccgatccgactcactacaaaccctaacgaccgaacgcaatctttctccccgaaaccgaaccccaac

SEQ ID NO: 29413 - DNA, 527 bp, Artificial Sequence
  chemically treated genomic DNA (Homo sapiens) CpG-island No: 29413
atagttacgtcggtaatttttaatttgtcgcgggttcgcgcggggcggttttttagagttttagtttttttttttagagcgggttcgtcgtcgtcggtgggttgagggagggcggttcggcgtcgggcgggtcgggcggggcggcgtttgatttagcgggcgggttatgggttgtttagtcggttcgatcggtcgggaggggtacgagtcgcgggggcgttgcggggtcgggcggttcggggggtgacgggaagggaggtcggttcggcgtcgtttagtttcgggtttcgggcgggaagtgggcgagcgcgacggtgcggggcgcgcgggcgacgggttagcgggatgggagtagggtttttcggcggttcgtagtttcgggagtcgcgttgaagtcgggggcgggattagcgcggagtcgatatgtgtttgcgtttcggtgagcgattgggggcgcgcgggaggtttcgaattattttaatttttttataggagcggagtattgagttcggaattcgagtttttag

SEQ ID NO: 29414 - DNA, 527 bp, Artificial Sequence
  chemically treated genomic DNA (Homo sapiens) CpG-island No: 29414
ctaaaaactcgaattccgaactcaatactccgctcctataaaaaaattaaaataattcgaaacctcccgcgcgcccccaatcgctcaccgaaacgcaaacacatatcgactccgcgctaatcccgcccccgacttcaacgcgactcccgaaactacgaaccgccgaaaaaccctactcccatcccgctaacccgtcgcccgcgcgccccgcaccgtcgcgctcgcccacttcccgcccgaaacccgaaactaaacgacgccgaaccgacctcccttcccgtcaccccccgaaccgcccgaccccgcaacgcccccgcgactcgtacccctcccgaccgatcgaaccgactaaacaacccataacccgcccgctaaatcaaacgccgccccgcccgacccgcccgacgccgaaccgccctccctcaacccaccgacgacgacgaacccgctctaaaaaaaaaaactaaaactctaaaaaaccgccccgcgcgaacccgcgacaaattaaaaattaccgacgtaactat

SEQ ID NO: 29415 - DNA, 527 bp, Artificial Sequence
  chemically treated genomic DNA (Homo sapiens) CpG-island No: 29415
ttgggggttcgggtttcgggtttagtgtttcgtttttgtgggagggttggggtggttcggggtttttcgcgcgtttttagtcgtttatcgaggcgtagatatatgtcggtttcgcgttggtttcgttttcggttttagcgcggttttcgaggttgcgggtcgtcgggggattttgtttttatttcgttggttcgtcgttcgcgcgtttcgtatcgtcgcgttcgtttatttttcgttcggagttcggggttgggcggcgtcggatcggttttttttttcgttatttttcgggtcgttcggtttcgtagcgttttcgcggttcgtgtttttttcggtcggtcggatcggttgagtagtttatggttcgttcgttgagttaggcgtcgtttcgttcggttcgttcggcgtcgagtcgtttttttttagtttatcggcggcggcgggttcgttttagaaagggaaattgaggttttgaggagtcgtttcgcgcgggttcgcggtaagttgggggttgtcggcgtagttgt

SEQ ID NO: 29416 - DNA, 527 bp, Artificial Sequence
  chemically treated genomic DNA (Homo sapiens) CpG-island No: 29416
acaactacgccgacaacccccaacttaccgcgaacccgcgcgaaacgactcctcaaaacctcaatttccctttctaaaacgaacccgccgccgccgataaactaaaaaaaaacgactcgacgccgaacgaaccgaacgaaacgacgcctaactcaacgaacgaaccataaactactcaaccgatccgaccgaccgaaaaaaacacgaaccgcgaaaacgctacgaaaccgaacgacccgaaaaataacgaaaaaaaaaaccgatccgacgccgcccaaccccgaactccgaacgaaaaataaacgaacgcgacgatacgaaacgcgcgaacgacgaaccaacgaaataaaaacaaaatcccccgacgacccgcaacctcgaaaaccgcgctaaaaccgaaaacgaaaccaacgcgaaaccgacatatatctacgcctcgataaacgactaaaaacgcgcgaaaaaccccgaaccaccccaaccctcccacaaaaacgaaacactaaacccgaaacccgaacccccaa

SEQ ID NO: 29417 - DNA, 533 bp, Artificial Sequence
  chemically treated genomic DNA (Homo sapiens) CpG-island No: 29417
tttttgcgttcggtttagtttaagtttttttcgtcgcgcgcggtttcgggagcgttgggtaggtagttcgggtgggagcgtttacgtttttcgcggatacggacggacggatggacgggcggtcgcgtaggttcgcgtttcgttttcgtttcgtttgtcgcgtttttcggggcgttcgtattaaagcgtatatgtaagttatgaattattaattgaaaggagttaattatcggttttaaaaacgagtgtttgcgttcgtagcgtttcgggttattcgtttatttacggagcgatttatttcgttcggttggggagggggtttcgggagggagagagacggagaaacggagttcgagatcgggagagagtcggagaggtagggattggagagtttgggatacgaaggagaggcggggagagatcgagatttagcgagacgcgcggagggtcggacgggagttaaggcggtttagttttttttttttttcgagtaggcgaggagaggtggggttttaggatttttaaggttttgt

SEQ ID NO: 29418 - DNA, 533 bp, Artificial Sequence
  chemically treated genomic DNA (Homo sapiens) CpG-island No: 29418
acaaaaccttaaaaatcctaaaaccccacctctcctcgcctactcgaaaaaaaaaaaaaactaaaccgccttaactcccgtccgaccctccgcgcgtctcgctaaatctcgatctctccccgcctctccttcgtatcccaaactctccaatccctacctctccgactctctcccgatctcgaactccgtttctccgtctctctccctcccgaaaccccctccccaaccgaacgaaataaatcgctccgtaaataaacgaataacccgaaacgctacgaacgcaaacactcgtttttaaaaccgataattaactcctttcaattaataattcataacttacatatacgctttaatacgaacgccccgaaaaacgcgacaaacgaaacgaaaacgaaacgcgaacctacgcgaccgcccgtccatccgtccgtccgtatccgcgaaaaacgtaaacgctcccacccgaactacctacccaacgctcccgaaaccgcgcgcgacgaaaaaaacttaaactaaaccgaacgcaaaaa

SEQ ID NO: 29419 - DNA, 533 bp, Artificial Sequence
  chemically treated genomic DNA (Homo sapiens) CpG-island No: 29419
atagggttttggaggttttgagattttattttttttcgtttgttcgggggagaagaggaattgagtcgttttggttttcgttcggtttttcgcgcgtttcgttgaatttcggttttttttcgtttttttttcgtgttttagattttttagtttttgttttttcggttttttttcggtttcgggtttcgttttttcgtttttttttttttcgaggttttttttttagtcgggcggggtagatcgtttcgtaaataggcggatggttcggggcgttgcgagcgtagatattcgtttttagagtcggtaattgattttttttagttgataatttatggtttgtatatgcgttttaatgcgggcgtttcgggaggcgcggtaggcggggcgggagcggggcgcgggtttgcgcggtcgttcgtttattcgttcgttcgtgttcgcgggagacgtgggcgtttttattcgggttgtttgtttagcgttttcgaggtcgcgcgcggcggaaggggtttgagttgggtcggacgtaaagg

SEQ ID NO: 29420 - DNA, 533 bp, Artificial Sequence
  chemically treated genomic DNA (Homo sapiens) CpG-island No: 29420
cctttacgtccgacccaactcaaaccccttccgccgcgcgcgacctcgaaaacgctaaacaaacaacccgaataaaaacgcccacgtctcccgcgaacacgaacgaacgaataaacgaacgaccgcgcaaacccgcgccccgctcccgccccgcctaccgcgcctcccgaaacgcccgcattaaaacgcatatacaaaccataaattatcaactaaaaaaaatcaattaccgactctaaaaacgaatatctacgctcgcaacgccccgaaccatccgcctatttacgaaacgatctaccccgcccgactaaaaaaaaaacctcgaaaaaaaaaaaaacgaaaaaacgaaacccgaaaccgaaaaaaaaccgaaaaaacaaaaactaaaaaatctaaaacacgaaaaaaaaacgaaaaaaaaccgaaattcaacgaaacgcgcgaaaaaccgaacgaaaaccaaaacgactcaattcctcttctcccccgaacaaacgaaaaaaaataaaatctcaaaacctccaaaaccctat

SEQ ID NO: 29421 - DNA, 552 bp, Artificial Sequence
  chemically treated genomic DNA (Homo sapiens) CpG-island No: 29421
attttttcgcggttgtttttgtaggcgggttttttatttattcggttgggagaagtttcggtcgttcgttcgggggagttttcgtttttttcgttcgagtaaattttttttaaattcgagagtcgtttagggcgaagtcgttttcgaggtttaattcgcgtttttcgcggatttgtataatcgggttagcggtcgcgttttttttcgttttcgtcgtcgtcgtcgtcgtcgcgcgcgattttttcgttgttatttagggaggtttagcgcgatttgcggtttaatttttcgggatcgttcggtcgtcgtttttcgaggggtcgttagattgttttttttataattgattgattttatttgtcggattgggattttaaagcgtcggcggcgcgggggcgtttgggaaggagcggggttcgaggagggcggggcggggcgggggtttggcgggtttcgtcgggagttgtagtttcgcggtcgtatcgttcggtttgggaggttagagtatgaaatgcgtaagtgataaggcggtgattacgttcgggtttggta

SEQ ID NO: 29422 - DNA, 552 bp, Artificial Sequence
  chemically treated genomic DNA (Homo sapiens) CpG-island No: 29422
taccaaacccgaacgtaatcaccgccttatcacttacgcatttcatactctaacctcccaaaccgaacgatacgaccgcgaaactacaactcccgacgaaacccgccaaacccccgccccgccccgccctcctcgaaccccgctccttcccaaacgcccccgcgccgccgacgctttaaaatcccaatccgacaaataaaatcaatcaattataaaaaaaacaatctaacgacccctcgaaaaacgacgaccgaacgatcccgaaaaattaaaccgcaaatcgcgctaaacctccctaaataacaacgaaaaaatcgcgcgcgacgacgacgacgacgacgaaaacgaaaaaaaacgcgaccgctaacccgattatacaaatccgcgaaaaacgcgaattaaacctcgaaaacgacttcgccctaaacgactctcgaatttaaaaaaaatttactcgaacgaaaaaaacgaaaactcccccgaacgaacgaccgaaacttctcccaaccgaataaataaaaaacccgcctacaaaaacaaccgcgaaaaaat

SEQ ID NO: 29423 - DNA, 552 bp, Artificial Sequence
  chemically treated genomic DNA (Homo sapiens) CpG-island No: 29423
tgttaggttcggacgtggttatcgttttgttatttgcgtattttatgttttggttttttaggtcgggcgatgcggtcgcggggttgtagttttcggcgaggttcgttaggttttcgtttcgtttcgtttttttcgggtttcgtttttttttaggcgttttcgcgtcgtcggcgttttgaagttttaattcggtaaatagagttaattaattatgaagggaataatttggcggtttttcggggagcggcggtcgagcgatttcgggggattaggtcgtaaatcgcgttgagtttttttaagtgatagcgagagaatcgcgcgcggcggcgacggcggcggcgggagcgggagggagcgcggtcgttaattcgattatgtagattcgcggggggcgcggattaggtttcgggggcggtttcgttttaagcggttttcggatttgggaaaagtttattcgggcggagggggcggagattttttcgggcgggcggtcgggattttttttagtcgggtgaatggaggattcgtttgtaggagtagtcgcgaaagagt

SEQ ID NO: 29424 - DNA, 552 bp, Artificial Sequence
  chemically treated genomic DNA (Homo sapiens) CpG-island No: 29424
actctttcgcgactactcctacaaacgaatcctccattcacccgactaaaaaaaatcccgaccgcccgcccgaaaaaatctccgccccctccgcccgaataaacttttcccaaatccgaaaaccgcttaaaacgaaaccgcccccgaaacctaatccgcgccccccgcgaatctacataatcgaattaacgaccgcgctccctcccgctcccgccgccgccgtcgccgccgcgcgcgattctctcgctatcacttaaaaaaactcaacgcgatttacgacctaatcccccgaaatcgctcgaccgccgctccccgaaaaaccgccaaattattcccttcataattaattaactctatttaccgaattaaaacttcaaaacgccgacgacgcgaaaacgcctaaaaaaaaacgaaacccgaaaaaaacgaaacgaaacgaaaacctaacgaacctcgccgaaaactacaaccccgcgaccgcatcgcccgacctaaaaaaccaaaacataaaatacgcaaataacaaaacgataaccacgtccgaacctaaca

SEQ ID NO: 29425 - DNA, 655 bp, Artificial Sequence
  chemically treated genomic DNA (Homo sapiens) CpG-island No: 29425
agcgtttacgagagttgggttgcgggcggtagcggtaggcgaagaatttagcgcggggaatttaggtttcggcggtgtacgattttttatagtttttattcgttttcgcgttcgcgtaataaaatttgttacggtcgcgtttcgatttagttgtgcgttcgcgggtttcggatttatcgttcgtttagtttggcgcggcgtttttattttagaaacgttgggtggatttcgcgtaattttttatttatagggtagtcggtagtcgcgtcgtcgcgtttcggtttagtttttggcgtcgtagatcgttcgtttcgcgtttttaaaagtatcgcgttcgtttagaagttcgggtagtttcgcgatttttatttacgttttttagtatcgtcgttgttttaatcgttatttagtttttcgtttgcgtttgcgtttgtagtttattggttttttaggatttcgatgggcgtgttaggataatttaaggcgtaggcgcggcggggttttaaagggattcggcggttttttttgtataacgggttcgagtaggttaggggtcgcgtaggcggaggaaaggagtaatttaggggaaggatcgagtgtagcggggacggggaaatttttttttttttttcgtttgttttttaaagtattagtt

SEQ ID NO: 29426 - DNA, 655 bp, Artificial Sequence
  chemically treated genomic DNA (Homo sapiens) CpG-island No: 29426
aactaatactttaaaaaacaaacgaaaaaaaaaaaaaaatttccccgtccccgctacactcgatccttcccctaaattactcctttcctccgcctacgcgacccctaacctactcgaacccgttatacaaaaaaaaccgccgaatccctttaaaaccccgccgcgcctacgccttaaattatcctaacacgcccatcgaaatcctaaaaaaccaataaactacaaacgcaaacgcaaacgaaaaactaaataacgattaaaacaacgacgatactaaaaaacgtaaataaaaatcgcgaaactacccgaacttctaaacgaacgcgatacttttaaaaacgcgaaacgaacgatctacgacgccaaaaactaaaccgaaacgcgacgacgcgactaccgactaccctataaataaaaaattacgcgaaatccacccaacgtttctaaaataaaaacgccgcgccaaactaaacgaacgataaatccgaaacccgcgaacgcacaactaaatcgaaacgcgaccgtaacaaattttattacgcgaacgcgaaaacgaataaaaactataaaaaatcgtacaccgccgaaacctaaattccccgcgctaaattcttcgcctaccgctaccgcccgcaacccaactctcgtaaacgct

SEQ ID NO: 29427 - DNA, 655 bp, Artificial Sequence
  chemically treated genomic DNA (Homo sapiens) CpG-island No: 29427
ggttggtgttttgaaagataggcggaggggagagagggattttttcgttttcgttgtattcggttttttttttgggttatttttttttttcgtttgcgcggtttttaatttgttcgaattcgttgtgtagaagaggtcgtcgggtttttttaaggtttcgtcgcgtttgcgttttgggttattttgatacgtttatcgggattttgaggagttagtgggttgtaggcgtaggcgtaggcgaggggttgggtggcggttgagatagcggcggtattgggaggcgtaggtgagggtcgcgaggttgttcgagtttttgagcgagcgcggtgtttttgggaacgcgggacgggcgatttgcggcgttaggagttgggtcgaggcgcggcggcgcggttgtcggttgttttgtgaatgggaagttacgcgaagtttatttagcgtttttgaggtgagggcgtcgcgttaggttgggcgggcggtgaattcgggattcgcgggcgtatagttgggtcgaggcgcggtcgtggtaagttttgttgcgcgagcgcgggggcgggtgggggttgtggggggtcgtgtatcgtcggggtttgagtttttcgcgttggatttttcgtttgtcgttgtcgttcgtagtttaattttcgtgggcgtt

SEQ ID NO: 29428 - DNA, 655 bp, Artificial Sequence
  chemically treated genomic DNA (Homo sapiens) CpG-island No: 29428
aacgcccacgaaaattaaactacgaacgacaacgacaaacgaaaaatccaacgcgaaaaactcaaaccccgacgatacacgaccccccacaacccccacccgcccccgcgctcgcgcaacaaaacttaccacgaccgcgcctcgacccaactatacgcccgcgaatcccgaattcaccgcccgcccaacctaacgcgacgccctcacctcaaaaacgctaaataaacttcgcgtaacttcccattcacaaaacaaccgacaaccgcgccgccgcgcctcgacccaactcctaacgccgcaaatcgcccgtcccgcgttcccaaaaacaccgcgctcgctcaaaaactcgaacaacctcgcgaccctcacctacgcctcccaataccgccgctatctcaaccgccacccaacccctcgcctacgcctacgcctacaacccactaactcctcaaaatcccgataaacgtatcaaaataacccaaaacgcaaacgcgacgaaaccttaaaaaaacccgacgacctcttctacacaacgaattcgaacaaattaaaaaccgcgcaaacgaaaaaaaaaaataacccaaaaaaaaaaccgaatacaacgaaaacgaaaaaatccctctctcccctccgcctatctttcaaaacaccaacc

SEQ ID NO: 29429 - DNA, 839 bp, Artificial Sequence
  chemically treated genomic DNA (Homo sapiens) CpG-island No: 29429
gcgttttatcgtcgattcgcgtcgaatgtatggtcgcgtcgttagtttgttcgtttggtgtagtaagatttttacgttgtttaagagtatggttacgttgttagtcgcgttgggcggtcggtttgcgtatttggcggagttgtcgatcgttgatacgggttagtcgttggcgtcgttgtttgaggcgttttgattgtcggggtcgttttgtttgggtcgttcgtattggtttaattggtgtcgcgaggttgtggcgcgcgagattttcgagtgcggcgttttcgtgtagtattatcgcgttatttacgagttgcgcgtattggacgcggcgttttcgcgttgttcgcgtcgtaagttttcgtagttcgttggcgtttcggttcgcgagtttattttgtaggaggattacgtggcggtcggttttggttagtttagcgtcgtcgtcgtttacggttcgttggtcgattgggagtttttggatattttgggttcgtttgaggtataggattgttaggcggcgttatttgagttcgagtagttggcgcgtcggtcgtttttttgtacggaattgcgcggcgtttaggattatttcgatttgcgtaaggagcgtatcgtttatttttttttggagtattggcgtttttgggtttttttcggatcgggtttttcgcggattaggcgcgtttaggtagattgttttttggcgtgacggtcgttcgtgttggtcggagttggaggttacggacgtttttcggttgtcggtgagtaagggcgaggtttatagttttaacgaacggttgcggtagttgttgaggtagcggtaggtagtgggtaagttg

SEQ ID NO: 29430 - DNA, 839 bp, Artificial Sequence
  chemically treated genomic DNA (Homo sapiens) CpG-island No: 29430
caacttacccactacctaccgctacctcaacaactaccgcaaccgttcgttaaaactataaacctcgcccttactcaccgacaaccgaaaaacgtccgtaacctccaactccgaccaacacgaacgaccgtcacgccaaaaaacaatctacctaaacgcgcctaatccgcgaaaaacccgatccgaaaaaaacccaaaaacgccaatactccaaaaaaaaataaacgatacgctccttacgcaaatcgaaataatcctaaacgccgcgcaattccgtacaaaaaaacgaccgacgcgccaactactcgaactcaaataacgccgcctaacaatcctatacctcaaacgaacccaaaatatccaaaaactcccaatcgaccaacgaaccgtaaacgacgacgacgctaaactaaccaaaaccgaccgccacgtaatcctcctacaaaataaactcgcgaaccgaaacgccaacgaactacgaaaacttacgacgcgaacaacgcgaaaacgccgcgtccaatacgcgcaactcgtaaataacgcgataatactacacgaaaacgccgcactcgaaaatctcgcgcgccacaacctcgcgacaccaattaaaccaatacgaacgacccaaacaaaacgaccccgacaatcaaaacgcctcaaacaacgacgccaacgactaacccgtatcaacgatcgacaactccgccaaatacgcaaaccgaccgcccaacgcgactaacaacgtaaccatactcttaaacaacgtaaaaatcttactacaccaaacgaacaaactaacgacgcgaccatacattcgacgcgaatcgacgataaaacgc

SEQ ID NO: 29431 - DNA, 839 bp, Artificial Sequence
  chemically treated genomic DNA (Homo sapiens) CpG-island No: 29431
tagtttgtttattgtttgtcgttgttttagtagttgtcgtagtcgttcgttggggttgtgggtttcgtttttgtttatcggtagtcggggggcgttcgtggtttttagtttcggttagtacgggcggtcgttacgttagggagtagtttgtttaggcgcgtttggttcgcggaaggttcggttcgaggaaggtttagaggcgttagtgttttaggaagaggtaaacgatgcgttttttgcgtaggtcgaggtagttttggacgtcgcgtagtttcgtgtagaggggcggtcggcgcgttagttgttcgggtttaagtagcgtcgtttggtaattttgtgttttaggcgggtttagggtgtttaggggtttttagtcggttagcgggtcgtgggcggcggcggcgttgggttggttagagtcggtcgttacgtagtttttttataggatgggttcgcggatcggggcgttagcggattgcgggggtttgcggcgcggatagcgcgggggcgtcgcgtttagtgcgcgtagttcgtaggtggcgcggtgatgttgtacggagacgtcgtattcgaggatttcgcgcgttatagtttcgcggtattagttgagttagtgcgagcggtttaggtaaagcggtttcggtagttagggcgttttaggtagcggcgttagcggttggttcgtgttagcggtcggtagtttcgttaggtgcgtaggtcggtcgtttagcgcggttagtagcgtggttatgtttttgagtagcgtggagattttgttgtattaggcgggtaggttggcggcgcggttatgtattcggcgcgggtcgacggtgaagcgt

SEQ ID NO: 29432 - DNA, 839 bp, Artificial Sequence
  chemically treated genomic DNA (Homo sapiens) CpG-island No: 29432
acgcttcaccgtcgacccgcgccgaatacataaccgcgccgccaacctacccgcctaatacaacaaaatctccacgctactcaaaaacataaccacgctactaaccgcgctaaacgaccgacctacgcacctaacgaaactaccgaccgctaacacgaaccaaccgctaacgccgctacctaaaacgccctaactaccgaaaccgctttacctaaaccgctcgcactaactcaactaataccgcgaaactataacgcgcgaaatcctcgaatacgacgtctccgtacaacatcaccgcgccacctacgaactacgcgcactaaacgcgacgcccccgcgctatccgcgccgcaaacccccgcaatccgctaacgccccgatccgcgaacccatcctataaaaaaactacgtaacgaccgactctaaccaacccaacgccgccgccgcccacgacccgctaaccgactaaaaacccctaaacaccctaaacccgcctaaaacacaaaattaccaaacgacgctacttaaacccgaacaactaacgcgccgaccgcccctctacacgaaactacgcgacgtccaaaactacctcgacctacgcaaaaaacgcatcgtttacctcttcctaaaacactaacgcctctaaaccttcctcgaaccgaaccttccgcgaaccaaacgcgcctaaacaaactactccctaacgtaacgaccgcccgtactaaccgaaactaaaaaccacgaacgccccccgactaccgataaacaaaaacgaaacccacaaccccaacgaacgactacgacaactactaaaacaacgacaaacaataaacaaacta

SEQ ID NO: 29433 - DNA, 822 bp, Artificial Sequence
  chemically treated genomic DNA (Homo sapiens) CpG-island No: 29433
ggcggtacgtgtcgttaagttcgggtttggcgtacggcgtgtattggttttagtattttttgtcgtttttagacggcggcgtattttcgcgttacgaaagttttacgttcgatttttttatgttcggttatttttagttatcggagatgggtttgagtcgcgaggatcgtaagtttcgttatttattgtgttacgagatgttttatcggttggatagttattcgtgggagcgtattcgttttttttatcgcgtggtgttggaggaggtggaggtcggtcggcgcggttggagcgacggtttcgaggattttaggtataggtttttcggaaacggtttggaggttgggtcggttttcgaagaataggcgaagaaaaaggaagagaaggggaaagaataggagcggatcgaagaggtcgtttcggtttagaagggggattcgtttaaggggtagcgcgaggttttggtttttgtgtcgtagtcgtcgttatcgttcgttcgttcgtcggttcgtcgcgttttttcgtcgcgttttttcggattttagatttttcgggtttcgaagttttcgtcgaagattttttggaattagtgtttgagatgggcgaatttagtaacgaggatatttgtcgttatatcgatcgtagtttttttttttggaaggagaaggaggtagagttgtttgatatttgagtagcggaattcggaattcgtagtttattttcgagcgttttaacgtgggtttggacgtttgtttgacgttttttagaggcgtgaagtagcgggaagaatttaggattgtggttttgagtagttcggagggt

SEQ ID NO: 29434 - DNA, 822 bp, Artificial Sequence
  chemically treated genomic DNA (Homo sapiens) CpG-island No: 29434
accctccgaactactcaaaaccacaatcctaaattcttcccgctacttcacgcctctaaaaaacgtcaaacaaacgtccaaacccacgttaaaacgctcgaaaataaactacgaattccgaattccgctactcaaatatcaaacaactctacctccttctccttccaaaaaaaaaaactacgatcgatataacgacaaatatcctcgttactaaattcgcccatctcaaacactaattccaaaaaatcttcgacgaaaacttcgaaacccgaaaaatctaaaatccgaaaaaacgcgacgaaaaaacgcgacgaaccgacgaacgaacgaacgataacgacgactacgacacaaaaaccaaaacctcgcgctaccccttaaacgaatcccccttctaaaccgaaacgacctcttcgatccgctcctattctttccccttctcttcctttttcttcgcctattcttcgaaaaccgacccaacctccaaaccgtttccgaaaaacctatacctaaaatcctcgaaaccgtcgctccaaccgcgccgaccgacctccacctcctccaacaccacgcgataaaaaaaacgaatacgctcccacgaataactatccaaccgataaaacatctcgtaacacaataaataacgaaacttacgatcctcgcgactcaaacccatctccgataactaaaaataaccgaacataaaaaaatcgaacgtaaaactttcgtaacgcgaaaatacgccgccgtctaaaaacgacaaaaaatactaaaaccaatacacgccgtacgccaaacccgaacttaacgacacgtaccgcc

SEQ ID NO: 29435 - DNA, 822 bp, Artificial Sequence
  chemically treated genomic DNA (Homo sapiens) CpG-island No: 29435
gtttttcgggttgtttaaggttatagttttgggtttttttcgttgttttacgtttttggagggcgttagataggcgtttaggtttacgttaagacgttcgagggtgaattgcgaatttcgaatttcgttgtttagatgttaaatagttttgtttttttttttttttagaaggagaagttgcggtcgatgtagcggtagatgttttcgttgttgaattcgtttattttagatattagttttaaagggttttcggcgggggtttcggaattcggagagtttgagattcggggaggcgcggcggggaggcgcggcgggtcggcgggcgggcgggcggtggcggcggttgcggtataggggttagggtttcgcgttgttttttgggcgggttttttttttgaatcggagcggttttttcggttcgtttttgtttttttttttttttttttttttttttcgtttgtttttcgggggtcggtttagtttttaggtcgttttcgaagaatttgtgtttgaggttttcgaagtcgtcgttttagtcgcgtcggtcggtttttattttttttagtattacgcggtggaagaggcggatgcgtttttacgggtggttgtttagtcggtggaatatttcgtagtatagtaggtggcggaatttgcgattttcgcggtttaggtttattttcggtagttggaagtagtcgagtatgaagaggtcgagcgtgaggttttcgtagcgcgggggtgcgtcgtcgtttaggggcgataggaagtgttggggttagtatacgtcgtgcgttaggttcgggtttggcggtacgtgtcgtt

SEQ ID NO: 29436 - DNA, 822 bp, Artificial Sequence
  chemically treated genomic DNA (Homo sapiens) CpG-island No: 29436
aacgacacgtaccgccaaacccgaacctaacgcacgacgtatactaaccccaacacttcctatcgcccctaaacgacgacgcacccccgcgctacgaaaacctcacgctcgacctcttcatactcgactacttccaactaccgaaaataaacctaaaccgcgaaaatcgcaaattccgccacctactatactacgaaatattccaccgactaaacaaccacccgtaaaaacgcatccgcctcttccaccgcgtaatactaaaaaaaataaaaaccgaccgacgcgactaaaacgacgacttcgaaaacctcaaacacaaattcttcgaaaacgacctaaaaactaaaccgacccccgaaaaacaaacgaaaaaaaaaaaaaaaaaaaaaaaaaaacaaaaacgaaccgaaaaaaccgctccgattcaaaaaaaaaacccgcccaaaaaacaacgcgaaaccctaacccctataccgcaaccgccgccaccgcccgcccgcccgccgacccgccgcgcctccccgccgcgcctccccgaatctcaaactctccgaattccgaaacccccgccgaaaaccctttaaaactaatatctaaaataaacgaattcaacaacgaaaacatctaccgctacatcgaccgcaacttctccttctaaaaaaaaaaaaaaacaaaactatttaacatctaaacaacgaaattcgaaattcgcaattcaccctcgaacgtcttaacgtaaacctaaacgcctatctaacgccctccaaaaacgtaaaacaacgaaaaaaacccaaaactataaccttaaacaacccgaaaaac

SEQ ID NO: 29437 - DNA, 588 bp, Artificial Sequence
  chemically treated genomic DNA (Homo sapiens) CpG-island No: 29437
gaattacgtgacgtaatcggacgattaatcgttttttatttttgttcgcggtttagtttttggttttttttttcgttttcgtttttttcgtttagtttcgttttttgtttgcggagagttcgcgtttgcgcgttgtgttttgcgcgttttttttttcgcgcgcgtttttcgtggaagagtaggggtagcgtgggaggcgttaagggagcgcgaatttgaggaggaagaaacggggttagcgcgtaggtttagaacggttcgagtcgcggtagtcggcgacgttttagagcggaagagggaagtgaattaggcgtcgggtagtgggttgttgggttgggtttgttgaggtagaggtagcgttaagaagaggtttttgtcgttggtcgggattgggatgtcgaagaatatagtgtcgtcggttcgttttcggaaggtggacgtggatgaatatgacgagaataagttcgtggacgaagaagatgggggcgacggttaggtcgggttcgacgagggcgaggtggatttttgtttgcggtaatatttttgtatttatcgttttttttattttagtttagtttagttcgtttt

SEQ ID NO: 29438 - DNA, 588 bp, Artificial Sequence
  chemically treated genomic DNA (Homo sapiens) CpG-island No: 29438
aaaacgaactaaactaaactaaaataaaaaaaacgataaatacaaaaatattaccgcaaacaaaaatccacctcgccctcgtcgaacccgacctaaccgtcgcccccatcttcttcgtccacgaacttattctcgtcatattcatccacgtccaccttccgaaaacgaaccgacgacactatattcttcgacatcccaatcccgaccaacgacaaaaacctcttcttaacgctacctctacctcaacaaacccaacccaacaacccactacccgacgcctaattcacttccctcttccgctctaaaacgtcgccgactaccgcgactcgaaccgttctaaacctacgcgctaaccccgtttcttcctcctcaaattcgcgctcccttaacgcctcccacgctacccctactcttccacgaaaaacgcgcgcgaaaaaaaaaacgcgcaaaacacaacgcgcaaacgcgaactctccgcaaacaaaaaacgaaactaaacgaaaaaaacgaaaacgaaaaaaaaaaccaaaaactaaaccgcgaacaaaaataaaaaacgattaatcgtccgattacgtcacgtaattc

SEQ ID NO: 29439 - DNA, 588 bp, Artificial Sequence
  chemically treated genomic DNA (Homo sapiens) CpG-island No: 29439
agggcgggttgggttgggttggggtggggagggcggtgaatgtaaggatattgtcgtaggtaggagtttatttcgttttcgtcgggttcggtttggtcgtcgtttttatttttttcgtttacgaatttgttttcgttatatttatttacgtttatttttcggaagcgggtcgacgatattgtgtttttcgatattttaatttcgattagcggtaaaggtttttttttggcgttgtttttattttagtaagtttagtttagtaatttattattcggcgtttgatttatttttttttttcgttttgaggcgtcgtcgattgtcgcggttcggatcgttttgggtttgcgcgttagtttcgtttttttttttttaggttcgcgtttttttggcgttttttacgttgtttttgtttttttacggagagcgcgcgcgagggaaggagcgcgtaggatatagcgcgtaggcgcgggtttttcgtaggtaaggggcggggttgggcgaaggaggcgggggcgagagggagggttaaaagttggatcgcgggtagaggtaagaagcgattggtcgttcgattgcgttacgtgattt

SEQ ID NO: 29440 - DNA, 588 bp, Artificial Sequence
  chemically treated genomic DNA (Homo sapiens) CpG-island No: 29440
aaatcacgtaacgcaatcgaacgaccaatcgcttcttacctctacccgcgatccaacttttaaccctccctctcgcccccgcctccttcgcccaaccccgccccttacctacgaaaaacccgcgcctacgcgctatatcctacgcgctccttccctcgcgcgcgctctccgtaaaaaaacaaaaacaacgtaaaaaacgccaaaaaaacgcgaacctaaaaaaaaaaaaacgaaactaacgcgcaaacccaaaacgatccgaaccgcgacaatcgacgacgcctcaaaacgaaaaaaaaaaataaatcaaacgccgaataataaattactaaactaaacttactaaaataaaaacaacgccaaaaaaaaacctttaccgctaatcgaaattaaaatatcgaaaaacacaatatcgtcgacccgcttccgaaaaataaacgtaaataaatataacgaaaacaaattcgtaaacgaaaaaaataaaaacgacgaccaaaccgaacccgacgaaaacgaaataaactcctacctacgacaatatccttacattcaccgccctccccaccccaacccaacccaacccgccct

SEQ ID NO: 29441 - DNA, 755 bp, Artificial Sequence
  chemically treated genomic DNA (Homo sapiens) CpG-island No: 29441
gtgttcgacgagaggacggttgatcgggcggcgcggttgcggagttttttgtttgagttggtagcgttgatcgcgtgtatttacgtgtagtgggattgtgtttcgttcgatttcgtagcgttttttttcgttgtcgcgttcgcgttgtttaacgcgttgtagttgcgcgttttcgtcgagtcggggggcgtcgtgcgcgttgcgttggtggtgcgtgggtagtacgcgttttttttcgtagtttttcgcgtcgacggtcgttggtattatgtgtgcgttacgtgggagtagcggggcgggcgttgggcgttgtttttcgatgggaggcggcgcgttggggcgcgggggttgggcgtcggttattcggtgtcgttcggcggtattttggtgttgggttaggattaggattttttgggcggtggtttttcggtgcgttacgtttttagcggtaattttatcgatttttatttgtgggcgcgggcgttgagtttcgtttagttgtatcgggtacgggtttgcgcgtcgtttttagagggtttgttttttcgttgggattcgggcgttttggacgttacgttttcgttgttgtttattgtgtgggtgcgttttttttgtttcggtacgattcgtttcgtttcggttttattttatggtttcgaatttttttttttcgattttggaattcgatttattttttgttaattaagttacgtttagttttggttacgttttttttaggtcgtagtgtttgtaag

SEQ ID NO: 29442 - DNA, 755 bp, Artificial Sequence
  chemically treated genomic DNA (Homo sapiens) CpG-island No: 29442
cttacaaacactacgacctaaaaaaaacgtaaccaaaactaaacgtaacttaattaacaaaaaataaatcgaattccaaaatcgaaaaaaaaaaattcgaaaccataaaataaaaccgaaacgaaacgaatcgtaccgaaacaaaaaaaacgcacccacacaataaacaacaacgaaaacgtaacgtccaaaacgcccgaatcccaacgaaaaaacaaaccctctaaaaacgacgcgcaaacccgtacccgatacaactaaacgaaactcaacgcccgcgcccacaaataaaaatcgataaaattaccgctaaaaacgtaacgcaccgaaaaaccaccgcccaaaaaatcctaatcctaacccaacaccaaaataccgccgaacgacaccgaataaccgacgcccaacccccgcgccccaacgcgccgcctcccatcgaaaaacaacgcccaacgcccgccccgctactcccacgtaacgcacacataataccaacgaccgtcgacgcgaaaaactacgaaaaaaaacgcgtactacccacgcaccaccaacgcaacgcgcacgacgccccccgactcgacgaaaacgcgcaactacaacgcgttaaacaacgcgaacgcgacaacgaaaaaaaacgctacgaaatcgaacgaaacacaatcccactacacgtaaatacacgcgatcaacgctaccaactcaaacaaaaaactccgcaaccgcgccgcccgatcaaccgtcctctcgtcgaacac

SEQ ID NO: 29443 - DNA, 755 bp, Artificial Sequence
  chemically treated genomic DNA (Homo sapiens) CpG-island No: 29443
tttgtaggtattgcggtttggagagggcgtggttagagttaggcgtggtttggttggtaaggggtgggtcgagttttagggtcggaagggaaggattcggggttatggggtggggtcggggcggggcgggtcgtatcgggatagagaaggcgtatttatatagtgggtagtagcgagggcgtgacgtttagggcgttcgggttttagcggaagagtaggttttttgagggcggcgcgtaggttcgtgttcggtgtagttgagcggggtttagcgttcgcgtttataggtggaagtcggtgaggttgtcgttgagggcgtgacgtatcgagaagttatcgtttagagagttttgattttggtttagtattaggatgtcgtcggacggtatcgggtggtcggcgtttagttttcgcgttttagcgcgtcgttttttatcggagaatagcgtttagcgttcgtttcgttgtttttacgtggcgtatatatggtgttagcggtcgtcggcgcggaaggttgcgaggaagggcgcgtgttgtttacgtattattagcgtagcgcgtacgacgtttttcggttcggcgaaggcgcgtagttgtagcgcgttgggtagcgcgggcgcggtaacggagaagagcgttgcggggtcgggcgaggtatagttttattgtacgtgagtatacgcggttagcgttgttagtttaggtagagggtttcgtagtcgcgtcgttcggttagtcgttttttcgtcgaatat

SEQ ID NO: 29444 - DNA, 755 bp, Artificial Sequence
  chemically treated genomic DNA (Homo sapiens) CpG-island No: 29444
atattcgacgaaaaaacgactaaccgaacgacgcgactacgaaaccctctacctaaactaacaacgctaaccgcgtatactcacgtacaataaaactatacctcgcccgaccccgcaacgctcttctccgttaccgcgcccgcgctacccaacgcgctacaactacgcgccttcgccgaaccgaaaaacgtcgtacgcgctacgctaataatacgtaaacaacacgcgcccttcctcgcaaccttccgcgccgacgaccgctaacaccatatatacgccacgtaaaaacaacgaaacgaacgctaaacgctattctccgataaaaaacgacgcgctaaaacgcgaaaactaaacgccgaccacccgataccgtccgacgacatcctaatactaaaccaaaatcaaaactctctaaacgataacttctcgatacgtcacgccctcaacgacaacctcaccgacttccacctataaacgcgaacgctaaaccccgctcaactacaccgaacacgaacctacgcgccgccctcaaaaaacctactcttccgctaaaacccgaacgccctaaacgtcacgccctcgctactacccactatataaatacgccttctctatcccgatacgacccgccccgccccgaccccaccccataaccccgaatccttcccttccgaccctaaaactcgacccaccccttaccaaccaaaccacgcctaactctaaccacgccctctccaaaccgcaatacctacaaa

SEQ ID NO: 29445 - DNA, 1233 bp, Artificial Sequence
  chemically treated genomic DNA (Homo sapiens) CpG-island No: 29445
ttcggttcggtaaggggcgcgttaaaggtgatattggaaggagtagggatagtttttggcggtagagatggagtcgagagcgatgtaggcggtttattttagtcggcgcgatttgtcggtatacgggaattcgagtggtcgtcgttagagtcggttagttgggggagcgcgggcgttttttttggattcgttcgtttttgggttgggttcggagtcgggtcggttggagcgagataggggcgggaggggtcgggttagcgggaggagggcggggtttttttttgttaggggatttgcgtcgcgtagtttagattcgcgcgggtttcgtttttttttttgcgtttttttcgggggcggggcgtttttttttggtttcggggcgcggtgggcgtgggttgcgggagtcgaacggttggcgtttcgggtttttcgtttcgaatttcgtagaagtttttttttcggcgttttagtttttaattttttttatcgttttttttattttcggagtcgttttttttttcggtttcgttttcgtcgggtttcgttttcgttttcgtttttttttttgtgtttttcgcgtcgcgcgttttttggtttttagggggttgttcgggcggggcggcgtagcgcggcggcgcggggaagggggaggagagtcgttcgttagtcgagtatttttagcgagttagcgagttagcgggtcgcgttgcgcgggggaggaggattcgtttttcgttcgattttagcggagttttttgtttttagttagaagtttgtatgtcgggatcgtgatagttgcgggcggggaggacggcggggtcgcggggttagcggcgtggtggagaatagaggcggttgtttgttatgtagtttacggcgtggcggttgcgggtcggggattggcggcggcgggcgaggcggcgtttatagtattcgggatttagttgtcggagggataaattaattttttgagcgcgggatttgaggttggcgcggtcgggagttatttgtagtttgcggtgaggcgattttggttttcggggcgcgcggtatggcgcggggaagcgggtcgtgttgagcgagttttttcgatagattcgcggtcgttgttgttgttcgttcgttcgtttgttttttcgaaggtttggcgcggggtttcgttcgttttgttttgtagttatagcgtagggttggtttgggagttataataatgttatgatgttttggagatag

SEQ ID NO: 29446 - DNA, 1233 bp, Artificial Sequence
  chemically treated genomic DNA (Homo sapiens) CpG-island No: 29446
ctatctccaaaacatcataacattattataactcccaaaccaaccctacgctataactacaaaacaaaacgaacgaaaccccgcgccaaaccttcgaaaaaacaaacgaacgaacgaacaacaacaacgaccgcgaatctatcgaaaaaactcgctcaacacgacccgcttccccgcgccataccgcgcgccccgaaaaccaaaatcgcctcaccgcaaactacaaataactcccgaccgcgccaacctcaaatcccgcgctcaaaaaattaatttatccctccgacaactaaatcccgaatactataaacgccgcctcgcccgccgccgccaatccccgacccgcaaccgccacgccgtaaactacataacaaacaaccgcctctattctccaccacgccgctaaccccgcgaccccgccgtcctccccgcccgcaactatcacgatcccgacatacaaacttctaactaaaaacaaaaaactccgctaaaatcgaacgaaaaacgaatcctcctcccccgcgcaacgcgacccgctaactcgctaactcgctaaaaatactcgactaacgaacgactctcctcccccttccccgcgccgccgcgctacgccgccccgcccgaacaaccccctaaaaaccaaaaaacgcgcgacgcgaaaaacacaaaaaaaaaaacgaaaacgaaaacgaaacccgacgaaaacgaaaccgaaaaaaaaaacgactccgaaaataaaaaaaacgataaaaaaaattaaaaactaaaacgccgaaaaaaaaacttctacgaaattcgaaacgaaaaacccgaaacgccaaccgttcgactcccgcaacccacgcccaccgcgccccgaaaccaaaaaaaaacgccccgcccccgaaaaaaacgcaaaaaaaaaaacgaaacccgcgcgaatctaaactacgcgacgcaaatcccctaacaaaaaaaaaccccgccctcctcccgctaacccgacccctcccgcccctatctcgctccaaccgacccgactccgaacccaacccaaaaacgaacgaatccaaaaaaaacgcccgcgctcccccaactaaccgactctaacgacgaccactcgaattcccgtataccgacaaatcgcgccgactaaaataaaccgcctacatcgctctcgactccatctctaccgccaaaaactatccctactccttccaatatcacctttaacgcgccccttaccgaaccgaa

SEQ ID NO: 29447 - DNA, 1233 bp, Artificial Sequence
  chemically treated genomic DNA (Homo sapiens) CpG-island No: 29447
ttgtttttaaaatattatggtattgttgtggtttttaggttaattttgcgttgtagttgtaaaataaggcgagcggagtttcgcgttaggttttcggaaaggtaggcgggcgggcgggtagtagtagcggtcgcgggtttgtcggaggggttcgtttagtacggttcgttttttcgcgttatgtcgcgcgtttcgagggttagggtcgttttatcgtaggttgtaggtggttttcggtcgcgttagttttaggtttcgcgtttaggaagttagtttgttttttcggtagttgagtttcgagtgttgtgggcgtcgtttcgttcgtcgtcgttagttttcggttcgtagtcgttacgtcgtgggttgtatgataagtagtcgtttttattttttattacgtcgttggtttcgcggtttcgtcgtttttttcgttcgtagttgttacggtttcggtatgtaaatttttggttgggaataaaaggtttcgttagggtcgggcggggggcgagtttttttttttcgcgtagcgcgattcgttagttcgttagttcgttggaagtgttcggttggcgggcggtttttttttttttttttcgcgtcgtcgcgttgcgtcgtttcgttcgggtagttttttggaagttagggagcgcgcgacgcggagagtataggaaggaggacgagggcgggggcggggttcggcgggggcggggtcggggagaggagcgatttcgagagtggagggagcggtggagaggattggaggttgaggcgtcgaaggaggggtttttgcgggattcggagcgagagattcgggacgttagtcgttcggttttcgtagtttacgtttatcgcgtttcggggttagaggggaacgtttcgttttcggagagggcgtaaggagaggaacggaattcgcgcgagtttgggttgcgcggcgtaaattttttgataaaggaaagtttcgtttttttttcgttggttcggtttttttcgtttttgtttcgttttaatcggttcggtttcgagtttagtttaaaggcgaacgaatttagaaagggcgttcgcgtttttttagttagtcggttttggcgacggttattcgagttttcgtgtgtcggtaggtcgcgtcggttggggtaggtcgtttgtatcgttttcggttttatttttgtcgttaaaggttgtttttgttttttttagtgttatttttagcgcgttttttgtcggatcgaa

SEQ ID NO: 29448 - DNA, 1233 bp, Artificial Sequence
  chemically treated genomic DNA (Homo sapiens) CpG-island No: 29448
ttcgatccgacaaaaaacgcgctaaaaataacactaaaaaaaacaaaaacaacctttaacgacaaaaataaaaccgaaaacgatacaaacgacctaccccaaccgacgcgacctaccgacacacgaaaactcgaataaccgtcgccaaaaccgactaactaaaaaaacgcgaacgccctttctaaattcgttcgcctttaaactaaactcgaaaccgaaccgattaaaacgaaacaaaaacgaaaaaaaccgaaccaacgaaaaaaaaacgaaactttcctttatcaaaaaatttacgccgcgcaacccaaactcgcgcgaattccgttcctctccttacgccctctccgaaaacgaaacgttcccctctaaccccgaaacgcgataaacgtaaactacgaaaaccgaacgactaacgtcccgaatctctcgctccgaatcccgcaaaaacccctccttcgacgcctcaacctccaatcctctccaccgctccctccactctcgaaatcgctcctctccccgaccccgcccccgccgaaccccgcccccgccctcgtcctccttcctatactctccgcgtcgcgcgctccctaacttccaaaaaactacccgaacgaaacgacgcaacgcgacgacgcgaaaaaaaaaaaaaaaaaccgcccgccaaccgaacacttccaacgaactaacgaactaacgaatcgcgctacgcgaaaaaaaaaaactcgccccccgcccgaccctaacgaaaccttttattcccaaccaaaaatttacataccgaaaccgtaacaactacgaacgaaaaaaacgacgaaaccgcgaaaccaacgacgtaataaaaaataaaaacgactacttatcatacaacccacgacgtaacgactacgaaccgaaaactaacgacgacgaacgaaacgacgcccacaacactcgaaactcaactaccgaaaaaacaaactaacttcctaaacgcgaaacctaaaactaacgcgaccgaaaaccacctacaacctacgataaaacgaccctaaccctcgaaacgcgcgacataacgcgaaaaaacgaaccgtactaaacgaacccctccgacaaacccgcgaccgctactactacccgcccgcccgcctacctttccgaaaacctaacgcgaaactccgctcgccttattttacaactacaacgcaaaattaacctaaaaaccacaacaataccataatattttaaaaacaa

SEQ ID NO: 29449 - DNA, 622 bp, Artificial Sequence
  chemically treated genomic DNA (Homo sapiens) CpG-island No: 29449
atcgcgcgggagcggaggtcgagtcgggtatttaaagcgcgcgttgtagggaggagataggttaaagtagtcgattttcgattgttcgtcgtagttttattagagggagtcgcgtagttgcgtttggagagtgagaggttgggggaagggtattttaaggtcggagtcgggattacgtttagcgttcgttcgcggggagatcggtagcggttttttgtttggttttttgataagggggcgggattttcgtagaaagtaagattgggtttattcgcgatgagaacggcgtggagggggaattaaggttggaattggagagggaggggtttgcggttagtcggacgcggcgttggaaattcggcggaggatttagaagtagcgggagcgatttgtgggcggggcgaacggtttgtcggtcgacggtagggtttgaagagtttagggtggggttcgcggtgtcgcggagggcgtggaagtgtgttagggttagcgtgtcggttttacggaagtcgagtttgaggcgagatttcgttttttgtatttttattgatttatattttttttatttaggtttttatattaggacgagaaggagttttcgagttatcgtgggagttgtggg

SEQ ID NO: 29450 - DNA, 622 bp, Artificial Sequence
  chemically treated genomic DNA (Homo sapiens) CpG-island No: 29450
cccacaactcccacgataactcgaaaactccttctcgtcctaatataaaaacctaaataaaaaaaatataaatcaataaaaatacaaaaaacgaaatctcgcctcaaactcgacttccgtaaaaccgacacgctaaccctaacacacttccacgccctccgcgacaccgcgaaccccaccctaaactcttcaaaccctaccgtcgaccgacaaaccgttcgccccgcccacaaatcgctcccgctacttctaaatcctccgccgaatttccaacgccgcgtccgactaaccgcaaacccctccctctccaattccaaccttaattccccctccacgccgttctcatcgcgaataaacccaatcttactttctacgaaaatcccgcccccttatcaaaaaaccaaacaaaaaaccgctaccgatctccccgcgaacgaacgctaaacgtaatcccgactccgaccttaaaatacccttcccccaacctctcactctccaaacgcaactacgcgactccctctaataaaactacgacgaacaatcgaaaatcgactactttaacctatctcctccctacaacgcgcgctttaaatacccgactcgacctccgctcccgcgcgat

SEQ ID NO: 29451 - DNA, 622 bp, Artificial Sequence
  chemically treated genomic DNA (Homo sapiens) CpG-island No: 29451
tttatagtttttacggtaattcgagggttttttttcgttttgatgtgggagtttgagtaaaggaaatatgagttagtgaaaatataaaaggcgagatttcgttttaggttcggttttcgtagggtcggtacgttggttttgatatatttttacgtttttcgcgatatcgcgagttttattttaggttttttaggttttatcgtcggtcggtaggtcgttcgtttcgtttatagatcgttttcgttatttttaggtttttcgtcggatttttagcgtcgcgttcgattgatcgtagatttttttttttttagttttagttttaattttttttttacgtcgtttttatcgcggataggtttaattttgttttttgcggaagtttcgtttttttgttaagagattaaatagaagatcgttgtcggttttttcgcgagcgagcgttaagcgtagtttcgatttcgattttaggatgttttttttttaattttttattttttaggcgtagttgcgcggttttttttggtggagttgcggcgggtaatcggaaatcggttattttggtttgttttttttttgtagcgcgcgttttgagtgttcggttcggttttcgttttcgcgcggt

SEQ ID NO: 29452 - DNA, 622 bp, Artificial Sequence
  chemically treated genomic DNA (Homo sapiens) CpG-island No: 29452
accgcgcgaaaacgaaaaccgaaccgaacactcaaaacgcgcgctacaaaaaaaaaacaaaccaaaataaccgatttccgattacccgccgcaactccaccaaaaaaaaccgcgcaactacgcctaaaaaataaaaaattaaaaaaaaaacatcctaaaatcgaaatcgaaactacgcttaacgctcgctcgcgaaaaaaccgacaacgatcttctatttaatctcttaacaaaaaaacgaaacttccgcaaaaaacaaaattaaacctatccgcgataaaaacgacgtaaaaaaaaaattaaaactaaaactaaaaaaaaaaaaatctacgatcaatcgaacgcgacgctaaaaatccgacgaaaaacctaaaaataacgaaaacgatctataaacgaaacgaacgacctaccgaccgacgataaaacctaaaaaacctaaaataaaactcgcgatatcgcgaaaaacgtaaaaatatatcaaaaccaacgtaccgaccctacgaaaaccgaacctaaaacgaaatctcgccttttatattttcactaactcatatttcctttactcaaactcccacatcaaaacgaaaaaaaaccctcgaattaccgtaaaaactataaa

SEQ ID NO: 29453 - DNA, 675 bp, Artificial Sequence
  chemically treated genomic DNA (Homo sapiens) CpG-island No: 29453
cgtttttcgtcgaggattttttttgttcgtttttatttatcgtcggtgtgtttggtttttagtcgcgagttggggttgtcgtgaggaggcggcggaggagacgagatttggggtttcgtagtcgggttattatatttttcgcgcgagtcggttcgggtttcggttttcgtttttcggagtcgttttcgcgttcgtttcgtagggggagtttttttagtttttttttcgttttattatttagttttttttcgtcgtcgtcgtcgtcgttttagtttcgcgcgttttcgtttcggttttttgttgtcgttcggggttatcgtcgggttttttgtttcgtagtcgtcgttgtcgttagattcgacgaacggaatgtcgagcggtcgttttttaattcggtcggtttcgtttcgtcggaattatttattcgtttcgcgttatgatatttattgaggcggaagtgtagttgaatggattttttacgacgatcgtatagtattgattgtagtaggagtcggtgggtttcgagtaggtgggttttcgtagggagttagcgtggatcgagtgcggggtttggatttttcgtttttttcgtattgtagattttgcggtgatttaaaggtgtttggcggtggtacgggatttaattgtaaaatgttattttagttagtgtgatat

SEQ ID NO: 29454 - DNA, 675 bp, Artificial Sequence
  chemically treated genomic DNA (Homo sapiens) CpG-island No: 29454
atatcacactaactaaaataacattttacaattaaatcccgtaccaccgccaaacacctttaaatcaccgcaaaatctacaatacgaaaaaaacgaaaaatccaaaccccgcactcgatccacgctaactccctacgaaaacccacctactcgaaacccaccgactcctactacaatcaatactatacgatcgtcgtaaaaaatccattcaactacacttccgcctcaataaatatcataacgcgaaacgaataaataattccgacgaaacgaaaccgaccgaattaaaaaacgaccgctcgacattccgttcgtcgaatctaacgacaacgacgactacgaaacaaaaaacccgacgataaccccgaacgacaacaaaaaaccgaaacgaaaacgcgcgaaactaaaacgacgacgacgacgacgaaaaaaaactaaataataaaacgaaaaaaaaactaaaaaaactccccctacgaaacgaacgcgaaaacgactccgaaaaacgaaaaccgaaacccgaaccgactcgcgcgaaaaatataataacccgactacgaaaccccaaatctcgtctcctccgccgcctcctcacgacaaccccaactcgcgactaaaaaccaaacacaccgacgataaataaaaacgaacaaaaaaaatcctcgacgaaaaacg

SEQ ID NO: 29455 - DNA, 675 bp, Artificial Sequence
  chemically treated genomic DNA (Homo sapiens) CpG-island No: 29455
atgttatattagttgggatgatattttatagttggatttcgtattatcgttaggtatttttaaattatcgtagagtttgtagtgcggagggggcgggaagtttaggtttcgtattcgatttacgttggttttttacggaggtttatttattcgaggtttatcgatttttattgtaattagtattatgcgatcgtcgtagagagtttatttagttgtattttcgttttagtaggtgttatggcgcggggcgggtgaatagtttcggcgaggcggggtcggtcgggttgagggacggtcgttcggtatttcgttcgtcgggtttggcgataacggcggttgcggagtaaggggttcggcggtagtttcggacggtagtaggaggtcgaggcgggagcgcgcggggttgaggcggcggcggcggcggcgggaaggggttgggtggtggagcgggagggaggttgaggaggttttttttgcgggacgggcgcggggacggtttcggggggcgggggtcggggttcgggtcggttcgcgcggggggtatgatgattcggttgcggggttttagatttcgtttttttcgtcgtttttttacggtagttttagttcgcggttgagaattagatatatcggcggtgagtggggacgggtaggaggggttttcggcggggagcg

SEQ ID NO: 29456 - DNA, 675 bp, Artificial Sequence
  chemically treated genomic DNA (Homo sapiens) CpG-island No: 29456
cgctccccgccgaaaacccctcctacccgtccccactcaccgccgatatatctaattctcaaccgcgaactaaaactaccgtaaaaaaacgacgaaaaaaacgaaatctaaaaccccgcaaccgaatcatcataccccccgcgcgaaccgacccgaaccccgacccccgccccccgaaaccgtccccgcgcccgtcccgcaaaaaaaacctcctcaacctccctcccgctccaccacccaaccccttcccgccgccgccgccgccgcctcaaccccgcgcgctcccgcctcgacctcctactaccgtccgaaactaccgccgaaccccttactccgcaaccgccgttatcgccaaacccgacgaacgaaataccgaacgaccgtccctcaacccgaccgaccccgcctcgccgaaactattcacccgccccgcgccataacacctactaaaacgaaaatacaactaaataaactctctacgacgatcgcataatactaattacaataaaaatcgataaacctcgaataaataaacctccgtaaaaaaccaacgtaaatcgaatacgaaacctaaacttcccgccccctccgcactacaaactctacgataatttaaaaatacctaacgataatacgaaatccaactataaaatatcatcccaactaatataacat

SEQ ID NO: 29457 - DNA, 813 bp, Artificial Sequence
  chemically treated genomic DNA (Homo sapiens) CpG-island No: 29457
  misc_feature (773)..(774): n is either a, c, g or t
ggggtcgcggtggtgatggtgtttgtgtcgttttttgtggtttttatgtttgggttcggtcgcgtttatcgttagaggcgagaaggtgaagagggtcgaggtgtttggggtcgggagaggggtagcgatagcgggttcggcgggtgttagcgaaggtggcggcggaggcggtaggagaagaggtttaatagggtttgggatagttggggttgtattcgttggcggtagcggtttaggatgttggcggttgcgacgtcgtcggtgagggggagcgagagggggtttttggttcggtcgttttcgttttttttgagattttttattgttagatcggcgttgtcgtttaatttttcgcggggagattttagtatgaggttttttttttttttttttgttcggttttttttgcgtcgttatcgttcgtattacgcgtatcgtttcgatttgcgtagttattttatttataaatatatatttaaatggttcgatcgttttttcgttcgcgtatcgcgtaagcgtcgttcgcgtattgttcgttgggtattggagtttttttttcgttttttatttgtcggtcgtttttcgtttagagatgaatatgtcggaagcggtcgtttttagttttttttcgtaggtttttttaatcgagtttttattgtaagtattttatgtcgcgtaaagcgttatgggagttgtagtttcgtcgcgttttcgtcgcgttttcggttttgagtggagaaaaaaaggggggttttttttgggggggggggggnnaaaaaaaaaaaaaaaaaaaagggggggggggggggaaaa

SEQ ID NO: 29458 - DNA, 813 bp, Artificial Sequence
  chemically treated genomic DNA (Homo sapiens) CpG-island No: 29458
  misc_feature (40)..(41): n is either a, c, g or t
ttttcccccccccccccccttttttttttttttttttttnncccccccccccccaaaaaaaacccccctttttttctccactcaaaaccgaaaacgcgacgaaaacgcgacgaaactacaactcccataacgctttacgcgacataaaatacttacaataaaaactcgattaaaaaaacctacgaaaaaaaactaaaaacgaccgcttccgacatattcatctctaaacgaaaaacgaccgacaaataaaaaacgaaaaaaaaactccaatacccaacgaacaatacgcgaacgacgcttacgcgatacgcgaacgaaaaaacgatcgaaccatttaaatatatatttataaataaaataactacgcaaatcgaaacgatacgcgtaatacgaacgataacgacgcaaaaaaaaccgaacaaaaaaaaaaaaaaaaaacctcatactaaaatctccccgcgaaaaattaaacgacaacgccgatctaacaataaaaaatctcaaaaaaaacgaaaacgaccgaaccaaaaaccccctctcgctccccctcaccgacgacgtcgcaaccgccaacatcctaaaccgctaccgccaacgaatacaaccccaactatcccaaaccctattaaacctcttctcctaccgcctccgccgccaccttcgctaacacccgccgaacccgctatcgctacccctctcccgaccccaaacacctcgaccctcttcaccttctcgcctctaacgataaacgcgaccgaacccaaacataaaaaccacaaaaaacgacacaaacaccatcaccaccgcgacccc

SEQ ID NO: 29459 - DNA, 813 bp, Artificial Sequence
  chemically treated genomic DNA (Homo sapiens) CpG-island No: 29459
  misc_feature (40)..(41): n is either a, c, g or t
tttttttttttttttttttttttttttttttttttttttnntttttttttttttaaaaaaaatttttttttttttttttatttagagtcggggacgcggcgggggcgcggcggaattatagtttttatgacgttttgcgcggtatagggtgtttataatagaagttcggttggagaggtttgcggagaaaagttgggaacggtcgttttcggtatgtttatttttggacgaagaacggtcgataagtggagggcggaggagagattttaatgtttagcgggtagtgcgcgggcggcgtttgcgcgatgcgcggacgggggggcggtcgggttatttaaatgtgtgtttgtgggtgaaatggttgcgtaggtcggagcggtgcgcgtagtacgggcggtggcggcgtaggaggagtcggataaagaggggaaggagaaattttatgttggggttttttcgcggggagttaaacggtagcgtcgatttagtagtggggggttttaggagaagcgggggcggtcgagttaggagttttttttcgtttttttttatcggcggcgtcgtagtcgttaatattttgggtcgttgtcgttaacgaatgtagttttaattgttttaggttttgttgagtttttttttttgtcgttttcgtcgttattttcgttggtattcgtcgggttcgttgtcgttgtttttttttcggttttaagtatttcggttttttttattttttcgtttttgacggtgagcgcggtcgggtttaagtataagggttataaggagcggtataagtattattattatcgcggtttt

SEQ ID NO: 29460 - DNA, 813 bp, Artificial Sequence
  chemically treated genomic DNA (Homo sapiens) CpG-island No: 29460
  misc_feature (773)..(774): n is either a, c, g or t
aaaaccgcgataataataatacttataccgctccttataacccttatacttaaacccgaccgcgctcaccgtcaaaaacgaaaaaataaaaaaaaccgaaatacttaaaaccgaaaaaaaaacaacgacaacgaacccgacgaataccaacgaaaataacgacgaaaacgacaaaaaaaaaaactcaacaaaacctaaaacaattaaaactacattcgttaacgacaacgacccaaaatattaacgactacgacgccgccgataaaaaaaaacgaaaaaaaactcctaactcgaccgcccccgcttctcctaaaaccccccactactaaatcgacgctaccgtttaactccccgcgaaaaaaccccaacataaaatttctccttcccctctttatccgactcctcctacgccgccaccgcccgtactacgcgcaccgctccgacctacgcaaccatttcacccacaaacacacatttaaataacccgaccgcccccccgtccgcgcatcgcgcaaacgccgcccgcgcactacccgctaaacattaaaatctctcctccgccctccacttatcgaccgttcttcgtccaaaaataaacataccgaaaacgaccgttcccaacttttctccgcaaacctctccaaccgaacttctattataaacaccctataccgcgcaaaacgtcataaaaactataattccgccgcgcccccgccgcgtccccgactctaaataaaaaaaaaaaaaaaaattttttttaaaaaaaaaaaaannaaaaaaaaaaaaaaaaaaaaaaaaaaaaaaaaaaaaaaa

SEQ ID NO: 29461 - DNA, 906 bp, Artificial Sequence
  chemically treated genomic DNA (Homo sapiens) CpG-island No: 29461
ggtttcgggggtgtggcgggcgttattcgttgttcgggtatatatttcgtagatttaattttagttcgttggttagattatggagggtcgttgggtgtagttatagagcgcggggtttcggcgatttcgtttcgtttcgcgttattcggcgttttgcggcgcgcgatgagtatttattattagcggagtcgcgagggagaggtcgcggttttttttcgttgtttgcggttatcggtcggtatttagagtttttcgtttggcgttaaatttaaaaacgtaatacgagtagtaggttggtttcggaaacgaaacgaaattcggtttttgggttttttttcgggcgttgtcggttttttagcgcgtcgcgttattcggaatagatttttttttcgttattttcggcggggttgggagattgaggttcgcggcgttgagtttgcggcgtttcggaagaggcgggcggtatggtcgttggcgtggattgcggggacggggttggcgttcggtagtacgtgtttttggttttaggtaaatacgcgcgttcgggcggcggggtcggtttaagaattggcggagcggttcgcgatttcgggcgcgtcgttttttatttcggtggtttttattattcggttcggcgcgggatgggattttttttgggatagttggtttcgtattttggttatacgttatagtaagtcgcggtttttaaattcggaagcgtcgaaaaggatcgagcgtgtttttcgggttttgattttcggtggttcgggtgggagggtggaagtcgatttagtttgaggggagttacgcgggttcgcggttatcggtgcgttgcgggtttcggaggtttttgtttttggtgttttttatttggtagttggttttgtttttgtgattttattgggt

SEQ ID NO: 29462 - DNA, 906 bp, Artificial Sequence
  chemically treated genomic DNA (Homo sapiens) CpG-island No: 29462
acccaataaaatcacaaaaacaaaaccaactaccaaataaaaaacaccaaaaacaaaaacctccgaaacccgcaacgcaccgataaccgcgaacccgcgtaactcccctcaaactaaatcgacttccaccctcccacccgaaccaccgaaaatcaaaacccgaaaaacacgctcgatccttttcgacgcttccgaatttaaaaaccgcgacttactataacgtataaccaaaatacgaaaccaactatcccaaaaaaaatcccatcccgcgccgaaccgaataataaaaaccaccgaaataaaaaacgacgcgcccgaaatcgcgaaccgctccgccaattcttaaaccgaccccgccgcccgaacgcgcgtatttacctaaaaccaaaaacacgtactaccgaacgccaaccccgtccccgcaatccacgccaacgaccataccgcccgcctcttccgaaacgccgcaaactcaacgccgcgaacctcaatctcccaaccccgccgaaaataacgaaaaaaaaatctattccgaataacgcgacgcgctaaaaaaccgacaacgcccgaaaaaaaacccaaaaaccgaatttcgtttcgtttccgaaaccaacctactactcgtattacgtttttaaatttaacgccaaacgaaaaactctaaataccgaccgataaccgcaaacaacgaaaaaaaaccgcgacctctccctcgcgactccgctaataataaatactcatcgcgcgccgcaaaacgccgaataacgcgaaacgaaacgaaatcgccgaaaccccgcgctctataactacacccaacgaccctccataatctaaccaacgaactaaaattaaatctacgaaatatatacccgaacaacgaataacgcccgccacacccccgaaacc

SEQ ID NO: 29463 - DNA, 906 bp, Artificial Sequence
  chemically treated genomic DNA (Homo sapiens) CpG-island No: 29463
atttagtaggattatagaagtagggttagttgttaggtaggggatattaagggtagaaattttcggggttcgtagcgtatcggtgatcgcgaattcgcgtggttttttttaggttgagtcggtttttatttttttattcgagttatcggggattagggttcgggaaatacgttcggtttttttcggcgttttcgggtttgaaaatcgcggtttgttatgacgtgtgattaaaatgcggggttagttgttttagagagaattttatttcgcgtcgggtcgggtagtgggagttatcggggtggggggcggcgcgttcggggtcgcgggtcgtttcgttagtttttgggtcgatttcgtcgttcgggcgcgcgtgtttatttgaaattaggaatacgtgttgtcgggcgttaatttcgttttcgtagtttacgttagcggttatgtcgttcgtttttttcggggcgtcgtaggtttagcgtcgcgggttttagttttttagtttcgtcgaaaatggcgggagaagggtttgtttcgggtggcgcggcgcgttgagggatcggtagcgttcgggaggaggtttagggatcgaatttcgtttcgttttcgagattagtttgttgttcgtgttacgtttttaaatttagcgttaggcgaggggttttgaatgtcggtcggtggtcgtaggtaacgggaaggggtcgcggtttttttttcgcggtttcgttagtggtaggtgtttatcgcgcgtcgtagggcgtcgagtgacgcggagcggggcggggtcgtcggggtttcgcgttttgtggttgtatttagcggttttttatggtttagttagcgggttaggattgggtttgcggggtgtgtgttcggataacgggtgacgttcgttatattttcggggtt

SEQ ID NO: 29464 - DNA, 906 bp, Artificial Sequence
  chemically treated genomic DNA (Homo sapiens) CpG-island No: 29464
aaccccgaaaatataacgaacgtcacccgttatccgaacacacaccccgcaaacccaatcctaacccgctaactaaaccataaaaaaccgctaaatacaaccacaaaacgcgaaaccccgacgaccccgccccgctccgcgtcactcgacgccctacgacgcgcgataaacacctaccactaacgaaaccgcgaaaaaaaaaccgcgaccccttcccgttacctacgaccaccgaccgacattcaaaacccctcgcctaacgctaaatttaaaaacgtaacacgaacaacaaactaatctcgaaaacgaaacgaaattcgatccctaaacctcctcccgaacgctaccgatccctcaacgcgccgcgccacccgaaacaaacccttctcccgccattttcgacgaaactaaaaaactaaaacccgcgacgctaaacctacgacgccccgaaaaaaacgaacgacataaccgctaacgtaaactacgaaaacgaaattaacgcccgacaacacgtattcctaatttcaaataaacacgcgcgcccgaacgacgaaatcgacccaaaaactaacgaaacgacccgcgaccccgaacgcgccgccccccaccccgataactcccactacccgacccgacgcgaaataaaattctctctaaaacaactaaccccgcattttaatcacacgtcataacaaaccgcgattttcaaacccgaaaacgccgaaaaaaaccgaacgtatttcccgaaccctaatccccgataactcgaataaaaaaataaaaaccgactcaacctaaaaaaaaccacgcgaattcgcgatcaccgatacgctacgaaccccgaaaatttctacccttaatatcccctacctaacaactaaccctacttctataatcctactaaat

SEQ ID NO: 29465 - DNA, 851 bp, Artificial Sequence
  chemically treated genomic DNA (Homo sapiens) CpG-island No: 29465
cggcgcggtttagttgtgaaggtcgcgtcggcggagagggtttatggtattttcgtcggtttcggaagttttttttttttttattttcgcgggttattttaggaattagcggttttcgattacgttcgcgcggattacggaatagcgacgcgtaagtaggtttttttcgttagcgtaattttttcgtagaaagtcgcgtattagttttaattacgttttattttttggtcgttggcgttattttcgttattcgggcgttttttagtagtttttagaaacgtcgtttttttaaatttagttatttatatatggcgggtttagtagttatcggtttcgttttttttcgtcgtcgtagtcgtaattgcgtttgcggttatagggcggatagttacgtttttgcggagggcgatcggaagtgtttacgtttttatttttttcgttacgttatcgtttttttaggtttagcgtgtagtaggaaggaggatttttttgtcgcggatttaagtcggaagtcgtttttttagtggagacgcgagtgggggaggagtagttcgaggggaacgtgggttgaacgttgtaattagggtggagattaagttggaataggagtttcgatcgattcggtattaagaaggggagtgttcgcggtaggtaagggagaagagggaggggttttttttcgttttcgaaattgggaaaagagatagagttgggatgatttatggggtagtcggcgcgttgaaaggatgggttgggttgggacggggtttaagtgggaaaggttgatgattaaggtatagagttggatttatagattcgtttgggcgtagagaggtgaacgttgaagagaa

SEQ ID NO: 29466 - DNA, 851 bp, Artificial Sequence
  chemically treated genomic DNA (Homo sapiens) CpG-island No: 29466
ttctcttcaacgttcacctctctacgcccaaacgaatctataaatccaactctataccttaatcatcaacctttcccacttaaaccccgtcccaacccaacccatcctttcaacgcgccgactaccccataaatcatcccaactctatctcttttcccaatttcgaaaacgaaaaaaaacccctccctcttctcccttacctaccgcgaacactccccttcttaataccgaatcgatcgaaactcctattccaacttaatctccaccctaattacaacgttcaacccacgttcccctcgaactactcctcccccactcgcgtctccactaaaaaaacgacttccgacttaaatccgcgacaaaaaaatcctccttcctactacacgctaaacctaaaaaaacgataacgtaacgaaaaaaataaaaacgtaaacacttccgatcgccctccgcaaaaacgtaactatccgccctataaccgcaaacgcaattacgactacgacgacgaaaaaaaacgaaaccgataactactaaacccgccatatataaataactaaatttaaaaaaacgacgtttctaaaaactactaaaaaacgcccgaataacgaaaataacgccaacgaccaaaaaataaaacgtaattaaaactaatacgcgactttctacgaaaaaattacgctaacgaaaaaaacctacttacgcgtcgctattccgtaatccgcgcgaacgtaatcgaaaaccgctaattcctaaaataacccgcgaaaataaaaaaaaaaaaaacttccgaaaccgacgaaaataccataaaccctctccgccgacgcgaccttcacaactaaaccgcgccg

SEQ ID NO: 29467 - DNA, 851 bp, Artificial Sequence
  chemically treated genomic DNA (Homo sapiens) CpG-island No: 29467
ttttttttagcgtttatttttttgcgtttaaacggatttgtaagtttaattttatattttaattattaattttttttatttgaatttcgttttagtttagtttatttttttagcgcgtcgattattttataggttattttagttttgtttttttttttaatttcgagagcggaaagaaatttttttttttttttttttatttgtcgcgggtatttttttttttggtatcgggtcgatcggaatttttgttttagtttgatttttattttagttgtaacgtttaatttacgtttttttcggattgttttttttttattcgcgtttttattaggaaggcggttttcggtttgagttcgcggtaaaagagtttttttttttgttgtacgttgggtttgaaaggacggtggcgtggcggggaaggtgaagacgtgagtattttcggtcgtttttcgtagaggcgtggttgttcgttttgtggtcgtagacgtagttgcgattgcggcgacgaggaggggcggggtcggtggttgttgagttcgttatgtgtgagtggttgggtttggggaggcgacgtttttggaagttgttggaaagcgttcgagtggcggaggtggcgttagcggttagggggtggggcgtgattaaaattagtgcgcggttttttgcggagggattacgttgacgaaagagatttgtttgcgcgtcgttgtttcgtggttcgcgcgagcgtggtcgggagtcgttggtttttggggtgattcgcggaggtgggagagggaagggttttcgaagtcggcgggggtgttatggatttttttcgtcggcgcggtttttatagttgggtcgcgtcg

SEQ ID NO: 29468 - DNA, 851 bp, Artificial Sequence
  chemically treated genomic DNA (Homo sapiens) CpG-island No: 29468
cgacgcgacccaactataaaaaccgcgccgacgaaaaaaatccataacacccccgccgacttcgaaaacccttccctctcccacctccgcgaatcaccccaaaaaccaacgactcccgaccacgctcgcgcgaaccacgaaacaacgacgcgcaaacaaatctctttcgtcaacgtaatccctccgcaaaaaaccgcgcactaattttaatcacgccccaccccctaaccgctaacgccacctccgccactcgaacgctttccaacaacttccaaaaacgtcgcctccccaaacccaaccactcacacataacgaactcaacaaccaccgaccccgcccctcctcgtcgccgcaatcgcaactacgtctacgaccacaaaacgaacaaccacgcctctacgaaaaacgaccgaaaatactcacgtcttcaccttccccgccacgccaccgtcctttcaaacccaacgtacaacaaaaaaaaaaactcttttaccgcgaactcaaaccgaaaaccgccttcctaataaaaacgcgaataaaaaaaaaacaatccgaaaaaaacgtaaattaaacgttacaactaaaataaaaatcaaactaaaacaaaaattccgatcgacccgataccaaaaaaaaaaatacccgcgacaaataaaaaaaaaaaaaaaaaaatttctttccgctctcgaaattaaaaaaaaaaacaaaactaaaataacctataaaataatcgacgcgctaaaaaaataaactaaactaaaacgaaattcaaataaaaaaaattaataattaaaatataaaattaaacttacaaatccgtttaaacgcaaaaaaataaacgctaaaaaaaa

SEQ ID NO: 29469 - DNA, 642 bp, Artificial Sequence
  chemically treated genomic DNA (Homo sapiens) CpG-island No: 29469
atcgtatatttcggggttatcggtttatgaacgaagcgggaggtcgaggtgcggcgggtttttagggagaagtttaaggttcgttttttcggcgcggaggaaagggttcgacgttcgagtttttttgcgaagtaggcgagtttttcgcgtattttcgggttggcggcgcggtgttaaggcgtttcggttttagggttttgcgggtagcgtagcgattttaggtttttttttttagaacgcgtttcgttgttagcgttttgttatttcggtcgttcgttcgcgggtttcggattacgtcgttcgcgtttttcgcgaatgtagtattttcgtttttttttagagtttattagttttcgcgtgtcggttagtttagattgtggttatgtttttcgttttcgaaaataggagagggttaggtatcgttatcggatattttttcggatttgatattcgagtcgatagtagtttttagcgtttgggagcgttcgggggaggaaaggcggagagatcgttcgttttagcgggtttcggttggaaagtttagcgaggagtttttatttaagttaaatggggcgggggttgggggtgggggacggggaattcgaggttttagaaataggtttcgaggtttcgcggattgat

SEQ ID NO: 29470 - DNA, 642 bp, Artificial Sequence
  chemically treated genomic DNA (Homo sapiens) CpG-island No: 29470
atcaatccgcgaaacctcgaaacctatttctaaaacctcgaattccccgtcccccacccccaacccccgccccatttaacttaaataaaaactcctcgctaaactttccaaccgaaacccgctaaaacgaacgatctctccgcctttcctcccccgaacgctcccaaacgctaaaaactactatcgactcgaatatcaaatccgaaaaaatatccgataacgatacctaaccctctcctattttcgaaaacgaaaaacataaccacaatctaaactaaccgacacgcgaaaactaataaactctaaaaaaaaacgaaaatactacattcgcgaaaaacgcgaacgacgtaatccgaaacccgcgaacgaacgaccgaaataacaaaacgctaacaacgaaacgcgttctaaaaaaaaaaacctaaaatcgctacgctacccgcaaaaccctaaaaccgaaacgccttaacaccgcgccgccaacccgaaaatacgcgaaaaactcgcctacttcgcaaaaaaactcgaacgtcgaaccctttcctccgcgccgaaaaaacgaaccttaaacttctccctaaaaacccgccgcacctcgacctcccgcttcgttcataaaccgataaccccgaaatatacgat

SEQ ID NO: 29471 - DNA, 642 bp, Artificial Sequence
  chemically treated genomic DNA (Homo sapiens) CpG-island No: 29471
gttagttcgcggggtttcggagtttgtttttggaatttcgggtttttcgttttttatttttaattttcgttttatttaatttaggtggagatttttcgttgggttttttaatcgaggttcgttggaacggacggttttttcgttttttttttttcgaacgtttttaggcgttaaaagttattatcggttcgggtgttaagttcgggaaggtgttcgatggcgatatttgatttttttttgttttcgaggacgaaggatatggttataatttaggttggtcggtacgcggggattggtgggttttggagagaggcggagatgttgtattcgcggggagcgcgggcggcgtggttcggggttcgcgggcgggcgatcggggtggtaggacgttggtagcgaagcgcgttttggagaggggagtttggagtcgttacgttgttcgtagagttttggagtcggggcgttttggtatcgcgtcgttagttcgagggtgcgcggggagttcgtttgtttcgtaggagaattcgggcgtcgagttttttttttcgcgtcggggagacgggttttaggtttttttttgagggttcgtcgtatttcggtttttcgtttcgtttataagtcggtagtttcggagtatgcggt

SEQ ID NO: 29472 - DNA, 642 bp, Artificial Sequence
  chemically treated genomic DNA (Homo sapiens) CpG-island No: 29472
accgcatactccgaaactaccgacttataaacgaaacgaaaaaccgaaatacgacgaaccctcaaaaaaaaacctaaaacccgtctccccgacgcgaaaaaaaaaactcgacgcccgaattctcctacgaaacaaacgaactccccgcgcaccctcgaactaacgacgcgataccaaaacgccccgactccaaaactctacgaacaacgtaacgactccaaactcccctctccaaaacgcgcttcgctaccaacgtcctaccaccccgatcgcccgcccgcgaaccccgaaccacgccgcccgcgctccccgcgaatacaacatctccgcctctctccaaaacccaccaatccccgcgtaccgaccaacctaaattataaccatatccttcgtcctcgaaaacaaaaaaaaatcaaatatcgccatcgaacaccttcccgaacttaacacccgaaccgataataacttttaacgcctaaaaacgttcgaaaaaaaaaaaacgaaaaaaccgtccgttccaacgaacctcgattaaaaaacccaacgaaaaatctccacctaaattaaataaaacgaaaattaaaaataaaaaacgaaaaacccgaaattccaaaaacaaactccgaaaccccgcgaactaac

SEQ ID NO: 29473 - DNA, 1557 bp, Artificial Sequence
  chemically treated genomic DNA (Homo sapiens) CpG-island No: 29473
  misc_feature (1255)..(1255): n is either a, c, g or t
ttttagtttcgcgtatttcgggttaagaagggattgacgggacgtaggttgggatttttaatttttcggggtagattggcggggaagacggcgtgcgttcgtaggtagtttcgaggcgcgttgcgtagttttagcggtcgtcgggttaggtgcgttcgtttttcggggtttttagggcgcggggcgggagcgtacgcgcggggcgcggcggcgcggcggattcggggtttcggggcgtcgcgtcggacgtagttcggacggtcgattttcgtgcggttttagggtgtcgggtcggtcgcggttggcgggtgggcgcggggcgggtgcgggttgggatataaagattcggagcggagacgatcggcgcgggcggcgggcgttgcgtttcgagcggggtcgtttgtgattatagatttagtgtagcgggtagcggttcgagcgcgcgggcgtcgcgtcggcgcggttttatgtttcggagtacggagcggagtagggcgttttcgggcgcgtaggagtttttttagttcgcgcggttttcggtttttagggtaggaaagagggagttcggttttcgtcgcgggtttcggacgcgcgcgggtttttgtgtgcggggagggcgtcgggattcgttgcgtgcgtagtttttcgtttcggtcggcgtcgcggttttcgtcgaggagagttagcgcggtcgtcgcgttgttagagcgttataaacgcggggtttcgtttcgtcgcgcgaagtttattggttcgcggtttcgcggtcgcgcgttggttggacggtcggttcgttcgttcgttattttttttcgatattgggtgtcgcgaggcggggttcgggttgataggtgagtttcgtttttggttttcgcgggcggcgggagcggagtagaagtcgggtaggagaagcgtttagcgcgtgtatagggcgttttcggggcggcgagaggttttttgggcgcggtgtagacgtggaaatagcgacggtcgagtagcgggttatttgttttcgcgttcgggggcgttttttttttcggcggaattagagggcgcggttttttttcgagtagtgcggaaggtagtaggtttcgttcggcgtttttttttcgtagatgcggcgttgtttcgcgtgtaagatttgtatttcgcgcgtatttttagagttttcggtttttgcgcgtttttttcgacgtttttcggcgagggttttttatttgattttggtattaatcgtttacggtttagttttagntagtggggtcgggaattgtaagacgatttttgcgacgcggcgtcggaatttgtagttttaattagggtttgagtatcgtcgtttttcgttttttttgcgggcgttttttttttttcggtttttcggggaggtggcgtttttggagttttttcgcgtgtcgtcggtatagtacgacgcggggatcgttttattagtttttaggagatacgcgcgttttttaagtgattagagatttagagggtgtgagatggaaaagttaaggtatgtgttttttattcggcgtttgtaagattttagagtag

SEQ ID NO: 29474 - DNA, 1557 bp, Artificial Sequence
  chemically treated genomic DNA (Homo sapiens) CpG-island No: 29474
  misc_feature (303)..(303): n is either a, c, g or t
ctactctaaaatcttacaaacgccgaataaaaaacacataccttaacttttccatctcacaccctctaaatctctaatcacttaaaaaacgcgcgtatctcctaaaaactaataaaacgatccccgcgtcgtactataccgacgacacgcgaaaaaactccaaaaacgccacctccccgaaaaaccgaaaaaaaaaaaacgcccgcaaaaaaaacgaaaaacgacgatactcaaaccctaattaaaactacaaattccgacgccgcgtcgcaaaaatcgtcttacaattcccgaccccactanctaaaactaaaccgtaaacgattaataccaaaatcaaataaaaaaccctcgccgaaaaacgtcgaaaaaaacgcgcaaaaaccgaaaactctaaaaatacgcgcgaaatacaaatcttacacgcgaaacaacgccgcatctacgaaaaaaaaacgccgaacgaaacctactaccttccgcactactcgaaaaaaaaccgcgccctctaattccgccgaaaaaaaaaacgcccccgaacgcgaaaacaaataacccgctactcgaccgtcgctatttccacgtctacaccgcgcccaaaaaacctctcgccgccccgaaaacgccctatacacgcgctaaacgcttctcctacccgacttctactccgctcccgccgcccgcgaaaaccaaaaacgaaactcacctatcaacccgaaccccgcctcgcgacacccaatatcgaaaaaaaataacgaacgaacgaaccgaccgtccaaccaacgcgcgaccgcgaaaccgcgaaccaataaacttcgcgcgacgaaacgaaaccccgcgtttataacgctctaacaacgcgacgaccgcgctaactctcctcgacgaaaaccgcgacgccgaccgaaacgaaaaactacgcacgcaacgaatcccgacgccctccccgcacacaaaaacccgcgcgcgtccgaaacccgcgacgaaaaccgaactccctctttcctaccctaaaaaccgaaaaccgcgcgaactaaaaaaactcctacgcgcccgaaaacgccctactccgctccgtactccgaaacataaaaccgcgccgacgcgacgcccgcgcgctcgaaccgctacccgctacactaaatctataatcacaaacgaccccgctcgaaacgcaacgcccgccgcccgcgccgatcgtctccgctccgaatctttatatcccaacccgcacccgccccgcgcccacccgccaaccgcgaccgacccgacaccctaaaaccgcacgaaaatcgaccgtccgaactacgtccgacgcgacgccccgaaaccccgaatccgccgcgccgccgcgccccgcgcgtacgctcccgccccgcgccctaaaaaccccgaaaaacgaacgcacctaacccgacgaccgctaaaactacgcaacgcgcctcgaaactacctacgaacgcacgccgtcttccccgccaatctaccccgaaaaattaaaaatcccaacctacgtcccgtcaatcccttcttaacccgaaatacgcgaaactaaaa

SEQ ID NO: 29475 - DNA, 1557 bp, Artificial Sequence
  chemically treated genomic DNA (Homo sapiens) CpG-island No: 29475
  misc_feature (303)..(303): n is either a, c, g or t
ttgttttggggttttgtagacgtcgagtgagaagtatatgttttgatttttttattttatattttttaaatttttggttatttgggaagcgcgcgtgttttttagaggttagtgagacggttttcgcgtcgtgttgtgtcggcgatacgcgggaaagttttaggggcgttattttttcggggggtcgaagggaaggaaacgttcgtagagaaggcgggaggcgacgatgtttaggttttgattagaattgtaaatttcggcgtcgcgtcgtaggaatcgttttgtaattttcggttttattgnttgaaattgagtcgtaggcgattggtattaaaattaagtgagaagttttcgtcgagaggcgtcgggagaagcgcgtagaagtcgggagttttaagggtgcgcgcggagtgtaagttttgtacgcggggtagcgtcgtatttgcggagaagggacgtcgagcggagtttgttgtttttcgtattgttcgagggaaagtcgcgttttttgatttcgtcgagggggaaggcgttttcgggcgcggagataggtggttcgttattcggtcgtcgttgtttttacgtttgtatcgcgtttagaaggtttttcgtcgtttcgggggcgttttgtgtacgcgttgagcgttttttttgttcggtttttgtttcgttttcgtcgttcgcgggagttaggggcggggtttatttgttagttcgagtttcgtttcgcggtatttaatgtcgggaggggatggcggacggacggatcggtcgtttaattagcgcgcggtcgcggagtcgcgggttaatgggtttcgcgcggcggggcggggtttcgcgtttatagcgttttgatagcgcggcggtcgcgttgatttttttcggcggggatcgcggcgtcggtcggagcgaggagttgcgtacgtagcgggtttcggcgtttttttcgtatataaaggttcgcgcgcgttcggagttcgcggcggggatcgagtttttttttttttgttttgggggtcgggagtcgcgcggattgagaaggtttttgcgcgttcggaggcgttttatttcgtttcgtgtttcgggatatggaatcgcgtcgacgcggcgttcgcgcgttcgggtcgttgttcgttgtattggatttatagttataggcggtttcgttcggggcgtagcgttcgtcgttcgcgtcggtcgttttcgtttcgggtttttgtgttttagttcgtattcgtttcgcgtttattcgttagtcgcggtcggttcggtattttggagtcgtacgggagtcggtcgttcgagttgcgttcggcgcggcgtttcggaatttcgagttcgtcgcgtcgtcgcgtttcgcgcgtgcgttttcgtttcgcgttttgagggtttcggagagcgagcgtatttggttcggcgatcgttggagttgcgtagcgcgtttcggagttgtttgcgggcgtacgtcgtttttttcgttagtttgtttcggaggattgggggttttagtttgcgtttcgttagtttttttttggttcggagtgcgcggagttggga

SEQ ID NO: 29476 - DNA, 1557 bp, Artificial Sequence
  chemically treated genomic DNA (Homo sapiens) CpG-island No: 29476
  misc_feature (1255)..(1255): n is either a, c, g or t
tcccaactccgcgcactccgaaccaaaaaaaaactaacgaaacgcaaactaaaacccccaatcctccgaaacaaactaacgaaaaaaacgacgtacgcccgcaaacaactccgaaacgcgctacgcaactccaacgatcgccgaaccaaatacgctcgctctccgaaaccctcaaaacgcgaaacgaaaacgcacgcgcgaaacgcgacgacgcgacgaactcgaaattccgaaacgccgcgccgaacgcaactcgaacgaccgactcccgtacgactccaaaataccgaaccgaccgcgactaacgaataaacgcgaaacgaatacgaactaaaacacaaaaacccgaaacgaaaacgaccgacgcgaacgacgaacgctacgccccgaacgaaaccgcctataactataaatccaatacaacgaacaacgacccgaacgcgcgaacgccgcgtcgacgcgattccatatcccgaaacacgaaacgaaataaaacgcctccgaacgcgcaaaaaccttctcaatccgcgcgactcccgacccccaaaacaaaaaaaaaaaaactcgatccccgccgcgaactccgaacgcgcgcgaacctttatatacgaaaaaaacgccgaaacccgctacgtacgcaactcctcgctccgaccgacgccgcgatccccgccgaaaaaaatcaacgcgaccgccgcgctatcaaaacgctataaacgcgaaaccccgccccgccgcgcgaaacccattaacccgcgactccgcgaccgcgcgctaattaaacgaccgatccgtccgtccgccatcccctcccgacattaaataccgcgaaacgaaactcgaactaacaaataaaccccgcccctaactcccgcgaacgacgaaaacgaaacaaaaaccgaacaaaaaaaacgctcaacgcgtacacaaaacgcccccgaaacgacgaaaaaccttctaaacgcgatacaaacgtaaaaacaacgacgaccgaataacgaaccacctatctccgcgcccgaaaacgccttccccctcgacgaaatcaaaaaacgcgactttccctcgaacaatacgaaaaacaacaaactccgctcgacgtcccttctccgcaaatacgacgctaccccgcgtacaaaacttacactccgcgcgcacccttaaaactcccgacttctacgcgcttctcccgacgcctctcgacgaaaacttctcacttaattttaataccaatcgcctacgactcaatttcaancaataaaaccgaaaattacaaaacgattcctacgacgcgacgccgaaatttacaattctaatcaaaacctaaacatcgtcgcctcccgccttctctacgaacgtttccttcccttcgaccccccgaaaaaataacgcccctaaaactttcccgcgtatcgccgacacaacacgacgcgaaaaccgtctcactaacctctaaaaaacacgcgcgcttcccaaataaccaaaaatttaaaaaatataaaataaaaaaatcaaaacatatacttctcactcgacgtctacaaaaccccaaaacaa

SEQ ID NO: 29477 - DNA, 1112 bp, Artificial Sequence
  chemically treated genomic DNA (Homo sapiens) CpG-island No: 29477
gaagcgttcgtttgttttcggtaaaaatcgttaggaggcggggtttacgtttcggtacgtttcgcgtagggtattgtgggaagggcggtcggtgtagtcgtagttgttattttaggggcgtttggcgttacgggtttttcgttggaggcggttttcgtggtagttgtagacgtcgggaaaaggtataaagttcgttggtcggtatttttttttttttcggtttcggtagaatcgttagttcgcgttcgaaggcggaggcgaggggaattggtcgcgtgaggggtttgaggcgagcggttagagcgtttttcggaaggatgggtcggtttcggagtcggagttcgtttcgttttaagtatattaagagtagtaagtataataagaagcgtagtcggtttcggtcgcgatttcgggataaggagcgcgtgcggaagcgttttaaatttcgggaaagtaaacggaatcggcggcgggagtcgcggtttcgttcgcgttttattaatacggtcgtgtttcggcgcgagcgggatcgggagcgcgtttcgttttcgttcgatcgtatcgatattttcgggcgtacggtgagtaagcgtagtagtttggacgagaagtagaagcgagaggaggaggagaagaaagcggagttcgagcggtagcgaaaaatgtgagtgttcgcgcggggagggatcggggcgtgcggagagtagggcgcggggcgagggcgtggggtcggggcgggacggtgcgggtcgggagaatggcggggacggttcggggttggggatcgggcgcgggaacgggtcggagaggcggcggcggggcgggtaggtttggcgtttggaaagtttggggtgggatagatttagaagttgttcgggatggaaaattcgagggtttgagtagaaagggtttaagagaaggcgattttggcgcgagagaggagtggtgtttcggaagtaggggtggagttcggagtgaggtcggagagttgcgttggtttgtgaggtcgggagcgagtcggtttgtagatgtggagggtggtgagcgtttgttggtcggtttgaggaggagagagaagggaattaatttttgagatgcgaattatagttggt

SEQ ID NO: 29478 - DNA, 1112 bp, Artificial Sequence
  chemically treated genomic DNA (Homo sapiens) CpG-island No: 29478
accaactataattcgcatctcaaaaattaattcccttctctctcctcctcaaaccgaccaacaaacgctcaccaccctccacatctacaaaccgactcgctcccgacctcacaaaccaacgcaactctccgacctcactccgaactccacccctacttccgaaacaccactcctctctcgcgccaaaatcgccttctcttaaaccctttctactcaaaccctcgaattttccatcccgaacaacttctaaatctatcccaccccaaactttccaaacgccaaacctacccgccccgccgccgcctctccgacccgttcccgcgcccgatccccaaccccgaaccgtccccgccattctcccgacccgcaccgtcccgccccgaccccacgccctcgccccgcgccctactctccgcacgccccgatccctccccgcgcgaacactcacatttttcgctaccgctcgaactccgctttcttctcctcctcctctcgcttctacttctcgtccaaactactacgcttactcaccgtacgcccgaaaatatcgatacgatcgaacgaaaacgaaacgcgctcccgatcccgctcgcgccgaaacacgaccgtattaataaaacgcgaacgaaaccgcgactcccgccgccgattccgtttactttcccgaaatttaaaacgcttccgcacgcgctccttatcccgaaatcgcgaccgaaaccgactacgcttcttattatacttactactcttaatatacttaaaacgaaacgaactccgactccgaaaccgacccatccttccgaaaaacgctctaaccgctcgcctcaaacccctcacgcgaccaattcccctcgcctccgccttcgaacgcgaactaacgattctaccgaaaccgaaaaaaaaaaaaataccgaccaacgaactttataccttttcccgacgtctacaactaccacgaaaaccgcctccaacgaaaaacccgtaacgccaaacgcccctaaaataacaactacgactacaccgaccgcccttcccacaataccctacgcgaaacgtaccgaaacgtaaaccccgcctcctaacgatttttaccgaaaacaaacgaacgcttc

SEQ ID NO: 29479 - DNA, 1112 bp, Artificial Sequence
  chemically treated genomic DNA (Homo sapiens) CpG-island No: 29479
gttagttgtgattcgtattttaaaggttaattttttttttttttttttttaagtcgattagtaaacgtttattattttttatatttgtaggtcggttcgttttcggttttataagttaacgtagtttttcgattttatttcgaattttatttttattttcgggatattatttttttttcgcgttaaaatcgtttttttttaaattttttttgtttaagttttcgaattttttatttcgaataatttttgggtttgttttattttaagttttttaaacgttaagtttgttcgtttcgtcgtcgttttttcgattcgttttcgcgttcggtttttagtttcggatcgttttcgttattttttcggttcgtatcgtttcgtttcggttttacgttttcgtttcgcgttttgtttttcgtacgtttcggttttttttcgcgcgggtatttatatttttcgttgtcgttcgaatttcgttttttttttttttttttttcgtttttgtttttcgtttaggttgttgcgtttgtttatcgtgcgttcgaagatgtcgatgcggtcgggcggggacgaggcgcgttttcggtttcgttcgcgtcgggatacggtcgtgttggtggagcgcgaacgggatcgcgattttcgtcgtcggtttcgtttattttttcgagatttggaacgttttcgtacgcgttttttgtttcgggatcgcgatcgggatcggttgcgttttttgttgtgtttgttgtttttggtgtgtttggagcgggacgagtttcggtttcgagatcggtttattttttcgggagacgttttaatcgttcgttttaggttttttacgcggttagtttttttcgttttcgttttcggacgcgggttggcggttttatcgaggtcggaggaaaaaaaggtgtcggttaacggattttatgttttttttcggcgtttatagttgttacgaaggtcgtttttaacgagaaattcgtagcgttaggcgtttttaagatggtagttgcggttgtatcggtcgttttttttataatgttttgcgcgaaacgtgtcgaagcgtgggtttcgttttttgacgatttttgtcgaaggtaggcgagcgtttt

SEQ ID NO: 29480 - DNA, 1112 bp, Artificial Sequence
  chemically treated genomic DNA (Homo sapiens) CpG-island No: 29480
aaaacgctcgcctaccttcgacaaaaatcgtcaaaaaacgaaacccacgcttcgacacgtttcgcgcaaaacattataaaaaaaacgaccgatacaaccgcaactaccatcttaaaaacgcctaacgctacgaatttctcgttaaaaacgaccttcgtaacaactataaacgccgaaaaaaaacataaaatccgttaaccgacacctttttttcctccgacctcgataaaaccgccaacccgcgtccgaaaacgaaaacgaaaaaaactaaccgcgtaaaaaacctaaaacgaacgattaaaacgtctcccgaaaaaataaaccgatctcgaaaccgaaactcgtcccgctccaaacacaccaaaaacaacaaacacaacaaaaaacgcaaccgatcccgatcgcgatcccgaaacaaaaaacgcgtacgaaaacgttccaaatctcgaaaaaataaacgaaaccgacgacgaaaatcgcgatcccgttcgcgctccaccaacacgaccgtatcccgacgcgaacgaaaccgaaaacgcgcctcgtccccgcccgaccgcatcgacatcttcgaacgcacgataaacaaacgcaacaacctaaacgaaaaacaaaaacgaaaaaaaaaaaaaaaaaaaacgaaattcgaacgacaacgaaaaatataaatacccgcgcgaaaaaaaaccgaaacgtacgaaaaacaaaacgcgaaacgaaaacgtaaaaccgaaacgaaacgatacgaaccgaaaaaataacgaaaacgatccgaaactaaaaaccgaacgcgaaaacgaatcgaaaaaacgacgacgaaacgaacaaacttaacgtttaaaaaacttaaaataaaacaaacccaaaaattattcgaaataaaaaattcgaaaacttaaacaaaaaaaatttaaaaaaaaacgattttaacgcgaaaaaaaaataatatcccgaaaataaaaataaaattcgaaataaaatcgaaaaactacgttaacttataaaaccgaaaacgaaccgacctacaaatataaaaaataataaacgtttactaatcgacttaaaaaaaaaaaaaaaaaaaattaacctttaaaatacgaatcacaactaac

SEQ ID NO: 29481 - DNA, 554 bp, Artificial Sequence
  chemically treated genomic DNA (Homo sapiens) CpG-island No: 29481
aagagggtttggagtatagacggtcggggtgggagggagacggagaggaatttagacggagtgagacgggggcgggggggttttagcggagagaagaatggggaggggtggaggtaacgataataaaaaaaggtagaaatatacgtattcggcgtcggttcggttcgtaggtggaaagttttttttgatgtataaattatttgttaaagaggtcgacggtcggggtcgtcgttttcgtcgttatcgtagtttaggcgttttcggcggagcggtgtaaataggtgtagtcgtggttaagttgtagtttcgtttttggggtcgggagcggtgcgttgggttcggttcggggtgtgttgttttttcgtcggtcgtcgttgcgcgttgtttttttttttttgcgttcggtttttagcggtttttaattcggaggttgtaatttttagtagggcggcgcgtcgcgtgcgttgggtatgtgttggttttaggtgttcgggggaagttaggcgttagtggcggggggggggaggcgtaggggggtttgtagggggcgatta

SEQ ID NO: 29482 - DNA, 554 bp, Artificial Sequence
  chemically treated genomic DNA (Homo sapiens) CpG-island No: 29482
taatcgccccctacaaacccccctacgcctccccccccccgccactaacgcctaacttcccccgaacacctaaaaccaacacatacccaacgcacgcgacgcgccgccctactaaaaattacaacctccgaattaaaaaccgctaaaaaccgaacgcaaaaaaaaaaaaacaacgcgcaacgacgaccgacgaaaaaacaacacaccccgaaccgaacccaacgcaccgctcccgaccccaaaaacgaaactacaacttaaccacgactacacctatttacaccgctccgccgaaaacgcctaaactacgataacgacgaaaacgacgaccccgaccgtcgacctctttaacaaataatttatacatcaaaaaaaactttccacctacgaaccgaaccgacgccgaatacgtatatttctacctttttttattatcgttacctccacccctccccattcttctctccgctaaaacccccccgcccccgtctcactccgtctaaattcctctccgtctccctcccaccccgaccgtctatactccaaaccctctt

SEQ ID NO: 29483 - DNA, 554 bp, Artificial Sequence
  chemically treated genomic DNA (Homo sapiens) CpG-island No: 29483
taatcgttttttgtaggtttttttgcgttttttttttttcgttattggcgtttggtttttttcgggtatttgggattagtatatgtttagcgtacgcggcgcgtcgttttgttagaagttgtagttttcgagttggaggtcgttgaggatcgagcgtaggaggaaggagatagcgcgtagcggcggtcggcgaggagatagtatatttcgggtcgggtttagcgtatcgttttcggttttaaaagcggagttgtaatttggttacgattgtatttgtttgtatcgtttcgtcgagggcgtttgggttgcggtggcggcgaagacggcgatttcgatcgtcggtttttttggtaagtggtttgtgtattaggagaaattttttatttgcgagtcgaatcggcgtcgagtgcgtgtgtttttgtttttttttgttgtcgttgtttttatttttttttattttttttttcgttaggattttttcgttttcgttttatttcgtttgaattttttttcgttttttttttatttcggtcgtttatgttttaggttttttt

SEQ ID NO: 29484 - DNA, 554 bp, Artificial Sequence
  chemically treated genomic DNA (Homo sapiens) CpG-island No: 29484
aaaaaaacctaaaacataaacgaccgaaataaaaaaaaaacgaaaaaaaattcaaacgaaataaaacgaaaacgaaaaaatcctaacgaaaaaaaaaataaaaaaaaataaaaacaacgacaacaaaaaaaaacaaaaacacacgcactcgacgccgattcgactcgcaaataaaaaatttctcctaatacacaaaccacttaccaaaaaaaccgacgatcgaaatcgccgtcttcgccgccaccgcaacccaaacgccctcgacgaaacgatacaaacaaatacaatcgtaaccaaattacaactccgcttttaaaaccgaaaacgatacgctaaacccgacccgaaatatactatctcctcgccgaccgccgctacgcgctatctccttcctcctacgctcgatcctcaacgacctccaactcgaaaactacaacttctaacaaaacgacgcgccgcgtacgctaaacatatactaatcccaaatacccgaaaaaaaccaaacgccaataacgaaaaaaaaaaaacgcaaaaaaacctacaaaaaacgatta

SEQ ID NO: 29485 - DNA, 566 bp, Artificial Sequence
  chemically treated genomic DNA (Homo sapiens) CpG-island No: 29485
gaggagcgcgggttcgcggagagggtcggagagtcggggtcgtcgagttcgggatgggttgttcgttgtttgttcggggtcgtgcgttcggagcggaggcgtacgcggggtcggcggcgcgcggggtttagtagttatacgtcgggttcgggttgttattaaatgagcgcgtcgcggttaatgggagtcggcggcggcggtgatttgtatggcgcgttggcgagtgacgtggggagggagtagatatattgggcgcgggcggcggagcggggaggaggggaggaaggagggggagtaaagtaggaaggaggggggaggaggttcgggagggggtgatagttatatcgttttttgagcgcgcgcgcgcggcggcggcggcggcggcgaatttcgagttcgtttttttcgtcgtttttcgttcgcgcgtttcgaatgattaacgattgggttgaaaagcgaagattaagaaaggatcgtcgtggggtggggggaggaaacgtagtttttggttaggtttaaacgggcgtagtggagatttagttttttttttgttttcgtcggttaat

SEQ ID NO: 29486 - DNA, 566 bp, Artificial Sequence
  chemically treated genomic DNA (Homo sapiens) CpG-island No: 29486
attaaccgacgaaaacaaaaaaaaaactaaatctccactacgcccgtttaaacctaaccaaaaactacgtttcctccccccaccccacgacgatcctttcttaatcttcgcttttcaacccaatcgttaatcattcgaaacgcgcgaacgaaaaacgacgaaaaaaacgaactcgaaattcgccgccgccgccgccgccgcgcgcgcgcgctcaaaaaacgatataactatcaccccctcccgaacctcctcccccctccttcctactttactccccctccttcctcccctcctccccgctccgccgcccgcgcccaatatatctactccctccccacgtcactcgccaacgcgccatacaaatcaccgccgccgccgactcccattaaccgcgacgcgctcatttaataacaacccgaacccgacgtataactactaaaccccgcgcgccgccgaccccgcgtacgcctccgctccgaacgcacgaccccgaacaaacaacgaacaacccatcccgaactcgacgaccccgactctccgaccctctccgcgaacccgcgctcctc

SEQ ID NO: 29487 - DNA, 566 bp, Artificial Sequence
  chemically treated genomic DNA (Homo sapiens) CpG-island No: 29487
gttggtcggcgggggtagaggaggagttgggtttttattgcgttcgtttaaatttggttaggggttgcgttttttttttttattttacgacgatttttttttagttttcgttttttaatttaatcgttaattattcggaacgcgcgggcggggagcggcgaggagggcgagttcggggttcgtcgtcgtcgtcgtcgtcgcgcgcgcgcgtttaggaagcggtgtggttgttattttttttcgggttttttttttttttttttttgttttgttttttttttttttttttttttttttcgtttcgtcgttcgcgtttagtgtatttattttttttttacgttattcgttagcgcgttatgtaaattatcgtcgtcgtcggtttttattggtcgcggcgcgtttatttaatggtagttcgggttcggcgtatggttgttgggtttcgcgcgtcgtcggtttcgcgtgcgttttcgtttcgagcgtacggtttcgggtaggtagcgggtagtttatttcgggttcggcggtttcggtttttcggtttttttcgcgagttcgcgtttttt

SEQ ID NO: 29488 - DNA, 566 bp, Artificial Sequence
  chemically treated genomic DNA (Homo sapiens) CpG-island No: 29488
aaaaaacgcgaactcgcgaaaaaaaccgaaaaaccgaaaccgccgaacccgaaataaactacccgctacctacccgaaaccgtacgctcgaaacgaaaacgcacgcgaaaccgacgacgcgcgaaacccaacaaccatacgccgaacccgaactaccattaaataaacgcgccgcgaccaataaaaaccgacgacgacgataatttacataacgcgctaacgaataacgtaaaaaaaaaataaatacactaaacgcgaacgacgaaacgaaaaaaaaaaaaaaaaaaaaaaaaaacaaaacaaaaaaaaaaaaaaaaaaaacccgaaaaaaaataacaaccacaccgcttcctaaacgcgcgcgcgcgacgacgacgacgacgacgaaccccgaactcgccctcctcgccgctccccgcccgcgcgttccgaataattaacgattaaattaaaaaacgaaaactaaaaaaaaatcgtcgtaaaataaaaaaaaaaaacgcaacccctaaccaaatttaaacgaacgcaataaaaacccaactcctcctctacccccgccgaccaac

SEQ ID NO: 29489 - DNA, 917 bp, Artificial Sequence
  chemically treated genomic DNA (Homo sapiens) CpG-island No: 29489
cgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttcgtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttagtgggcgttttcgtgatcgtcgtagcgttatttttcgtgggcgttttcgtgatcgtcgtagcgttatttttcgtgggcgttttcgtgatcgtcgtagcgttatttttcgtgggcgttttcgtgatcgtcgtagcgttatttttcgtgggcgttttcgtgatcgtcgtagcgttatttttcgtgggcgttttcgtgatcgtcgtagcgttatttttagtgggcgttttcgtgattattatagcgttatttttagtaggtattttcgtgatttttgtagcgttatttttagtaggtatttttatgattatcgtagcgttatttttagtgggcgtttttttgattatcgtagtattatttttagtgggtattttcgtgatttttgtagtattatttt

SEQ ID NO: 29490 - DNA, 917 bp, Artificial Sequence
  chemically treated genomic DNA (Homo sapiens) CpG-island No: 29490
aaaataatactacaaaaatcacgaaaatacccactaaaaataatactacgataatcaaaaaaacgcccactaaaaataacgctacgataatcataaaaatacctactaaaaataacgctacaaaaatcacgaaaatacctactaaaaataacgctataataatcacgaaaacgcccactaaaaataacgctacgacgatcacgaaaacgcccacgaaaaataacgctacgacgatcacgaaaacgcccacgaaaaataacgctacgacgatcacgaaaacgcccacgaaaaataacgctacgacgatcacgaaaacgcccacgaaaaataacgctacgacgatcacgaaaacgcccacgaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccacgaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccactaaaaataacgctacgacgatcacgaaaacgcccactaaaaataacgctacgacg

SEQ ID NO: 29491 - DNA, 917 bp, Artificial Sequence
  chemically treated genomic DNA (Homo sapiens) CpG-island No: 29491
ggagtaatgttgtaagggttacggaagtgtttattgggagtaatgttgcggtggttaaggaagcgtttattgggagtaacgttgcggtggttatggaagtatttattgggagtaacgttgtaagggttacggaagtatttattgggagtaacgttgtggtggttacggaagcgtttattgggagtaacgttgcggcggttacggaagcgtttacggggagtaacgttgcggcggttacggaagcgtttacggggagtaacgttgcggcggttacggaagcgtttacggggagtaacgttgcggcggttacggaagcgtttacggggagtaacgttgcggcggttacggaagcgtttacggggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttacggggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttattgggagtaacgttgcggcggttacggaagcgtttattgggagtaacgttgcggcg

SEQ ID NO: 29492 - DNA, 917 bp, Artificial Sequence
  chemically treated genomic DNA (Homo sapiens) CpG-island No: 29492
cgccgcaacgttactcccaataaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactccccgtaaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactcccaataaacgcttccgtaaccgccgcaacgttactccccgtaaacgcttccgtaaccgccgcaacgttactccccgtaaacgcttccgtaaccgccgcaacgttactccccgtaaacgcttccgtaaccgccgcaacgttactccccgtaaacgcttccgtaaccgccgcaacgttactccccgtaaacgcttccgtaaccgccgcaacgttactcccaataaacgcttccgtaaccaccacaacgttactcccaataaatacttccgtaacccttacaacgttactcccaataaatacttccataaccaccgcaacgttactcccaataaacgcttccttaaccaccgcaacattactcccaataaacacttccgtaacccttacaacattactcc

SEQ ID NO: 29493 - DNA, 579 bp, Artificial Sequence
  chemically treated genomic DNA (Homo sapiens) CpG-island No: 29493
tttagttgcgcgttcgtcgggattacgtttttttcgttttcgggagtcgagcggcgtttgcggttggttcggacgtgtttttttcgggcgggggtggtcgggttttttcggggtttcgggtttttcgggcgtatttttttgtttgcgtttttttaagtcgtttttttttcggttttgttcgcggttgagtttcgtatatcgcgtcgttgtttttggggtttcggtatacggcgtttttttttcgttttcgttatttatttttatcgtttttttagtttttgtgtcgtttttatcgttttttgattttcgtatcgagttgcgttttcgtcgtcggttttttttagcgcggttcggttttttttttgtttttgaagttttttcgtcgaggttcgcgcgcggttttttttttcgttttttttcggtttttgggcgtttagtcggaggtcggggcgggatggggtacgagtttcggggcggttcgcgttttttttattagtttttttattgtttcggtttcgttttcgtagtttcggggcgggagggcgtaggggttttcgggcgttttgggagtttattttt

SEQ ID NO: 29494 - DNA, 579 bp, Artificial Sequence
  chemically treated genomic DNA (Homo sapiens) CpG-island No: 29494
aaaaataaactcccaaaacgcccgaaaacccctacgccctcccgccccgaaactacgaaaacgaaaccgaaacaataaaaaaactaataaaaaaaacgcgaaccgccccgaaactcgtaccccatcccgccccgacctccgactaaacgcccaaaaaccgaaaaaaaacgaaaaaaaaaaccgcgcgcgaacctcgacgaaaaaacttcaaaaacaaaaaaaaaaccgaaccgcgctaaaaaaaaccgacgacgaaaacgcaactcgatacgaaaatcaaaaaacgataaaaacgacacaaaaactaaaaaaacgataaaaataaataacgaaaacgaaaaaaaaacgccgtataccgaaaccccaaaaacaacgacgcgatatacgaaactcaaccgcgaacaaaaccgaaaaaaaaacgacttaaaaaaacgcaaacaaaaaaatacgcccgaaaaacccgaaaccccgaaaaaacccgaccacccccgcccgaaaaaaacacgtccgaaccaaccgcaaacgccgctcgactcccgaaaacgaaaaaaacgtaatcccgacgaacgcgcaactaaa

SEQ ID NO: 29495 - DNA, 579 bp, Artificial Sequence
  chemically treated genomic DNA (Homo sapiens) CpG-island No: 29495
ggagatgggtttttagggcgttcggggatttttgcgttttttcgtttcgaggttgcggggacggggtcgaggtaatgaggggattagtagggggagcgcgggtcgtttcgagattcgtgttttatttcgtttcgattttcgattgggcgtttaagggtcggagagggacggagaggggagtcgcgcgcgggtttcggcgggggagttttaaagataaagaggaggtcgggtcgcgttgagagaggtcggcggcggagacgtagttcggtgcgggagttagagggcggtggagacggtatagggattggagaggcggtgggagtggatggcgggggcggggagggaacgtcgtgtgtcgggattttaaggatagcggcgcggtgtgcggggtttagtcgcgggtagagtcggagaaagggcgatttggagaggcgtaggtaggggggtgcgttcgggaggttcgaggtttcgaggaggttcggttattttcgttcggaggggatacgttcggattagtcgtagacgtcgttcggttttcgggggcgggaggagcgtggtttcggcgggcgcgtagttgga

SEQ ID NO: 29496 - DNA, 579 bp, Artificial Sequence
  chemically treated genomic DNA (Homo sapiens) CpG-island No: 29496
tccaactacgcgcccgccgaaaccacgctcctcccgcccccgaaaaccgaacgacgtctacgactaatccgaacgtatcccctccgaacgaaaataaccgaacctcctcgaaacctcgaacctcccgaacgcacccccctacctacgcctctccaaatcgccctttctccgactctacccgcgactaaaccccgcacaccgcgccgctatccttaaaatcccgacacacgacgttccctccccgcccccgccatccactcccaccgcctctccaatccctataccgtctccaccgccctctaactcccgcaccgaactacgtctccgccgccgacctctctcaacgcgacccgacctcctctttatctttaaaactcccccgccgaaacccgcgcgcgactcccctctccgtccctctccgacccttaaacgcccaatcgaaaatcgaaacgaaataaaacacgaatctcgaaacgacccgcgctccccctactaatcccctcattacctcgaccccgtccccgcaacctcgaaacgaaaaaacgcaaaaatccccgaacgccctaaaaacccatctcc

SEQ ID NO: 29497 - DNA, 872 bp, Artificial Sequence
  chemically treated genomic DNA (Homo sapiens) CpG-island No: 29497
ggagggtaggagtggagagaggcgcggttttttggaacgcgcgggggaacgtggaaaggagggcgcgggagattcggagggttgtttcggcggggattagaagcgaggcgggtttagcgttttgggcgtcgtaggaaagtgattcgtagagcgaggcgcggcgtttcgggagttggagtttagttttacgattcgcgttgcggcgggtattacgcggggggcgcgcggggaggggagaggcggggtcggcggggattgtgtcgtcgtcgacgtcgcggttgcgggtcgtagaggcgggtagagagagtcgtcgtcgagcgggtggcggagtagtttttagtttttagtcggtttggttgcgcgtaatcgcgtcggtttcgggtataggggtaattgtcgattttttttattcgtcgcgcggggttggttttcgagtcgagtttcggttatcgtcgcgtcgtttggcgttcggtttcggcggattttttttcggtaggtaggggcgtcggcggggcgttgcgcgcggtttaagcgcggggaacgcggcggggtagttttttcgagtttggaggtacgcggggcgtagaggttgttttgtatcgtcgggttggggacgtcgggagggtgtttcgggtcggatttgcggcgttgggtttttatttagagttttcgtacggtgagggttggacgcgtttggggggcgtggagaggaggtttgtcggtttttttttgggaaaggaatcgcggggattttttaatcgttaggacgcgtaagtcgaggttgggagtagaagttttttgaattttggatttattttagaaggagggggcgaaattggttatttcgagggacgcggaagtttcgttgttag

SEQ ID NO: 29498 - DNA, 872 bp, Artificial Sequence
  chemically treated genomic DNA (Homo sapiens) CpG-island No: 29498
ctaacaacgaaacttccgcgtccctcgaaataaccaatttcgccccctccttctaaaataaatccaaaattcaaaaaacttctactcccaacctcgacttacgcgtcctaacgattaaaaaatccccgcgattcctttcccaaaaaaaaaccgacaaacctcctctccacgccccccaaacgcgtccaaccctcaccgtacgaaaactctaaataaaaacccaacgccgcaaatccgacccgaaacaccctcccgacgtccccaacccgacgatacaaaacaacctctacgccccgcgtacctccaaactcgaaaaaactaccccgccgcgttccccgcgcttaaaccgcgcgcaacgccccgccgacgcccctacctaccgaaaaaaaatccgccgaaaccgaacgccaaacgacgcgacgataaccgaaactcgactcgaaaaccaaccccgcgcgacgaataaaaaaaatcgacaattacccctatacccgaaaccgacgcgattacgcgcaaccaaaccgactaaaaactaaaaactactccgccacccgctcgacgacgactctctctacccgcctctacgacccgcaaccgcgacgtcgacgacgacacaatccccgccgaccccgcctctcccctccccgcgcgccccccgcgtaatacccgccgcaacgcgaatcgtaaaactaaactccaactcccgaaacgccgcgcctcgctctacgaatcactttcctacgacgcccaaaacgctaaacccgcctcgcttctaatccccgccgaaacaaccctccgaatctcccgcgccctcctttccacgttcccccgcgcgttccaaaaaaccgcgcctctctccactcctaccctcc

SEQ ID NO: 29499 - DNA, 872 bp, Artificial Sequence
  chemically treated genomic DNA (Homo sapiens) CpG-island No: 29499
ttagtaacggggttttcgcgtttttcgaaatggttagtttcgttttttttttttggggtaggtttagagtttagaaggtttttatttttagtttcggtttacgcgttttagcggttgggaagttttcgcgattttttttttaggaagggatcgataagttttttttttacgttttttagacgcgtttaatttttatcgtgcgggaattttgggtggggatttagcgtcgtaagttcgattcggggtattttttcggcgtttttagttcggcggtgtagaatagtttttgcgtttcgcgtatttttagattcggagaggttgtttcgtcgcgtttttcgcgtttggatcgcgcgtagcgtttcgtcgacgtttttatttgtcggagaagggttcgtcggagtcgggcgttaggcgacgcggcgatggtcgggattcggttcggaaattagtttcgcgcggcgggtgagaggggtcggtagttgtttttgtgttcggggtcggcgcggttgcgcgtagttaggtcggttggaggttggggattgtttcgttattcgttcggcggcggttttttttgttcgtttttgcgattcgtagtcgcggcgtcggcggcgatatagttttcgtcggtttcgtttttttttttttcgcgcgtttttcgcgtggtgttcgtcgtagcgcgggtcgtggggttgagttttagttttcggggcgtcgcgtttcgttttgcgggttatttttttgcggcgtttaggacgttgaattcgtttcgtttttaattttcgtcggggtagtttttcgggtttttcgcgtttttttttttacgttttttcgcgcgttttaggagatcgcgtttttttttatttttgtttttt

SEQ ID NO: 29500 - DNA, 872 bp, Artificial Sequence
  chemically treated genomic DNA (Homo sapiens) CpG-island No: 29500
aaaaaacaaaaataaaaaaaaacgcgatctcctaaaacgcgcgaaaaaacgtaaaaaaaaaaacgcgaaaaacccgaaaaactaccccgacgaaaattaaaaacgaaacgaattcaacgtcctaaacgccgcaaaaaaataacccgcaaaacgaaacgcgacgccccgaaaactaaaactcaaccccacgacccgcgctacgacgaacaccacgcgaaaaacgcgcgaaaaaaaaaaaaacgaaaccgacgaaaactatatcgccgccgacgccgcgactacgaatcgcaaaaacgaacaaaaaaaaccgccgccgaacgaataacgaaacaatccccaacctccaaccgacctaactacgcgcaaccgcgccgaccccgaacacaaaaacaactaccgacccctctcacccgccgcgcgaaactaatttccgaaccgaatcccgaccatcgccgcgtcgcctaacgcccgactccgacgaacccttctccgacaaataaaaacgtcgacgaaacgctacgcgcgatccaaacgcgaaaaacgcgacgaaacaacctctccgaatctaaaaatacgcgaaacgcaaaaactattctacaccgccgaactaaaaacgccgaaaaaataccccgaatcgaacttacgacgctaaatccccacccaaaattcccgcacgataaaaattaaacgcgtctaaaaaacgtaaaaaaaaaacttatcgatcccttcctaaaaaaaaaatcgcgaaaacttcccaaccgctaaaacgcgtaaaccgaaactaaaaataaaaaccttctaaactctaaacctaccccaaaaaaaaaaaacgaaactaaccatttcgaaaaacgcgaaaaccccgttactaa

SEQ ID NO: 29501 - DNA, 893 bp, Artificial Sequence
  chemically treated genomic DNA (Homo sapiens) CpG-island No: 29501
agatttgtattacggtggtcggaattagtaaacgttaatagtcggaggtcgttcgtttttcgggcgtttgtaggcggcgggtatcgggcgtcgatttttttttttggattagatttatatattttagtttacgttagtttcgtagttcgggcgagcgaagatagtcgcgaaggattaaggtttcggggcgagttgtggcgtcgtttcggtcgtttttcggggcgcggcgttgatttatatttagttgacgttcgtatttgaggcggttgttcgtagttagcgagagggcgcgtagcgaggcgggtagggtaaagttatttattgggaaagcgcggttgttcgggtcgcgtacgggtttttggcgtcgttgttcggtattagttttcgtttttcgcggttcgttgagggagcggagagtttgttcggtttcgtttcgttaggaatcgtcgtcgtcgtcgtcgtcgtcgcggattttttggtaaaaagtaaatttcggttaagattttattttttaatcgtttttgttgttttttcgggggtagcgttaaggtcgagcggtttaattcgtattcgggttaatcggaggtagtatagggcgggaggtgggcggattagaaggcggttttatttattcgagagttcgggaggcgggttagaagggattcgttattttcgggttagagtgagattatttcgttttcgtcgttcgttttttttattcgtttcgggttgttttcgtcgttcgtttgatttttttgcggaagtttcgttggttaggtgtttgcgcgtattttcggtcgtcgttaagagtggtatagttggggaaggagtgaatatttagaggaatcgcggggcgggggggggggaggttaggagaataggtggcgtaggga

SEQ ID NO: 29502 - DNA, 893 bp, Artificial Sequence
  chemically treated genomic DNA (Homo sapiens) CpG-island No: 29502
tccctacgccacctattctcctaacctcccccccccccgccccgcgattcctctaaatattcactccttccccaactataccactcttaacgacgaccgaaaatacgcgcaaacacctaaccaacgaaacttccgcaaaaaaatcaaacgaacgacgaaaacaacccgaaacgaataaaaaaaacgaacgacgaaaacgaaataatctcactctaacccgaaaataacgaatcccttctaacccgcctcccgaactctcgaataaataaaaccgccttctaatccgcccacctcccgccctatactacctccgattaacccgaatacgaattaaaccgctcgaccttaacgctacccccgaaaaaacaacaaaaacgattaaaaaataaaatcttaaccgaaatttactttttaccaaaaaatccgcgacgacgacgacgacgacgacgattcctaacgaaacgaaaccgaacaaactctccgctccctcaacgaaccgcgaaaaacgaaaactaataccgaacaacgacgccaaaaacccgtacgcgacccgaacaaccgcgctttcccaataaataactttaccctacccgcctcgctacgcgccctctcgctaactacgaacaaccgcctcaaatacgaacgtcaactaaatataaatcaacgccgcgccccgaaaaacgaccgaaacgacgccacaactcgccccgaaaccttaatccttcgcgactatcttcgctcgcccgaactacgaaactaacgtaaactaaaatatataaatctaatccaaaaaaaaaaatcgacgcccgatacccgccgcctacaaacgcccgaaaaacgaacgacctccgactattaacgtttactaattccgaccaccgtaatacaaatct

SEQ ID NO: 29503 - DNA, 893 bp, Artificial Sequence
  chemically treated genomic DNA (Homo sapiens) CpG-island No: 29503
tttttgcgttatttgtttttttggtttttttttttttcgtttcgcgatttttttggatgtttattttttttttagttgtgttatttttggcggcggtcgggggtgcgcgtagatatttagttagcggggttttcgtaggggaattaggcgggcggcggggatagttcggggcgagtgggggaggcgggcggcgagggcggagtggttttattttaattcgggagtgacgggttttttttggttcgtttttcgagttttcggataggtggagtcgttttttggttcgtttatttttcgttttgtgttattttcgattggttcgggtgcgggttgggtcgttcggttttggcgttgttttcgggaaggtagtaggggcggttgagaagtgaagttttggtcggagtttgttttttgttaggaaattcgcggcggcggcggcggcggcggcgatttttggcggagcggagtcgggtaggtttttcgtttttttagcgggtcgcggagagcgggagttggtgtcgagtagcggcgttaggagttcgtgcgcggttcgggtagtcgcgtttttttagtgagtaattttgttttgttcgtttcgttgcgcgttttttcgttggttgcgggtagtcgttttaggtgcgggcgttagttgggtgtgggttagcgtcgcgtttcgggaggcggtcggagcggcgttatagttcgtttcggagttttggtttttcgcggttgttttcgttcgttcgggttgcggggttggcgtggattagggtgtgtgggtttggtttaggagggagagtcggcgttcggtgttcgtcgtttgtaggcgttcgggaggcgggcggttttcggttgttagcgtttgttggtttcggttatcgtggtgtagattt

SEQ ID NO: 29504 - DNA, 893 bp, Artificial Sequence
  chemically treated genomic DNA (Homo sapiens) CpG-island No: 29504
aaatctacaccacgataaccgaaaccaacaaacgctaacaaccgaaaaccgcccgcctcccgaacgcctacaaacgacgaacaccgaacgccgactctccctcctaaaccaaacccacacaccctaatccacgccaaccccgcaacccgaacgaacgaaaacaaccgcgaaaaaccaaaactccgaaacgaactataacgccgctccgaccgcctcccgaaacgcgacgctaacccacacccaactaacgcccgcacctaaaacgactacccgcaaccaacgaaaaaacgcgcaacgaaacgaacaaaacaaaattactcactaaaaaaacgcgactacccgaaccgcgcacgaactcctaacgccgctactcgacaccaactcccgctctccgcgacccgctaaaaaaacgaaaaacctacccgactccgctccgccaaaaatcgccgccgccgccgccgccgccgcgaatttcctaacaaaaaacaaactccgaccaaaacttcacttctcaaccgcccctactaccttcccgaaaacaacgccaaaaccgaacgacccaacccgcacccgaaccaatcgaaaataacacaaaacgaaaaataaacgaaccaaaaaacgactccacctatccgaaaactcgaaaaacgaaccaaaaaaaacccgtcactcccgaattaaaataaaaccactccgccctcgccgcccgcctcccccactcgccccgaactatccccgccgcccgcctaattcccctacgaaaaccccgctaactaaatatctacgcgcacccccgaccgccgccaaaaataacacaactaaaaaaaaaataaacatccaaaaaaatcgcgaaacgaaaaaaaaaaaaaccaaaaaaacaaataacgcaaaaa

SEQ ID NO: 29505 - DNA, 1005 bp, Artificial Sequence
  chemically treated genomic DNA (Homo sapiens) CpG-island No: 29505
tttttttcgcgtttacgcgagtttttttttcgggagataacgggtcgatggatttttttttttttagtaagataagattttcgattgtttatcgcgttagggaacgtacgatagatatttagatagtatttatatttttgttcgtttttcggtttttatttatttgtttgtatcgtgttcgagaggtcgtgttcgggggttgcggtacggggaaatttttttaattttttggcgtttaggtttagtttttcggagttggtcgtttttttaagcgcgcgttttagatttcggtttaagggtaggttgaagttttcgttgttatcgtcgttattattcgtttcgtcgggggcgtcggttttttcgtggtgttgatggtggtggtggtggtggtggggatgatgaagtgggtgtagagtagttatcgaaagggtcgggacgaaaggttggggttcgtttttcggcgtcgttattttttttcgggtttttttatttcgtttcgtcgtttttgcgggggggttatagcgtttttcgcgaggggaaaacggtagttcgggttgagtgtcgtagtgttttatcgaaaggcgttggaaggaggggaggagggtgtgggtaggcgcgtagaatggggggcgggcggggaggcggtcgtggtagttcggttttgaaggttttttgttttcgggaagttaaggattgcggcggcggcggcggcggcggtagcgcgtatgtgttttttttcgtttttgcgtttttttttcggttgttttgttttttttcgtcgtttgtttttttttttttttttttttacgtagtttgtttcgtttgagttttttttcgcgtttattttgtcggtcgtcgtcgttttgtcgcgattcgtttcgtaatcgggtatacggcggggttggacgtttgtttcggggtaattgaggcgtcgaatttttttttgggcgtttttttgtcgtttaggaggttttaggggattggaggttgcggggataggggggt

SEQ ID NO: 29506 - DNA, 1005 bp, Artificial Sequence
  chemically treated genomic DNA (Homo sapiens) CpG-island No: 29506
acccccctatccccgcaacctccaatcccctaaaacctcctaaacgacaaaaaaacgcccaaaaaaaaattcgacgcctcaattaccccgaaacaaacgtccaaccccgccgtatacccgattacgaaacgaatcgcgacaaaacgacgacgaccgacaaaataaacgcgaaaaaaaactcaaacgaaacaaactacgtaaaaaaaaaaaaaaaaaaaaacaaacgacgaaaaaaaacaaaacaaccgaaaaaaaaacgcaaaaacgaaaaaaaacacatacgcgctaccgccgccgccgccgccgccgcaatccttaacttcccgaaaacaaaaaaccttcaaaaccgaactaccacgaccgcctccccgcccgccccccattctacgcgcctacccacaccctcctcccctccttccaacgcctttcgataaaacactacgacactcaacccgaactaccgttttcccctcgcgaaaaacgctataacccccccgcaaaaacgacgaaacgaaataaaaaaacccgaaaaaaaataacgacgccgaaaaacgaaccccaacctttcgtcccgaccctttcgataactactctacacccacttcatcatccccaccaccaccaccaccaccatcaacaccacgaaaaaaccgacgcccccgacgaaacgaataataacgacgataacaacgaaaacttcaacctacccttaaaccgaaatctaaaacgcgcgcttaaaaaaacgaccaactccgaaaaactaaacctaaacgccaaaaaattaaaaaaatttccccgtaccgcaacccccgaacacgacctctcgaacacgatacaaacaaataaataaaaaccgaaaaacgaacaaaaatataaatactatctaaatatctatcgtacgttccctaacgcgataaacaatcgaaaatcttatcttactaaaaaaaaaaaaatccatcgacccgttatctcccgaaaaaaaaactcgcgtaaacgcgaaaaaaa

SEQ ID NO: 29507 - DNA, 1005 bp, Artificial Sequence
  chemically treated genomic DNA (Homo sapiens) CpG-island No: 29507
atttttttattttcgtaatttttagttttttaaagttttttgggcggtaaaaggacgtttagagagaggttcggcgttttagttgtttcggagtagacgtttagtttcgtcgtgtattcgattgcggggcggatcgcggtaaggcggcggcggtcggtagaataggcgcggaggaaggtttaggcggggtagattgcgtgggggaaggaggaggagagagtagacggcggaggagggtagagtagtcggggggagggcgtaggggcgggaggagatatatgcgcgttgtcgtcgtcgtcgtcgtcgtcgtagtttttagtttttcggggataggaaatttttaagatcgagttgttacggtcgttttttcgttcgttttttattttacgcgtttgtttatattttttttttttttttttagcgtttttcggtggagtattgcggtatttagttcgagttgtcgtttttttttcgcggggaacgttgtgattttttcgtaggagcggcggggcggggtgggggggttcgggagaagatggcgacgtcgggaagcgaattttaatttttcgtttcggttttttcggtagttattttgtatttattttattatttttattattattattattattattagtattacggaggaatcggcgttttcggcggggcgggtggtggcggcggtggtagcgggggttttaatttgtttttgaatcggggtttggagcgcgcgtttgaggaggcggttaatttcggggggttgaatttgagcgttaggaaattgaaggaattttttcgtatcgtagttttcgggtacgatttttcggatacggtgtaggtaggtgagtgagggtcgaggggcgggtaggggtgtgggtgttgtttgggtgtttgtcgtgcgttttttaacgcggtggatagtcggagattttgttttgttgggggagggagggtttatcggttcgttgtttttcgaagaagggattcgcgtgggcgcggaagaag

SEQ ID NO: 29508 - DNA, 1005 bp, Artificial Sequence
  chemically treated genomic DNA (Homo sapiens) CpG-island No: 29508
cttcttccgcgcccacgcgaatcccttcttcgaaaaacaacgaaccgataaaccctccctcccccaacaaaacaaaatctccgactatccaccgcgttaaaaaacgcacgacaaacacccaaacaacacccacacccctacccgcccctcgaccctcactcacctacctacaccgtatccgaaaaatcgtacccgaaaactacgatacgaaaaaattccttcaatttcctaacgctcaaattcaaccccccgaaattaaccgcctcctcaaacgcgcgctccaaaccccgattcaaaaacaaattaaaacccccgctaccaccgccgccaccacccgccccgccgaaaacgccgattcctccgtaatactaataataataataataataataaaaataataaaataaatacaaaataactaccgaaaaaaccgaaacgaaaaattaaaattcgcttcccgacgtcgccatcttctcccgaacccccccaccccgccccgccgctcctacgaaaaaatcacaacgttccccgcgaaaaaaaaacgacaactcgaactaaataccgcaatactccaccgaaaaacgctaaaaaaaaaaaaaaaaaatataaacaaacgcgtaaaataaaaaacgaacgaaaaaacgaccgtaacaactcgatcttaaaaatttcctatccccgaaaaactaaaaactacgacgacgacgacgacgacgacaacgcgcatatatctcctcccgcccctacgccctccccccgactactctaccctcctccgccgtctactctctcctcctccttcccccacgcaatctaccccgcctaaaccttcctccgcgcctattctaccgaccgccgccgccttaccgcgatccgccccgcaatcgaatacacgacgaaactaaacgtctactccgaaacaactaaaacgccgaacctctctctaaacgtccttttaccgcccaaaaaactttaaaaaactaaaaattacgaaaataaaaaaat

SEQ ID NO: 29509 - DNA, 647 bp, Artificial Sequence
  chemically treated genomic DNA (Homo sapiens) CpG-island No: 29509
gacgaataatttcgttttttatttaatgcgtttatacgtacgtatataagtagcgcgcggtcgaggagggtacgttttatttgttttcgtcgtgttatttattttttttttatttaggttcggcgtttttaatttcgttttcgtcgtggtttttcggtcgttcgtttcgagcgtcgcgtatttattgtttgattgagcgcgtttagcgtttgtagggttcggcggcggcggcggggatcgagatagcggttgtagtagcggcggcggcggcggcggcggcggcggttttagtcggcgttagttagattggagtcgcgaagttttatcgttcgtattagtgcgtcgatttggaaagcggttagggagttttgtttgcggttcgttttcgttcgtcgtcgcgcgttttggtcgtttcgggagtcgtagaggagggggttgcgcgggttcggcggggggcgggagcgagatcggttttacggttacgtgcgcggaaattcgcggcgcgggggtggcggggtagtatttttcgtagcggtttgcggttcggttttcgttttttttttatttttagtttcgcgttgttttttcggtttttttgcgcgattttaggttcggtttttgttcggtttgtcggggtggttcggggg

SEQ ID NO: 29510 - DNA, 647 bp, Artificial Sequence
  chemically treated genomic DNA (Homo sapiens) CpG-island No: 29510
cccccgaaccaccccgacaaaccgaacaaaaaccgaacctaaaatcgcgcaaaaaaaccgaaaaaacaacgcgaaactaaaaataaaaaaaaaacgaaaaccgaaccgcaaaccgctacgaaaaatactaccccgccacccccgcgccgcgaatttccgcgcacgtaaccgtaaaaccgatctcgctcccgccccccgccgaacccgcgcaaccccctcctctacgactcccgaaacgaccaaaacgcgcgacgacgaacgaaaacgaaccgcaaacaaaactccctaaccgctttccaaatcgacgcactaatacgaacgataaaacttcgcgactccaatctaactaacgccgactaaaaccgccgccgccgccgccgccgccgccgctactacaaccgctatctcgatccccgccgccgccgccgaaccctacaaacgctaaacgcgctcaatcaaacaataaatacgcgacgctcgaaacgaacgaccgaaaaaccacgacgaaaacgaaattaaaaacgccgaacctaaataaaaaaaaaataaataacacgacgaaaacaaataaaacgtaccctcctcgaccgcgcgctacttatatacgtacgtataaacgcattaaataaaaaacgaaattattcgtc

SEQ ID NO: 29511 - DNA, 647 bp, Artificial Sequence
  chemically treated genomic DNA (Homo sapiens) CpG-island No: 29511
ttttcgggttatttcggtaggtcgggtaggggtcgagtttggggtcgcgtagggggatcgagagggtagcgcggggttgggggtggggaagaggcgggaatcgagtcgtaggtcgttgcgaggagtattatttcgttattttcgcgtcgcgagttttcgcgtacgtggtcgtggggtcggtttcgttttcgtttttcgtcgggttcgcgtagtttttttttttgcggttttcggagcggttagagcgcgcggcggcgggcgggggcgggtcgtaagtagggttttttggtcgttttttaggtcggcgtattaatacgggcgatgaggtttcgcggttttagtttgattgacgtcggttggggtcgtcgtcgtcgtcgtcgtcgtcgtcgttgttgtagtcgttgtttcggttttcgtcgtcgtcgtcgggttttgtaggcgttgggcgcgtttagttaggtagtgagtgcgcggcgttcggagcgggcggtcgggggattacggcgggggcggggttgggggcgtcggatttgggtgggggagggatgagtggtacggcggggataggtaagacgtgtttttttcggtcgcgcgttgtttgtgtgcgtgcgtgtgagcgtattgagtggagggcgaagttgttcgtt

SEQ ID NO: 29512 - DNA, 647 bp, Artificial Sequence
  chemically treated genomic DNA (Homo sapiens) CpG-island No: 29512
aacgaacaacttcgccctccactcaatacgctcacacgcacgcacacaaacaacgcgcgaccgaaaaaaacacgtcttacctatccccgccgtaccactcatccctcccccacccaaatccgacgcccccaaccccgcccccgccgtaatcccccgaccgcccgctccgaacgccgcgcactcactacctaactaaacgcgcccaacgcctacaaaacccgacgacgacgacgaaaaccgaaacaacgactacaacaacgacgacgacgacgacgacgacgacgaccccaaccgacgtcaatcaaactaaaaccgcgaaacctcatcgcccgtattaatacgccgacctaaaaaacgaccaaaaaaccctacttacgacccgcccccgcccgccgccgcgcgctctaaccgctccgaaaaccgcaaaaaaaaaaactacgcgaacccgacgaaaaacgaaaacgaaaccgaccccacgaccacgtacgcgaaaactcgcgacgcgaaaataacgaaataatactcctcgcaacgacctacgactcgattcccgcctcttccccacccccaaccccgcgctaccctctcgatccccctacgcgaccccaaactcgacccctacccgacctaccgaaataacccgaaaa

SEQ ID NO: 29513 - DNA, 521 bp, Artificial Sequence
  chemically treated genomic DNA (Homo sapiens) CpG-island No: 29513
ttgaggaagaggttaggatatcggcgtttaacgagatttatagtatcgtttcggcgtcgtcgtcgtagttgttatcgtcggaggttatttcgttgcgtcgagcgttggagtttcgggaatttggtgtcgttatcgtttgcgttttttgcgttgcgttgcgttcgttgcgttcgggttttgttgttcggcgatcgttacggttaagcggagtttcgtttcgtgcgcgtcgggcgagttgcggattttttaaggacgcgtcgttatttcgattggttgcgggagttattggtttcgtttttgttcgtcgcgttttttttacgtcgggggcgcgcgttgttggcggtttagagattggcggtttttttaggggcgtcgcgggagggtgcggttcgcgttgggcgaggttttttgcgggtatcggcgcgttcggttttcgtttttgggcgttgtagttttttttttttttgttagtttagagataaatagacggttagaaagaaaagaaaaagagaaaatatttt

SEQ ID NO: 29514 - DNA, 521 bp, Artificial Sequence
  chemically treated genomic DNA (Homo sapiens) CpG-island No: 29514
aaaatattttctctttttcttttctttctaaccgtctatttatctctaaactaacaaaaaaaaaaaaaactacaacgcccaaaaacgaaaaccgaacgcgccgatacccgcaaaaaacctcgcccaacgcgaaccgcaccctcccgcgacgcccctaaaaaaaccgccaatctctaaaccgccaacaacgcgcgcccccgacgtaaaaaaaacgcgacgaacaaaaacgaaaccaataactcccgcaaccaatcgaaataacgacgcgtccttaaaaaatccgcaactcgcccgacgcgcacgaaacgaaactccgcttaaccgtaacgatcgccgaacaacaaaacccgaacgcaacgaacgcaacgcaacgcaaaaaacgcaaacgataacgacaccaaattcccgaaactccaacgctcgacgcaacgaaataacctccgacgataacaactacgacgacgacgccgaaacgatactataaatctcgttaaacgccgatatcctaacctcttcctcaa

SEQ ID NO: 29515 - DNA, 521 bp, Artificial Sequence
  chemically treated genomic DNA (Homo sapiens) CpG-island No: 29515
gagatgtttttttttttttttttttttttggtcgtttatttatttttgggttggtaaggagagggagaattgtagcgtttaggagcggaggtcgagcgcgtcggtgttcgtaggaagtttcgtttagcgcggatcgtattttttcgcgacgtttttggagaagtcgttagtttttgggtcgttagtagcgcgcgttttcggcgtgggaggagcgcggcgagtaggggcggggttagtgattttcgtagttaatcggggtggcggcgcgtttttggagggttcgtagttcgttcggcgcgtacggggcggggtttcgtttgatcgtggcggtcgtcgggtagtagagttcgggcgtagcgagcgtagcgtagcgtagggagcgtaggcggtggcggtattaggttttcggggttttagcgttcggcgtagcgaagtagttttcggcggtggtaattacggcggcggcgtcggggcgatgttgtgggtttcgttgggcgtcggtgttttggttttttttttag

SEQ ID NO: 29516 - DNA, 521 bp, Artificial Sequence
  chemically treated genomic DNA (Homo sapiens) CpG-island No: 29516
ctaaaaaaaaaaccaaaacaccgacgcccaacgaaacccacaacatcgccccgacgccgccgccgtaattaccaccgccgaaaactacttcgctacgccgaacgctaaaaccccgaaaacctaataccgccaccgcctacgctccctacgctacgctacgctcgctacgcccgaactctactacccgacgaccgccacgatcaaacgaaaccccgccccgtacgcgccgaacgaactacgaaccctccaaaaacgcgccgccaccccgattaactacgaaaatcactaaccccgcccctactcgccgcgctcctcccacgccgaaaacgcgcgctactaacgacccaaaaactaacgacttctccaaaaacgtcgcgaaaaaatacgatccgcgctaaacgaaacttcctacgaacaccgacgcgctcgacctccgctcctaaacgctacaattctccctctccttaccaacccaaaaataaataaacgaccaaaaaaaaaaaaaaaaaaaaaaacatctc

SEQ ID NO: 29517 - DNA, 581 bp, Artificial Sequence
  chemically treated genomic DNA (Homo sapiens) CpG-island No: 29517
ttcgcgtcgggcgttttcggaggtcgtaggttagggggcgaggcgcggtgttcgggtttttttcgcgggtagtcggcgattttggggtgtcgagggagtagcgtttttttttttcgatagcgtttttttcgatttgaggcgtttatttcggtgtaagcgggggttttagggagtcggcgaggtcgtttggtatttttttttttcgcgtcggacgttcgcgtcgtagggattaaggtcggcgatacggtggggggcgaggggcgaagacggggattggttttcgttggtttcggcggttttagggtttcggcgtcgtttagcgtcgtgtttttagtcgttcgcgcgttaggtagcgttttcggtttttgcgggttatttgtggtcgagttcgtcgcgttcgtcgtcgtagggttttttgtttcgtttcgtcggtttcgttttatttttgtcggcggtttttacgtcggtgtcgtagcgttttttagcggcgagtcggggtacggtagggattttcgcgagagagaggtggtatcgcggaggttttggggttggtttcgatttgtagtttttttttgggtggg

SEQ ID NO: 29518 - DNA, 581 bp, Artificial Sequence
  chemically treated genomic DNA (Homo sapiens) CpG-island No: 29518
cccacccaaaaaaaaactacaaatcgaaaccaaccccaaaacctccgcgataccacctctctctcgcgaaaatccctaccgtaccccgactcgccgctaaaaaacgctacgacaccgacgtaaaaaccgccgacaaaaataaaacgaaaccgacgaaacgaaacaaaaaaccctacgacgacgaacgcgacgaactcgaccacaaataacccgcaaaaaccgaaaacgctacctaacgcgcgaacgactaaaaacacgacgctaaacgacgccgaaaccctaaaaccgccgaaaccaacgaaaaccaatccccgtcttcgcccctcgccccccaccgtatcgccgaccttaatccctacgacgcgaacgtccgacgcgaaaaaaaaaaataccaaacgacctcgccgactccctaaaacccccgcttacaccgaaataaacgcctcaaatcgaaaaaaacgctatcgaaaaaaaaaaacgctactccctcgacaccccaaaatcgccgactacccgcgaaaaaaacccgaacaccgcgcctcgccccctaacctacgacctccgaaaacgcccgacgcgaa

SEQ ID NO: 29519 - DNA, 581 bp, Artificial Sequence
  chemically treated genomic DNA (Homo sapiens) CpG-island No: 29519
tttatttaggagagggttgtagatcggggttagttttagggttttcgcggtgttatttttttttcgcgagggtttttgtcgtgtttcggttcgtcgttgggaggcgttgcggtatcggcgtaggagtcgtcggtaggggtggggcggggtcggcgggacggggtagagggttttgcggcggcggacgcggcgggttcggttataggtaattcgtaggagtcgagagcgttgtttggcgcgcgggcggttggaggtacggcgttgggcggcgtcgaggttttggggtcgtcggagttagcgggagttagttttcgttttcgtttttcgttttttatcgtgtcgtcggttttggtttttgcggcgcggacgttcggcgcgggagagaaaggtattaggcgatttcgtcggttttttgggattttcgtttatatcggggtgggcgttttaggtcggggaggacgttgtcgggggaagggggcgttgttttttcggtattttaggatcgtcgattgttcgcggaggagattcggatatcgcgtttcgttttttggtttgcggttttcgaaaacgttcggcgcgag

SEQ ID NO: 29520 - DNA, 581 bp, Artificial Sequence
  chemically treated genomic DNA (Homo sapiens) CpG-island No: 29520
ctcgcgccgaacgttttcgaaaaccgcaaaccaaaaaacgaaacgcgatatccgaatctcctccgcgaacaatcgacgatcctaaaataccgaaaaaacaacgcccccttcccccgacaacgtcctccccgacctaaaacgcccaccccgatataaacgaaaatcccaaaaaaccgacgaaatcgcctaatacctttctctcccgcgccgaacgtccgcgccgcaaaaaccaaaaccgacgacacgataaaaaacgaaaaacgaaaacgaaaactaactcccgctaactccgacgaccccaaaacctcgacgccgcccaacgccgtacctccaaccgcccgcgcgccaaacaacgctctcgactcctacgaattacctataaccgaacccgccgcgtccgccgccgcaaaaccctctaccccgtcccgccgaccccgccccacccctaccgacgactcctacgccgataccgcaacgcctcccaacgacgaaccgaaacacgacaaaaaccctcgcgaaaaaaaaataacaccgcgaaaaccctaaaactaaccccgatctacaaccctctcctaaataaa

SEQ ID NO: 29521 - DNA, 916 bp, Artificial Sequence
  chemically treated genomic DNA (Homo sapiens) CpG-island No: 29521
ggcgtgtgggagtgggacggcgggggggatattgagggtgtgcggcgtttttttttttgtttgtgcggggattacgtgaaggagaggcgcgtgggggtttttggcgcgtagtcgcggtgggtgacggtcggcgtttcgggggtttcgtgtacggggcgtgtgtcggtgtgagtttgggagggtgtaggggtttcgcgttttttcggttttttcgtgcgtgtgcgtgtgcgtgtgtatgtgtgttttcggtttagcgtttcgtcgagtggtgttcgcggtcgggcgagcgcgcgcgcgttcgtgcggggtgtgtatgtgagtatgtgatagtgtgtgttaggtgattcgggttacgtagtttttttttttttttttttttcgggaggaattgtcgcgtttcggttgattttttcgtcggcgggcggggcgggggagggggtttcgggcgcgttgggaatcgcgggattcggatttgggcgtcgttcgtcgggggacgcgcggttttcgttttcgtcgggtttcgttgagttttagataaattttcgttttagaaataggttgcgggcggtcggttaggaggtttggtttttatttcgggattttcgtcgttttcgggtcggtcggtcggtgggtacgatgagttaggtgttggggaagtcgtagtcgtaggacgaggacgacgcggaggaggaggaggaggaggatgagttggtggggttagcggattacggagacgggttcgattttttcgacgtcgattcggatagcggtatagaggagggaggtgagcgttcggttttcgcgttttcggttcgcgttttttttttttttttggcgttttttcgtttttagttcggtcgtgcgcgagttatcgatttggagggggtttaggggagcgggtttagttgagggtttg

SEQ ID NO: 29522 - DNA, 916 bp, Artificial Sequence
  chemically treated genomic DNA (Homo sapiens) CpG-island No: 29522
caaaccctcaactaaacccgctcccctaaaccccctccaaatcgataactcgcgcacgaccgaactaaaaacgaaaaaacgccaaaaaaaaaaaaaaaacgcgaaccgaaaacgcgaaaaccgaacgctcacctccctcctctataccgctatccgaatcgacgtcgaaaaaatcgaacccgtctccgtaatccgctaaccccaccaactcatcctcctcctcctcctcctccgcgtcgtcctcgtcctacgactacgacttccccaacacctaactcatcgtacccaccgaccgaccgacccgaaaacgacgaaaatcccgaaataaaaaccaaacctcctaaccgaccgcccgcaacctatttctaaaacgaaaatttatctaaaactcaacgaaacccgacgaaaacgaaaaccgcgcgtcccccgacgaacgacgcccaaatccgaatcccgcgattcccaacgcgcccgaaaccccctcccccgccccgcccgccgacgaaaaaatcaaccgaaacgcgacaattcctcccgaaaaaaaaaaaaaaaaaaaaactacgtaacccgaatcacctaacacacactatcacatactcacatacacaccccgcacgaacgcgcgcgcgctcgcccgaccgcgaacaccactcgacgaaacgctaaaccgaaaacacacatacacacgcacacgcacacgcacgaaaaaaccgaaaaaacgcgaaacccctacaccctcccaaactcacaccgacacacgccccgtacacgaaacccccgaaacgccgaccgtcacccaccgcgactacgcgccaaaaacccccacgcgcctctccttcacgtaatccccgcacaaacaaaaaaaaaaacgccgcacaccctcaatatcccccccgccgtcccactcccacacgcc

SEQ ID NO: 29523 - DNA, 916 bp, Artificial Sequence
  chemically treated genomic DNA (Homo sapiens) CpG-island No: 29523
taaatttttaattggattcgtttttttggattttttttaagtcggtggttcgcgtacggtcgggttgggggcgggaaggcgttaaggggaggaaaggggcgcgagtcgaggacgcgggggtcgggcgtttattttttttttttgtgtcgttgttcggatcggcgtcggaggagtcgggttcgttttcgtagttcgttagttttattagtttattttttttttttttttttttcgcgtcgttttcgttttgcggttgcggtttttttagtatttggtttatcgtgtttatcggtcggtcggttcggggacggcgggggtttcggggtgggggttaagttttttagtcggtcgttcgtagtttatttttgaagcggaggtttgtttagagtttagcggggttcggcggaagcgggggtcgcgcgtttttcggcgggcggcgtttaggttcgggtttcgcggtttttagcgcgttcgaagttttttttttcgtttcgttcgtcggcggaggagttagtcggagcgcggtagtttttttcggaggagggagagagagagagattgcgtgattcgagttatttgatatatattgttatatatttatatatatatttcgtacgggcgcgcgcgcgttcgttcggtcgcgggtattattcggcggggcgttgggtcgaggatatatatgtatacgtatacgtatacgtacgaggagatcggggaggcgcggggtttttgtatttttttagatttatatcgatatacgtttcgtatacggggttttcgggacgtcggtcgttatttatcgcggttgcgcgttaggggtttttacgcgttttttttttacgtggttttcgtataggtaggggagggggcgtcgtatatttttaatgtttttttcgtcgttttatttttatacgtt

SEQ ID NO: 29524 - DNA, 916 bp, Artificial Sequence
  chemically treated genomic DNA (Homo sapiens) CpG-island No: 29524
aacgtataaaaataaaacgacgaaaaaaacattaaaaatatacgacgccccctcccctacctatacgaaaaccacgtaaaaaaaaaacgcgtaaaaacccctaacgcgcaaccgcgataaataacgaccgacgtcccgaaaaccccgtatacgaaacgtatatcgatataaatctaaaaaaatacaaaaaccccgcgcctccccgatctcctcgtacgtatacgtatacgtatacatatatatcctcgacccaacgccccgccgaataatacccgcgaccgaacgaacgcgcgcgcgcccgtacgaaatatatatataaatatataacaatatatatcaaataactcgaatcacgcaatctctctctctctccctcctccgaaaaaaactaccgcgctccgactaactcctccgccgacgaacgaaacgaaaaaaaaaacttcgaacgcgctaaaaaccgcgaaacccgaacctaaacgccgcccgccgaaaaacgcgcgacccccgcttccgccgaaccccgctaaactctaaacaaacctccgcttcaaaaataaactacgaacgaccgactaaaaaacttaacccccaccccgaaacccccgccgtccccgaaccgaccgaccgataaacacgataaaccaaatactaaaaaaaccgcaaccgcaaaacgaaaacgacgcgaaaaaaaaaaaaaaaaaaaataaactaataaaactaacgaactacgaaaacgaacccgactcctccgacgccgatccgaacaacgacacaaaaaaaaaaaataaacgcccgacccccgcgtcctcgactcgcgcccctttcctccccttaacgccttcccgcccccaacccgaccgtacgcgaaccaccgacttaaaaaaaatccaaaaaaacgaatccaattaaaaattta

SEQ ID NO: 29525 - DNA, 636 bp, Artificial Sequence
  chemically treated genomic DNA (Homo sapiens) CpG-island No: 29525
gggagggacgttaaaagttcgatttcgagttgttaaatgagggagcgcggtgttggtggcggaggggtaattaggatcggtggaaaaggggaaggagggagtaagcgtttgggttggaggagcgcgcgtttttgttttttttagagtcggtgtttttcgcgttttttattttaagtttttcgtagcgtttggcggttggggaggggaggggatcgcgggcgcgttttgggattttttttttagaacggtgttgttgaagttagggttagatgtcgtggttaaaaaaaggtagtcggcggcggcgtgattggtagggtcgtcggtagttgcgggtgttagtttcgtttcgcgtcgtcgcgggaggggtttatttaggtagtggttggggagattcgcggggcggcggggggatgttcgttaagttgttgtgggagttttcgagaggtcgtagatttttcgggatttacgtaaatatcgttgttaggatattttatttgttttcggtattattatttggatatggtagtgtttgttcgggagtgagcgcgcggcggggaattttttgttttaatagtgaagtaaatttttttttttgttttagaagcgggttttagtaatcgtttagtttgtgggggt

SEQ ID NO: 29526 - DNA, 636 bp, Artificial Sequence
  chemically treated genomic DNA (Homo sapiens) CpG-island No: 29526
acccccacaaactaaacgattactaaaacccgcttctaaaacaaaaaaaaaaatttacttcactattaaaacaaaaaattccccgccgcgcgctcactcccgaacaaacactaccatatccaaataataataccgaaaacaaataaaatatcctaacaacgatatttacgtaaatcccgaaaaatctacgacctctcgaaaactcccacaacaacttaacgaacatccccccgccgccccgcgaatctccccaaccactacctaaataaacccctcccgcgacgacgcgaaacgaaactaacacccgcaactaccgacgaccctaccaatcacgccgccgccgactacctttttttaaccacgacatctaaccctaacttcaacaacaccgttctaaaaaaaaaatcccaaaacgcgcccgcgatcccctcccctccccaaccgccaaacgctacgaaaaacttaaaataaaaaacgcgaaaaacaccgactctaaaaaaaacaaaaacgcgcgctcctccaacccaaacgcttactccctccttccccttttccaccgatcctaattacccctccgccaccaacaccgcgctccctcatttaacaactcgaaatcgaacttttaacgtccctccc

SEQ ID NO: 29527 - DNA, 636 bp, Artificial Sequence
  chemically treated genomic DNA (Homo sapiens) CpG-island No: 29527
gtttttataagttgaacgattgttaaaattcgtttttagaataggaaaaagagtttgttttattattgaagtaaagaatttttcgtcgcgcgtttattttcgggtaggtattgttatgtttaggtggtgatatcgagagtagataaggtgttttgataacggtgtttgcgtggatttcgggaaatttgcggtttttcggagatttttataatagtttggcgagtattttttcgtcgtttcgcgggtttttttagttattatttgggtgggtttttttcgcggcgacgcggggcgagattgatattcgtagttgtcgacgattttgttagttacgtcgtcgtcggttgtttttttttagttacgatatttgattttggttttaatagtatcgttttgggagagaggttttagggcgcgttcgcggtttttttttttttttaatcgttagacgttgcggagagtttggggtgaggggcgcgggaggtatcggttttgaaaggggtagaagcgcgcgtttttttagtttagacgtttattttttttttttttttttttatcgattttggttgttttttcgttattagtatcgcgtttttttatttggtagttcgaggtcgggtttttggcgtttttttt

SEQ ID NO: 29528 - DNA, 636 bp, Artificial Sequence
  chemically treated genomic DNA (Homo sapiens) CpG-island No: 29528
aaaaaaaacgccaaaaacccgacctcgaactaccaaataaaaaaacgcgatactaataacgaaaaaacaaccaaaatcgataaaaaaaaaaaaaaaaaaaataaacgtctaaactaaaaaaacgcgcgcttctacccctttcaaaaccgatacctcccgcgcccctcaccccaaactctccgcaacgtctaacgattaaaaaaaaaaaaaaaccgcgaacgcgccctaaaacctctctcccaaaacgatactattaaaaccaaaatcaaatatcgtaactaaaaaaaaacaaccgacgacgacgtaactaacaaaatcgtcgacaactacgaatatcaatctcgccccgcgtcgccgcgaaaaaaacccacccaaataataactaaaaaaacccgcgaaacgacgaaaaaatactcgccaaactattataaaaatctccgaaaaaccgcaaatttcccgaaatccacgcaaacaccgttatcaaaacaccttatctactctcgatatcaccacctaaacataacaatacctacccgaaaataaacgcgcgacgaaaaattctttacttcaataataaaacaaactctttttcctattctaaaaacgaattttaacaatcgttcaacttataaaaac

SEQ ID NO: 29529 - DNA, 639 bp, Artificial Sequence
  chemically treated genomic DNA (Homo sapiens) CpG-island No: 29529
gcgggatcgcgcgcgggtagtcggttgcggatagttttgtagtcggagttcggcgtttttttcgagttttcgagggttcgggggtttcggatttcgtttatagcgggtagggtcgggacgagaggacgaggacgtcgttcgtttttgtatttttttaagtcggtttcgtcgggcgggcggcggttgggtagtgatcgatcgttacgaagttattgttacgttagggtaattttataaatttcggacgagggcgggtgacgtaagtcgggcggtcgcggtagggttgggtttgcgattattcgaggaggttgatttttagttcgggcgttcggtttagcgtcgtttcggtcggcgtcggtgtttgttaggtatttagggaggcgggggcgtagtggaggaggcggcgttatcgcgaagcgagcgtttcgttcgtatttagttttgttatttcgttcgtagtttaggttggattgggcggtatttgtcgaggtttttcggttaggtttcgttcgttcgagtcgcgttgagattcgggtagcggtcgcgtggagaggaggtggtagcggttcgggaggtcggagttaagttagcgatttattatggagattcgttataatttgaagagttcgggtgagtagg

SEQ ID NO: 29530 - DNA, 639 bp, Artificial Sequence
  chemically treated genomic DNA (Homo sapiens) CpG-island No: 29530
cctactcacccgaactcttcaaattataacgaatctccataataaatcgctaacttaactccgacctcccgaaccgctaccacctcctctccacgcgaccgctacccgaatctcaacgcgactcgaacgaacgaaacctaaccgaaaaacctcgacaaataccgcccaatccaacctaaactacgaacgaaataacaaaactaaatacgaacgaaacgctcgcttcgcgataacgccgcctcctccactacgcccccgcctccctaaatacctaacaaacaccgacgccgaccgaaacgacgctaaaccgaacgcccgaactaaaaatcaacctcctcgaataatcgcaaacccaaccctaccgcgaccgcccgacttacgtcacccgccctcgtccgaaatttataaaattaccctaacgtaacaataacttcgtaacgatcgatcactacccaaccgccgcccgcccgacgaaaccgacttaaaaaaatacaaaaacgaacgacgtcctcgtcctctcgtcccgaccctacccgctataaacgaaatccgaaacccccgaaccctcgaaaactcgaaaaaaacgccgaactccgactacaaaactatccgcaaccgactacccgcgcgcgatcccgc

SEQ ID NO: 29531 - DNA, 639 bp, Artificial Sequence
  chemically treated genomic DNA (Homo sapiens) CpG-island No: 29531
tttgtttattcggattttttaggttgtagcgggtttttatggtgggtcgttggtttggtttcggtttttcgggtcgttgttattttttttttacgcggtcgttgttcgggttttagcgcggttcgggcggacggggtttggtcgaggagtttcggtaaatgtcgtttagtttagtttggattgcgggcggggtggtaaggttgagtgcgggcgaggcgttcgtttcgcgatggcgtcgttttttttattgcgttttcgtttttttgagtgtttggtaggtatcggcgtcggtcggggcggcgttgaatcgggcgttcgggttggaggttagttttttcgggtagtcgtaggtttagttttgtcgcggtcgttcggtttgcgttattcgttttcgttcgggatttgtgaagttgttttgacgtggtagtagtttcgtggcggtcggttattatttagtcgtcgttcgttcggcgaagtcggtttggggaggtgtaggagcgagcggcgttttcgttttttcgtttcggttttgttcgttgtaggcgaggttcgggattttcgggttttcgagagttcggagggggcgtcgggtttcggttgtaaagttgttcgtagtcggttgttcgcgcgcggtttcgt

SEQ ID NO: 29532 - DNA, 639 bp, Artificial Sequence
  chemically treated genomic DNA (Homo sapiens) CpG-island No: 29532
acgaaaccgcgcgcgaacaaccgactacgaacaactttacaaccgaaacccgacgccccctccgaactctcgaaaacccgaaaatcccgaacctcgcctacaacgaacaaaaccgaaacgaaaaaacgaaaacgccgctcgctcctacacctccccaaaccgacttcgccgaacgaacgacgactaaataataaccgaccgccacgaaactactaccacgtcaaaacaacttcacaaatcccgaacgaaaacgaataacgcaaaccgaacgaccgcgacaaaactaaacctacgactacccgaaaaaactaacctccaacccgaacgcccgattcaacgccgccccgaccgacgccgatacctaccaaacactcaaaaaaacgaaaacgcaataaaaaaaacgacgccatcgcgaaacgaacgcctcgcccgcactcaaccttaccaccccgcccgcaatccaaactaaactaaacgacatttaccgaaactcctcgaccaaaccccgtccgcccgaaccgcgctaaaacccgaacaacgaccgcgtaaaaaaaaaataacaacgacccgaaaaaccgaaaccaaaccaacgacccaccataaaaacccgctacaacctaaaaaatccgaataaacaaa

SEQ ID NO: 29533 - DNA, 518 bp, Artificial Sequence
  chemically treated genomic DNA (Homo sapiens) CpG-island No: 29533
gaagtcgagagtgggatagaagtggagcgttgggcggtaacgaggaaattaaagttatagaagttcggcgtagggcgggaagcgtgggaaggttttttttttcgcggcgaggtgtttttttcgttcgaaacgtcggtttaggttcgttttcggtttttaggtcgttatttttttttttttcgtcgcgggttatttattggcgttcgttcggtgggtttcgcggtttggcggtttggagcgtattatcgcggcggagcggcgggttggggcgtcgtacggtgagaaaggtcggggtttgagaataaatcgtcgcggtcgtcggggtaacgggacggggtacgtgtttttttcgttagagtcggaagcggtaggttcgtgcgttttttttgagttcgaagttaattaggtttcgagcggttcgttgcggtcggtttatgtcggttagttttcgtttttcgagaaggatggtttggaattgttgagacgaggttagagtatgtatggggtttttttttagg

SEQ ID NO: 29534 - DNA, 518 bp, Artificial Sequence
  chemically treated genomic DNA (Homo sapiens) CpG-island No: 29534
cctaaaaaaaaaccccatacatactctaacctcgtctcaacaattccaaaccatccttctcgaaaaacgaaaactaaccgacataaaccgaccgcaacgaaccgctcgaaacctaattaacttcgaactcaaaaaaaacgcacgaacctaccgcttccgactctaacgaaaaaaacacgtaccccgtcccgttaccccgacgaccgcgacgatttattctcaaaccccgacctttctcaccgtacgacgccccaacccgccgctccgccgcgataatacgctccaaaccgccaaaccgcgaaacccaccgaacgaacgccaataaataacccgcgacgaaaaaaaaaaaaataacgacctaaaaaccgaaaacgaacctaaaccgacgtttcgaacgaaaaaaacacctcgccgcgaaaaaaaaaaccttcccacgcttcccgccctacgccgaacttctataactttaatttcctcgttaccgcccaacgctccacttctatcccactctcgacttc

SEQ ID NO: 29535 - DNA, 518 bp, Artificial Sequence
  chemically treated genomic DNA (Homo sapiens) CpG-island No: 29535
tttgaagaaaagttttatgtatgttttggtttcgttttagtagttttaggttatttttttcgaggggcgggagttgatcggtatgaatcggtcgtagcgagtcgttcgaggtttggttggtttcgagtttaggagggacgtacgagtttgtcgttttcggttttggcggggggggtacgtgtttcgtttcgttgtttcggcgatcgcggcggtttgtttttaggtttcggttttttttatcgtgcgacgttttaattcgtcgtttcgtcgcggtggtacgttttaggtcgttaggtcgcgaggtttatcgagcggacgttagtggatgattcgcggcgggggaggaggaggtgacggtttgggagtcggaggcgggtttgggtcggcgtttcgggcgaggggggtatttcgtcgcgaaggaaggggtttttttacgtttttcgttttgcgtcgggtttttgtggttttagttttttcgttgtcgtttagcgttttatttttgttttattttcgatttt

SEQ ID NO: 29536 - DNA, 518 bp, Artificial Sequence
  chemically treated genomic DNA (Homo sapiens) CpG-island No: 29536
aaaatcgaaaataaaacaaaaataaaacgctaaacgacaacgaaaaaactaaaaccacaaaaacccgacgcaaaacgaaaaacgtaaaaaaaccccttccttcgcgacgaaatacccccctcgcccgaaacgccgacccaaacccgcctccgactcccaaaccgtcacctcctcctcccccgccgcgaatcatccactaacgtccgctcgataaacctcgcgacctaacgacctaaaacgtaccaccgcgacgaaacgacgaattaaaacgtcgcacgataaaaaaaaccgaaacctaaaaacaaaccgccgcgatcgccgaaacaacgaaacgaaacacgtaccccccccgccaaaaccgaaaacgacaaactcgtacgtccctcctaaactcgaaaccaaccaaacctcgaacgactcgctacgaccgattcataccgatcaactcccgcccctcgaaaaaaataacctaaaactactaaaacgaaaccaaaacatacataaaacttttcttcaaa

SEQ ID NO: 29537 - DNA, 984 bp, Artificial Sequence
  chemically treated genomic DNA (Homo sapiens) CpG-island No: 29537
tggggcgtcggggtttcgaatcgttcgttttttttagtcgagtttttttattcgttaggttatcgcggcgtcggggttttatatttgatgttgttgtcgtttttgttggtaaggtttaattggtttttggtggtaacgtcgcgttcggattttgtcgttatcgtttttttcgattttttcggttttcgaggttatggcggagttttcgtcgtttttcgtttcggggcgggtaagggggcgggagaggtagaggcggaggttttagagagtttttttcgtcgttcggtttcggtttaaaagttcgttcgcgttgtttatatagtgggtataagtattttaggaatcgcgaggttgcgagtaggagcggagagagggtgagtgttggtagcggggaagggggtggcggtcgtagaggtcgaggaggtttcggttcggtcgtttttgcggattttcgtttttgtgtgtgttacggtttttatggagatttttcgtagaggatagtacgaatagtttttcgcggtgttgaggtttaattcgatcgtcgattggtgggagttttttcgtcgttttagtcgtagttgtcgtagttgaagtcgttggcgacgttcgtttattttttttttgtgcgtatagcgttcgtttcgtcgtcgtcgtcgtcgtcgtttttgtagttttcgtcgtcgttgcgtttattatttttgttaaggcggttgtcgcggtcgcgagttaaaatgtcgttatttatcggcgttcgacgtatttgtattattatgttgcgacgagttgataggtaaagaggaagggttggtcgagtttacgttttcggtcgcgcggtacgttgggaaacgtagtttaataacggaacgcggtttttcggaaaggaagagggacggggaaggagattttcggggcgtcgtagaggtataaagttaaggggtatttttgttgtttttggttgtaaattagattttgaaaagatattta

SEQ ID NO: 29538 - DNA, 984 bp, Artificial Sequence
  chemically treated genomic DNA (Homo sapiens) CpG-island No: 29538
taaatatcttttcaaaatctaatttacaaccaaaaacaacaaaaataccccttaactttatacctctacgacgccccgaaaatctccttccccgtccctcttcctttccgaaaaaccgcgttccgttattaaactacgtttcccaacgtaccgcgcgaccgaaaacgtaaactcgaccaacccttcctctttacctatcaactcgtcgcaacataataatacaaatacgtcgaacgccgataaataacgacattttaactcgcgaccgcgacaaccgccttaacaaaaataataaacgcaacgacgacgaaaactacaaaaacgacgacgacgacgacgacgaaacgaacgctatacgcacaaaaaaaaaataaacgaacgtcgccaacgacttcaactacgacaactacgactaaaacgacgaaaaaactcccaccaatcgacgatcgaattaaacctcaacaccgcgaaaaactattcgtactatcctctacgaaaaatctccataaaaaccgtaacacacacaaaaacgaaaatccgcaaaaacgaccgaaccgaaacctcctcgacctctacgaccgccacccccttccccgctaccaacactcaccctctctccgctcctactcgcaacctcgcgattcctaaaatacttatacccactatataaacaacgcgaacgaacttttaaaccgaaaccgaacgacgaaaaaaactctctaaaacctccgcctctacctctcccgcccccttacccgccccgaaacgaaaaacgacgaaaactccgccataacctcgaaaaccgaaaaaatcgaaaaaaacgataacgacaaaatccgaacgcgacgttaccaccaaaaaccaattaaaccttaccaacaaaaacgacaacaacatcaaatataaaaccccgacgccgcgataacctaacgaataaaaaaactcgactaaaaaaaacgaacgattcgaaaccccgacgcccca

SEQ ID NO: 29539 - DNA, 984 bp, Artificial Sequence
  chemically treated genomic DNA (Homo sapiens) CpG-island No: 29539
taagtgtttttttaaagtttaatttatagttaagaatagtaaaagtattttttggttttgtgtttttgcggcgtttcggagattttttttttcgttttttttttttttcgagaagtcgcgtttcgttgttgaattacgttttttagcgtgtcgcgcggtcgagagcgtggattcgattagttttttttttttgtttattagttcgtcgtagtatgatgatgtaaatgcgtcgggcgtcgatgagtgacgatattttggttcgcgatcgcggtagtcgttttagtaggggtaataggcgtaacggcggcggaggttgtagggacgacgacgacgacggcggcggggcgggcgttgtgcgtataggggaggggtaggcgggcgtcgttagcggttttaattgcggtagttacggttagggcgacggaagaatttttattagtcggcggtcgagttaggttttagtatcgcggggaattgttcgtgttgttttttgcgggagatttttatagagatcgtgatatatatagaggcgggggttcgtagaggcggtcggatcggagttttttcggtttttgcggtcgttattttttttttcgttgttagtatttatttttttttcgtttttgttcgtaatttcgcggtttttggggtgtttgtgtttattgtgtggatagcgcgggcggatttttgggtcggggtcgggcggcgggggaggttttttaaggttttcgtttttgtttttttcgtttttttattcgtttcggagcgggaagcggcggaggtttcgttatggtttcgggagtcggaggagtcggagggggcggtggcggtaagattcggacgcggcgttgttattaggggttaattaagttttattagtaggggcgataatagtattaggtatgggatttcgacgtcgcggtggtttggcgggtggggaaattcggttggaggggacgggcggttcgaggtttcggcgtttta

SEQ ID NO: 29540 - DNA, 984 bp, Artificial Sequence
  chemically treated genomic DNA (Homo sapiens) CpG-island No: 29540
taaaacgccgaaacctcgaaccgcccgtcccctccaaccgaatttccccacccgccaaaccaccgcgacgtcgaaatcccatacctaatactattatcgcccctactaataaaacttaattaacccctaataacaacgccgcgtccgaatcttaccgccaccgccccctccgactcctccgactcccgaaaccataacgaaacctccgccgcttcccgctccgaaacgaataaaaaaacgaaaaaaacaaaaacgaaaaccttaaaaaacctcccccgccgcccgaccccgacccaaaaatccgcccgcgctatccacacaataaacacaaacaccccaaaaaccgcgaaattacgaacaaaaacgaaaaaaaaataaatactaacaacgaaaaaaaaaataacgaccgcaaaaaccgaaaaaactccgatccgaccgcctctacgaacccccgcctctatatatatcacgatctctataaaaatctcccgcaaaaaacaacacgaacaattccccgcgatactaaaacctaactcgaccgccgactaataaaaattcttccgtcgccctaaccgtaactaccgcaattaaaaccgctaacgacgcccgcctacccctcccctatacgcacaacgcccgccccgccgccgtcgtcgtcgtcgtccctacaacctccgccgccgttacgcctattacccctactaaaacgactaccgcgatcgcgaaccaaaatatcgtcactcatcgacgcccgacgcatttacatcatcatactacgacgaactaataaacaaaaaaaaaaaactaatcgaatccacgctctcgaccgcgcgacacgctaaaaaacgtaattcaacaacgaaacgcgacttctcgaaaaaaaaaaaaaacgaaaaaaaaaatctccgaaacgccgcaaaaacacaaaaccaaaaaatacttttactattcttaactataaattaaactttaaaaaaacactta

SEQ ID NO: 29541 - DNA, 794 bp, Artificial Sequence
  chemically treated genomic DNA (Homo sapiens) CpG-island No: 29541
tggattcgtatacggggtgtttttggtgtgagaatgtgtgtggattcgtatacggggtgtttttggtgtgagaatgtgtgtggattcgtagacggggtgtttttggtgtgagaatgtgtgtggattcgtatacggggtgtttttggtgtgagaatgtgtgtggattcgtatacggggtgtttttggtgtgagaatgtgtgtggattcgtatacggggtgtttttggtgtgagaatgtgtgtggattcgtatacggggtgtttttggtgtgagaatgtgtgtggattcgtatacggggtgtttttggtgtgagaatgtgtgtggattcgtatacggggtgtttttggtgtgagaatgtgtgtggattcgtatacggggtgtttttggtgtgagaatgtgtgtggattcgtatacggggtgtttttggtgtgagaatgtgtgtggattcgtagacggggtgtttttggtgtgagaatgtgtgtggattcgtatacggggtgtttttggtgtgagaatgtgtgtggattcgtatacggggtgtttttggtgtgagaatgtgtgtggattcgtagacggggtgtttttggtgtgagaatgtgtgtggattcgtatacggggtgtttttggtgtgagaatgtgtgtggattcgtagacggggtgtttttggtgtgagaatgtgtgtggattcgtatacggggtgtttttggtgtgagaatgtgtgtggattcgtatacggggtgtttttggtgtgagaatgtgtgtggattcgtatacggggtgtttttggtgtgagaa

SEQ ID NO: 29542 - DNA, 794 bp, Artificial Sequence
  chemically treated genomic DNA (Homo sapiens) CpG-island No: 29542
ttctcacaccaaaaacaccccgtatacgaatccacacacattctcacaccaaaaacaccccgtatacgaatccacacacattctcacaccaaaaacaccccgtatacgaatccacacacattctcacaccaaaaacaccccgtctacgaatccacacacattctcacaccaaaaacaccccgtatacgaatccacacacattctcacaccaaaaacaccccgtctacgaatccacacacattctcacaccaaaaacaccccgtatacgaatccacacacattctcacaccaaaaacaccccgtatacgaatccacacacattctcacaccaaaaacaccccgtctacgaatccacacacattctcacaccaaaaacaccccgtatacgaatccacacacattctcacaccaaaaacaccccgtatacgaatccacacacattctcacaccaaaaacaccccgtatacgaatccacacacattctcacaccaaaaacaccccgtatacgaatccacacacattctcacaccaaaaacaccccgtatacgaatccacacacattctcacaccaaaaacaccccgtatacgaatccacacacattctcacaccaaaaacaccccgtatacgaatccacacacattctcacaccaaaaacaccccgtatacgaatccacacacattctcacaccaaaaacaccccgtctacgaatccacacacattctcacaccaaaaacaccccgtatacgaatccacacacattctcacaccaaaaacaccccgtatacgaatcca

SEQ ID NO: 29543 - DNA, 794 bp, Artificial Sequence
  chemically treated genomic DNA (Homo sapiens) CpG-island No: 29543
tttttatattaagaatatttcgtgtacgaatttatatatatttttatattaagaatatttcgtgtgcgaatttatatatatttttatattaagaatatttcgtgtgcgaatttatatatatttttatattaagaatatttcgtttgcgaatttatatatatttttatattaagaatatttcgtgtgcgaatttatatatatttttatattaagaatatttcgtttgcgaatttatatatatttttatattaagaatatttcgtgtgcgaatttatatatatttttatattaagaatatttcgtgtgcgaatttatatatatttttatattaagaatatttcgtttgcgaatttatatatatttttatattaagaatatttcgtgtgcgaatttatatatatttttatattaagaatatttcgtgtgcgaatttatatatatttttatattaagaatatttcgtgtgcgaatttatatatatttttatattaagaatatttcgtgtgcgaatttatatatatttttatattaagaatatttcgtgtgcgaatttatatatatttttatattaagaatatttcgtgtgcgaatttatatatatttttatattaagaatatttcgtgtgcgaatttatatatatttttatattaagaatatttcgtgtgcgaatttatatatatttttatattaagaatatttcgtttgcgaatttatatatatttttatattaagaatatttcgtgtgcgaatttatatatatttttatattaagaatatttcgtgtgcgaattta

SEQ ID NO: 29544 - DNA, 794 bp, Artificial Sequence
  chemically treated genomic DNA (Homo sapiens) CpG-island No: 29544
taaattcgcacacgaaatattcttaatataaaaatatatataaattcgcacacgaaatattcttaatataaaaatatatataaattcgcaaacgaaatattcttaatataaaaatatatataaattcgcacacgaaatattcttaatataaaaatatatataaattcgcacacgaaatattcttaatataaaaatatatataaattcgcacacgaaatattcttaatataaaaatatatataaattcgcacacgaaatattcttaatataaaaatatatataaattcgcacacgaaatattcttaatataaaaatatatataaattcgcacacgaaatattcttaatataaaaatatatataaattcgcacacgaaatattcttaatataaaaatatatataaattcgcacacgaaatattcttaatataaaaatatatataaattcgcaaacgaaatattcttaatataaaaatatatataaattcgcacacgaaatattcttaatataaaaatatatataaattcgcacacgaaatattcttaatataaaaatatatataaattcgcaaacgaaatattcttaatataaaaatatatataaattcgcacacgaaatattcttaatataaaaatatatataaattcgcaaacgaaatattcttaatataaaaatatatataaattcgcacacgaaatattcttaatataaaaatatatataaattcgcacacgaaatattcttaatataaaaatatatataaattcgtacacgaaatattcttaatataaaaa

SEQ ID NO: 29545 - DNA, 552 bp, Artificial Sequence
  chemically treated genomic DNA (Homo sapiens) CpG-island No: 29545
tcgttattttttttacgatgttttttagcgttttttagcgcggtaggcggatgttcgcgtcggaggcgcgtaggttgggcggtaggtagtttcgttatatttttttgggaagtattcgtacgggtagattttgtattacgttgcgagcgcggtttagggacgagattagttttatcgttatcgtgagggaggggcggcgtttgtgggttagttgtagttttagggaggacgcgttcgttgcgtttttcgtcgttcgggataggtgtttcgtcgttagttttaggtggattttatcgagatttttcgagatattttttatgcgaaattgttggaaggttttttgtcgtatttcgtattatagtttggtttcgtggaggtcgtcggaattcgcggggtcgaagtataggttgttagggcgtacgcggagtacgtagattttcgttagtttcgcgacggtgtcgttgacgtgaatgaatagttttagatagtttttgtcggtgattttggcgcgaaattttatgatgttatagggaaggtagttgggggtttttg

SEQ ID NO: 29546 - DNA, 552 bp, Artificial Sequence
  chemically treated genomic DNA (Homo sapiens) CpG-island No: 29546
caaaaacccccaactaccttccctataacatcataaaatttcgcgccaaaatcaccgacaaaaactatctaaaactattcattcacgtcaacgacaccgtcgcgaaactaacgaaaatctacgtactccgcgtacgccctaacaacctatacttcgaccccgcgaattccgacgacctccacgaaaccaaactataatacgaaatacgacaaaaaaccttccaacaatttcgcataaaaaatatctcgaaaaatctcgataaaatccacctaaaactaacgacgaaacacctatcccgaacgacgaaaaacgcaacgaacgcgtcctccctaaaactacaactaacccacaaacgccgcccctccctcacgataacgataaaactaatctcgtccctaaaccgcgctcgcaacgtaatacaaaatctacccgtacgaatacttcccaaaaaaatataacgaaactacctaccgcccaacctacgcgcctccgacgcgaacatccgcctaccgcgctaaaaaacgctaaaaaacatcgtaaaaaaaataacga

SEQ ID NO: 29547 - DNA, 552 bp, Artificial Sequence
  chemically treated genomic DNA (Homo sapiens) CpG-island No: 29547
tagaggtttttagttgttttttttgtggtattatgaagtttcgcgttaagattatcggtaaaggttgtttagagttgtttatttacgttagcggtatcgtcgcgaggttagcgaaggtttgcgtgtttcgcgtgcgttttgatagtttgtgtttcggtttcgcgggtttcggcggtttttacgaggttaggttgtggtgcgaggtgcggtagggggttttttagtagtttcgtatggaaggtgtttcggaagatttcgatgagatttatttggagttgacggcggagtatttgtttcgggcggcgagaagcgtagcgggcgcgttttttttgaagttgtagttgatttataagcgtcgttttttttttacggtggcggtggagttggtttcgtttttgggtcgcgttcgtagcgtggtgtaagatttgttcgtgcgggtgttttttaggagagtgtggcgggattgtttgtcgtttagtttgcgcgttttcgacgcgagtattcgtttgtcgcgttggaggacgttgaggagtatcgtggagaggatggcga

SEQ ID NO: 29548 - DNA, 552 bp, Artificial Sequence
  chemically treated genomic DNA (Homo sapiens) CpG-island No: 29548
tcgccatcctctccacgatactcctcaacgtcctccaacgcgacaaacgaatactcgcgtcgaaaacgcgcaaactaaacgacaaacaatcccgccacactctcctaaaaaacacccgcacgaacaaatcttacaccacgctacgaacgcgacccaaaaacgaaaccaactccaccgccaccgtaaaaaaaaaacgacgcttataaatcaactacaacttcaaaaaaaacgcgcccgctacgcttctcgccgcccgaaacaaatactccgccgtcaactccaaataaatctcatcgaaatcttccgaaacaccttccatacgaaactactaaaaaaccccctaccgcacctcgcaccacaacctaacctcgtaaaaaccgccgaaacccgcgaaaccgaaacacaaactatcaaaacgcacgcgaaacacgcaaaccttcgctaacctcgcgacgataccgctaacgtaaataaacaactctaaacaacctttaccgataatcttaacgcgaaacttcataataccacaaaaaaaacaactaaaaacctcta

SEQ ID NO: 29549 - DNA, 1169 bp, Artificial Sequence
  chemically treated genomic DNA (Homo sapiens) CpG-island No: 29549
gatgcggcgggattagagaaaaattatttagggttaatgttagcgtttcgttaatatagatgtaggtgttttatagggtagttagtagtattttgcgatgtagattcggaatataatggtgtagggcgttgattttcgcgtttttagattttacgaaatacggaaatcgaagattatttatgttgttgtttaggtcgtagacgttttgtagtagtagtcgttttacgttcgttcgcgtatcggtgatttattttgttaattagtaaggtaattttaatagtttagtcgggtttttaacgataggagtacgattatgcgtattcgtggttaggatttaacgttgttcgagatgcgtcgcgtgcggttgttggagatggcggacgcgatggatatgttttgttaagggttggtttgcgtatttatagtttttcgtaagattgattggttttaatttttggagtggtgaattcgttagcgaggtgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgagtttgatattgtaggattatattgttttaataaatttgcggtcgttaa

SEQ ID NO: 29550 - DNA, 1169 bp, Artificial Sequence
  chemically treated genomic DNA (Homo sapiens) CpG-island No: 29550
ttaacgaccgcaaatttattaaaacaatataatcctacaatatcaaactcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgacacctcgctaacgaattcaccactccaaaaattaaaaccaatcaatcttacgaaaaactataaatacgcaaaccaacccttaacaaaacatatccatcgcgtccgccatctccaacaaccgcacgcgacgcatctcgaacaacgttaaatcctaaccacgaatacgcataatcgtactcctatcgttaaaaacccgactaaactattaaaattaccttactaattaacaaaataaatcaccgatacgcgaacgaacgtaaaacgactactactacaaaacgtctacgacctaaacaacaacataaataatcttcgatttccgtatttcgtaaaatctaaaaacgcgaaaatcaacgccctacaccattatattccgaatctacatcgcaaaatactactaactaccctataaaacacctacatctatattaacgaaacgctaacattaaccctaaataatttttctctaatcccgccgcatc

SEQ ID NO: 29551 - DNA, 1169 bp, Artificial Sequence
  chemically treated genomic DNA (Homo sapiens) CpG-island No: 29551
ttagcggtcgtaaatttattagagtaatatagttttataatgttaagttcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggtatttcgttaacggatttattattttaagaattggagttaattaattttgcggagaattgtgaatgcgtaaattaatttttggtagaatatatttatcgcgttcgttatttttagtagtcgtacgcggcgtatttcgggtagcgttgggttttggttacgggtgcgtatgatcgtgtttttgtcgttgaggattcggttaggttgttggggttgttttattggttagtagaatgaattatcgatacgcgagcgaacgtgaagcgattgttgttgtaaaacgtttgcgatttgagtaataatatgaatggttttcggttttcgtgtttcgtaaagtttggaaacgcggaagttagcgttttgtattattatgtttcggatttgtatcgtaggatgttgttggttattttgtggaatatttatatttgtattaacgaagcgttggtattgattttgagtgatttttttttggtttcgtcgtatt

SEQ ID NO: 29552 - DNA, 1169 bp, Artificial Sequence
  chemically treated genomic DNA (Homo sapiens) CpG-island No: 29552
aatacgacgaaaccaaaaaaaaatcactcaaaatcaataccaacgcttcgttaatacaaatataaatattccacaaaataaccaacaacatcctacgatacaaatccgaaacataataatacaaaacgctaacttccgcgtttccaaactttacgaaacacgaaaaccgaaaaccattcatattattactcaaatcgcaaacgttttacaacaacaatcgcttcacgttcgctcgcgtatcgataattcattctactaaccaataaaacaaccccaacaacctaaccgaatcctcaacgacaaaaacacgatcatacgcacccgtaaccaaaacccaacgctacccgaaatacgccgcgtacgactactaaaaataacgaacgcgataaatatattctaccaaaaattaatttacgcattcacaattctccgcaaaattaattaactccaattcttaaaataataaatccgttaacgaaataccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgaacttaacattataaaactatattactctaataaatttacgaccgctaa

SEQ ID NO: 29553 - DNA, 505 bp, Artificial Sequence
  chemically treated genomic DNA (Homo sapiens) CpG-island No: 29553
aaatcgtaagttgcgttaaatttcgcgtatcggggcgggagggcgggtggggaatgtaaggtatcgcgagatgataggattttttcgcgaaggagaagcgcgtttttttttttggcgggggatttggttagaaggttgggtcggtatcggttgtgaggagttagttcgcggtattgtaggttttgataggagggattcggttttcgggtgagtgtttaggtatgttagcggaacggttcgcgggtagcggcggtgagtgaggaaaattttttgggcgcgggtggtagtttgcggggttgaggtgggtaagtatggagttgcggcggagtttcggggagggagtcgatttcgggtagggattgaggaggaaaggagggttgggaaattgtacggtgagtggaggatatttcggaatcgtacgtattagtatgtcggtgaagattttttataggtaattgtattttttcgagtatttcgagttgtaaattgtggtttaggttatttg

SEQ ID NO: 29554 - DNA, 505 bp, Artificial Sequence
  chemically treated genomic DNA (Homo sapiens) CpG-island No: 29554
caaataacctaaaccacaatttacaactcgaaatactcgaaaaaatacaattacctataaaaaatcttcaccgacatactaatacgtacgattccgaaatatcctccactcaccgtacaatttcccaaccctcctttcctcctcaatccctacccgaaatcgactccctccccgaaactccgccgcaactccatacttacccacctcaaccccgcaaactaccacccgcgcccaaaaaattttcctcactcaccgccgctacccgcgaaccgttccgctaacatacctaaacactcacccgaaaaccgaatccctcctatcaaaacctacaataccgcgaactaactcctcacaaccgataccgacccaaccttctaaccaaatcccccgccaaaaaaaaaaacgcgcttctccttcgcgaaaaaatcctatcatctcgcgataccttacattccccacccgccctcccgccccgatacgcgaaatttaacgcaacttacgattt

SEQ ID NO: 29555 - DNA, 505 bp, Artificial Sequence
  chemically treated genomic DNA (Homo sapiens) CpG-island No: 29555
taagtggtttggattatagtttataattcgggatgttcgggaaaatgtagttgtttatgagaaatttttatcggtatgttaatacgtgcgatttcggggtgttttttatttatcgtgtagttttttaattttttttttttttttagtttttgttcggggtcggtttttttttcgaaatttcgtcgtagttttatgtttgtttattttagtttcgtaggttgttattcgcgtttaaaaggttttttttatttatcgtcgttgttcgcgggtcgtttcgttggtatgtttggatatttattcgggaatcgggttttttttattagagtttgtaatgtcgcgagttaattttttataatcggtgtcggtttagttttttagttaaatttttcgttagggaaaaaagcgcgtttttttttcgcgggaaaattttgttatttcgcgatattttatattttttattcgttttttcgtttcgatgcgcgagatttggcgtagtttgcggttt

SEQ ID NO: 29556 - DNA, 505 bp, Artificial Sequence
  chemically treated genomic DNA (Homo sapiens) CpG-island No: 29556
aaaccgcaaactacgccaaatctcgcgcatcgaaacgaaaaaacgaataaaaaatataaaatatcgcgaaataacaaaattttcccgcgaaaaaaaaacgcgcttttttccctaacgaaaaatttaactaaaaaactaaaccgacaccgattataaaaaattaactcgcgacattacaaactctaataaaaaaaacccgattcccgaataaatatccaaacataccaacgaaacgacccgcgaacaacgacgataaataaaaaaaaccttttaaacgcgaataacaacctacgaaactaaaataaacaaacataaaactacgacgaaatttcgaaaaaaaaaccgaccccgaacaaaaactaaaaaaaaaaaaaaaattaaaaaactacacgataaataaaaaacaccccgaaatcgcacgtattaacataccgataaaaatttctcataaacaactacattttcccgaacatcccgaattataaactataatccaaaccactta

SEQ ID NO: 29557 - DNA, 522 bp, Artificial Sequence
  chemically treated genomic DNA (Homo sapiens) CpG-island No: 29557
agaagtcgcgcggtcgcgttgagtcgtcggttagttaggtggcgtatttatttagtaaggcggggttgttgaatttttaagtttcgttgtaggtcgtgtattgggggtggttgtacgggttgtcggagaattcgttttttgcgggagggtcggggagtggggattagacgtttgtaagttagggcggattttacgagttcggtcggtggttttttcgttcgtttttttcgtcgggttttaggcgtaggtgtcgcgggtagggtaatggtcgtggcgggcgggtcgggcggaggtggggcgattatcgcgttcgcgtggagagagttcggggaggcgggaggtatcgacgcgttcgtatatttacgggcgggatttgtgggtcggtgttcgtttagggttttttagcggaggcgttcgcggttatttacgaagggtttgtattggggcgcgtttattttgtcgcgttgggggttagggtttttatagatgttatttcggttttaggaggtatggtttttaatg

SEQ ID NO: 29558 - DNA, 522 bp, Artificial Sequence
  chemically treated genomic DNA (Homo sapiens) CpG-island No: 29558
cattaaaaaccatacctcctaaaaccgaaataacatctataaaaaccctaacccccaacgcgacaaaataaacgcgccccaatacaaacccttcgtaaataaccgcgaacgcctccgctaaaaaaccctaaacgaacaccgacccacaaatcccgcccgtaaatatacgaacgcgtcgatacctcccgcctccccgaactctctccacgcgaacgcgataatcgccccacctccgcccgacccgcccgccacgaccattaccctacccgcgacacctacgcctaaaacccgacgaaaaaaacgaacgaaaaaaccaccgaccgaactcgtaaaatccgccctaacttacaaacgtctaatccccactccccgaccctcccgcaaaaaacgaattctccgacaacccgtacaaccacccccaatacacgacctacaacgaaacttaaaaattcaacaaccccgccttactaaataaatacgccacctaactaaccgacgactcaacgcgaccgcgcgacttct

SEQ ID NO: 29559 - DNA, 522 bp, Artificial Sequence
  chemically treated genomic DNA (Homo sapiens) CpG-island No: 29559
tattaggggttatgttttttagaatcggagtggtatttataaaggttttggtttttagcgcgatagggtggacgcgttttaatataaatttttcgtgggtggtcgcgagcgttttcgttgggaagttttgggcgggtatcggtttataggtttcgttcgtgggtgtgcgagcgcgtcggtgtttttcgttttttcgggttttttttacgcggacgcggtgatcgttttattttcgttcggttcgttcgttacggttattattttgttcgcgatatttgcgtttgagattcggcgggaggagcgggcggagaagttatcggtcggattcgtggggttcgttttggtttgtaggcgtttgatttttatttttcgattttttcgtagggagcgagtttttcggtaattcgtatagttatttttagtatacggtttataacgaggtttggagatttagtaatttcgttttattaagtgagtacgttatttggttggtcggcggtttagcgcggtcgcgcggttttt

SEQ ID NO: 29560 - DNA, 522 bp, Artificial Sequence
  chemically treated genomic DNA (Homo sapiens) CpG-island No: 29560
aaaaaccgcgcgaccgcgctaaaccgccgaccaaccaaataacgtactcacttaataaaacgaaattactaaatctccaaacctcgttataaaccgtatactaaaaataactatacgaattaccgaaaaactcgctccctacgaaaaaatcgaaaaataaaaatcaaacgcctacaaaccaaaacgaaccccacgaatccgaccgataacttctccgcccgctcctcccgccgaatctcaaacgcaaatatcgcgaacaaaataataaccgtaacgaacgaaccgaacgaaaataaaacgatcaccgcgtccgcgtaaaaaaaacccgaaaaaacgaaaaacaccgacgcgctcgcacacccacgaacgaaacctataaaccgatacccgcccaaaacttcccaacgaaaacgctcgcgaccacccacgaaaaatttatattaaaacgcgtccaccctatcgcgctaaaaaccaaaacctttataaataccactccgattctaaaaaacataacccctaata

SEQ ID NO: 29561 - DNA, 627 bp, Artificial Sequence
  chemically treated genomic DNA (Homo sapiens) CpG-island No: 29561
gattagggttttttagtagttcggttcgcgagttggtatcgttcggaatttcgtttacgtttagttcggggcggcgtttggaggcggagtcgttcgttgggttaaatggggtagaggtcgggaggggtgggggtttttcgcgtcgtagttatggagtagtttcgcgtcgtcgttcgtttgtagattgttttgggttatttcggtcgtttttcggtcggggttgtcgtattttttgggttgcgcggggttcgggttggattcggcgtcggcgtcgtcgtttgagtggtggttttggttcgggtggaggtttcggggtcgtacgtttcgtagttttagcgttttttcgtttagcgtcgcgttttcgtttgggtcgcgttttttttaggagtcggggagcggggaagaggttgcgtttttcgaggatacgcgcggtcgttttggggtcggggtaattgtcgcgttgttttgtttttcgggatttttgggggtttttgtttttttttttgtggagacgtcgttttatcggcggcgcgtgatttcggtagttgtttagagatttagagatgtttaattataggcgtacggtgtataggcgcgtagggttgtttggaatcggtttaggtaggt

SEQ ID NO: 29562 - DNA, 627 bp, Artificial Sequence
  chemically treated genomic DNA (Homo sapiens) CpG-island No: 29562
acctacctaaaccgattccaaacaaccctacgcgcctatacaccgtacgcctataattaaacatctctaaatctctaaacaactaccgaaatcacgcgccgccgataaaacgacgtctccacaaaaaaaaaaacaaaaacccccaaaaatcccgaaaaacaaaacaacgcgacaattaccccgaccccaaaacgaccgcgcgtatcctcgaaaaacgcaacctcttccccgctccccgactcctaaaaaaaacgcgacccaaacgaaaacgcgacgctaaacgaaaaaacgctaaaactacgaaacgtacgaccccgaaacctccacccgaaccaaaaccaccactcaaacgacgacgccgacgccgaatccaacccgaaccccgcgcaacccaaaaaatacgacaaccccgaccgaaaaacgaccgaaataacccaaaacaatctacaaacgaacgacgacgcgaaactactccataactacgacgcgaaaaacccccacccctcccgacctctaccccatttaacccaacgaacgactccgcctccaaacgccgccccgaactaaacgtaaacgaaattccgaacgataccaactcgcgaaccgaactactaaaaaaccctaatc

SEQ ID NO: 29563 - DNA, 627 bp, Artificial Sequence
  chemically treated genomic DNA (Homo sapiens) CpG-island No: 29563
gtttgtttgggtcggttttaggtagttttgcgcgtttgtgtatcgtgcgtttgtgattggatatttttgggtttttggatagttgtcggggttacgcgtcgtcggtgaaacgacgtttttataaagagaggagtagaggtttttagggatttcggagggtagggtaacgcggtaattgtttcgattttagggcggtcgcgcgtgttttcgggggacgtagtttttttttcgtttttcggtttttggaagagacgcgatttaggcggggacgcggcgttgagcgaggaggcgttggggttgcgaagcgtgcgatttcgaggtttttattcggattagggttattatttaggcggcggcgtcggcgtcggatttagttcgagtttcgcgtagtttaaaggatacgatagtttcggtcgaggggcggtcgaggtggtttagaataatttgtagacgggcggcggcgcgaagttgttttatggttgcggcgcggggaatttttatttttttcggtttttgttttatttagtttagcgggcggtttcgtttttaggcgtcgtttcggattggacgtaagcgggatttcgggcggtgttagttcgcgggtcgggttgttggggagttttagtt

SEQ ID NO: 29564 - DNA, 627 bp, Artificial Sequence
  chemically treated genomic DNA (Homo sapiens) CpG-island No: 29564
aactaaaactccccaacaacccgacccgcgaactaacaccgcccgaaatcccgcttacgtccaatccgaaacgacgcctaaaaacgaaaccgcccgctaaactaaataaaacaaaaaccgaaaaaaataaaaattccccgcgccgcaaccataaaacaacttcgcgccgccgcccgtctacaaattattctaaaccacctcgaccgcccctcgaccgaaactatcgtatcctttaaactacgcgaaactcgaactaaatccgacgccgacgccgccgcctaaataataaccctaatccgaataaaaacctcgaaatcgcacgcttcgcaaccccaacgcctcctcgctcaacgccgcgtccccgcctaaatcgcgtctcttccaaaaaccgaaaaacgaaaaaaaaactacgtcccccgaaaacacgcgcgaccgccctaaaatcgaaacaattaccgcgttaccctaccctccgaaatccctaaaaacctctactcctctctttataaaaacgtcgtttcaccgacgacgcgtaaccccgacaactatccaaaaacccaaaaatatccaatcacaaacgcacgatacacaaacgcgcaaaactacctaaaaccgacccaaacaaac

SEQ ID NO: 29565 - DNA, 551 bp, Artificial Sequence
  chemically treated genomic DNA (Homo sapiens) CpG-island No: 29565
  misc_feature (187)..(187): n is either a, c, g or t
  misc_feature (239)..(239): n is either a, c, g or t
cggagacgtttgcggcggtttcggagatatcggaaggagtcgcggttgttgcgggaagtggttagtttaggaggcggatttttcgagggtagcgttgcggggtcgtttttcggtttttttgacgcgatattgttttttttcgagagttgagaaggaaaagaggagtttgcgaaggtgcggttgtagntcgttgttggtcgagttggcgggtttcgcgggtaagatcgtgaaggtgagtncggcgttgttggaaggggcgcggggtttaagggcgtttcgttcgcgttcggggtacggtttttgttttcgttttcgcgcgttggggttgcggtcgttgtagtagttttttttttttggttttgggtggcggcgggttcgcgggcgggaagaaggttttggtttttcggtgttttgcgttgtagagataatttagtggtcgttttgttaacggtcggtggaggatgggaatcggtcgttgatttgaggaagggtttttaggggtttttttttggaagcgggaggtgtaggtgagttcgagaagcgggggtttt

SEQ ID NO: 29566 - DNA, 551 bp, Artificial Sequence
  chemically treated genomic DNA (Homo sapiens) CpG-island No: 29566
  misc_feature (313)..(313): n is either a, c, g or t
  misc_feature (365)..(365): n is either a, c, g or t
aaaacccccgcttctcgaactcacctacacctcccgcttccaaaaaaaaacccctaaaaacccttcctcaaatcaacgaccgattcccatcctccaccgaccgttaacaaaacgaccactaaattatctctacaacgcaaaacaccgaaaaaccaaaaccttcttcccgcccgcgaacccgccgccacccaaaaccaaaaaaaaaaaactactacaacgaccgcaaccccaacgcgcgaaaacgaaaacaaaaaccgtaccccgaacgcgaacgaaacgcccttaaaccccgcgccccttccaacaacgccgnactcaccttcacgatcttacccgcgaaacccgccaactcgaccaacaacganctacaaccgcaccttcgcaaactcctcttttccttctcaactctcgaaaaaaaacaatatcgcgtcaaaaaaaccgaaaaacgaccccgcaacgctaccctcgaaaaatccgcctcctaaactaaccacttcccgcaacaaccgcgactccttccgatatctccgaaaccgccgcaaacgtctccg

SEQ ID NO: 29567 - DNA, 551 bp, Artificial Sequence
  chemically treated genomic DNA (Homo sapiens) CpG-island No: 29567
  misc_feature (313)..(313): n is either a, c, g or t
  misc_feature (365)..(365): n is either a, c, g or t
agagttttcgtttttcgggtttatttgtatttttcgtttttagggaagaatttttgaggatttttttttaaattaacgatcggtttttattttttatcgatcgttgatagggcgattattagattatttttgtaacgtagagtatcgaggggttaaggtttttttttcgttcgcgaattcgtcgttatttaggattaagaaaaagaggttgttgtagcggtcgtaattttagcgcgcggaagcgagaatagagatcgtatttcggacgcgagcgaaacgtttttgggtttcgcgttttttttagtagcgtcgngtttatttttacggttttgttcgcgggattcgttagttcgattaataacggnttgtagtcgtattttcgtaagtttttttttttttttttagttttcggagaggggtagtgtcgcgttaggagggtcggaaaacggtttcgtagcgttgttttcggggggttcgttttttgaattggttatttttcgtagtagtcgcggtttttttcggtgttttcggggtcgtcgtaggcgttttcg

SEQ ID NO: 29568 - DNA, 551 bp, Artificial Sequence
  chemically treated genomic DNA (Homo sapiens) CpG-island No: 29568
  misc_feature (187)..(187): n is either a, c, g or t
  misc_feature (239)..(239): n is either a, c, g or t
cgaaaacgcctacgacgaccccgaaaacaccgaaaaaaaccgcgactactacgaaaaataaccaattcaaaaaacgaaccccccgaaaacaacgctacgaaaccgttttccgaccctcctaacgcgacactacccctctccgaaaactaaaaaaaaaaaaaaaaacttacgaaaatacgactacaanccgttattaatcgaactaacgaatcccgcgaacaaaaccgtaaaaataaacncgacgctactaaaaaaaacgcgaaacccaaaaacgtttcgctcgcgtccgaaatacgatctctattctcgcttccgcgcgctaaaattacgaccgctacaacaacctctttttcttaatcctaaataacgacgaattcgcgaacgaaaaaaaaaccttaacccctcgatactctacgttacaaaaataatctaataatcgccctatcaacgatcgataaaaaataaaaaccgatcgttaatttaaaaaaaaatcctcaaaaattcttccctaaaaacgaaaaatacaaataaacccgaaaaacgaaaactct

SEQ ID NO: 29569 - DNA, 504 bp, Artificial Sequence
  chemically treated genomic DNA (Homo sapiens) CpG-island No: 29569
gggcgcgtttttgttcggcgcgtcgatttcgggtattagagtcgttagtttcgtttttcgggtagggggcgggcgtggaaacgtttaagaggatgttgagtgatagaggcgtaggtcgcgtttcgattttgttatgtttttttttagttgtttttttcgttagtcgtcgcgtttttaacgttttttttttttagtagattgggttttcggagtagtagcggtcggtcgcgtagacgtaaagtttcggggatggaggattagattttaagatggcgttagcggtttcgcgtttgcggtttttataaggtttttttgggagttgtagttcggttagcgggttatatgcgaggtatttagcgcgattttcgttttaaattcggttgtatatttggtttacggcgagtgcggagtagaaagtattattggcgcgggttatagttagtcgtttttatttgttaagattttatttgaaagtcgtattagtgtttttaaggattttttcgt

SEQ ID NO: 29570 - DNA, 504 bp, Artificial Sequence
  chemically treated genomic DNA (Homo sapiens) CpG-island No: 29570
acgaaaaaatccttaaaaacactaatacgactttcaaataaaatcttaacaaataaaaacgactaactataacccgcgccaataatactttctactccgcactcgccgtaaaccaaatatacaaccgaatttaaaacgaaaatcgcgctaaatacctcgcatataacccgctaaccgaactacaactcccaaaaaaaccttataaaaaccgcaaacgcgaaaccgctaacgccatcttaaaatctaatcctccatccccgaaactttacgtctacgcgaccgaccgctactactccgaaaacccaatctactaaaaaaaaaaaacgttaaaaacgcgacgactaacgaaaaaaacaactaaaaaaaaacataacaaaatcgaaacgcgacctacgcctctatcactcaacatcctcttaaacgtttccacgcccgccccctacccgaaaaacgaaactaacgactctaatacccgaaatcgacgcgccgaacaaaaacgcgccc

SEQ ID NO: 29571 - DNA, 504 bp, Artificial Sequence
  chemically treated genomic DNA (Homo sapiens) CpG-island No: 29571
gcgggaggatttttgagggtattggtgcgatttttaggtgaggttttagtagatgaaagcggttggttgtggttcgcgttagtagtgttttttgtttcgtattcgtcgtgagttaggtgtgtaatcggatttggggcgagggtcgcgttggatatttcgtatgtagttcgttgatcggattatagtttttagaagagttttgtggaggtcgtagacgcgaagtcgttggcgttattttgaaatttgattttttattttcgaggttttgcgtttgcgcggtcggtcgttgttgtttcgggagtttagtttgttaaaaggggaggacgttgaggacgcggcggttggcgggagagatagttggggagagatatggtagggtcggagcgcggtttgcgtttttgttatttagtatttttttaggcgtttttacgttcgttttttgttcgaggggcggggttgacggttttggtattcggagtcggcgcgtcgggtaggggcgcgttt

SEQ ID NO: 29572 - DNA, 504 bp, Artificial Sequence
  chemically treated genomic DNA (Homo sapiens) CpG-island No: 29572
aaacgcgcccctacccgacgcgccgactccgaataccaaaaccgtcaaccccgcccctcgaacaaaaaacgaacgtaaaaacgcctaaaaaaatactaaataacaaaaacgcaaaccgcgctccgaccctaccatatctctccccaactatctctcccgccaaccgccgcgtcctcaacgtcctccccttttaacaaactaaactcccgaaacaacaacgaccgaccgcgcaaacgcaaaacctcgaaaataaaaaatcaaatttcaaaataacgccaacgacttcgcgtctacgacctccacaaaactcttctaaaaactataatccgatcaacgaactacatacgaaatatccaacgcgaccctcgccccaaatccgattacacacctaactcacgacgaatacgaaacaaaaaacactactaacgcgaaccacaaccaaccgctttcatctactaaaacctcacctaaaaatcgcaccaataccctcaaaaatcctcccgc

SEQ ID NO: 29573 - DNA, 636 bp, Artificial Sequence
  chemically treated genomic DNA (Homo sapiens) CpG-island No: 29573
gcgagcgagcgagcgtttagcgtttcgggttgagtgagggaggaggttcggtggagaggttgtaagtgggcgagggttgggcgtagcgattttattggagtcggtcggtggacgtttcggcggaatcgtttagagtttttgttttgcgttatttattcgaacgcgtttgcgcgttgcgaatttcgtttcggtgttatttgttggagtttttcgttcgcgtagtcgtgtatatgcgtattgtcggtcgtcggttagtggggttacgtgttgcgcgcgagttattttttttgttggcgttttttgtcgttatcgttgcggtttagggttcgcgggagtttagggcggtgtcgggtgagataaggtcggggtttggttcggatttatcgcgaggtatgtcgcgttttcgtttttcggcgtggggagttttggggatcgcgggggtagatggaggcggcgcgggcggggtagggcggcgcgtttcgtagcgcgggagtgggggtttcgtgtcgtttttttttacggatttcgttgtttatttttcgtgaggtttggttgtgttatcggggtcgtagttttggagtgtttggtttcgtttttatttgagtcggagttattttcgaaatttgatatttagag

SEQ ID NO: 29574 - DNA, 636 bp, Artificial Sequence
  chemically treated genomic DNA (Homo sapiens) CpG-island No: 29574
ctctaaatatcaaatttcgaaaataactccgactcaaataaaaacgaaaccaaacactccaaaactacgaccccgataacacaaccaaacctcacgaaaaataaacaacgaaatccgtaaaaaaaaacgacacgaaacccccactcccgcgctacgaaacgcgccgccctaccccgcccgcgccgcctccatctacccccgcgatccccaaaactccccacgccgaaaaacgaaaacgcgacatacctcgcgataaatccgaaccaaaccccgaccttatctcacccgacaccgccctaaactcccgcgaaccctaaaccgcaacgataacgacaaaaaacgccaacaaaaaaaataactcgcgcgcaacacgtaaccccactaaccgacgaccgacaatacgcatatacacgactacgcgaacgaaaaactccaacaaataacaccgaaacgaaattcgcaacgcgcaaacgcgttcgaataaataacgcaaaacaaaaactctaaacgattccgccgaaacgtccaccgaccgactccaataaaatcgctacgcccaaccctcgcccacttacaacctctccaccgaacctcctccctcactcaacccgaaacgctaaacgctcgctcgctcgc

SEQ ID NO: 29575 - DNA, 636 bp, Artificial Sequence
  chemically treated genomic DNA (Homo sapiens) CpG-island No: 29575
ttttgagtgttagatttcgggagtgatttcggtttaggtgaaagcgaggttagatattttaaggttgcggtttcgatgatatagttaggttttacggaaggtgggtaacggagttcgtagggggaggcgatacgggatttttattttcgcgttgcgggacgcgtcgttttgtttcgttcgcgtcgtttttatttattttcgcggtttttagaattttttacgtcgaggggcggggacgcggtatatttcgcggtgaattcgagttaaatttcggttttgttttattcggtatcgttttgggttttcgcgggttttgggtcgtagcggtagcgataggaagcgttagtaggggaggtggttcgcgcgtaatacgtgattttattggtcggcggtcggtagtgcgtatgtgtacggttacgcgggcggggggttttaataggtgatatcggggcggggttcgtagcgcgtaggcgcgttcgggtaggtagcgtaggataggaattttgggcggtttcgtcggggcgtttatcggtcggttttaatgaggtcgttgcgtttagttttcgtttatttgtagtttttttatcgaatttttttttttatttagttcgaggcgttgggcgttcgttcgttcgt

SEQ ID NO: 29576 - DNA, 636 bp, Artificial Sequence
  chemically treated genomic DNA (Homo sapiens) CpG-island No: 29576
acgaacgaacgaacgcccaacgcctcgaactaaataaaaaaaaaaattcgataaaaaaactacaaataaacgaaaactaaacgcaacgacctcattaaaaccgaccgataaacgccccgacgaaaccgcccaaaattcctatcctacgctacctacccgaacgcgcctacgcgctacgaaccccgccccgatatcacctattaaaaccccccgcccgcgtaaccgtacacatacgcactaccgaccgccgaccaataaaatcacgtattacgcgcgaaccacctcccctactaacgcttcctatcgctaccgctacgacccaaaacccgcgaaaacccaaaacgataccgaataaaacaaaaccgaaatttaactcgaattcaccgcgaaatataccgcgtccccgcccctcgacgtaaaaaattctaaaaaccgcgaaaataaataaaaacgacgcgaacgaaacaaaacgacgcgtcccgcaacgcgaaaataaaaatcccgtatcgcctccccctacgaactccgttacccaccttccgtaaaacctaactatatcatcgaaaccgcaaccttaaaatatctaacctcgctttcacctaaaccgaaatcactcccgaaatctaacactcaaaa

SEQ ID NO: 29577 - DNA, 624 bp, Artificial Sequence
  chemically treated genomic DNA (Homo sapiens) CpG-island No: 29577
cgtttagttttcgttatcggagcgtttcgttcgagattattgattttttggggtttcgtagttttgttttcgaacgttaaggtcgcggtgcgtcggggtagcgaacggttaggttcgaaatttcgtttcgtagttaaacgttcggttcgttattttgcgtttagttttagtcgtcgggtttcgtttgggtttttttttttgggaatatcgggtatcggtggtttcgtttttatttgcgcgtcgtattttcgggaataatagtttttttttcgagtattatagttagatatggtttagattagggattcgcgcggtttttaattttcgtacggttttgcgcgcggcgtttagtttgggatacggtagcgaggtcgtaaatgtaattaggcggcgttgagggtagttcgggggcggggcgaacggggcgggggtcggggtttggtaaggtttcgtcggttgagatatttagcggcgtatttgatttttcgggaggtaaggttaacgtggttggaggcggggttgggttggggggcgggggtttaagtttgagagatttaaaggtatcgttagcgtttgggggcgtggttaattatgcgggaggcggggttttgatgttggatatta

SEQ ID NO: 29578 - DNA, 624 bp, Artificial Sequence
  chemically treated genomic DNA (Homo sapiens) CpG-island No: 29578
taatatccaacatcaaaaccccgcctcccgcataattaaccacgcccccaaacgctaacgatacctttaaatctctcaaacttaaacccccgccccccaacccaaccccgcctccaaccacgttaaccttacctcccgaaaaatcaaatacgccgctaaatatctcaaccgacgaaaccttaccaaaccccgacccccgccccgttcgccccgcccccgaactaccctcaacgccgcctaattacatttacgacctcgctaccgtatcccaaactaaacgccgcgcgcaaaaccgtacgaaaattaaaaaccgcgcgaatccctaatctaaaccatatctaactataatactcgaaaaaaaaactattattcccgaaaatacgacgcgcaaataaaaacgaaaccaccgatacccgatattcccaaaaaaaaaaacccaaacgaaacccgacgactaaaactaaacgcaaaataacgaaccgaacgtttaactacgaaacgaaatttcgaacctaaccgttcgctaccccgacgcaccgcgaccttaacgttcgaaaacaaaactacgaaaccccaaaaaatcaataatctcgaacgaaacgctccgataacgaaaactaaacg

SEQ ID NO: 29579 - DNA, 624 bp, Artificial Sequence
  chemically treated genomic DNA (Homo sapiens) CpG-island No: 29579
tgatgtttagtattaaggtttcgtttttcgtatggttggttacgtttttagacgttagcggtgtttttaggttttttagatttgaattttcgttttttaatttagtttcgtttttaattacgttggttttgtttttcgggaagttaggtgcgtcgttggatattttagtcggcggggttttattagatttcggttttcgtttcgttcgtttcgttttcgggttgtttttagcgtcgtttgattgtatttgcggtttcgttgtcgtattttaggttaagcgtcgcgcgtaaagtcgtgcggagattggaggtcgcgcgggtttttggtttgggttatgtttggttgtgatgttcgggagggagattgttgttttcggaaatgcggcgcgtaggtaagggcggggttatcggtgttcggtatttttaggaggagaggtttaggcgggattcggcggttggagttgggcgtagggtagcgggtcgggcgtttagttgcggggcggggtttcgggtttggtcgttcgttatttcggcgtatcgcgattttggcgttcggaagtaaggttgcgaggttttaggagattagtggtttcgggcggggcgtttcgatggcgggagttgggcg

SEQ ID NO: 29580 - DNA, 624 bp, Artificial Sequence
  chemically treated genomic DNA (Homo sapiens) CpG-island No: 29580
cgcccaactcccgccatcgaaacgccccgcccgaaaccactaatctcctaaaacctcgcaaccttacttccgaacgccaaaatcgcgatacgccgaaataacgaacgaccaaacccgaaaccccgccccgcaactaaacgcccgacccgctaccctacgcccaactccaaccgccgaatcccgcctaaacctctcctcctaaaaataccgaacaccgataaccccgcccttacctacgcgccgcatttccgaaaacaacaatctccctcccgaacatcacaaccaaacataacccaaaccaaaaacccgcgcgacctccaatctccgcacgactttacgcgcgacgcttaacctaaaatacgacaacgaaaccgcaaatacaatcaaacgacgctaaaaacaacccgaaaacgaaacgaacgaaacgaaaaccgaaatctaataaaaccccgccgactaaaatatccaacgacgcacctaacttcccgaaaaacaaaaccaacgtaattaaaaacgaaactaaattaaaaaacgaaaattcaaatctaaaaaacctaaaaacaccgctaacgtctaaaaacgtaaccaaccatacgaaaaacgaaaccttaatactaaacatca

SEQ ID NO: 29581 - DNA, 1116 bp, Artificial Sequence
  chemically treated genomic DNA (Homo sapiens) CpG-island No: 29581
ggcgttgtttattttggcggtcggcgcggacggttcgtttcggtagtttcggagcgagtttaggtggtacgtgttagttaggtagtttcggttcggaggagagcgtcgcggggtacgggggcgttttttggagtcgcggtttggaggagtaggtgttttcgggtttttcggaggtttaggcggcggcgtggttggagacggttcgcggcgttcggatggtggttttggagcgcgggggttgcgggcgtagttttaatcgattggttcgttttgtcgacggtattcgcgtttgcgtgcgttacggtattaattcggagtagatttagggcgaggttttgttttattatttggcgcgtttgttgggtttttagcgttacgtgtcgtcgttggtattggttcgggtggaggttcggggcgcgtagtgggcgtaggtgtaggaggagttgcgcgttgcgtattggatcgagggtagcgtggtgagtttgatacgttggttgtttaattttacggacgtggtggtgttcgcgttttggcgttcggaggacggtcgtttgcgtttttttcgggatgtcgggggtgagttggttaattttagttaggcggagttggtggatttagtataatggatcgatttaatttttttcgattatttgacggttaatttcgatcggttcgtaagtaatttttttagtttgtagtgggattcgcgcgttatgtagcgtgttattagtaatttgtatcgcggttcgggcggggcgttggtttttttggataatgaggcgggtttggtgtacggttatcgggtagtaggtatgtgggataagtataacgagtcgttgttgtagttagtgtgcgtgtttcgcgagcggatcgcgcggcgcgttttggagttgtatcgcggataggacgtcgcggttcggttgttgcgtttttatcggcgttacgagtttcgttttttcgagttggtcgtttttgtagatttttacgtttagttgttatagcgtcgtttcgattttttcgttaagtatattttgtattgtaaggttaagtacggtcgtcggtttgggatttagtgttatcgggaggaaaagagagagatttggggttggggtatgg

SEQ ID NO: 29582 - DNA, 1116 bp, Artificial Sequence
  chemically treated genomic DNA (Homo sapiens) CpG-island No: 29582
ccataccccaaccccaaatctctctcttttcctcccgataacactaaatcccaaaccgacgaccgtacttaaccttacaatacaaaatatacttaacgaaaaaatcgaaacgacgctataacaactaaacgtaaaaatctacaaaaacgaccaactcgaaaaaacgaaactcgtaacgccgataaaaacgcaacaaccgaaccgcgacgtcctatccgcgatacaactccaaaacgcgccgcgcgatccgctcgcgaaacacgcacactaactacaacaacgactcgttatacttatcccacatacctactacccgataaccgtacaccaaacccgcctcattatccaaaaaaaccaacgccccgcccgaaccgcgatacaaattactaataacacgctacataacgcgcgaatcccactacaaactaaaaaaattacttacgaaccgatcgaaattaaccgtcaaataatcgaaaaaaattaaatcgatccattatactaaatccaccaactccgcctaactaaaattaaccaactcacccccgacatcccgaaaaaaacgcaaacgaccgtcctccgaacgccaaaacgcgaacaccaccacgtccgtaaaattaaacaaccaacgtatcaaactcaccacgctaccctcgatccaatacgcaacgcgcaactcctcctacacctacgcccactacgcgccccgaacctccacccgaaccaataccaacgacgacacgtaacgctaaaaacccaacaaacgcgccaaataataaaacaaaacctcgccctaaatctactccgaattaataccgtaacgcacgcaaacgcgaataccgtcgacaaaacgaaccaatcgattaaaactacgcccgcaacccccgcgctccaaaaccaccatccgaacgccgcgaaccgtctccaaccacgccgccgcctaaacctccgaaaaacccgaaaacacctactcctccaaaccgcgactccaaaaaacgcccccgtaccccgcgacgctctcctccgaaccgaaactacctaactaacacgtaccacctaaactcgctccgaaactaccgaaacgaaccgtccgcgccgaccgccaaaataaacaacgcc

SEQ ID NO: 29583 - DNA, 1116 bp, Artificial Sequence
  chemically treated genomic DNA (Homo sapiens) CpG-island No: 29583
ttatattttagttttagatttttttttttttttttcggtgatattaagttttagatcggcggtcgtatttggttttatagtgtaaaatgtgtttggcgaggaagtcgaggcggcgttgtagtagttgagcgtgggggtttgtaagggcggttagttcggggaagcgaggttcgtggcgtcggtagaggcgtagtagtcgggtcgcggcgttttgttcgcggtgtagttttaggacgcgtcgcgcggttcgttcgcggaatacgtatattgattgtaatagcggttcgttatatttgttttatatgtttgttattcggtagtcgtgtattaagttcgttttattgtttagaaagattagcgtttcgttcggatcgcggtgtaggttgttggtggtacgttgtatgacgcgcgggttttattgtaggttgaagaggttgtttacgagtcggtcgaagttggtcgttaggtagtcgaaaaggattaagtcggtttattgtattaggtttattagtttcgtttggttgaggttggttagtttattttcggtatttcggagggggcgtagacggtcgtttttcgagcgttagggcgcgggtattattacgttcgtgaggttgggtagttagcgtgttaggtttattacgttgttttcggtttagtgcgtagcgcgtagttttttttgtatttgcgtttattgcgcgtttcgagtttttattcgagttagtgttagcggcggtacgtggcgttggaggtttagtaggcgcgttagatagtaagatagggtttcgttttgaatttgtttcgggttgatgtcgtagcgtacgtaggcgcgggtgtcgtcggtaaaacgggttagtcggttggagttgcgttcgtaattttcgcgttttagggttattattcgggcgtcgcgagtcgtttttagttacgtcgtcgtttgggttttcgaaaagttcgggggtatttgtttttttaggtcgcggttttagaagacgttttcgtgtttcgcggcgttttttttcgggtcggggttgtttggttgatacgtgttatttgggttcgtttcgggattgtcggggcgggtcgttcgcgtcggtcgttagggtgagtagcgtt

SEQ ID NO: 29584 - DNA, 1116 bp, Artificial Sequence
  chemically treated genomic DNA (Homo sapiens) CpG-island No: 29584
aacgctactcaccctaacgaccgacgcgaacgacccgccccgacaatcccgaaacgaacccaaataacacgtatcaaccaaacaaccccgacccgaaaaaaaacgccgcgaaacacgaaaacgtcttctaaaaccgcgacctaaaaaaacaaatacccccgaacttttcgaaaacccaaacgacgacgtaactaaaaacgactcgcgacgcccgaataataaccctaaaacgcgaaaattacgaacgcaactccaaccgactaacccgttttaccgacgacacccgcgcctacgtacgctacgacatcaacccgaaacaaattcaaaacgaaaccctatcttactatctaacgcgcctactaaacctccaacgccacgtaccgccgctaacactaactcgaataaaaactcgaaacgcgcaataaacgcaaatacaaaaaaaactacgcgctacgcactaaaccgaaaacaacgtaataaacctaacacgctaactacccaacctcacgaacgtaataatacccgcgccctaacgctcgaaaaacgaccgtctacgccccctccgaaataccgaaaataaactaaccaacctcaaccaaacgaaactaataaacctaatacaataaaccgacttaatccttttcgactacctaacgaccaacttcgaccgactcgtaaacaacctcttcaacctacaataaaacccgcgcgtcatacaacgtaccaccaacaacctacaccgcgatccgaacgaaacgctaatctttctaaacaataaaacgaacttaatacacgactaccgaataacaaacatataaaacaaatataacgaaccgctattacaatcaatatacgtattccgcgaacgaaccgcgcgacgcgtcctaaaactacaccgcgaacaaaacgccgcgacccgactactacgcctctaccgacgccacgaacctcgcttccccgaactaaccgcccttacaaacccccacgctcaactactacaacgccgcctcgacttcctcgccaaacacattttacactataaaaccaaatacgaccgccgatctaaaacttaatatcaccgaaaaaaaaaaaaaaaaatctaaaactaaaatataa

SEQ ID NO: 29585 - DNA, 656 bp, Artificial Sequence
  chemically treated genomic DNA (Homo sapiens) CpG-island No: 29585
aattttgtacggcgttggagcgtggaagggtaaggaggagttaggggaggcggtgtgtagggttgagaacggagggagcgaattggcgtcgtggatttgcgggttttcgggcgggttgtattagggtagtggggagagggtcgggggtatcgcgaggtcggggcgtcggatattacgtatgcgcggggttgggagtttagcggggcgcgcggttgtagtagtttgggtagatcgtttcggtttcgttcggtgtcggttgcggtcgttttcgttttagcgcggcggtcgggtttatattagtttttttttagttattcggaattcggtagttcggttagattcgtcgaggtcgcgacgtcggcgtcgatagcggttgcgacggttttgggagcgcgtgaggtttcggggtcgcggcggcgattggtcggtcgcggcgttcgtttttagaatgtagcgtatggcgcgttattgaagagagattatgatggcggcggcgttggggtttttagaagtgatcgtttagttggagaacgcggttaaagttttgatggtgaggacgtcgcgttttttagatttcgggattcgcgggttttcggtcggttttgttattttaggttttgttgttcgttgggttggcgattggtaagggtttgtag

SEQ ID NO: 29586 - DNA, 656 bp, Artificial Sequence
  chemically treated genomic DNA (Homo sapiens) CpG-island No: 29586
ctacaaacccttaccaatcgccaacccaacgaacaacaaaacctaaaataacaaaaccgaccgaaaacccgcgaatcccgaaatctaaaaaacgcgacgtcctcaccatcaaaactttaaccgcgttctccaactaaacgatcacttctaaaaaccccaacgccgccgccatcataatctctcttcaataacgcgccatacgctacattctaaaaacgaacgccgcgaccgaccaatcgccgccgcgaccccgaaacctcacgcgctcccaaaaccgtcgcaaccgctatcgacgccgacgtcgcgacctcgacgaatctaaccgaactaccgaattccgaataactaaaaaaaaactaatataaacccgaccgccgcgctaaaacgaaaacgaccgcaaccgacaccgaacgaaaccgaaacgatctacccaaactactacaaccgcgcgccccgctaaactcccaaccccgcgcatacgtaatatccgacgccccgacctcgcgatacccccgaccctctccccactaccctaatacaacccgcccgaaaacccgcaaatccacgacgccaattcgctccctccgttctcaaccctacacaccgcctcccctaactcctccttacccttccacgctccaacgccgtacaaaatt

SEQ ID NO: 29587 - DNA, 656 bp, Artificial Sequence
  chemically treated genomic DNA (Homo sapiens) CpG-island No: 29587
ttgtaggtttttgttagtcgttagtttagcgagtagtaaggtttggagtggtagggtcgatcgggggttcgcgaatttcggggtttgaggggcgcggcgtttttattattagaattttagtcgcgttttttagttgagcgattatttttgggggttttagcgtcgtcgttattatggtttttttttaatgacgcgttatgcgttgtattttgggagcgggcgtcgcggtcggttaatcgtcgtcgcgatttcggagttttacgcgtttttagggtcgtcgtagtcgttgtcgacgtcggcgtcgcggtttcggcgggtttggtcgggttgtcgggtttcgggtggttgggaggggattagtgtgagttcggtcgtcgcgttggggcgggggcggtcgtagtcggtatcgggcgaggtcgaggcggtttgtttagattgttgtagtcgcgcgtttcgttaagtttttagtttcgcgtatgcgtggtgttcggcgtttcggtttcgcggtgttttcggttttttttttattattttagtatagttcgttcggggattcgtagatttacgacgttagttcgtttttttcgtttttagttttgtatatcgttttttttggtttttttttgtttttttacgttttagcgtcgtgtaggatt

SEQ ID NO: 29588 - DNA, 656 bp, Artificial Sequence
  chemically treated genomic DNA (Homo sapiens) CpG-island No: 29588
aatcctacacgacgctaaaacgtaaaaaaacaaaaaaaaaccaaaaaaaacgatatacaaaactaaaaacgaaaaaaacgaactaacgtcgtaaatctacgaatccccgaacgaactatactaaaataataaaaaaaaaaccgaaaacaccgcgaaaccgaaacgccgaacaccacgcatacgcgaaactaaaaacttaacgaaacgcgcgactacaacaatctaaacaaaccgcctcgacctcgcccgataccgactacgaccgcccccgccccaacgcgacgaccgaactcacactaatcccctcccaaccacccgaaacccgacaacccgaccaaacccgccgaaaccgcgacgccgacgtcgacaacgactacgacgaccctaaaaacgcgtaaaactccgaaatcgcgacgacgattaaccgaccgcgacgcccgctcccaaaatacaacgcataacgcgtcattaaaaaaaaaccataataacgacgacgctaaaacccccaaaaataatcgctcaactaaaaaacgcgactaaaattctaataataaaaacgccgcgcccctcaaaccccgaaattcgcgaacccccgatcgaccctaccactccaaaccttactactcgctaaactaacgactaacaaaaacctacaa

SEQ ID NO: 29589 - DNA, 694 bp, Artificial Sequence
  chemically treated genomic DNA (Homo sapiens) CpG-island No: 29589
  misc_feature (692)..(692): n is either a, c, g or t
ttttattcgtatttttcgcgttcgagtgagtttatttcgtttatagttggttgtcggttattgttttcgttattaatgacgtttttaggggcgggtacgttttcgtttttatttcgcgttttttttcgcgtttcgttttcgttcgcgtttcgttttcgttcgcgtttcgttttcgttcgcgtttcgtttttttttcgcgtttcgtttttttttcgcgtttcgttttagttttcgttttttttttcggcgtttcgtttttattttcgtttcgtatttcgttgtatagattttatttatttttttaagcgtcggggtttgcgtagcggcggaaatgggtagggcggagcgagcgttgcggttaaagcgaaggcggggattttatttatttttagttttgtcggttttttttatttcgggttacgtcgtgataggggcgaaagcgtcggtggcggtggcggtcgaaaagaggttggggttcgcggcgcggttgtagtcgtttgtgcgtcggcgcgcggtttcgaaaaggcgttttagtttaaggcggcgcgtatcgtttcgttggcgtttagaggtgggaggttttttatttcggggcgtgcgtgggggtcgtggcggatttcgggtgatagcgttgtataaagtagtttggttggggtgtaagttttttttttttttttgtgtagcgttttttntt

SEQ ID NO: 29590 - DNA, 694 bp, Artificial Sequence
  chemically treated genomic DNA (Homo sapiens) CpG-island No: 29590
  misc_feature (3)..(3): n is either a, c, g or t
aanaaaaaacgctacacaaaaaaaaaaaaaaaacttacaccccaaccaaactactttatacaacgctatcacccgaaatccgccacgacccccacgcacgccccgaaataaaaaacctcccacctctaaacgccaacgaaacgatacgcgccgccttaaactaaaacgccttttcgaaaccgcgcgccgacgcacaaacgactacaaccgcgccgcgaaccccaacctcttttcgaccgccaccgccaccgacgctttcgcccctatcacgacgtaacccgaaataaaaaaaaccgacaaaactaaaaataaataaaatccccgccttcgctttaaccgcaacgctcgctccgccctacccatttccgccgctacgcaaaccccgacgcttaaaaaaataaataaaatctatacaacgaaatacgaaacgaaaataaaaacgaaacgccgaaaaaaaaaacgaaaactaaaacgaaacgcgaaaaaaaaacgaaacgcgaaaaaaaaacgaaacgcgaacgaaaacgaaacgcgaacgaaaacgaaacgcgaacgaaaacgaaacgcgaaaaaaaacgcgaaataaaaacgaaaacgtacccgcccctaaaaacgtcattaataacgaaaacaataaccgacaaccaactataaacgaaataaactcactcgaacgcgaaaaatacgaataaaa

SEQ ID NO: 29591 - DNA, 694 bp, Artificial Sequence
  chemically treated genomic DNA (Homo sapiens) CpG-island No: 29591
  misc_feature (3)..(3): n is either a, c, g or t
ggngaggggcgttgtatagggggaaagggagggtttgtattttaattaagttgttttgtgtaacgttgttattcgaaattcgttacggtttttacgtacgtttcgaagtggggagttttttatttttgagcgttagcgaggcggtgcgcgtcgttttggattggggcgttttttcggagtcgcgcgtcggcgtatagacggttgtagtcgcgtcgcgagttttagttttttttcggtcgttatcgttatcggcgttttcgtttttgttacggcgtgattcggggtgggaggagtcgataggattagggatgggtagggttttcgttttcgttttagtcgtagcgttcgtttcgttttgtttattttcgtcgttgcgtaaatttcggcgtttggggaagtgggtggagtttgtgtaacgaggtacggggcgggagtgaagacggggcgtcgggagagggggcgggaattgaggcggggcgcgggaaagaggcggggcgcgggaaagaggcggggcgcgggcggaggcggggcgcgggcggaggcggggcgcgggcggaggcggggcgcggagaaagacgcgaggtggaagcggaggcgtattcgtttttggggacgttattggtggcggaggtaatggtcggtaattagttgtaagcgaggtaggtttattcgggcgcggagggtgcgggtgaga

SEQ ID NO: 29592 - DNA, 694 bp, Artificial Sequence
  chemically treated genomic DNA (Homo sapiens) CpG-island No: 29592
  misc_feature (692)..(692): n is either a, c, g or t
tctcacccgcaccctccgcgcccgaataaacctacctcgcttacaactaattaccgaccattacctccgccaccaataacgtccccaaaaacgaatacgcctccgcttccacctcgcgtctttctccgcgccccgcctccgcccgcgccccgcctccgcccgcgccccgcctccgcccgcgccccgcctctttcccgcgccccgcctctttcccgcgccccgcctcaattcccgccccctctcccgacgccccgtcttcactcccgccccgtacctcgttacacaaactccacccacttccccaaacgccgaaatttacgcaacgacgaaaataaacaaaacgaaacgaacgctacgactaaaacgaaaacgaaaaccctacccatccctaatcctatcgactcctcccaccccgaatcacgccgtaacaaaaacgaaaacgccgataacgataacgaccgaaaaaaaactaaaactcgcgacgcgactacaaccgtctatacgccgacgcgcgactccgaaaaaacgccccaatccaaaacgacgcgcaccgcctcgctaacgctcaaaaataaaaaactccccacttcgaaacgtacgtaaaaaccgtaacgaatttcgaataacaacgttacacaaaacaacttaattaaaatacaaaccctccctttccccctatacaacgcccctcncc

SEQ ID NO: 29593 - DNA, 523 bp, Artificial Sequence
  chemically treated genomic DNA (Homo sapiens) CpG-island No: 29593
tatcgtcgtcgttacgattacgttttgtattttcgtttttaacgtttcggttcgagtggcgtagtttggatattgtcgtcgtcgtttttttttttcgtttttacgttatttttacggatacgtcgtcgttatttttgtcgttgtcgtcgtcgtcgttagttttcgcgagaggagatagttttcgtttcgtttagttttttttttttttgcgtgtttttagcgagttcgttaagggagacgtggcgagcgtaacggtggaattcggcgaggtttcgtttttagtttcgttttaacgttaaagtttttttttaattttttttttagggtttcgtttttaatcgtttcgtttttttttatcgtttagttttttagcgtattacgtcggatttcgggcgtcggcgtataggattttagagaaggtttttcgtcggagtagcggtcgcgggcggtttatttggttgcgtaggggttttagatatttagagaagagttgaggtttagtttgttttgttttttggattaa

SEQ ID NO: 29594 - DNA, 523 bp, Artificial Sequence
  chemically treated genomic DNA (Homo sapiens) CpG-island No: 29594
ttaatccaaaaaacaaaacaaactaaacctcaactcttctctaaatatctaaaacccctacgcaaccaaataaaccgcccgcgaccgctactccgacgaaaaaccttctctaaaatcctatacgccgacgcccgaaatccgacgtaatacgctaaaaaactaaacgataaaaaaaaacgaaacgattaaaaacgaaaccctaaaaaaaaaattaaaaaaaaactttaacgttaaaacgaaactaaaaacgaaacctcgccgaattccaccgttacgctcgccacgtctcccttaacgaactcgctaaaaacacgcaaaaaaaaaaaaaactaaacgaaacgaaaactatctcctctcgcgaaaactaacgacgacgacgacaacgacaaaaataacgacgacgtatccgtaaaaataacgtaaaaacgaaaaaaaaaaacgacgacgacaatatccaaactacgccactcgaaccgaaacgttaaaaacgaaaatacaaaacgtaatcgtaacgacgacgata

SEQ ID NO: 29595 - DNA, 523 bp, Artificial Sequence
  chemically treated genomic DNA (Homo sapiens) CpG-island No: 29595
ttaatttagagggtaggataggttgagttttagtttttttttgaatatttgggatttttgcgtagttaggtgaatcgttcgcgatcgttgtttcggcgggaagttttttttgggattttgtacgtcgacgttcggaattcggcgtggtgcgttgggaaattgagcggtggaggaaggcggagcggttaggggcgggattttaggggaggggttgggggagggttttgacgttagggcggggttaagggcgagatttcgtcgagttttatcgttgcgttcgttacgttttttttagcgagttcgttggggatacgtagggggagggaaaattgagcggggcgggaattattttttttcgcgagagttggcgacggcggcggtagcggtagaggtggcggcggcgtgttcgtgagagtggcgtgggggcggggaggagaggcggcggcggtagtgtttaagttacgttattcgggtcggggcgttgggagcgggagtgtagagcgtggtcgtggcggcggcggtg

SEQ ID NO: 29596 - DNA, 523 bp, Artificial Sequence
  chemically treated genomic DNA (Homo sapiens) CpG-island No: 29596
caccgccgccgccacgaccacgctctacactcccgctcccaacgccccgacccgaataacgtaacttaaacactaccgccgccgcctctcctccccgcccccacgccactctcacgaacacgccgccgccacctctaccgctaccgccgccgtcgccaactctcgcgaaaaaaaataattcccgccccgctcaattttccctccccctacgtatccccaacgaactcgctaaaaaaaacgtaacgaacgcaacgataaaactcgacgaaatctcgcccttaaccccgccctaacgtcaaaaccctcccccaacccctcccctaaaatcccgcccctaaccgctccgccttcctccaccgctcaatttcccaacgcaccacgccgaattccgaacgtcgacgtacaaaatcccaaaaaaaacttcccgccgaaacaacgatcgcgaacgattcacctaactacgcaaaaatcccaaatattcaaaaaaaaactaaaactcaacctatcctaccctctaaattaa

SEQ ID NO: 29597 - DNA, 507 bp, Artificial Sequence
  chemically treated genomic DNA (Homo sapiens) CpG-island No: 29597
tgggcggttgttatgtgtacgtaagggggattttttagagtcgatttgtaggtatgtaagtttggtattggtcgtcgttttataacgtcgtgattgggaaaattttggcgttatttaatttaatcgttttgtagtatatttttttttcgttagttggcgtaatagcgaagaggttcgtatcgatcgtttttttaatagttgcgtagtttgaatggcgaatggcgtttgatgcggtattttttttttacgtatttgtgcggtattttatatcggaatggggtatttttagaataatttgttttgatgtcgtatagttaagttagtttcgatattcgttaatattcgttgacgcgttttgacgggtttgtttgttttcggtattcgtttatagataagttgtgatcgttttcgggagttgtatgtgttagaggtttttatcgttattatcgaaacgcgcgagacgaaagggtttcgtgatacgtttatttttataggttaacgttacga

SEQ ID NO: 29598 - DNA, 507 bp, Artificial Sequence
  chemically treated genomic DNA (Homo sapiens) CpG-island No: 29598
tcgtaacgttaacctataaaaataaacgtatcacgaaaccctttcgtctcgcgcgtttcgataataacgataaaaacctctaacacatacaactcccgaaaacgatcacaacttatctataaacgaataccgaaaacaaacaaacccgtcaaaacgcgtcaacgaatattaacgaatatcgaaactaacttaactatacgacatcaaaacaaattattctaaaaataccccattccgatataaaataccgcacaaatacgtaaaaaaaaaataccgcatcaaacgccattcgccattcaaactacgcaactattaaaaaaacgatcgatacgaacctcttcgctattacgccaactaacgaaaaaaaaatatactacaaaacgattaaattaaataacgccaaaattttcccaatcacgacgttataaaacgacgaccaataccaaacttacatacctacaaatcgactctaaaaaatcccccttacgtacacataacaaccgccca

SEQ ID NO: 29599 - DNA, 507 bp, Artificial Sequence
  chemically treated genomic DNA (Homo sapiens) CpG-island No: 29599
tcgtggcgttaatttataaaaataggcgtattacgaggttttttcgtttcgcgcgtttcggtgatgacggtgaaaatttttgatatatgtagttttcggagacggttatagtttgtttgtaagcggatgtcgggagtagataagttcgttagggcgcgttagcgggtgttggcgggtgtcggggttggtttaattatgcggtattagagtagattgttttgagagtgttttatttcggtgtgaaatatcgtatagatgcgtaaggagaaaatatcgtattaggcgttattcgttatttaggttgcgtaattgttggaagggcgatcggtgcgggttttttcgttattacgttagttggcgaaagggggatgtgttgtaaggcgattaagttgggtaacgttagggtttttttagttacgacgttgtaaaacgacggttagtgttaagtttgtatgtttgtaggtcgattttagaggattttttttacgtatatatgatagtcgttta

SEQ ID NO: 29600 - DNA, 507 bp, Artificial Sequence
  chemically treated genomic DNA (Homo sapiens) CpG-island No: 29600
taaacgactatcatatatacgtaaaaaaaatcctctaaaatcgacctacaaacatacaaacttaacactaaccgtcgttttacaacgtcgtaactaaaaaaaccctaacgttacccaacttaatcgccttacaacacatccccctttcgccaactaacgtaataacgaaaaaacccgcaccgatcgcccttccaacaattacgcaacctaaataacgaataacgcctaatacgatattttctccttacgcatctatacgatatttcacaccgaaataaaacactctcaaaacaatctactctaataccgcataattaaaccaaccccgacacccgccaacacccgctaacgcgccctaacgaacttatctactcccgacatccgcttacaaacaaactataaccgtctccgaaaactacatatatcaaaaattttcaccgtcatcaccgaaacgcgcgaaacgaaaaaacctcgtaatacgcctatttttataaattaacgccacga

SEQ ID NO: 29601 - DNA, 512 bp, Artificial Sequence
  chemically treated genomic DNA (Homo sapiens) CpG-island No: 29601
ttcgtgcgtttcgcgggttcggcggtcgggtgattttcgagaggtttcgcgtttgggcggtcggcggcgatttcgcggttcgcgaatacgcgtggattttgtggaacgtcgggttttttcgggcgttttcgttttttggtagttgtcgggagattcggtcggtggggaagttcgcggagtcgtagtttcggtttcggaaggtttttttgggtttcgggttcgatttttatttttgcgtcggttcgcgggtttcgtaggttttgtattgtcgatcgggttgcgtttaaggtcgttagtcgttcgtcgttttttttgttttttcgttgtaggaaggtcgcggtagagggggcgttttttaagtcgttagttacgtacgcggaggcgttcgggtttcggggcggcgtatcgggagagtacgtcggggaggatacgtgggttttcgcgcggtgggttgagagtttcggtttcggggaatttcgtagtttttttttgttatttttggaattgggttt

SEQ ID NO: 29602 - DNA, 512 bp, Artificial Sequence
  chemically treated genomic DNA (Homo sapiens) CpG-island No: 29602
aaacccaattccaaaaataacaaaaaaaaactacgaaattccccgaaaccgaaactctcaacccaccgcgcgaaaacccacgtatcctccccgacgtactctcccgatacgccgccccgaaacccgaacgcctccgcgtacgtaactaacgacttaaaaaacgccccctctaccgcgaccttcctacaacgaaaaaacaaaaaaaacgacgaacgactaacgaccttaaacgcaacccgatcgacaatacaaaacctacgaaacccgcgaaccgacgcaaaaataaaaatcgaacccgaaacccaaaaaaaccttccgaaaccgaaactacgactccgcgaacttccccaccgaccgaatctcccgacaactaccaaaaaacgaaaacgcccgaaaaaacccgacgttccacaaaatccacgcgtattcgcgaaccgcgaaatcgccgccgaccgcccaaacgcgaaacctctcgaaaatcacccgaccgccgaacccgcgaaacgcacgaa

SEQ ID NO: 29603 - DNA, 512 bp, Artificial Sequence
  chemically treated genomic DNA (Homo sapiens) CpG-island No: 29603
gagtttagttttaggggtagtaggagggggttgcgggatttttcggggtcggggtttttaatttatcgcgcgaaggtttacgtgtttttttcggcgtgttttttcggtgcgtcgtttcgaggttcgagcgttttcgcgtgcgtggttgacggtttggagggcgttttttttgtcgcggtttttttgtagcggggggataaagagggcggcgggcggttggcggttttgagcgtagttcggtcggtagtgtagggtttgcgaagttcgcgggtcggcgtaggggtgggagtcgggttcggggtttagagagatttttcggggtcggggttgcggtttcgcgggtttttttatcggtcgggtttttcggtaattattagagagcgggggcgttcggggaggttcggcgttttataaggtttacgcgtattcgcgggtcgcggggtcgtcgtcggtcgtttaggcgcggagtttttcgggggttattcggtcgtcgggttcgcgggacgtacggg

SEQ ID NO: 29604 - DNA, 512 bp, Artificial Sequence
  chemically treated genomic DNA (Homo sapiens) CpG-island No: 29604
cccgtacgtcccgcgaacccgacgaccgaataacccccgaaaaactccgcgcctaaacgaccgacgacgaccccgcgacccgcgaatacgcgtaaaccttataaaacgccgaacctccccgaacgcccccgctctctaataattaccgaaaaacccgaccgataaaaaaacccgcgaaaccgcaaccccgaccccgaaaaatctctctaaaccccgaacccgactcccacccctacgccgacccgcgaacttcgcaaaccctacactaccgaccgaactacgctcaaaaccgccaaccgcccgccgccctctttatccccccgctacaaaaaaaccgcgacaaaaaaaacgccctccaaaccgtcaaccacgcacgcgaaaacgctcgaacctcgaaacgacgcaccgaaaaaacacgccgaaaaaaacacgtaaaccttcgcgcgataaattaaaaaccccgaccccgaaaaatcccgcaaccccctcctactacccctaaaactaaactc

SEQ ID NO: 29605 - DNA, 874 bp, Artificial Sequence
  chemically treated genomic DNA (Homo sapiens) CpG-island No: 29605
ttgggtcgaaagtgttagcggttgcgttgttacgtcgcggttggggagcgggcgtttcggttaggttcgacgttcgggttttatcgtattttgcgggataagcggagtaggcgtaggtcgcgtaagattacgggttgtcgcggcgcgggttttttcgtaggaggggggtcggttttcggagaaagcgagttattgacgggattttggttcgttttcgtttcggttttcgttttcggtaagtttcggttttaggtttttcgtagtttttttcgttgcgcgttttcggttcgggggcgtcgcgttttgtcggtcgtcggtcgggattgcgggtttttagcgcgggttttacgtcgcggattaggggttaggtcgtttgtcgttcgtttgttcgtgtttatggtaatgtttcgtttcgcgcggttcgtttcggtcgagcgtttcggttcgatcgtgatagttgggtgtttaaagggttaagtcggtagcgcggcggtcggtgtttttcgcgcgttgttcgttagtcgcgagttggttttagcgcgtacgcgttcgttcgttatttgcggtcgttttcgcgttttttttttatttggtcgttttttttcgggggtcgttttttagttcgttttttcggttcggcgtcgcgtattttgttggttgttcggacgttgttcgcggaggaggggcgagggcgttattattatatattagtatattagcgcgcgttacgtggtcgttttagttaatggttattttagaagggcggggattgggcggaatacgttttagtgttgtttttagtttgaatcggtggttatggtaacgggcgggtgggcgggggagtggggaggtgtcggagttcggtgttttcggg

SEQ ID NO: 29606 - DNA, 874 bp, Artificial Sequence
  chemically treated genomic DNA (Homo sapiens) CpG-island No: 29606
cccgaaaacaccgaactccgacacctccccactcccccgcccacccgcccgttaccataaccaccgattcaaactaaaaacaacactaaaacgtattccgcccaatccccgcccttctaaaataaccattaactaaaacgaccacgtaacgcgcgctaatatactaatatataataataacgccctcgcccctcctccgcgaacaacgtccgaacaaccaacaaaatacgcgacgccgaaccgaaaaaacgaactaaaaaacgacccccgaaaaaaaacgaccaaataaaaaaaaaacgcgaaaacgaccgcaaataacgaacgaacgcgtacgcgctaaaaccaactcgcgactaacgaacaacgcgcgaaaaacaccgaccgccgcgctaccgacttaaccctttaaacacccaactatcacgatcgaaccgaaacgctcgaccgaaacgaaccgcgcgaaacgaaacattaccataaacacgaacaaacgaacgacaaacgacctaacccctaatccgcgacgtaaaacccgcgctaaaaacccgcaatcccgaccgacgaccgacaaaacgcgacgcccccgaaccgaaaacgcgcaacgaaaaaaactacgaaaaacctaaaaccgaaacttaccgaaaacgaaaaccgaaacgaaaacgaaccaaaatcccgtcaataactcgctttctccgaaaaccgacccccctcctacgaaaaaacccgcgccgcgacaacccgtaatcttacgcgacctacgcctactccgcttatcccgcaaaatacgataaaacccgaacgtcgaacctaaccgaaacgcccgctccccaaccgcgacgtaacaacgcaaccgctaacactttcgacccaa

SEQ ID NO: 29607 - DNA, 874 bp, Artificial Sequence
  chemically treated genomic DNA (Homo sapiens) CpG-island No: 29607
ttcgggggtatcgggtttcggtatttttttattttttcgtttattcgttcgttgttatggttatcggtttaggttgggagtagtattaaggcgtgtttcgtttaattttcgtttttttagggtgattattggttggagcggttacgtgacgcgcgttggtatgttaatatatggtaatagcgttttcgtttttttttcgcgggtagcgttcgagtagttagtagggtgcgcggcgtcgagtcgagggggcgggttgaggggcggttttcgggagagagcggttaggtggaggaggagcgcggaggcgatcgtaggtaacgggcgggcgcgtgcgcgttggggttagttcgcggttgacgggtagcgcgcgggggatatcggtcgtcgcgttgtcggtttaattttttgggtatttagttgttacggtcgggtcggagcgttcggtcgggacgggtcgcgcggggcggggtattgttatgggtacggataggcgggcggtaggcggtttgatttttggttcgcggcgtggggttcgcgttgggagttcgtagtttcggtcggcgatcggtagagcgcggcgttttcgggtcgggaacgcgtagcgaggagggttgcggagagtttggggtcgaggtttgtcgggaacgggaatcggaacgggaacgggttaaggtttcgttagtgattcgtttttttcggggatcgattttttttttgcggagaggttcgcgtcgcggtagttcgtggttttgcgcggtttgcgtttgtttcgtttgtttcgtagagtgcggtgagattcgggcgtcgggtttgatcggggcgttcgttttttagtcgcggcgtgatagcgtagtcgttggtattttcggtttag

SEQ ID NO: 29608 - DNA, 874 bp, Artificial Sequence
  chemically treated genomic DNA (Homo sapiens) CpG-island No: 29608
ctaaaccgaaaataccaacgactacgctatcacgccgcgactaaaaaacgaacgccccgatcaaacccgacgcccgaatctcaccgcactctacgaaacaaacgaaacaaacgcaaaccgcgcaaaaccacgaactaccgcgacgcgaacctctccgcaaaaaaaaaatcgatccccgaaaaaaacgaatcactaacgaaaccttaacccgttcccgttccgattcccgttcccgacaaacctcgaccccaaactctccgcaaccctcctcgctacgcgttcccgacccgaaaacgccgcgctctaccgatcgccgaccgaaactacgaactcccaacgcgaaccccacgccgcgaaccaaaaatcaaaccgcctaccgcccgcctatccgtacccataacaataccccgccccgcgcgacccgtcccgaccgaacgctccgacccgaccgtaacaactaaatacccaaaaaattaaaccgacaacgcgacgaccgatatcccccgcgcgctacccgtcaaccgcgaactaaccccaacgcgcacgcgcccgcccgttacctacgatcgcctccgcgctcctcctccacctaaccgctctctcccgaaaaccgcccctcaacccgccccctcgactcgacgccgcgcaccctactaactactcgaacgctacccgcgaaaaaaaaacgaaaacgctattaccatatattaacataccaacgcgcgtcacgtaaccgctccaaccaataatcaccctaaaaaaacgaaaattaaacgaaacacgccttaatactactcccaacctaaaccgataaccataacaacgaacgaataaacgaaaaaataaaaaaataccgaaacccgatacccccgaa

SEQ ID NO: 29609 - DNA, 505 bp, Artificial Sequence
  chemically treated genomic DNA (Homo sapiens) CpG-island No: 29609
ttcggcgcggtaggcgtttttcggttttgtttggtcgcgggtttcgtcgtttcgtagtcgagtttgggattcgggattcggttgttcgttgttgtacggtttttttatgattcggcgttttgttcgggatcggttcgttcgttgtattggtttttttttcggtttttttttgagtttttttcggataggggtatcgtgcgtttttcggttatcgtcgttttgttttcggttttttggggtcggggatttcggatcgggagtcgggttgttggtcggggcgcgtatagacgttaggcggtttagttcgggcgtcgttggtatcggttcgcggttttcggtaaaaattcgttcgattggttgggttattttcgtttgacgtttttttagatgatacgattagttttttcggcgtgttgtttttgttagtttattcgttaggttgttagaataagcggtatttcgttttttgcgtgtttttatagagtttcggtataattagattgtt

SEQ ID NO: 29610 - DNA, 505 bp, Artificial Sequence
  chemically treated genomic DNA (Homo sapiens) CpG-island No: 29610
aacaatctaattataccgaaactctataaaaacacgcaaaaaacgaaataccgcttattctaacaacctaacgaataaactaacaaaaacaacacgccgaaaaaactaatcgtatcatctaaaaaaacgtcaaacgaaaataacccaaccaatcgaacgaatttttaccgaaaaccgcgaaccgataccaacgacgcccgaactaaaccgcctaacgtctatacgcgccccgaccaacaacccgactcccgatccgaaatccccgaccccaaaaaaccgaaaacaaaacgacgataaccgaaaaacgcacgatacccctatccgaaaaaaactcaaaaaaaaaccgaaaaaaaaaccaatacaacgaacgaaccgatcccgaacaaaacgccgaatcataaaaaaaccgtacaacaacgaacaaccgaatcccgaatcccaaactcgactacgaaacgacgaaacccgcgaccaaacaaaaccgaaaaacgcctaccgcgccgaa

SEQ ID NO: 29611 - DNA, 505 bp, Artificial Sequence
  chemically treated genomic DNA (Homo sapiens) CpG-island No: 29611
ggtagtttgattgtgtcggggttttgtagggatacgtaggaggcgaggtgtcgtttgttttgataatttggcgggtagattggtaaaggtagtacgtcgggagagttagtcgtgttatttgggggggcgttaggcgggagtggtttagttagtcggacgggtttttgtcgggagtcgcgagtcggtgttagcggcgttcgggttgggtcgtttagcgtttgtgcgcgtttcggttaataattcggttttcgattcggaattttcggttttagagagtcgagggtagagcgacggtggtcggggagcgtacggtgtttttgttcgaggaaagtttaagaggaggtcgaggagaggattagtgtagcgagcgggtcggtttcgggtagggcgtcgggttatggaggagtcgtgtagtagcgggtagtcgagtttcgagttttagattcggttgcgaagcggcggagttcgcggttagatagggtcgggaagcgtttgtcgcgtcgag

SEQ ID NO: 29612 - DNA, 505 bp, Artificial Sequence
  chemically treated genomic DNA (Homo sapiens) CpG-island No: 29612
ctcgacgcgacaaacgcttcccgaccctatctaaccgcgaactccgccgcttcgcaaccgaatctaaaactcgaaactcgactacccgctactacacgactcctccataacccgacgccctacccgaaaccgacccgctcgctacactaatcctctcctcgacctcctcttaaactttcctcgaacaaaaacaccgtacgctccccgaccaccgtcgctctaccctcgactctctaaaaccgaaaattccgaatcgaaaaccgaattattaaccgaaacgcgcacaaacgctaaacgacccaacccgaacgccgctaacaccgactcgcgactcccgacaaaaacccgtccgactaactaaaccactcccgcctaacgcccccccaaataacacgactaactctcccgacgtactacctttaccaatctacccgccaaattatcaaaacaaacgacacctcgcctcctacgtatccctacaaaaccccgacacaatcaaactacc

SEQ ID NO: 29613 - DNA, 546 bp, Artificial Sequence
  chemically treated genomic DNA (Homo sapiens) CpG-island No: 29613
tgtacggcgtttcgcggttgtagtggtcgggattgagttcgcggcggagcgagttgcgtttgcgcgaggaggagggcggagcggaggatttcgcgagcgcgcggtagcgaacgaagcgcgtattagaattcgttcgcgggaaagtagcggagagcgtaggcgcgcgtcgtatcgttcgttttttcgtttttagatttcgtttatttggttttacgttttttttttcgtttttttttttttttcgcgtagggagggtcgcggcgcgaggtttgtttgcgtcgtcgttatcgtttcggcgtaagcgtagtggttttttcggtcgcggggcggggcgggcggggtcgtgtcgggttttatttgcggagtatttcgtttagtagcgacgcgttgagatattcgggtggtgagagtcgtcgttgtattttcgttatcgtgattttgtattttgaggtggagttgaggagcgagaggcgattcggaattgaatagaagatttcgttggggtttattacgttttttaataagttgtttttggtaatagggatg

SEQ ID NO: 29614 - DNA, 546 bp, Artificial Sequence
  chemically treated genomic DNA (Homo sapiens) CpG-island No: 29614
catccctattaccaaaaacaacttattaaaaaacgtaataaaccccaacgaaatcttctattcaattccgaatcgcctctcgctcctcaactccacctcaaaatacaaaatcacgataacgaaaatacaacgacgactctcaccacccgaatatctcaacgcgtcgctactaaacgaaatactccgcaaataaaacccgacacgaccccgcccgccccgccccgcgaccgaaaaaaccactacgcttacgccgaaacgataacgacgacgcaaacaaacctcgcgccgcgaccctccctacgcgaaaaaaaaaaaaaaacgaaaaaaaaaacgtaaaaccaaataaacgaaatctaaaaacgaaaaaacgaacgatacgacgcgcgcctacgctctccgctactttcccgcgaacgaattctaatacgcgcttcgttcgctaccgcgcgctcgcgaaatcctccgctccgccctcctcctcgcgcaaacgcaactcgctccgccgcgaactcaatcccgaccactacaaccgcgaaacgccgtaca

SEQ ID NO: 29615 - DNA, 546 bp, Artificial Sequence
  chemically treated genomic DNA (Homo sapiens) CpG-island No: 29615
tatttttattattaaggataatttattagaaggcgtggtgaattttaacgaagttttttgtttagtttcgggtcgtttttcgttttttagttttattttaaagtataaggttacggtggcgaaagtgtagcggcggtttttattattcgagtgttttaacgcgtcgttgttggacggagtgtttcgtaggtaaggttcggtacggtttcgttcgtttcgtttcgcggtcgggggaattattgcgtttgcgtcggggcggtggcggcgacgtaaataggtttcgcgtcgcggttttttttacgcgggaaaggaaagggggcggggagaagagcgtagagttaagtgggcgggatttgggggcgggggagcgggcgatgcggcgcgcgtttgcgtttttcgttgttttttcgcgagcgagttttggtgcgcgtttcgttcgttgtcgcgcgttcgcggagtttttcgtttcgttttttttttcgcgtaagcgtagttcgtttcgtcgcgggtttaatttcggttattgtagtcgcggggcgtcgtata

SEQ ID NO: 29616 - DNA, 546 bp, Artificial Sequence
  chemically treated genomic DNA (Homo sapiens) CpG-island No: 29616
tatacgacgccccgcgactacaataaccgaaattaaacccgcgacgaaacgaactacgcttacgcgaaaaaaaaaacgaaacgaaaaactccgcgaacgcgcgacaacgaacgaaacgcgcaccaaaactcgctcgcgaaaaaacaacgaaaaacgcaaacgcgcgccgcatcgcccgctcccccgcccccaaatcccgcccacttaactctacgctcttctccccgccccctttcctttcccgcgtaaaaaaaaccgcgacgcgaaacctatttacgtcgccgccaccgccccgacgcaaacgcaataattcccccgaccgcgaaacgaaacgaacgaaaccgtaccgaaccttacctacgaaacactccgtccaacaacgacgcgttaaaacactcgaataataaaaaccgccgctacactttcgccaccgtaaccttatactttaaaataaaactaaaaaacgaaaaacgacccgaaactaaacaaaaaacttcgttaaaattcaccacgccttctaataaattatccttaataataaaaata

SEQ ID NO: 29617 - DNA, 527 bp, Artificial Sequence
  chemically treated genomic DNA (Homo sapiens) CpG-island No: 29617
cgaaaatttcgggaagaaacggttagtacgggtttcgtcgtgtcggttatttaatacgtttttttgagagtatagaatatttatagttttatatagcgcgttatttagagagtttcggatttttagttcggcgtaggggcgggattttcgtttaagttagattttcgggcgaggcggtgaggggttttcggttggggtggtagggtggtggatttgtcggtttcgttttttcgtcgtacgtggtggttattgttggtttttgaatggtttgtaaggcggatatttacgttaaggtttttggatcggtcgtgggtatattcgtttgagtcgtttttttttatcgtagagcggcggttttcggcggcgttttttagttatggattatcggcggttttttatgagtcgggtggttttcgggtaattcgacgacgcggatttttttgataggtaggcggtcgtatagtgttttggttttgggtacggttttttttttgatcgtttttttggggtgtggatttttgtttgcg

SEQ ID NO: 29618 - DNA, 527 bp, Artificial Sequence
  chemically treated genomic DNA (Homo sapiens) CpG-island No: 29618
cgcaaacaaaaatccacaccccaaaaaaacgatcaaaaaaaaaaccgtacccaaaaccaaaacactatacgaccgcctacctatcaaaaaaatccgcgtcgtcgaattacccgaaaaccacccgactcataaaaaaccgccgataatccataactaaaaaacgccgccgaaaaccgccgctctacgataaaaaaaaacgactcaaacgaatatacccacgaccgatccaaaaaccttaacgtaaatatccgccttacaaaccattcaaaaaccaacaataaccaccacgtacgacgaaaaaacgaaaccgacaaatccaccaccctaccaccccaaccgaaaacccctcaccgcctcgcccgaaaatctaacttaaacgaaaatcccgcccctacgccgaactaaaaatccgaaactctctaaataacgcgctatataaaactataaatattctatactctcaaaaaaacgtattaaataaccgacacgacgaaacccgtactaaccgtttcttcccgaaattttcg

SEQ ID NO: 29619 - DNA, 527 bp, Artificial Sequence
  chemically treated genomic DNA (Homo sapiens) CpG-island No: 29619
cgtaaataagagtttatattttaagggggcggttaaggagagagtcgtatttagagttagggtattgtacggtcgtttatttgttagaggagttcgcgtcgtcgaattgttcggggattattcggtttatgagaagtcgtcggtagtttatgattggagagcgtcgtcggaggtcgtcgttttgcgatggaaaggaacggtttagacggatgtatttacggtcgatttaaaggttttggcgtggatattcgttttgtaaattatttagaagttaatagtggttattacgtgcgacgggaaaacgggatcgatagatttattattttgttattttaatcggaagttttttatcgtttcgttcggaagtttgatttgagcggaagtttcgtttttgcgtcgagttgggagttcggagttttttggatggcgcgttgtatagggttgtggatgttttgtgtttttaggaaggcgtgttgagtagtcggtacggcgaggttcgtgttggtcgttttttttcggagttttcg

SEQ ID NO: 29620 - DNA, 527 bp, Artificial Sequence
  chemically treated genomic DNA (Homo sapiens) CpG-island No: 29620
cgaaaactccgaaaaaaaacgaccaacacgaacctcgccgtaccgactactcaacacgccttcctaaaaacacaaaacatccacaaccctatacaacgcgccatccaaaaaactccgaactcccaactcgacgcaaaaacgaaacttccgctcaaatcaaacttccgaacgaaacgataaaaaacttccgattaaaataacaaaataataaatctatcgatcccgttttcccgtcgcacgtaataaccactattaacttctaaataatttacaaaacgaatatccacgccaaaacctttaaatcgaccgtaaatacatccgtctaaaccgttcctttccatcgcaaaacgacgacctccgacgacgctctccaatcataaactaccgacgacttctcataaaccgaataatccccgaacaattcgacgacgcgaactcctctaacaaataaacgaccgtacaataccctaactctaaatacgactctctccttaaccgcccccttaaaatataaactcttatttacg

SEQ ID NO: 29621 - DNA, 917 bp, Artificial Sequence
  chemically treated genomic DNA (Homo sapiens) CpG-island No: 29621
ttgggatgttttgagtaattagatttgcgtagatacgacgattgacggtgcggcggtgttttttgtttgcggttcggcgcgttttttttttagttttgcgttgtttttcgattaaacgggcggtttttgtttttttttggcggcggcgttcggcggtaacggttttttttttttcgcggcgcgtacgtttttcggttttttttttttcgcgtttcgtacgttgtttcgttttaatgcgttggcgtttagttagttttgtacgtgttttttttttagttttacggcgcgttgcggttttaattttcgttttgtgtttcgtttcggtatttcggcgggtttgttttgttgtttcgcgtttaatgcgtttttcgtgtttacgtcgagtttgtttcgttaggcgggcgttgttttttgcggttatcggtcgaaatttttgtttattagtagagttatttcgtggttttgtttgaattgggtcgttaatttttgatcgaattggatgtttatttttagcgttttggcgtgtagcgcgtttatggtttttttagtatttaatgcgtttttgttcgtttttttattcggtgagtggcggggggttgcgtttcgaattcgttatatgtattaacgaaattttaatttcggtttagtaggtcgtatagttttttttaggcgttttaggtattttcggttcggttttttaattgtcgttttattgcgtgatatttgcgttgttagagaggcgatacggttacgtttttttttcgtggataggttcggtatttcgtttattgtttggcggatttgttcgagataagtattaaggtcgttcgttacgtaaagtattggggtttgtttcggtttgatttcgatgatagttaagttcgttatttcgtttatggttttttttgaaattttga

SEQ ID NO: 29622 - DNA, 917 bp, Artificial Sequence
  chemically treated genomic DNA (Homo sapiens) CpG-island No: 29622
tcaaaatttcaaaaaaaaccataaacgaaataacgaacttaactatcatcgaaatcaaaccgaaacaaaccccaatactttacgtaacgaacgaccttaatacttatctcgaacaaatccgccaaacaataaacgaaataccgaacctatccacgaaaaaaaaacgtaaccgtatcgcctctctaacaacgcaaatatcacgcaataaaacgacaattaaaaaaccgaaccgaaaatacctaaaacgcctaaaaaaaactatacgacctactaaaccgaaattaaaatttcgttaatacatataacgaattcgaaacgcaaccccccgccactcaccgaataaaaaaacgaacaaaaacgcattaaatactaaaaaaaccataaacgcgctacacgccaaaacgctaaaaataaacatccaattcgatcaaaaattaacgacccaattcaaacaaaaccacgaaataactctactaataaacaaaaatttcgaccgataaccgcaaaaaacaacgcccgcctaacgaaacaaactcgacgtaaacacgaaaaacgcattaaacgcgaaacaacaaaacaaacccgccgaaataccgaaacgaaacacaaaacgaaaattaaaaccgcaacgcgccgtaaaactaaaaaaaaaacacgtacaaaactaactaaacgccaacgcattaaaacgaaacaacgtacgaaacgcgaaaaaaaaaaaaccgaaaaacgtacgcgccgcgaaaaaaaaaaaaccgttaccgccgaacgccgccgccaaaaaaaaacaaaaaccgcccgtttaatcgaaaaacaacgcaaaactaaaaaaaaaacgcgccgaaccgcaaacaaaaaacaccgccgcaccgtcaatcgtcgtatctacgcaaatctaattactcaaaacatcccaa

SEQ ID NO: 29623 - DNA, 917 bp, Artificial Sequence
  chemically treated genomic DNA (Homo sapiens) CpG-island No: 29623
ttaaaattttaggagaaattatgagcgaagtaacggatttaattgttatcgaaattaagtcggaataggttttagtgttttacgtagcgggcggttttgatgtttatttcgagtaaattcgttaggtagtaaacgaagtgtcggatttgtttacgaagaaaggacgtgatcgtgtcgtttttttggtagcgtaggtattacgtagtaaggcggtaattgaaaagtcgggtcgagagtatttgaagcgtttgaaagaggttgtgcgatttgttaggtcgaaattaaggtttcgttgatgtatgtgacgagttcgggacgtaatttttcgttatttatcgaatgggaaagcgagtaggaacgtattaagtgttaaaaaagttatgaacgcgttgtacgttaaagcgttggaaatgaatatttagttcgattaggagttggcggtttagtttaagtaagattacgaaatggttttgttgatgaataaggatttcgatcggtgatcgtaaagagtagcgttcgtttggcggaataggttcggcgtgagtacgaagagcgtattaagcgcgaagtagtagaataagttcgtcgagatgtcgaagcgaagtataaagcggagattgaagtcgtagcgcgtcgtgaagttgaagagaaagtacgtgtagagttggttgaacgttagcgtattgaagcggaatagcgtgcggaacgcgagaagaaggaaatcgaagagcgtgcgcgtcgcgaaaaagaagaagtcgttgtcgtcgagcgtcgtcgttaggaagaggtagaagtcgttcgtttggtcgaagagtagcgtaaagttgaagaagaagcgcgtcgagtcgtagataaagagtatcgtcgtatcgttaatcgtcgtgtttacgtagatttaattgtttagggtattttag

SEQ ID NO: 29624 - DNA, 917 bp, Artificial Sequence
  chemically treated genomic DNA (Homo sapiens) CpG-island No: 29624
ctaaaataccctaaacaattaaatctacgtaaacacgacgattaacgatacgacgatactctttatctacgactcgacgcgcttcttcttcaactttacgctactcttcgaccaaacgaacgacttctacctcttcctaacgacgacgctcgacgacaacgacttcttctttttcgcgacgcgcacgctcttcgatttccttcttctcgcgttccgcacgctattccgcttcaatacgctaacgttcaaccaactctacacgtactttctcttcaacttcacgacgcgctacgacttcaatctccgctttatacttcgcttcgacatctcgacgaacttattctactacttcgcgcttaatacgctcttcgtactcacgccgaacctattccgccaaacgaacgctactctttacgatcaccgatcgaaatccttattcatcaacaaaaccatttcgtaatcttacttaaactaaaccgccaactcctaatcgaactaaatattcatttccaacgctttaacgtacaacgcgttcataacttttttaacacttaatacgttcctactcgctttcccattcgataaataacgaaaaattacgtcccgaactcgtcacatacatcaacgaaaccttaatttcgacctaacaaatcgcacaacctctttcaaacgcttcaaatactctcgacccgacttttcaattaccgccttactacgtaatacctacgctaccaaaaaaacgacacgatcacgtcctttcttcgtaaacaaatccgacacttcgtttactacctaacgaatttactcgaaataaacatcaaaaccgcccgctacgtaaaacactaaaacctattccgacttaatttcgataacaattaaatccgttacttcgctcataatttctcctaaaattttaa

SEQ ID NO: 29625 - DNA, 1007 bp, Artificial Sequence
  chemically treated genomic DNA (Homo sapiens) CpG-island No: 29625
gaaagagaaaaaagtttgcgtcgtgtttttggtaagtagggttcgtttcgttttttttttcggttggattagttttttttttgaggtttcggggtcgcgagggatttggcggggggggcgcgaggcgtgggcgagcgtttgggattcgattcggttgtcggttacgggggttttcgtggtcgcgtagttcggattttgcggagcggcgggggcgcggttagtcgaatttattattttttaaagcggttcgcggcgttcgtttcgcgggaggcgggcgggaggcggattcggtttatttcgacgtcgattatcgcgtcgttcgcgatgggaagcgttttataaagtcgcgttcggtcggttcgagttattcgtcgtcgcgtcgtttcgttgtttcgaacgcgggttatacgtagtttttttggagtgacgggtcgatttcggacgatttcggttacggatagattcgggacgatttcggtcggggcgcgttttttgcgggcgggcgggcggcggggttggggagtttttggcgggggtatgcgtgcgatatggtttcggcggtgtttgagggtacgtcgttcgtgaatatgttcgtgcgcggttgttgggtgaacggtattcgtaggtttatcgttagtcggcgcggcgacgaagaggagtttttcgagattcgtacggagtggtcggatcgtagcgtgttttatttgtatcgtagtttggcggatttgggtcgtttgtggtagcgtttgcgcgacgtttttttcgaggatcggttcgaattggcgtaggggtcgttgcggtaaggtgcggggtcggggacgcgggaggggcgcggggtcgaggtagttttgaagtgtacgaaggaggcggggaagagattttaatcgagattgcgattttttttttttgttcgttttggataggggatatttggatttcgcgttcgtagacgaggggtgttcgggcggcggggttagggggacggggagttagtttgtttagtttgg

SEQ ID NO: 29626 - DNA, 1007 bp, Artificial Sequence
  chemically treated genomic DNA (Homo sapiens) CpG-island No: 29626
ccaaactaaacaaactaactccccgtccccctaaccccgccgcccgaacacccctcgtctacgaacgcgaaatccaaatatcccctatccaaaacgaacaaaaaaaaaaaatcgcaatctcgattaaaatctcttccccgcctccttcgtacacttcaaaactacctcgaccccgcgcccctcccgcgtccccgaccccgcaccttaccgcaacgacccctacgccaattcgaaccgatcctcgaaaaaaacgtcgcgcaaacgctaccacaaacgacccaaatccgccaaactacgatacaaataaaacacgctacgatccgaccactccgtacgaatctcgaaaaactcctcttcgtcgccgcgccgactaacgataaacctacgaataccgttcacccaacaaccgcgcacgaacatattcacgaacgacgtaccctcaaacaccgccgaaaccatatcgcacgcatacccccgccaaaaactccccaaccccgccgcccgcccgcccgcaaaaaacgcgccccgaccgaaatcgtcccgaatctatccgtaaccgaaatcgtccgaaatcgacccgtcactccaaaaaaactacgtataacccgcgttcgaaacaacgaaacgacgcgacgacgaataactcgaaccgaccgaacgcgactttataaaacgcttcccatcgcgaacgacgcgataatcgacgtcgaaataaaccgaatccgcctcccgcccgcctcccgcgaaacgaacgccgcgaaccgctttaaaaaataataaattcgactaaccgcgcccccgccgctccgcaaaatccgaactacgcgaccacgaaaacccccgtaaccgacaaccgaatcgaatcccaaacgctcgcccacgcctcgcgccccccccgccaaatccctcgcgaccccgaaacctcaaaaaaaaaactaatccaaccgaaaaaaaaaacgaaacgaaccctacttaccaaaaacacgacgcaaacttttttctctttc

SEQ ID NO: 29627 - DNA, 1007 bp, Artificial Sequence
  chemically treated genomic DNA (Homo sapiens) CpG-island No: 29627
ttaggttgggtaggttggtttttcgtttttttaatttcgtcgttcgggtatttttcgtttgcgggcgcggggtttaagtgttttttgtttagggcgggtagaaaggagaagtcgtaatttcggttgaagtttttttttcgtttttttcgtgtattttaaggttgtttcggtttcgcgtttttttcgcgttttcggtttcgtattttgtcgtagcggtttttgcgttagttcggatcggttttcgggaaaggcgtcgcgtaggcgttgttataggcggtttaggttcgttaggttgcggtgtaggtagagtacgttgcggttcgattatttcgtgcggatttcgaagaattttttttcgtcgtcgcgtcggttgacgatgagtttgcggatgtcgtttatttagtagtcgcgtacgaatatgtttacgagcgacgtgtttttaaatatcgtcgaggttatgtcgtacgtatgttttcgttaagggttttttagtttcgtcgttcgttcgttcgtaggaggcgcgtttcggtcggggtcgtttcgggtttgttcgtggtcggggtcgttcggggtcggttcgttattttaaggaggttgcgtatggttcgcgttcggggtagcggggcggcgcggcggcgagtggttcgggtcggtcgggcgcggttttataaggcgttttttatcgcgggcggcgcggtagtcgacgtcgaggtaggtcgggttcgtttttcgttcgtttttcgcggaacgggcgtcgcgggtcgttttggaaagtaataggttcggttggtcgcgttttcgtcgtttcgtagagttcgggttgcgcggttacgaaaattttcgtagtcggtagtcgggtcgagttttaagcgttcgtttacgtttcgcgtttttttcgttaaatttttcgcggtttcggagttttagaaaaaaaattggtttagtcgggaagggaggcggggcgggttttgtttgttaggagtacggcgtagatttttttttttttt

SEQ ID NO: 29628 - DNA, 1007 bp, Artificial Sequence
  chemically treated genomic DNA (Homo sapiens) CpG-island No: 29628
aaaaaaaaaaaaaatctacgccgtactcctaacaaacaaaacccgccccgcctcccttcccgactaaaccaattttttttctaaaactccgaaaccgcgaaaaatttaacgaaaaaaacgcgaaacgtaaacgaacgcttaaaactcgacccgactaccgactacgaaaattttcgtaaccgcgcaacccgaactctacgaaacgacgaaaacgcgaccaaccgaacctattactttccaaaacgacccgcgacgcccgttccgcgaaaaacgaacgaaaaacgaacccgacctacctcgacgtcgactaccgcgccgcccgcgataaaaaacgccttataaaaccgcgcccgaccgacccgaaccactcgccgccgcgccgccccgctaccccgaacgcgaaccatacgcaacctccttaaaataacgaaccgaccccgaacgaccccgaccacgaacaaacccgaaacgaccccgaccgaaacgcgcctcctacgaacgaacgaacgacgaaactaaaaaacccttaacgaaaacatacgtacgacataacctcgacgatatttaaaaacacgtcgctcgtaaacatattcgtacgcgactactaaataaacgacatccgcaaactcatcgtcaaccgacgcgacgacgaaaaaaaattcttcgaaatccgcacgaaataatcgaaccgcaacgtactctacctacaccgcaacctaacgaacctaaaccgcctataacaacgcctacgcgacgcctttcccgaaaaccgatccgaactaacgcaaaaaccgctacgacaaaatacgaaaccgaaaacgcgaaaaaaacgcgaaaccgaaacaaccttaaaatacacgaaaaaaacgaaaaaaaaacttcaaccgaaattacgacttctcctttctacccgccctaaacaaaaaacacttaaaccccgcgcccgcaaacgaaaaatacccgaacgacgaaattaaaaaaacgaaaaaccaacctacccaacctaa

SEQ ID NO: 29629 - DNA, 578 bp, Artificial Sequence
  chemically treated genomic DNA (Homo sapiens) CpG-island No: 29629
ggcgttttcggcggaggagttaaatggggcgggaaaggggtcgaggtcggtagggcgggcgtcggattttttttgaggacgagttattttcgaggagggcgggggcgttcggggttgagcggtttatagggtcggttcggttttagttttttgttcggtatttttcgagggtcggcgggcgggcgtattgggaaagcgtttgggagtagttaattgtagggttcgagtcgggggtcgcgtcgggtttggtcgtcgtttcgagtttttttcgcggagggcgcgtttttggttttcgagcgcgaggtgttacgtagttttttcgttttttttcggagcggtcgtttcgttcgcggttgtcgcggatagttagggttttttcgtattttcgttagggttggtttttattcgcgtttgattagttgcgtcgtttttttttcggtttcgtgatcgttttggttcgcgggaatttttgtttttagaaatcgcggtggtttttttttttttatcgttttgttcgattttttttttggaggttaggttgagggggtggaagtcgggaggacgtaagagagagggat

SEQ ID NO: 29630 - DNA, 578 bp, Artificial Sequence
  chemically treated genomic DNA (Homo sapiens) CpG-island No: 29630
atccctctctcttacgtcctcccgacttccaccccctcaacctaacctccaaaaaaaaaatcgaacaaaacgataaaaaaaaaaaaaccaccgcgatttctaaaaacaaaaattcccgcgaaccaaaacgatcacgaaaccgaaaaaaaaacgacgcaactaatcaaacgcgaataaaaaccaaccctaacgaaaatacgaaaaaaccctaactatccgcgacaaccgcgaacgaaacgaccgctccgaaaaaaaacgaaaaaactacgtaacacctcgcgctcgaaaaccaaaaacgcgccctccgcgaaaaaaactcgaaacgacgaccaaacccgacgcgacccccgactcgaaccctacaattaactactcccaaacgctttcccaatacgcccgcccgccgaccctcgaaaaataccgaacaaaaaactaaaaccgaaccgaccctataaaccgctcaaccccgaacgcccccgccctcctcgaaaataactcgtcctcaaaaaaaatccgacgcccgccctaccgacctcgacccctttcccgccccatttaactcctccgccgaaaacgcc

SEQ ID NO: 29631 - DNA, 578 bp, Artificial Sequence
  chemically treated genomic DNA (Homo sapiens) CpG-island No: 29631
gttttttttttttgcgttttttcggtttttatttttttagtttggtttttaaaagaaagatcgggtagagcggtaggaaaagggaagttatcgcggtttttgaaaataagaattttcgcgagttaggacggttacgaggtcggggaggaggcggcgtagttgattaaacgcgaatggggattagttttggcgggggtgcgggggggttttggttgttcgcggtagtcgcgggcggggcggtcgtttcgaggagggacggaagggttgcgtggtatttcgcgttcgaagattaggggcgcgtttttcgcggggagaattcggggcggcggttagattcgacgcgattttcggttcggattttgtagttaattgtttttagacgtttttttagtgcgttcgttcgtcggttttcgggaggtatcgggtagggggttagggtcgggtcgattttgtgagtcgtttagtttcgggcgttttcgtttttttcggaagtgattcgtttttagggagagttcggcgttcgttttgtcggtttcggtttttttttcgttttatttggttttttcgtcgggggcgtt

SEQ ID NO: 29632 - DNA, 578 bp, Artificial Sequence
  chemically treated genomic DNA (Homo sapiens) CpG-island No: 29632
aacgcccccgacgaaaaaaccaaataaaacgaaaaaaaaaccgaaaccgacaaaacgaacgccgaactctccctaaaaacgaatcacttccgaaaaaaacgaaaacgcccgaaactaaacgactcacaaaatcgacccgaccctaaccccctacccgatacctcccgaaaaccgacgaacgaacgcactaaaaaaacgtctaaaaacaattaactacaaaatccgaaccgaaaatcgcgtcgaatctaaccgccgccccgaattctccccgcgaaaaacgcgcccctaatcttcgaacgcgaaataccacgcaacccttccgtccctcctcgaaacgaccgccccgcccgcgactaccgcgaacaaccaaaacccccccgcacccccgccaaaactaatccccattcgcgtttaatcaactacgccgcctcctccccgacctcgtaaccgtcctaactcgcgaaaattcttattttcaaaaaccgcgataacttcccttttcctaccgctctacccgatctttcttttaaaaaccaaactaaaaaaataaaaaccgaaaaaacgcaaaaaaaaaaaac

SEQ ID NO: 29633 - DNA, 735 bp, Artificial Sequence
  chemically treated genomic DNA (Homo sapiens) CpG-island No: 29633
gtttcgtcgtttttcgggagcggttgtagttttcgttggttgtagacgggtagatattcgaagtgttcgcgtcggtagtcggatcgtaagcgaggaagagcgaatcgcgttttcgggtttggtcgaagcgttttttgtgttaggtttttcggtttcgggtttcgggaggaggatcgcgggttagaggcggagtcgtcgttttgtcgcgatttttagatttcgattatggtttcgcgttggtggcggtggcggcgcggttgtttttgaaagtcggcggcgcggagtttcgggtttcggttttttcggtcgtgcgggatcgttggggtcgagcgtcgttgtcgaagttcgcgcgtaggtaaggttggaaggcgcgcgttcggcggggtttagaggttacggttttaatgatagtagtgggcggaatgaatgggagcggggagtacgtgcgtcgcgacgcgggggcgcgcggggtagtttcggggtagtttcggggtgggatttcggagttgaggggtgttcgcggtgggacggagtcgcgcgttggattgaagtaggggcgttttatacggggttgtagaaagcggtgttttggggatttcgggagcgttttggggggtggagaaagcggtgggattcgtgttttgggggaagcgtaggagcgattagattgatcgttgttatatggataaggttaattaagtttggagagcgattgtagttatttattttggagtt

SEQ ID NO: 29634 - DNA, 735 bp, Artificial Sequence
  chemically treated genomic DNA (Homo sapiens) CpG-island No: 29634
aactccaaaataaataactacaatcgctctccaaacttaattaaccttatccatataacaacgatcaatctaatcgctcctacgcttcccccaaaacacgaatcccaccgctttctccaccccccaaaacgctcccgaaatccccaaaacaccgctttctacaaccccgtataaaacgcccctacttcaatccaacgcgcgactccgtcccaccgcgaacacccctcaactccgaaatcccaccccgaaactaccccgaaactaccccgcgcgcccccgcgtcgcgacgcacgtactccccgctcccattcattccgcccactactatcattaaaaccgtaacctctaaaccccgccgaacgcgcgccttccaaccttacctacgcgcgaacttcgacaacgacgctcgaccccaacgatcccgcacgaccgaaaaaaccgaaacccgaaactccgcgccgccgactttcaaaaacaaccgcgccgccaccgccaccaacgcgaaaccataatcgaaatctaaaaatcgcgacaaaacgacgactccgcctctaacccgcgatcctcctcccgaaacccgaaaccgaaaaacctaacacaaaaaacgcttcgaccaaacccgaaaacgcgattcgctcttcctcgcttacgatccgactaccgacgcgaacacttcgaatatctacccgtctacaaccaacgaaaactacaaccgctcccgaaaaacgacgaaac

SEQ ID NO: 29635 - DNA, 735 bp, Artificial Sequence
  chemically treated genomic DNA (Homo sapiens) CpG-island No: 29635
aattttaaagtaaatagttgtagtcgttttttaggtttaattaattttgtttatatagtagcggttaatttgatcgtttttgcgttttttttaggatacggattttatcgttttttttattttttaaaacgttttcggggtttttaggatatcgttttttgtaatttcgtgtagggcgtttttattttagtttaacgcgcggtttcgttttatcgcgggtattttttagtttcggagttttatttcggagttatttcggagttatttcgcgcgttttcgcgtcgcgacgtacgtgtttttcgtttttatttatttcgtttattgttgttattggagtcgtgatttttgagtttcgtcgggcgcgcgttttttaattttatttgcgcgcggatttcggtagcggcgttcggttttaacggtttcgtacggtcgggggagtcggggttcggggtttcgcgtcgtcggtttttaggagtagtcgcgtcgttatcgttattagcgcgaggttatggtcggagtttgaaagtcgcggtagggcggcggtttcgtttttggttcgcgatttttttttcgggattcggagtcgggaaatttggtataggaagcgtttcggttaggttcgggagcgcggttcgttttttttcgtttgcggttcggttgtcggcgcggatatttcgggtgtttgttcgtttgtagttaacggggattgtagtcgttttcgggaggcgacggggt

SEQ ID NO: 29636 - DNA, 735 bp, Artificial Sequence
  chemically treated genomic DNA (Homo sapiens) CpG-island No: 29636
accccgtcgcctcccgaaaacgactacaatccccgttaactacaaacgaacaaacacccgaaatatccgcgccgacaaccgaaccgcaaacgaaaaaaaacgaaccgcgctcccgaacctaaccgaaacgcttcctataccaaatttcccgactccgaatcccgaaaaaaaaatcgcgaaccaaaaacgaaaccgccgccctaccgcgactttcaaactccgaccataacctcgcgctaataacgataacgacgcgactactcctaaaaaccgacgacgcgaaaccccgaaccccgactcccccgaccgtacgaaaccgttaaaaccgaacgccgctaccgaaatccgcgcgcaaataaaattaaaaaacgcgcgcccgacgaaactcaaaaatcacgactccaataacaacaataaacgaaataaataaaaacgaaaaacacgtacgtcgcgacgcgaaaacgcgcgaaataactccgaaataactccgaaataaaactccgaaactaaaaaatacccgcgataaaacgaaaccgcgcgttaaactaaaataaaaacgccctacacgaaattacaaaaaacgatatcctaaaaaccccgaaaacgttttaaaaaataaaaaaaacgataaaatccgtatcctaaaaaaaacgcaaaaacgatcaaattaaccgctactatataaacaaaattaattaaacctaaaaaacgactacaactatttactttaaaatt

SEQ ID NO: 29637 - DNA, 535 bp, Artificial Sequence
  chemically treated genomic DNA (Homo sapiens) CpG-island No: 29637
tttttttcgttttagacgttgtcgtttcgttttttttcgcgatcgagtttcggttttttttttttgttaaagatttttatgagcgtggggtatttgattttagttttttttttcggttcgcggcgttcgcgtttagtcgtttttcgttcgtcgggggtatttgtttttgtagtcgtttttgttttttttgttcggtttgcgttttttttcgtgttttttgtttttttcgttttcgggttttcgtttttcgtttcgttcgggtttcggtttttcgtgttagttgtttttttcgtattcgtttgggggacggagtaaacggtttaggttcggtttttgttttttttttagcgtttacgagggtttttttagttttcgaggcgtatttatttgtttttttttgtttgtagttttcgtttttgtttttcgcgttttcgttgttttcgggtttggcgtcgttttttagttaagagtcgagtggttttttttcggtttgtggtgtcggttattggtttgttaggggttatcgggggagtag

SEQ ID NO: 29638 - DNA, 535 bp, Artificial Sequence
  chemically treated genomic DNA (Homo sapiens) CpG-island No: 29638
ctactcccccgataacccctaacaaaccaataaccgacaccacaaaccgaaaaaaaaccactcgactcttaactaaaaaacgacgccaaacccgaaaacaacgaaaacgcgaaaaacaaaaacgaaaactacaaacaaaaaaaaacaaataaatacgcctcgaaaactaaaaaaaccctcgtaaacgctaaaaaaaaaacaaaaaccgaacctaaaccgtttactccgtcccccaaacgaatacgaaaaaaacaactaacacgaaaaaccgaaacccgaacgaaacgaaaaacgaaaacccgaaaacgaaaaaaacaaaaaacacgaaaaaaaacgcaaaccgaacaaaaaaaacaaaaacgactacaaaaacaaatacccccgacgaacgaaaaacgactaaacgcgaacgccgcgaaccgaaaaaaaaaactaaaatcaaataccccacgctcataaaaatctttaacaaaaaaaaaaaaccgaaactcgatcgcgaaaaaaaacgaaacgacaacgtctaaaacgaaaaaaa

SEQ ID NO: 29639 - DNA, 535 bp, Artificial Sequence
  chemically treated genomic DNA (Homo sapiens) CpG-island No: 29639
ttgttttttcggtgatttttagtaaattaatggtcggtattatagatcgagaagaagttattcggtttttggttgagaagcggcgttaggttcgggagtagcgggagcgcgaggagtaggagcggaggttgtaggtagaaagggataagtgagtgcgtttcggggattgagggggttttcgtgggcgttggagaagaagtagaggtcgagtttgagtcgtttgtttcgttttttaggcgaatgcgagaggagtagttggtacgggaggtcgaggttcgggcggagcgggaggcggaggttcggaggcgggaggagtaggaggtacgagagaaggcgtaggtcgagtaggaggagtaggagcggttgtagaagtaggtgttttcggcgggcgggaagcggttgggcgcgggcgtcgcgggtcgggagggaaggttggagttaagtgttttacgtttatgggggtttttggtagaaagaggaggtcgaagttcggtcgcgggaagaggcggagcggtagcgtttggagcgggaaaag

SEQ ID NO: 29640 - DNA, 535 bp, Artificial Sequence
  chemically treated genomic DNA (Homo sapiens) CpG-island No: 29640
cttttcccgctccaaacgctaccgctccgcctcttcccgcgaccgaacttcgacctcctctttctaccaaaaacccccataaacgtaaaacacttaactccaaccttccctcccgacccgcgacgcccgcgcccaaccgcttcccgcccgccgaaaacacctacttctacaaccgctcctactcctcctactcgacctacgccttctctcgtacctcctactcctcccgcctccgaacctccgcctcccgctccgcccgaacctcgacctcccgtaccaactactcctctcgcattcgcctaaaaaacgaaacaaacgactcaaactcgacctctacttcttctccaacgcccacgaaaaccccctcaatccccgaaacgcactcacttatccctttctacctacaacctccgctcctactcctcgcgctcccgctactcccgaacctaacgccgcttctcaaccaaaaaccgaataacttcttctcgatctataataccgaccattaatttactaaaaatcaccgaaaaaacaa

SEQ ID NO: 29641 - DNA, 902 bp, Artificial Sequence
  chemically treated genomic DNA (Homo sapiens) CpG-island No: 29641
cgcgcggggtttttgcggttttcgacgttcgatgcgttcggtattcggggtgggggagggggtagttgttagaggatgtatcgcgagtttggagtcgtcgtcgtcgtagtttttatttttaaatttttaagtggttagagggcgcggtagcggaggggttttcgtttagtcggtcggttttattttcggtcgttttgtagtttttttatttatttttatttcgttttcgcgtggttttcggtatatttgggggtgcgttcgtttttagtttcgtacgcgggtcgttttttatggttgcggcgttattgggggtttcggggttttagcggcggcggcggcggcggttagtggttaggataggggtttcgcggcgtattacgttcggttcggttcggttcggtaagtagcgattcggaggcgggggcgtttcggggaaggtcgaggtaggtggttcgcgagtttcggaggtgtcggtcgttcggggtttttcggttgcggtcgcgaattcgtttttcgttcggcgtcggtttagtttcggtttcggtttaattttattgtatcgttcgggttgggtttggtttttcgttggcgcgtattaagttcgaggcgggggggtttattttagtagcgtttcgggatttagtttttcgcgttcgcgtcgttcgcgtcgttcgcgtcgttttcgtttcggagtttcgcgttcgtagtttttcggcgttttttttacggttacggtcgagcgggttttacggttttaggagttcgtcgcgttagttgtttttttttgcgttcgcgttttggtacgcgtcgtagcgtttgaggattaagtagggagcgttcgggtgatttattcgtcgcggggattgggggagagggggagtagggttgggattttttttttt

SEQ ID NO: 29642 - DNA, 902 bp, Artificial Sequence
  chemically treated genomic DNA (Homo sapiens) CpG-island No: 29642
aaaaaaaaaaatcccaaccctactccccctctcccccaatccccgcgacgaataaatcacccgaacgctccctacttaatcctcaaacgctacgacgcgtaccaaaacgcgaacgcaaaaaaaaacaactaacgcgacgaactcctaaaaccgtaaaacccgctcgaccgtaaccgtaaaaaaaacgccgaaaaactacgaacgcgaaactccgaaacgaaaacgacgcgaacgacgcgaacgacgcgaacgcgaaaaactaaatcccgaaacgctactaaaataaacccccccgcctcgaacttaatacgcgccaacgaaaaaccaaacccaacccgaacgatacaataaaattaaaccgaaaccgaaactaaaccgacgccgaacgaaaaacgaattcgcgaccgcaaccgaaaaaccccgaacgaccgacacctccgaaactcgcgaaccacctacctcgaccttccccgaaacgcccccgcctccgaatcgctacttaccgaaccgaaccgaaccgaacgtaatacgccgcgaaacccctatcctaaccactaaccgccgccgccgccgccgctaaaaccccgaaacccccaataacgccgcaaccataaaaaacgacccgcgtacgaaactaaaaacgaacgcacccccaaatataccgaaaaccacgcgaaaacgaaataaaaataaataaaaaaactacaaaacgaccgaaaataaaaccgaccgactaaacgaaaacccctccgctaccgcgccctctaaccacttaaaaatttaaaaataaaaactacgacgacgacgactccaaactcgcgatacatcctctaacaactaccccctcccccaccccgaataccgaacgcatcgaacgtcgaaaaccgcaaaaaccccgcgcg

SEQ ID NO: 29643 - DNA, 902 bp, Artificial Sequence
  chemically treated genomic DNA (Homo sapiens) CpG-island No: 29643
ggaaaggggagttttagttttgtttttttttttttttagttttcgcggcgggtgagttattcgagcgttttttatttagtttttaggcgttgcggcgcgtattaagacgcggacgtagggggaggtagttagcgcggcgaatttttggagtcgtggagttcgttcggtcgtggtcgtgggagaggcgtcgggaggttgcgggcgcggggtttcggggcgggggcggcgcgaacggcgcggacggcgcgggcgcggggggttgggtttcggggcgttgttggggtggattttttcgtttcgaatttggtacgcgttagcgagaggttaggtttagttcgggcggtataatagggttgggtcgaggtcgggattgggtcggcgtcgggcggggaacgggttcgcgatcgtagtcgagagatttcgggcgatcggtattttcgagattcgcgggttatttgtttcgatttttttcggagcgttttcgttttcgagtcgttatttgtcgggtcgggtcgggtcgggcgtgatgcgtcgcgggatttttgttttggttattggtcgtcgtcgtcgtcgtcgttgagatttcgagatttttagtgacgtcgtagttatggagagcggttcgcgtgcggagttgggggcgggcgtatttttaggtatgtcgggagttacgcggaggcgagatgggggtagatggaggggttgtagggcggtcgaggatgaggtcggtcggttgggcggggattttttcgttgtcgcgttttttgattatttggaagtttaaaaataaaggttgcggcggcggcggttttaggttcgcgatgtattttttgatagttgtttttttttttatttcgggtgtcggacgtatcgggcgtcgggagtcgtagggatttcgcgcg

SEQ ID NO: 29644 - DNA, 902 bp, Artificial Sequence
  chemically treated genomic DNA (Homo sapiens) CpG-island No: 29644
cgcgcgaaatccctacgactcccgacgcccgatacgtccgacacccgaaataaaaaaaaaaacaactatcaaaaaatacatcgcgaacctaaaaccgccgccgccgcaacctttatttttaaacttccaaataatcaaaaaacgcgacaacgaaaaaatccccgcccaaccgaccgacctcatcctcgaccgccctacaacccctccatctacccccatctcgcctccgcgtaactcccgacatacctaaaaatacgcccgcccccaactccgcacgcgaaccgctctccataactacgacgtcactaaaaatctcgaaatctcaacgacgacgacgacgacgaccaataaccaaaacaaaaatcccgcgacgcatcacgcccgacccgacccgacccgacaaataacgactcgaaaacgaaaacgctccgaaaaaaatcgaaacaaataacccgcgaatctcgaaaataccgatcgcccgaaatctctcgactacgatcgcgaacccgttccccgcccgacgccgacccaatcccgacctcgacccaaccctattataccgcccgaactaaacctaacctctcgctaacgcgtaccaaattcgaaacgaaaaaatccaccccaacaacgccccgaaacccaaccccccgcgcccgcgccgtccgcgccgttcgcgccgcccccgccccgaaaccccgcgcccgcaacctcccgacgcctctcccacgaccacgaccgaacgaactccacgactccaaaaattcgccgcgctaactacctccccctacgtccgcgtcttaatacgcgccgcaacgcctaaaaactaaataaaaaacgctcgaataactcacccgccgcgaaaactaaaaaaaaaaaaaaacaaaactaaaactcccctttcc

SEQ ID NO: 29645 - DNA, 573 bp, Artificial Sequence
  chemically treated genomic DNA (Homo sapiens) CpG-island No: 29645
atcgcgcggttcggtttgaagcgcggtcgtttttatttttttttcggggttggggtgggttatcggtcgataaatataggaggggtcgcgttttcgttttcgacgcgtttataaacgtcgtggtcgttcgaattttcggtttcgtagtattcggttataggatcgcgatattgtagggtttcggttttgcgcgttgcgtttcggtcgttcggcgcgggaggacgtgcggtcgcgtttgtttcggtggtcgcgcggggtaggtggttgcggggatcggaaggatggcgaggaagtcggaaagggttttttgagatgagagattattttcgttcgggttgcggtttttttttggagtcggttagtcggggttcggggagcggggtgcgtagggttcggggttacgttttgttatttgtagcgttcgggtgggtcgcgggggtttcggcgggacgcgttcggttttgtcgtaggagttaacgtagggggaatttttgtaggtgggagtattttagagcgtataagttatggtggttaaatagcggattcggatggttaacgagaagtatagtaaaa

SEQ ID NO: 29646 - DNA, 573 bp, Artificial Sequence
  chemically treated genomic DNA (Homo sapiens) CpG-island No: 29646
ttttactatacttctcgttaaccatccgaatccgctatttaaccaccataacttatacgctctaaaatactcccacctacaaaaattccccctacgttaactcctacgacaaaaccgaacgcgtcccgccgaaacccccgcgacccacccgaacgctacaaataacaaaacgtaaccccgaaccctacgcaccccgctccccgaaccccgactaaccgactccaaaaaaaaaccgcaacccgaacgaaaataatctctcatctcaaaaaaccctttccgacttcctcgccatccttccgatccccgcaaccacctaccccgcgcgaccaccgaaacaaacgcgaccgcacgtcctcccgcgccgaacgaccgaaacgcaacgcgcaaaaccgaaaccctacaatatcgcgatcctataaccgaatactacgaaaccgaaaattcgaacgaccacgacgtttataaacgcgtcgaaaacgaaaacgcgacccctcctatatttatcgaccgataacccaccccaaccccgaaaaaaaaataaaaacgaccgcgcttcaaaccgaaccgcgcgat

SEQ ID NO: 29647 - DNA, 573 bp, Artificial Sequence
  chemically treated genomic DNA (Homo sapiens) CpG-island No: 29647
ttttgttgtgtttttcgttagttattcggattcgttgtttggttattatggtttgtgcgttttgaaatgtttttatttgtaaggattttttttgcgttagtttttgcgatagggtcgagcgcgtttcgtcgaggttttcgcggtttattcgggcgttgtaggtggtaaggcgtggtttcgagttttgcgtatttcgtttttcgagtttcggttagtcgattttagagagaggtcgtagttcggacggaagtaattttttattttaggaaatttttttcgattttttcgttattttttcggttttcgtagttatttatttcgcgcggttatcgaggtaggcgcgatcgtacgttttttcgcgtcgagcggtcggagcgtagcgcgtagagtcggggttttgtagtgtcgcggttttgtagtcgaatgttgcggggtcgaaggttcgggcgattacggcgtttgtgagcgcgtcggggacggggacgcggttttttttgtgtttgtcggtcggtgatttattttagtttcggggaagggatgagggcggtcgcgttttaggtcgggtcgcgcggt

SEQ ID NO: 29648 - DNA, 573 bp, Artificial Sequence
  chemically treated genomic DNA (Homo sapiens) CpG-island No: 29648
accgcgcgacccgacctaaaacgcgaccgccctcatcccttccccgaaactaaaataaatcaccgaccgacaaacacaaaaaaaaccgcgtccccgtccccgacgcgctcacaaacgccgtaatcgcccgaaccttcgaccccgcaacattcgactacaaaaccgcgacactacaaaaccccgactctacgcgctacgctccgaccgctcgacgcgaaaaaacgtacgatcgcgcctacctcgataaccgcgcgaaataaataactacgaaaaccgaaaaaataacgaaaaaatcgaaaaaaatttcctaaaataaaaaattacttccgtccgaactacgacctctctctaaaatcgactaaccgaaactcgaaaaacgaaatacgcaaaactcgaaaccacgccttaccacctacaacgcccgaataaaccgcgaaaacctcgacgaaacgcgctcgaccctatcgcaaaaactaacgcaaaaaaaatccttacaaataaaaacatttcaaaacgcacaaaccataataaccaaacaacgaatccgaataactaacgaaaaacacaacaaaa

SEQ ID NO: 29649 - DNA, 1081 bp, Artificial Sequence
  chemically treated genomic DNA (Homo sapiens) CpG-island No: 29649
gcgtttcgagagttggtttttttttacgttgcgcgcgtattttttcgtttttatttttattcgttggcgtgtttagtggaacggagttttgtgttttcgttttaagttttcggatgtttattttttcgattcgttttcgttgtggtttcgttttcgcgcggtttttcgtgttacgttatcgtttgcgtcgttttcggaggcgtagcgggcgatgacgtagagggacgtgttttttatatgaggttggggagcggttgagtcggtttttttcgttcgttttttttttttttcgagcgtcgtttcggttgtatcgcgttcgtttcgagttttaggttcgtgttaagttagcgtcgtcgtcgtttttttttagtcgttattatgattatttatcgggattttattagtcgtgagtttttattgtattatttttattgtcgtatacgggggtttggggtgcgggtgggggcggggaaggcgtagtcgtcgcgggtttaggggacgtcggcggttttagtcgagcgcggaggggtcggtgttcggggttcgcgtttagttttggtgtgttacggaggggtagatttcgcgtgcggtcgtcggcgcgggaaatgcgggaaatggcggcgttaggcgtacggtgatgggcggttttgtgtattcggtagacgatgagatgtttttcgatatttataagattcgggagatcgcggacgggttgtgtttggaggtggaggggaaggtgagtcggtcgggtttgcgcgtgggggagttcgggtcgagcgggttcgggtttttttcgttttttcgtttgaggttgtgtaatttttttcgtcgttttttggcggaggagacgtttttttcgggtttgggtttttttagaaaattggaggcggagttgattttggaaataggttcgtcgattaggcgtttatttttttttcggagttgttcggatatgatgttttcgttttagagtttggagttttttcgtgttgttttgtttttatttattaatcggagtattatatgttcgtattggaatattttttatgattttatttttgtttcggttatagatattttt

SEQ ID NO: 29650 - DNA, 1081 bp, Artificial Sequence
  chemically treated genomic DNA (Homo sapiens) CpG-island No: 29650
aaaaatatctataaccgaaacaaaaataaaatcataaaaaatattccaatacgaacatataatactccgattaataaataaaaacaaaacaacacgaaaaaactccaaactctaaaacgaaaacatcatatccgaacaactccgaaaaaaaaataaacgcctaatcgacgaacctatttccaaaatcaactccgcctccaattttctaaaaaaacccaaacccgaaaaaaacgtctcctccgccaaaaaacgacgaaaaaaattacacaacctcaaacgaaaaaacgaaaaaaacccgaacccgctcgacccgaactcccccacgcgcaaacccgaccgactcaccttcccctccacctccaaacacaacccgtccgcgatctcccgaatcttataaatatcgaaaaacatctcatcgtctaccgaatacacaaaaccgcccatcaccgtacgcctaacgccgccatttcccgcatttcccgcgccgacgaccgcacgcgaaatctacccctccgtaacacaccaaaactaaacgcgaaccccgaacaccgacccctccgcgctcgactaaaaccgccgacgtcccctaaacccgcgacgactacgccttccccgcccccacccgcaccccaaacccccgtatacgacaataaaaataatacaataaaaactcacgactaataaaatcccgataaataatcataataacgactaaaaaaaaacgacgacgacgctaacttaacacgaacctaaaactcgaaacgaacgcgatacaaccgaaacgacgctcgaaaaaaaaaaaaaacgaacgaaaaaaaccgactcaaccgctccccaacctcatataaaaaacacgtccctctacgtcatcgcccgctacgcctccgaaaacgacgcaaacgataacgtaacacgaaaaaccgcgcgaaaacgaaaccacaacgaaaacgaatcgaaaaaataaacatccgaaaacttaaaacgaaaacacaaaactccgttccactaaacacgccaacgaataaaaataaaaacgaaaaaatacgcgcgcaacgtaaaaaaaaaccaactctcgaaacgc

SEQ ID NO: 29651 - DNA, 1081 bp, Artificial Sequence
  chemically treated genomic DNA (Homo sapiens) CpG-island No: 29651
aagagtgtttgtggtcggaataaaaatggggttataaaaagtgttttagtgcgggtatgtgatgtttcggttggtaagtggggataggataatacgaaaggattttaggttttaaagcgaaagtattatgttcggataatttcgggagaaggatgggcgtttagtcggcgggtttatttttaggattagtttcgtttttagttttttagaaaaatttaagttcggaaagagcgtttttttcgttaggaggcggcggggaggattgtataattttaggcgggggagcggaggaaattcgagttcgttcggttcggatttttttacgcgtaggttcgatcgatttatttttttttttatttttaggtataattcgttcgcgatttttcggattttgtagatgtcggagaatattttatcgtttgtcggatatatagagtcgtttattatcgtgcgtttggcgtcgttatttttcgtatttttcgcgtcggcggtcgtacgcgggatttgttttttcgtagtatattagagttgggcgcgagtttcgggtatcgattttttcgcgttcggttaagatcgtcggcgttttttaggttcgcgacggttgcgtttttttcgtttttattcgtattttagattttcgtgtgcggtagtaaggatagtgtagtgaggatttacggttgatgaggtttcggtagataattatgatggcgattgaagggagacgacgacggcgttagtttagtacgagtttgaaattcggagcgagcgcggtgtagtcggagcggcgttcggggggaggggggagcgggcggaaaaggtcgatttagtcgttttttaattttatatagagggtacgtttttttacgttatcgttcgttgcgttttcggaagcgacgtaggcggtgacgtggtacgaagagtcgcgcgggggcggggttatagcgggggcgagtcggggaggtgagtattcggggatttgaggcggagatataaggtttcgttttattgggtacgttagcgggtaggggtgggggcggggaggtgcgcgcgtagcgtgggaggaggttaattttcggggcgt

SEQ ID NO: 29652 - DNA, 1081 bp, Artificial Sequence
  chemically treated genomic DNA (Homo sapiens) CpG-island No: 29652
acgccccgaaaattaacctcctcccacgctacgcgcgcacctccccgcccccacccctacccgctaacgtacccaataaaacgaaaccttatatctccgcctcaaatccccgaatactcacctccccgactcgcccccgctataaccccgcccccgcgcgactcttcgtaccacgtcaccgcctacgtcgcttccgaaaacgcaacgaacgataacgtaaaaaaacgtaccctctatataaaattaaaaaacgactaaatcgaccttttccgcccgctcccccctccccccgaacgccgctccgactacaccgcgctcgctccgaatttcaaactcgtactaaactaacgccgtcgtcgtctcccttcaatcgccatcataattatctaccgaaacctcatcaaccgtaaatcctcactacactatccttactaccgcacacgaaaatctaaaatacgaataaaaacgaaaaaaacgcaaccgtcgcgaacctaaaaaacgccgacgatcttaaccgaacgcgaaaaaatcgatacccgaaactcgcgcccaactctaatatactacgaaaaaacaaatcccgcgtacgaccgccgacgcgaaaaatacgaaaaataacgacgccaaacgcacgataataaacgactctatatatccgacaaacgataaaatattctccgacatctacaaaatccgaaaaatcgcgaacgaattatacctaaaaataaaaaaaaaaataaatcgatcgaacctacgcgtaaaaaaatccgaaccgaacgaactcgaatttcctccgctcccccgcctaaaattatacaatcctccccgccgcctcctaacgaaaaaaacgctctttccgaacttaaatttttctaaaaaactaaaaacgaaactaatcctaaaaataaacccgccgactaaacgcccatccttctcccgaaattatccgaacataatactttcgctttaaaacctaaaatcctttcgtattatcctatccccacttaccaaccgaaacatcacatacccgcactaaaacactttttataaccccatttttattccgaccacaaacactctt

SEQ ID NO: 29653 - DNA, 613 bp, Artificial Sequence
  chemically treated genomic DNA (Homo sapiens) CpG-island No: 29653
ttttcgcgttgggcgtaggtcgttttatttgtcgagttcgtcggggtcgtttttgttcgttcggttaggttcgttagcgttttgttggcggttattgtcgtagtcgttttggtttaggcgcgtttcggcgttggagtagtagtagcgtaacgcgtagttgtcgtagtagatggtggcgtcgtcgtcgtcgaagcgttcgggatattggaagtcgatgcgttagacgttttgcgcgtttagttagtcgtggtagtattcgtcgttggttttcgttttcgtcgttagtagcgtagttagtagtagttgtaggagcgaagcggcgttttaggatgaggagacggacgagcggcgagcgttttatatggtattattttgggcgcggatagcgcgtttttagagagcgtaggacggttttcgagaagtcgtggtttcggcgattttcgggtttcgttattgattgtttcgcggcgtttttcgcgcgggttatttttttttgtcgcgataaataggaggcgacgacgtcgggttttaggtttaggagtttttaagttattttcgtttttagtcggtggttcggtttttttagggattgttttatgagttgtattcgttg

SEQ ID NO: 29654 - DNA, 613 bp, Artificial Sequence
  chemically treated genomic DNA (Homo sapiens) CpG-island No: 29654
caacgaatacaactcataaaacaatccctaaaaaaaccgaaccaccgactaaaaacgaaaataacttaaaaactcctaaacctaaaacccgacgtcgtcgcctcctatttatcgcgacaaaaaaaaataacccgcgcgaaaaacgccgcgaaacaatcaataacgaaacccgaaaatcgccgaaaccacgacttctcgaaaaccgtcctacgctctctaaaaacgcgctatccgcgcccaaaataataccatataaaacgctcgccgctcgtccgtctcctcatcctaaaacgccgcttcgctcctacaactactactaactacgctactaacgacgaaaacgaaaaccaacgacgaatactaccacgactaactaaacgcgcaaaacgtctaacgcatcgacttccaatatcccgaacgcttcgacgacgacgacgccaccatctactacgacaactacgcgttacgctactactactccaacgccgaaacgcgcctaaaccaaaacgactacgacaataaccgccaacaaaacgctaacgaacctaaccgaacgaacaaaaacgaccccgacgaactcgacaaataaaacgacctacgcccaacgcgaaaa

SEQ ID NO: 29655 - DNA, 613 bp, Artificial Sequence
  chemically treated genomic DNA (Homo sapiens) CpG-island No: 29655
tagcgagtgtaatttataaggtagtttttaaggggatcgggttatcggttgaggacggggatggtttaggagtttttggatttagggttcggcgtcgtcgttttttgtttgtcgcggtagaggggagtggttcgcgcggaaagcgtcgcgggatagttagtgacgaggttcgggggtcgtcggggttacgatttttcggagatcgttttgcgttttttggagacgcgttgttcgcgtttagggtggtgttatgtggggcgttcgtcgttcgttcgtttttttattttggaacgtcgtttcgtttttgtagttgttgttggttgcgttgttggcggcgggggcgagggttagcggcgagtattgttacggttggttggacgcgtagggcgtttggcgtatcggtttttagtgtttcgagcgtttcgacggcggcgacgttattatttgttgcggtagttgcgcgttgcgttattgttgttttagcgtcgaggcgcgtttggattagggcggttgcgataatgatcgttagtagggcgttggcgagtttggtcgggcggataaagacggtttcgacgggttcggtaggtagggcggtttgcgtttagcgcgaaag

SEQ ID NO: 29656 - DNA, 613 bp, Artificial Sequence
  chemically treated genomic DNA (Homo sapiens) CpG-island No: 29656
ctttcgcgctaaacgcaaaccgccctacctaccgaacccgtcgaaaccgtctttatccgcccgaccaaactcgccaacgccctactaacgatcattatcgcaaccgccctaatccaaacgcgcctcgacgctaaaacaacaataacgcaacgcgcaactaccgcaacaaataataacgtcgccgccgtcgaaacgctcgaaacactaaaaaccgatacgccaaacgccctacgcgtccaaccaaccgtaacaatactcgccgctaaccctcgcccccgccgccaacaacgcaaccaacaacaactacaaaaacgaaacgacgttccaaaataaaaaaacgaacgaacgacgaacgccccacataacaccaccctaaacgcgaacaacgcgtctccaaaaaacgcaaaacgatctccgaaaaatcgtaaccccgacgacccccgaacctcgtcactaactatcccgcgacgctttccgcgcgaaccactcccctctaccgcgacaaacaaaaaacgacgacgccgaaccctaaatccaaaaactcctaaaccatccccgtcctcaaccgataacccgatccccttaaaaactaccttataaattacactcgcta

SEQ ID NO: 29657 - DNA, 663 bp, Artificial Sequence
  chemically treated genomic DNA (Homo sapiens) CpG-island No: 29657
agtcgatcgggtcggttcgcgggcgtggttggttttggttttggcggcggtcgggttttttagattttcggtttttttcgtcggttaggttttcgggtcgtcgtttcgatatcgatggaacgcggaggaggaagggggagttaggcgattgatcggcgatatgagtcgttttattttcggttcggtcgattcgcgtttttcgttttttttggggtcgtttggagtttttcgttttttatttattttttcggttcggcgttttttttattttttttattttttttatttttttttttttttttttttttttttcggtcgtggtttttgtttcggttttgcgcggcgatagtagcgggagcggcggcggtaggggtttcgggagcggcggcggcgttttttttagaacgcgtacgtacgtattacgtaggtttcgttttttggttttgtttcgtttttttaagttggcgatggttgggtttcggtttcgttttttttacggcgtttcggagttcgtttaaaggagtcgcgtatattggagtcgggaaagtttggagttatcgggaaggggcggggagttttagttttgcgtagggcgggatgggaggtgggtaagatcggaaaaaagatgaggaagggtttaaagatttaagaagagaatttgga

SEQ ID NO: 29658 - DNA, 663 bp, Artificial Sequence
  chemically treated genomic DNA (Homo sapiens) CpG-island No: 29658
tccaaattctcttcttaaatctttaaacccttcctcatcttttttccgatcttacccacctcccatcccgccctacgcaaaactaaaactccccgccccttcccgataactccaaactttcccgactccaatatacgcgactcctttaaacgaactccgaaacgccgtaaaaaaaacgaaaccgaaacccaaccatcgccaacttaaaaaaacgaaacaaaaccaaaaaacgaaacctacgtaatacgtacgtacgcgttctaaaaaaaacgccgccgccgctcccgaaacccctaccgccgccgctcccgctactatcgccgcgcaaaaccgaaacaaaaaccacgaccgaaaaaaaaaaaaaaaaaaaaaaaaaaataaaaaaaataaaaaaaataaaaaaaacgccgaaccgaaaaaataaataaaaaacgaaaaactccaaacgaccccaaaaaaaacgaaaaacgcgaatcgaccgaaccgaaaataaaacgactcatatcgccgatcaatcgcctaactcccccttcctcctccgcgttccatcgatatcgaaacgacgacccgaaaacctaaccgacgaaaaaaaccgaaaatctaaaaaacccgaccgccgccaaaaccaaaaccaaccacgcccgcgaaccgacccgatcgact

SEQ ID NO: 29659 - DNA, 663 bp, Artificial Sequence
  chemically treated genomic DNA (Homo sapiens) CpG-island No: 29659
tttaaattttttttttgaatttttggatttttttttatttttttttcggttttatttattttttatttcgttttacgtaaagttaaaatttttcgttttttttcggtagttttaggttttttcggttttagtgtgcgcggtttttttaagcggatttcggaacgtcgtggggaaggcggggtcgaagtttagttatcgttaatttggaggggcggggtagaattagggggcggggtttgcgtggtgcgtgcgtgcgcgttttggaggaggcgtcgtcgtcgttttcgaggtttttgtcgtcgtcgttttcgttgttgtcgtcgcgtagagtcggagtaggagttacggtcgagaggagggaggaggaggaggaggaggtggagaaggtggaggaggtggaggaggcgtcggatcgggggggtgagtaaggggcggggagttttagacggttttagagggagcggggggcgcgggtcggtcgagtcgagggtgaggcggtttatgtcgtcggttagtcgtttggttttttttttttttttcgcgttttatcggtgtcggggcggcggttcgggggtttggtcggcgggaggggtcggagatttgggaggttcggtcgtcgttagggttagagttaattacgttcgcggatcgattcggtcgatt

SEQ ID NO: 29660 - DNA, 663 bp, Artificial Sequence
  chemically treated genomic DNA (Homo sapiens) CpG-island No: 29660
aatcgaccgaatcgatccgcgaacgtaattaactctaaccctaacgacgaccgaacctcccaaatctccgacccctcccgccgaccaaacccccgaaccgccgccccgacaccgataaaacgcgaaaaaaaaaaaaaaaaccaaacgactaaccgacgacataaaccgcctcaccctcgactcgaccgacccgcgccccccgctccctctaaaaccgtctaaaactccccgccccttactcacccccccgatccgacgcctcctccacctcctccaccttctccacctcctcctcctcctcctccctcctctcgaccgtaactcctactccgactctacgcgacgacaacaacgaaaacgacgacgacaaaaacctcgaaaacgacgacgacgcctcctccaaaacgcgcacgcacgcaccacgcaaaccccgccccctaattctaccccgcccctccaaattaacgataactaaacttcgaccccgccttccccacgacgttccgaaatccgcttaaaaaaaccgcgcacactaaaaccgaaaaaacctaaaactaccgaaaaaaaacgaaaaattttaactttacgtaaaacgaaataaaaaataaataaaaccgaaaaaaaaataaaaaaaaatccaaaaattcaaaaaaaaaatttaaa

SEQ ID NO: 29661 - DNA, 514 bp, Artificial Sequence
  chemically treated genomic DNA (Homo sapiens) CpG-island No: 29661
taggggaaaaaggcgagggcgggggagtgagaggtgggggaaaagaaagaagtttaggagcgagaagaaacgaggggagaggcgagtcggaaagaatttttagtcgagaaacgaaaaaaacgacgtttacgggagaggtacgggagaggaggagagcggacggagggggtaacgtcgtaaaatttcgaatagtatttaaggtataggatgcgacgagcgagatcgagagggggagcgaaacgggaaagggaaggaacgaagtcgatacggttcggaggattacgaaataacgggtcgggaataagggaggttagtataataagacgggggagtgagcgagggagtaggtcggttcggggcgtagcgcggcggggaggcgggagacggggcggtcgaggggacgaggggggcgggagaggacgatagcgcggagaacgagacgggggcggatcgtacggataaagaaaatcgttaaatagaaaaaaagagattagtaattcgagtattaatatcg

SEQ ID NO: 29662 - DNA, 514 bp, Artificial Sequence
  chemically treated genomic DNA (Homo sapiens) CpG-island No: 29662
cgatattaatactcgaattactaatctctttttttctatttaacgattttctttatccgtacgatccgcccccgtctcgttctccgcgctatcgtcctctcccgcccccctcgtcccctcgaccgccccgtctcccgcctccccgccgcgctacgccccgaaccgacctactccctcgctcactcccccgtcttattatactaacctcccttattcccgacccgttatttcgtaatcctccgaaccgtatcgacttcgttccttccctttcccgtttcgctccccctctcgatctcgctcgtcgcatcctataccttaaatactattcgaaattttacgacgttaccccctccgtccgctctcctcctctcccgtacctctcccgtaaacgtcgtttttttcgtttctcgactaaaaattctttccgactcgcctctcccctcgtttcttctcgctcctaaacttctttcttttcccccacctctcactcccccgccctcgcctttttccccta

SEQ ID NO: 29663 - DNA, 514 bp, Artificial Sequence
  chemically treated genomic DNA (Homo sapiens) CpG-island No: 29663
cggtgttggtgttcgggttattggtttttttttttttatttagcggttttttttgttcgtgcggttcgttttcgtttcgtttttcgcgttgtcgttttttttcgtttttttcgttttttcggtcgtttcgtttttcgttttttcgtcgcgttgcgtttcgggtcggtttgttttttcgtttattttttcgttttgttgtgttggttttttttgttttcggttcgttgtttcgtggtttttcgggtcgtgtcggtttcgttttttttttttttcgtttcgttttttttttcggtttcgttcgtcgtattttgtgttttgggtgttgttcggggttttgcggcgttatttttttcgttcgttttttttttttttcgtgtttttttcgtaggcgtcgtttttttcgtttttcggttgggggtttttttcggttcgttttttttttcgttttttttcgtttttgggtttttttttttttttttattttttattttttcgttttcgtttttttttttta

SEQ ID NO: 29664 - DNA, 514 bp, Artificial Sequence
  chemically treated genomic DNA (Homo sapiens) CpG-island No: 29664
taaaaaaaaaaaacgaaaacgaaaaaataaaaaataaaaaaaaaaaaaaaaacccaaaaacgaaaaaaaacgaaaaaaaaaacgaaccgaaaaaaacccccaaccgaaaaacgaaaaaaacgacgcctacgaaaaaaacacgaaaaaaaaaaaaaacgaacgaaaaaaataacgccgcaaaaccccgaacaacacccaaaacacaaaatacgacgaacgaaaccgaaaaaaaaaacgaaacgaaaaaaaaaaaaaacgaaaccgacacgacccgaaaaaccacgaaacaacgaaccgaaaacaaaaaaaaccaacacaacaaaacgaaaaaataaacgaaaaaacaaaccgacccgaaacgcaacgcgacgaaaaaacgaaaaacgaaacgaccgaaaaaacgaaaaaaacgaaaaaaaacgacaacgcgaaaaacgaaacgaaaacgaaccgcacgaacaaaaaaaaccgctaaataaaaaaaaaaaaaccaataacccgaacaccaacaccg
